United States Patent
Huo

(10) Patent No.: US 11,639,524 B2
(45) Date of Patent: May 2, 2023

(54) NORMALIZATION AND BASELINE SHIFT REMOVAL BY ROTATION IN ADDED DATA DIMENSIONS

(71) Applicant: Roche Sequencing Solutions, Inc., Pleasanton, CA (US)

(72) Inventor: Shouqin Huo, San Diego, CA (US)

(73) Assignee: Roche Sequencing Solutions, Inc., Pleasanton, CA (US)

( * ) Notice: Subject to any disclaimer, the term of this patent is extended or adjusted under 35 U.S.C. 154(b) by 399 days.

(21) Appl. No.: 16/883,843

(22) Filed: May 26, 2020

(65) Prior Publication Data

US 2020/0283844 A1 Sep. 10, 2020

Related U.S. Application Data

(63) Continuation of application No. PCT/US2018/062081, filed on Nov. 20, 2018.
(Continued)

(51) Int. Cl.
*G01N 33/487* (2006.01)
*G16B 40/10* (2019.01)
(Continued)

(52) U.S. Cl.
CPC ..... *C12Q 1/6869* (2013.01); *G01N 33/48721* (2013.01); *G16B 30/00* (2019.02);
(Continued)

(58) Field of Classification Search
None
See application file for complete search history.

(56) References Cited

U.S. PATENT DOCUMENTS

2014/0154790 A1 6/2014 Ono et al.
2014/0248608 A1 9/2014 Barrall et al.
(Continued)

FOREIGN PATENT DOCUMENTS

JP 2009-519705 A 5/2009
WO 2007057668 A1 5/2007
WO 2012/164679 A1 12/2012

OTHER PUBLICATIONS

Baumgartner, et al. ("A new approach to image segmentation with two-dimensional hidden Markov models." (Sep. 2013) BRICS Congress on Computational Intelligence and 11th Brazilian Congress on Computational Intelligence (pp. 213-222) (Year: 2013).*
(Continued)

*Primary Examiner* — Roy Y Yi
(74) *Attorney, Agent, or Firm* — Winston Chu

(57) ABSTRACT

A method of using a sequencing cell includes applying voltage across the sequencing cell, acquiring one or more signal values from the sequencing cell, and acquiring one or more correlated signal values that are correlated with respective values of the plurality of acquired signal values thereby forming a plurality of two-dimensional data points. The plurality of two-dimensional data points comprise values in a first dimension that equal the plurality of acquired signal value and values in a second dimension that equal the plurality of correlated signal values. The method can further include computing a plurality of transformed signal values by applying a two-dimensional transformation to the plurality of two-dimensional data points.

15 Claims, 21 Drawing Sheets

Related U.S. Application Data

(60) Provisional application No. 62/591,099, filed on Nov. 27, 2017.

(51) Int. Cl.
  *G16B 50/00*   (2019.01)
  *G01N 33/00*   (2006.01)
  *C12Q 1/6869*  (2018.01)
  *G16B 30/00*   (2019.01)

(52) U.S. Cl.
  CPC ............. *G16B 40/10* (2019.02); *G16B 50/00* (2019.02); *G01N 33/00* (2013.01)

(56) References Cited

U.S. PATENT DOCUMENTS

| | | |
|---|---|---|
| 2016/0178554 A1 | 6/2016 | Chen et al. |
| 2017/0089858 A1 | 3/2017 | Fernandez-Gomez et al. |
| 2017/0096703 A1* | 4/2017 | Dolan .................... G16B 40/00 |

OTHER PUBLICATIONS

International Search Report and Written Opinion dated Mar. 21, 2019 in corresponding PCT/US2018/062081 filed Nov. 20, 2018, pp. 1-12.

Kumar et al, PEG-Labeled Nucleotides and Nanopore Detection for Single Molecule DNA Sequencing by Synthesis, Scientific Reports, 2012, pp. 1-8, vol. 2.

Fuller, C. et al., Real-time single-molecule electronic DNA sequencing by synthesis using polymer-tagged nucleotides on a nanopore array, PNAS, (2016), pp. 5233-5238, vol. 113, No. 19.

* cited by examiner

NORMALIZATION AND BASELINE SHIFT REMOVAL BY ROTATION IN ADDED DATA DIMENSIONS

CROSS-REFERENCE TO RELATED APPLICATION

This application is a continuation of International Patent Application No. PCT/US2018/062081, filed Nov. 20, 2018, which claims the benefit of U.S. Provisional Patent Application No. 62/591,099, filed Nov. 27, 2017, the contents of which are incorporated by reference herein in their entirety.

BACKGROUND

Nanopore membrane devices having pore sizes on the order of one nanometer in internal diameter have shown promise in rapid nucleotide sequencing. When a voltage potential is applied across a nanopore immersed in a conducting fluid, a small ion current attributed to the conduction of ions across the nanopore can exist. The size of the current is sensitive to the pore size and which molecule is in the nanopore. The molecule can be a particular tag attached to a particular nucleotide, thereby allowing detection of a nucleotide at a particular position of a nucleic acid. A voltage in a circuit including the nanopore can be measured (e.g., at an integrating capacitor) as a way of measuring the resistance of the molecule, thereby allowing detection of which molecule is in the nanopore.

A nanopore based sequencing chip may be used for DNA sequencing. A nanopore based sequencing chip can incorporate a large number of sensor cells configured as an array. For example, an array of one million cells may include 1000 rows by 1000 columns of cells.

The voltages that are measured can vary from chip to chip and from cell to cell of a same chip due to manufacturing variability. Therefore, it can be difficult to determine the correct molecule, which may be or correspond to the correct nucleotide in a particular nucleic acid or other polymer in a cell. In addition, other time dependent non-idealities in the measured voltages can lead to inaccuracies. And, because these circuits employ biochemical circuit elements, e.g., lipid bilayers, nanopores, etc., the variability in the electrical characteristics can be much higher than for traditional semiconductor circuits.

Accordingly, signal normalization techniques are desired to improve the accuracy and stability of sequencing processes.

BRIEF SUMMARY

Various embodiments provide techniques and systems related to the processing of output signals from cells of a multi-cell nanopore-based sequencing chip. An improved multi-cell nanopore-based sequencing chip may be built by employing various embodiments disclosed herein. For example, embodiments can include systems and methods for performing sequencing signal processing that can compensate for non-idealities in the sequencing signal that can be caused by, e.g., zero point voltage fluctuations/drift, gain drift, and baseline shift.

According to one embodiment, non-idealities in the sequencing signal can be compensated for by using an improved signal processing technique that can more effectively compensate for effects such as baseline-shift induced errors in the sequencing signal. The technique can include generating two-dimensional signal values, i.e., two-dimensional data points, from one dimensional bright mode signal values by associating each bright mode signal value with a corresponding correlated signal value. The two-dimensional data points can then be used to determine one or more two-dimensional transformations that can reduce a variance in the bright mode data. The technique can also include applying the two-dimensional transformation to newly acquired bright mode signal values to reduce a variance in the newly acquired bright mode signal values.

According to another embodiment, non-idealities in the sequencing signal can be compensated for by an improved signal processing system and method that employs a dark mode signal as a baseline that is subtracted from a bright mode signal. The dark mode signal is acquired during a "dark mode" period of an AC signal that when applied to the sequencing cell, a tag is pushed out of the barrel of the nanopore by the applied electric field. For example, to compensate for fluctuations in a zero point voltage of a cell, zero point compensated signal values can be computed by subtracting dark mode signal values from both the bright mode open channel signal values and the bright mode threaded signal values. The zero point compensated signal values may be used as input to other intermediate processing stages, e.g., stages that employ a running histogram and/or two-dimensional processing method as described below. The technique may correct the sequencing signal for errors induced by phenomena such as variation and/or drift in a cell's zero point voltage even if the value of the zero point voltage itself is unknown.

According to another embodiment, an improved estimate for a normalization factor can be determined using an improved signal processing technique. The technique can use a running/moving histogram to determine a an open-channel pore state (e.g., no tag in the pore) at any instant in time based on a set of historical measurements at that instant in time. The contributions to the histogram by the historical data can be controlled by weighting/discounting the historical data according to its age. A normalization factor for use in normalizing signals measured with a tag in the pore can be determined to be the sequencing signal value associated with the largest peak in the running/moving histogram.

The above techniques can be used independently or in any combination or order to improve the sequencing signal of a nanopore-based sequencing cell. One or more of the above techniques can also be applied on a cell-by-cell basis to improve the sequencing signal of a multi-cell nanopore-based sequencing chip.

Other embodiments are directed to systems and computer readable media associated with methods described herein.

A better understanding of the nature and advantages of embodiments of the present invention may be gained with reference to the following detailed description and the accompanying drawings.

TERMS

Figure 1:
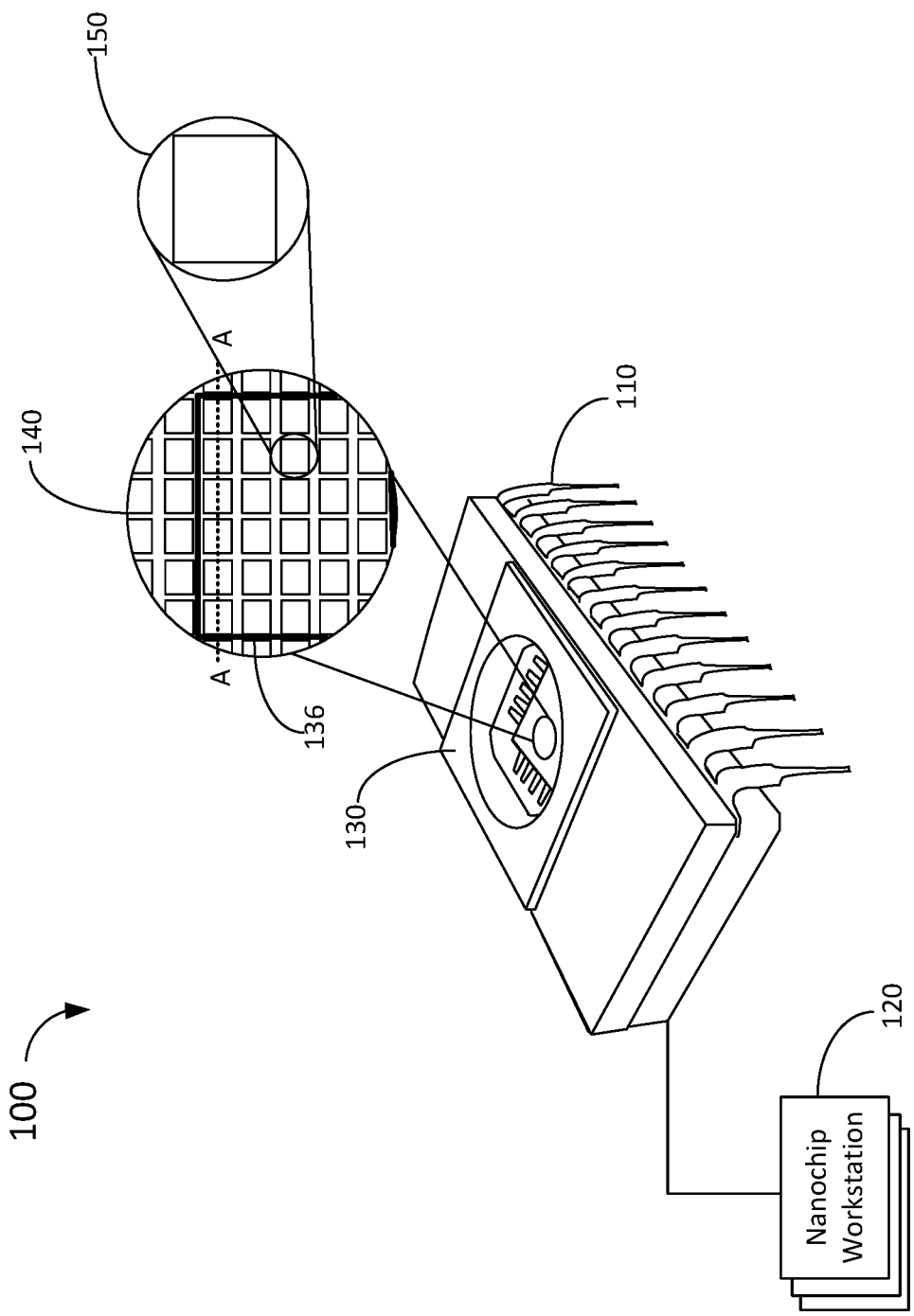
FIG. 1 is a top view of an embodiment of a nanopore sensor chip having an array of nanopore cells.

Unless defined otherwise, technical and scientific terms used herein have the same meaning as commonly understood by a person of ordinary skill in the art. Methods, devices, and materials similar or equivalent to those described herein can be used in the practice of disclosed techniques. The following terms are provided to facilitate understanding of certain terms used frequently and are not meant to limit the scope of the present disclosure. Abbreviations used herein have their conventional meaning within the chemical and biological arts.

A "nucleic acid" may refer to deoxyribonucleotides or ribonucleotides and polymers thereof in either single- or double-stranded form. The term may encompass nucleic acids containing known nucleotide analogs or modified backbone residues or linkages, which are synthetic, naturally occurring, and non-naturally occurring, which have similar binding properties as the reference nucleic acid, and which are metabolized in a manner similar to the reference nucleotides. Examples of such analogs may include, without limitation, phosphorothioates, phosphoramidites, methyl phosphonates, chiral-methyl phosphonates, 2-O-methyl ribonucleotides, peptide-nucleic acids (PNAs). Unless otherwise indicated, a particular nucleic acid sequence also implicitly encompasses conservatively modified variants thereof (e.g., degenerate codon substitutions) and complementary sequences, as well as the sequence explicitly indicated. Specifically, degenerate codon substitutions may be achieved by generating sequences in which the third position of one or more selected (or all) codons is substituted with mixed-base and/or deoxyinosine residues (Batzer et al., *Nucleic Acid Res.* 19:5081 (1991); Ohtsuka et al., *J. Biol. Chem.* 260:2605-2608 (1985); Rossolini et al., *Mol. Cell. Probes* 8:91-98 (1994)). The term nucleic acid may be used interchangeably with gene, cDNA, mRNA, oligonucleotide, and polynucleotide.

The term "template" may refer to a single stranded nucleic acid molecule that is copied into a complementary strand of DNA nucleotides for DNA synthesis. In some cases, a template may refer to the sequence of DNA that is copied during the synthesis of mRNA.

The term "primer" may refer to a short nucleic acid sequence that provides a starting point for DNA synthesis. Enzymes that catalyze the DNA synthesis, such as DNA polymerases, can add new nucleotides to a primer for DNA replication.

A "polymerase" may refer to an enzyme that performs template-directed synthesis of polynucleotides. The term encompasses both a full length polypeptide and a domain that has polymerase activity. DNA polymerases are well-known to those skilled in the art, and include but are not limited to DNA polymerases isolated or derived from *Pyrococcus furiosus, Thermococcus litoralis*, and *Thermotoga maritime*, or modified versions thereof. They include both DNA-dependent polymerases and RNA-dependent polymerases such as reverse transcriptase. At least five families of DNA-dependent DNA polymerases are known, although most fall into families A, B and C. There is little or no sequence similarity among the various families Most family A polymerases are single chain proteins that can contain multiple enzymatic functions including polymerase, 3' to 5' exonuclease activity and 5' to 3' exonuclease activity. Family B polymerases typically have a single catalytic domain with polymerase and 3' to 5' exonuclease activity, as well as accessory factors. Family C polymerases are typically multi-subunit proteins with polymerizing and 3' to 5' exonuclease activity. In *E. coli*, three types of DNA polymerases have been found, DNA polymerases I (family A), II (family B), and III (family C). In eukaryotic cells, three different family B polymerases, DNA polymerases α, δ, and ε, are implicated in nuclear replication, and a family A polymerase, polymerase γ, is used for mitochondrial DNA replication. Other types of DNA polymerases include phage polymerases. Similarly, RNA polymerases typically include eukaryotic RNA polymerases I, II, and III, and bacterial RNA polymerases as well as phage and viral polymerases. RNA polymerases can be DNA-dependent and RNA-dependent.

A "nanopore" refers to a pore, channel or passage formed or otherwise provided in a membrane. A membrane can be an organic membrane, such as a lipid bilayer, or a synthetic membrane, such as a membrane formed of a polymeric material. The nanopore can be disposed adjacent or in proximity to a sensing circuit or an electrode coupled to a sensing circuit, such as, for example, a complementary metal oxide semiconductor (CMOS) or field effect transistor (FET) circuit. In some examples, a nanopore has a characteristic width or diameter on the order of 0.1 nanometers (nm) to about 1000 nm. In some implementations, a nanopore may be a protein.

The term "nucleotide," in addition to referring to the naturally occurring ribonucleotide or deoxyribonucleotide monomers, may be understood to refer to related structural variants thereof, including derivatives and analogs, that are functionally equivalent with respect to the particular context in which the nucleotide is being used (e.g., hybridization to a complementary base), unless the context clearly indicates otherwise.

The term "tag" may refer to a detectable moiety that can be atoms or molecules, or a collection of atoms or molecules. A tag can provide an optical, electrochemical, magnetic, or electrostatic (e.g., inductive, capacitive) signature, which signature may be detected with the aid of a nanopore. Typically, when a nucleotide is attached to the tag it is called a "Tagged Nucleotide." The tag can be attached to the nucleotide via the phosphate moiety.

The term "bright period" may generally refer to the time period when a tag of a tagged nucleotide is forced into a nanopore by an electric field applied through an AC signal. The term "dark period" may generally refer to the time period when a tag of a tagged nucleotide is pushed out of the nanopore by the electric field applied through the AC signal. An AC cycle may include the bright period and the dark period. In different embodiments, the polarity of the voltage signal applied to a nanopore cell to put the nanopore cell into the bright period (or the dark period) may be different. The bright periods and the dark periods can correspond to different portions of an alternating signal relative to a reference voltage.

The term "signal value" may refer to a value of the sequencing signal output from a sequencing cell. According to certain embodiments, the sequencing signal may be an electrical signal that is measured and/or output from a point in a circuit of one or more sequencing cells e.g., the signal value may be (or represent) a voltage or a current. The signal value may represent the results of a direct measurement of voltage and/or current and/or may represent an indirect measurement, e.g., the signal value may be a measured duration of time for which it takes a voltage or current to reach a specified value. A signal value may represent any measurable quantity that correlates with the resistivity of a nanopore and from which the resistivity and/or conductance of the nanopore (threaded and/or unthreaded) may be derived. As another example, the signal value may correspond to a light intensity, e.g., from a fluorophore attached to a nucleotide being catalyzed to a nucleic acid with a polymerase.

The term "histogram" may refer to a data structure storing a count of a number of signal values for each of a specified number of intervals (bins). Each bin can correspond to a discrete value of a signal value (e.g., as determined by a resolution of an ADC) or to range of possible signal values within the interval.

DETAILED DESCRIPTION

According to certain embodiments, methods and systems disclosed herein relate to improvements in processing of a nanopore sequencing signal, e.g., a voltage signal as measured by an ADC connected to a nanopore cell. More specifically, methods and systems disclosed herein correct for both gain drift and baseline shift in a nanopore sequencing signal.

The phenomena of baseline shift in the nanopore sequencing signal can be related to charge imbalances that build up on certain inherently capacitive elements in the system (e.g., the working electrode of a cell) during the charging and discharging cycles that take place during the measurement process. Gain drift of the signal can be caused by relatively slow (hundreds or a thousand of seconds) changes in a membrane capacitance, where the membrane (e.g., a bilayer) covers the pore. Such membrane capacitance can change in a deterministic way, e.g., in response to physical changes in the bilayer.

A baseline drift of the signal can be removed (on a cell-by-cell basis) by a two-dimensional transformation, e.g., by rotating or flattening the cell's data in a 2-dimensional space, where one axis of the 2-dimensional space is defined to be the measured bright-channel voltage and the other axis is defined to be a derived value that serves as a proxy for the charge imbalance within the cell. In some embodiments, the proxy can be a time-weighted integrated history of either the bright-channel voltage or the dark-channel voltage. To compute the integrated history, historical voltage values can be summed together (i.e., integrated) with the contribution of older data to the sum being downgraded as the historical values age. The time constant for the temporal downgrading is related to the step-response time of the cell, which can be measured independently on a cell-by-cell basis.

A compensation of gain drift can be accomplished (on a cell-by-cell basis) through a point-by-point normalization of the cell's bright-channel signal. For example, to normalize the signal, each measured raw voltage can be divided by an estimate of the peak OC voltage. The estimate of the peak OC voltage can be found using what is referred to herein as a "moving histogram method." The peak OC voltage can be identified as the maximum value of the largest peak in a time-weighted running histogram of the data. For each point to be normalized, a histogram can be determined each time a new voltage is acquired, e.g., using an update procedure with the contribution of historical data to each new histogram being exponentially downgraded with age. The time constant for the exponential downgrade in the moving histogram method may be also related to rate at which the gain of the cell changes.

A compensation of a drift or fluctuation in a cell's zero point voltage $V_0$ can be accomplished by an improved processing technique that does not require measurement and tracking of $V_0$ explicitly. For example, by using the dark mode signal as a baseline signal that is subtracted from both the open channel signal and the threaded signal, the effect of $V_0$ drift on the sequencing signal can be compensated for. Furthermore, a variance in the raw sequencing signal values that is caused by a variance of $V_0$ is greatly reduced or even eliminated without needing to make any additional measurements to explicitly track $V_0$ for each cell during or before the sequencing operation.

I. Nanopore Sequencing Cell

Nanopore cells 150 in nanopore sensor chip 100 may be implemented in many different ways. For example, in some embodiments, tags of different sizes and/or chemical structures may be attached to different nucleotides in a nucleic acid molecule to be sequenced. In some embodiments, a complementary strand to a template of the nucleic acid molecule to be sequenced may be synthesized by hybridizing differently polymer-tagged nucleotides with the template. In some implementations, the nucleic acid molecule and the attached tags may both move through the nanopore, and an ion current passing through the nanopore may indicate the nucleotide that is in the nanopore because of the particular size and/or structure of the tag attached to the nucleotide. In some implementations, only the tags may be moved into the nanopore. There may also be many different ways to detect the different tags in the nanopores.

A. Nanopore Sequencing Cell Structure

Figure 2:
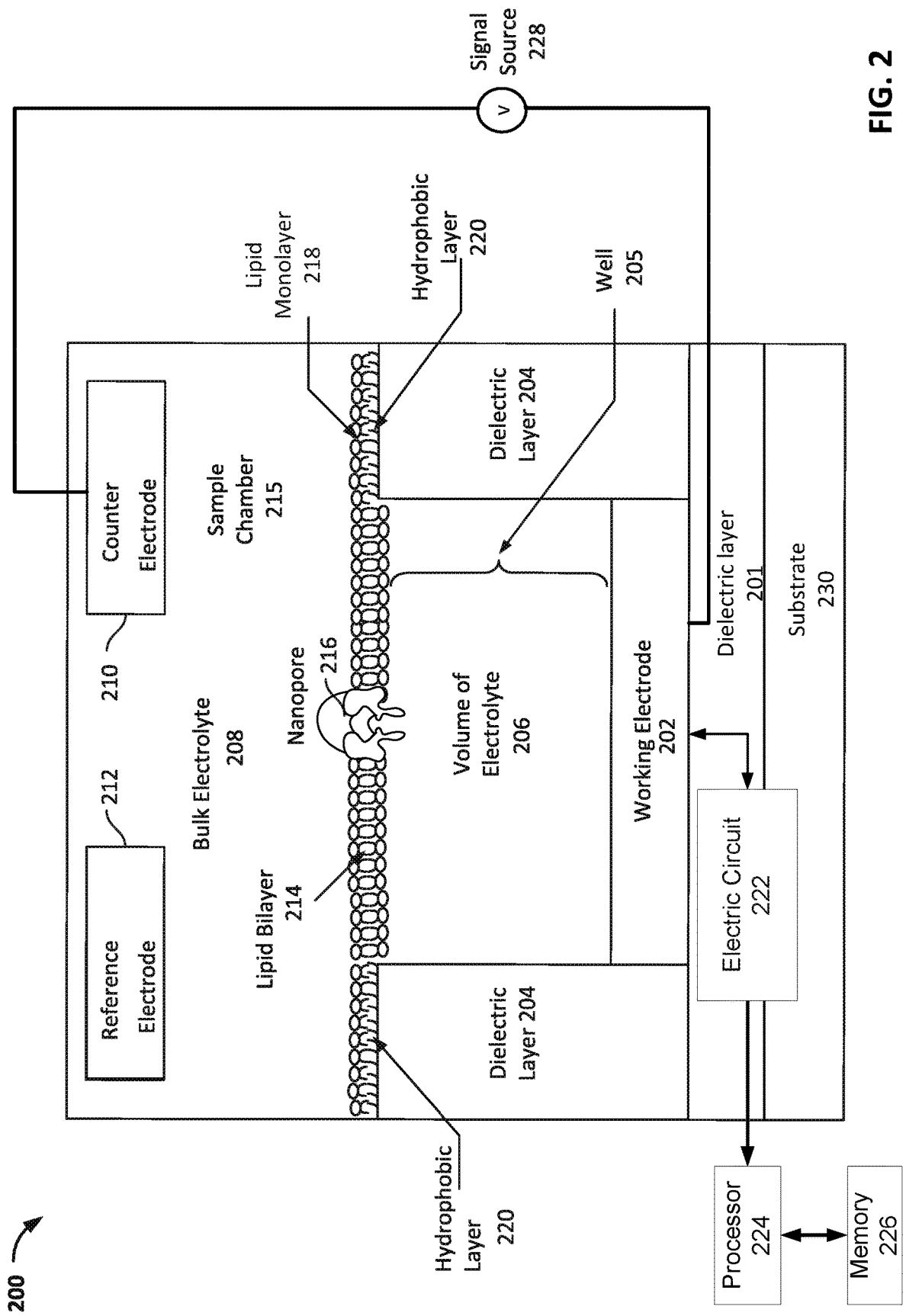
FIG. 2 illustrates an embodiment of a nanopore cell in a nanopore sensor chip that can be used to characterize a polynucleotide or a polypeptide.

FIG. 2 illustrates an embodiment of a nanopore cell 200 in a nanopore sensor chip, such as nanopore cell 150 in nanopore sensor chip 100 of FIG. 1, that can be used to characterize a polynucleotide or a polypeptide. Nanopore cell 200 may include a well 205 formed of dielectric layers 201 and 204; a membrane, such as a lipid bilayer 214 formed over well 205; and a sample chamber 215 on lipid bilayer 214 and separated from well 205 by lipid bilayer 214. Well 205 may contain a volume of electrolyte 206, and sample chamber 215 may hold bulk electrolyte 208 containing a nanopore, e.g., a soluble protein nanopore transmembrane molecular complexes (PNTMC), and the analyte of interest (e.g., a nucleic acid molecule to be sequenced).

Nanopore cell 200 may include a working electrode 202 at the bottom of well 205 and a counter electrode 210 disposed in sample chamber 215. A signal source 228 may apply a voltage signal between working electrode 202 and counter electrode 210. A single nanopore (e.g., a PNTMC) may be inserted into lipid bilayer 214 by an electroporation process caused by the voltage signal, thereby forming a nanopore 216 in lipid bilayer 214. The individual membranes (e.g., lipid bilayers 214 or other membrane structures) in the array may be neither chemically nor electrically connected to each other. Thus, each nanopore cell in the array may be an independent sequencing machine, producing data unique to the single polymer molecule associated with the nanopore that operates on the analyte of interest and modulates the ionic current through the otherwise impermeable lipid bilayer.

As shown in FIG. 2, nanopore cell 200 may be formed on a substrate 230, such as a silicon substrate. Dielectric layer 201 may be formed on substrate 230. Dielectric material used to form dielectric layer 201 may include, for example, glass, oxides, nitrides, and the like. An electric circuit 222 for controlling electrical stimulation and for processing the signal detected from nanopore cell 200 may be formed on substrate 230 and/or within dielectric layer 201. For example, a plurality of patterned metal layers (e.g., metal 1 to metal 6) may be formed in dielectric layer 201, and a plurality of active devices (e.g., transistors) may be fabricated on substrate 230. In some embodiments, signal source 228 is included as a part of electric circuit 222. Electric circuit 222 may include, for example, amplifiers, integrators, analog-to-digital converters, noise filters, feedback control logic, and/or various other components. Electric circuit 222 may be further coupled to a processor 224 that is coupled to a memory 226, where processor 224 can analyze the sequencing data to determine sequences of the polymer molecules that have been sequenced in the array.

Working electrode 202 may be formed on dielectric layer 201, and may form at least a part of the bottom of well 205. In some embodiments, working electrode 202 is a metal electrode. For non-faradaic conduction, working electrode 202 may be made of metals or other materials that are resistant to corrosion and oxidation, such as, for example, platinum, gold, titanium nitride, and graphite. For example, working electrode 202 may be a platinum electrode with electroplated platinum. In another example, working electrode 202 may be a titanium nitride (TiN) working electrode. Working electrode 202 may be porous, thereby increasing its surface area and a resulting capacitance associated with working electrode 202. Because the working electrode of a nanopore cell may be independent from the working electrode of another nanopore cell, the working electrode may be referred to as cell electrode in this disclosure.

Dielectric layer 204 may be formed above dielectric layer 201. Dielectric layer 204 forms the walls surrounding well 205. A dielectric material used to form dielectric layer 204 may include, for example, glass, oxide, silicon mononitride (SiN), polyimide, or other suitable hydrophobic insulating material. The top surface of dielectric layer 204 may be silanized. The silanization may form a hydrophobic layer 220 above the top surface of dielectric layer 204. In some embodiments, hydrophobic layer 220 has a thickness of about 1.5 nanometers (nm).

Well 205 formed by walls of the dielectric layer 204 includes volume of electrolyte 206 above working electrode 202. Volume of electrolyte 206 may be buffered and may include one or more of the following: lithium chloride (LiCl), sodium chloride (NaCl), potassium chloride (KCl), lithium glutamate, sodium glutamate, potassium glutamate, lithium acetate, sodium acetate, potassium acetate, calcium chloride ($CaCl_2$), strontium chloride ($SrCl_2$), manganese chloride ($MnCl_2$), and magnesium chloride ($MgCl_2$). In some embodiments, volume of electrolyte 206 has a thickness of about three microns ($\mu$m).

As also shown in FIG. 2, a membrane may be formed on top of dielectric layer 204 and span across well 205. In some embodiments, the membrane may include a lipid monolayer 218 formed on top of hydrophobic layer 220. As the membrane reaches the opening of well 205, lipid monolayer 218 may transition to lipid bilayer 214 that spans across the opening of well 205. The lipid bilayer may comprise or consist of phospholipid, for example, selected from diphytanoyl-phosphatidylcholine (DPhPC), 1,2-diphytanoyl-sn-glycero-3-phosphocholine, 1,2-Di-O-Phytanyl-sn-Glycero-3-phosphocholine (DoPhPC), palmitoyl-oleoyl-phosphatidylcholine (POPC), dioleoyl-phosphatidyl-methylester (DOPME), dipalmitoylphosphatidylcholine (DPPC), phosphatidylcholine, phosphatidylethanolamine, phosphatidylserine, phosphatidic acid, phosphatidylinositol, phosphatidylglycerol, sphingomyelin, 1,2-di-O-phytanyl-sn-glycerol; 1,2-dipalmitoyl-sn-glycero-3-phosphoethanolamine-N-[methoxy(polyethylene glycol)-350]; 1,2-dipalmitoyl-sn-glycero-3-phosphoethanolamine-N-[methoxy (polyethylene glycol)-550]; 1,2-dipalmitoyl-sn-glycero-3-phosphoethanolamine-N-[methoxy(polyethylene glycol)-750]; 1,2-dipalmitoyl-sn-glycero-3-phosphoethanolamine-N-[methoxy(polyethylene glycol)-1000]; 1,2-dipalmitoyl-sn-glycero-3-phosphoethanolamine-N-[methoxy (polyethylene glycol)-2000]; 1,2-dioleoyl-sn-glycero-3-phosphoethanolamine-N-lactosyl; GM1 Ganglioside, Lysophosphatidylcholine (LPC) or any combination thereof.

As shown, lipid bilayer 214 is embedded with a single nanopore 216, e.g., formed by a single PNTMC. As described above, nanopore 216 may be formed by inserting a single PNTMC into lipid bilayer 214 by electroporation. Nanopore 216 may be large enough for passing at least a portion of the analyte of interest and/or small ions (e.g., $Na^+$, $K^+$, $Ca^{2+}$, $Cl^-$) between the two sides of lipid bilayer 214.

Sample chamber 215 is over lipid bilayer 214, and can hold a solution of the analyte of interest for characterization. The solution may be an aqueous solution containing bulk electrolyte 208 and buffered to an optimum ion concentration and maintained at an optimum pH to keep the nanopore 216 open. Nanopore 216 crosses lipid bilayer 214 and provides the only path for ionic flow from bulk electrolyte 208 to working electrode 202. In addition to nanopores (e.g., PNTMCs) and the analyte of interest, bulk electrolyte 208 may further include one or more of the following: lithium chloride (LiCl), sodium chloride (NaCl), potassium chloride (KCl), lithium glutamate, sodium glutamate, potassium glutamate, lithium acetate, sodium acetate, potassium acetate, calcium chloride ($CaCl_2$), strontium chloride ($SrCl_2$), Manganese chloride ($MnCl_2$), and magnesium chloride ($MgCl_2$).

Counter electrode 210 may be an electrochemical potential sensor. In some embodiments, counter electrode 210 may be shared between a plurality of nanopore cells, and may therefore be referred to as a common electrode. In some cases, the common potential and the common electrode may be common to all nanopore cells, or at least all nanopore cells within a particular grouping. The common electrode can be configured to apply a common potential to the bulk electrolyte 208 in contact with the nanopore 216. Counter electrode 210 and working electrode 202 may be coupled to signal source 228 for providing electrical stimulus (e.g., voltage bias) across lipid bilayer 214, and may be used for sensing electrical characteristics of lipid bilayer 214 (e.g., resistance, capacitance, and ionic current flow). In some embodiments, nanopore cell 200 can also include a reference electrode 212.

In some embodiments, various checks can be made during creation of the nanopore cell as part of calibration. Once a nanopore cell is created, further calibration steps can be performed, e.g., to identify nanopore cells that are performing as desired (e.g., one nanopore in the cell). Such calibration checks can include physical checks, voltage calibration, open channel calibration, and identification of cells with a single nanopore.

B. Detection Signals of Nanopore Sequencing Cell

Nanopore cells in nanopore sensor chip, such as nanopore cells 150 in nanopore sensor chip 100, may enable parallel sequencing using a single molecule nanopore-based sequencing by synthesis (Nano-SBS) technique.

Figure 3:
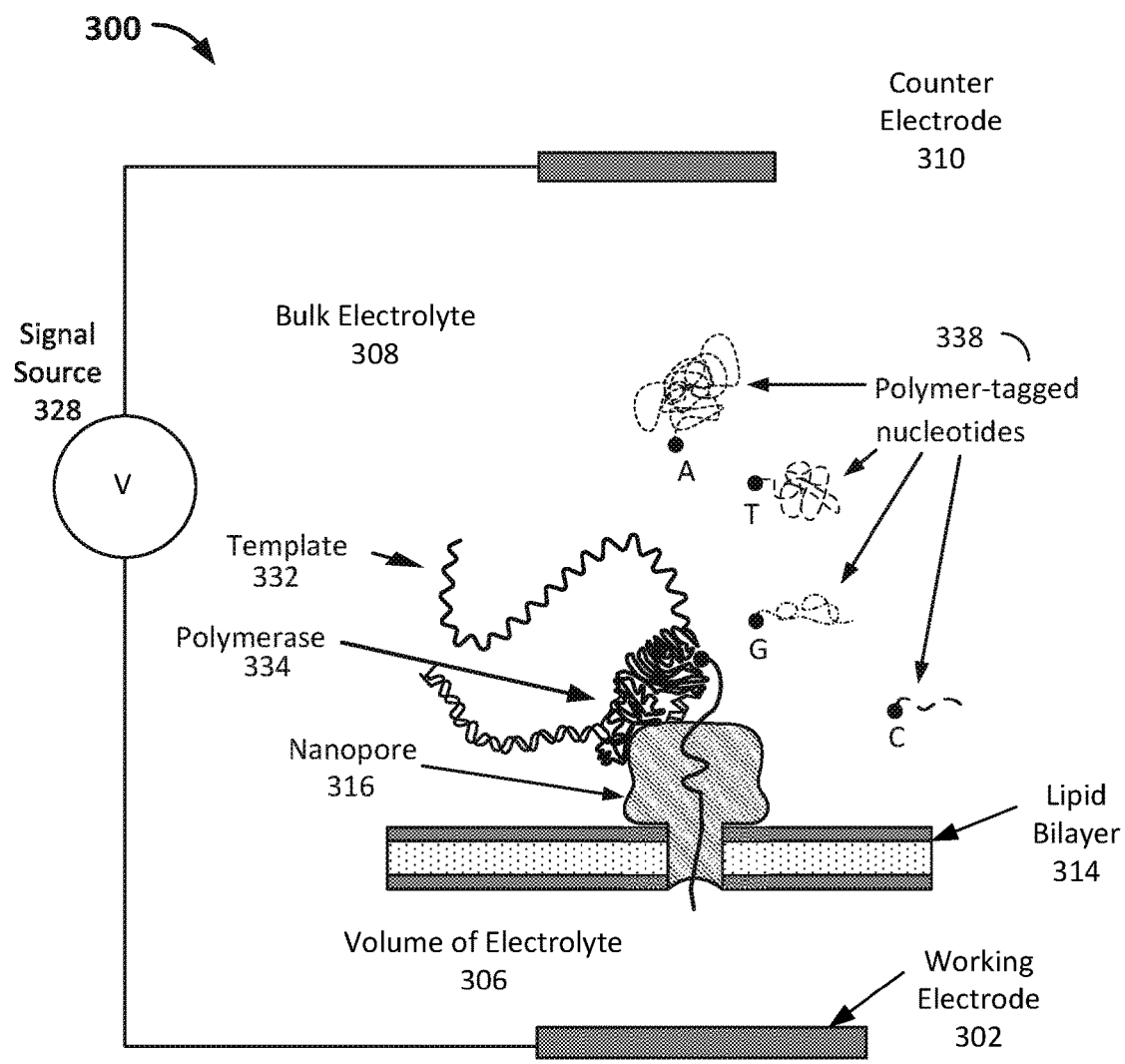
FIG. 3 illustrates an embodiment of a nanopore cell performing nucleotide sequencing using a nanopore-based sequencing-by-synthesis (Nano-SBS) technique.
Figure 3:
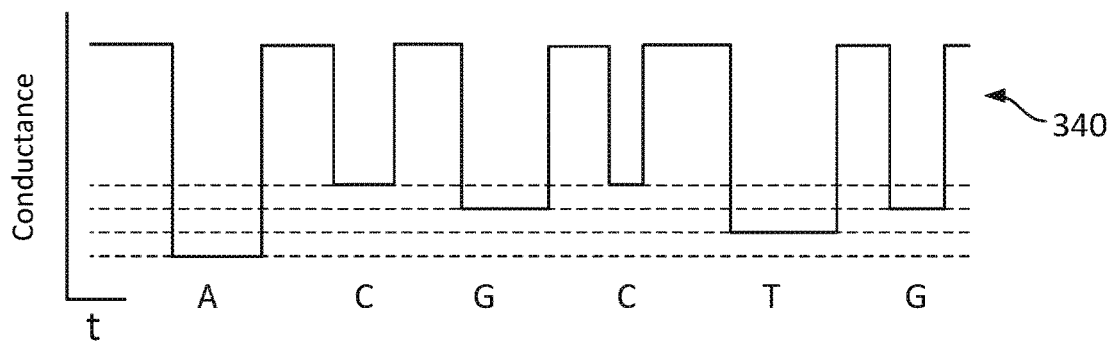

FIG. 3 illustrates an embodiment of a nanopore cell 300 performing nucleotide sequencing using the Nano-SBS technique. In the Nano-SBS technique, a template 332 to be sequenced (e.g., a nucleotide acid molecule or another analyte of interest) and a primer may be introduced into bulk electrolyte 308 in the sample chamber of nanopore cell 300. As examples, template 332 can be circular or linear. A nucleic acid primer may be hybridized to a portion of template 332 to which four differently polymer-tagged nucleotides 338 may be added.

In some embodiments, an enzyme (e.g., a polymerase 334, such as a DNA polymerase) may be associated with nanopore 316 for use in the synthesizing a complementary strand to template 332. For example, polymerase 334 may be covalently attached to nanopore 316. Polymerase 334 may catalyze the incorporation of nucleotides 338 onto the primer using a single stranded nucleic acid molecule as the template. Nucleotides 338 may comprise tag species ("tags") with the nucleotide being one of four different types: A, T, G, or C.

When a tagged nucleotide is correctly bound with polymerase 334, the tag may be pulled (loaded) into the nanopore by an electrical force, such as a force generated in the presence of an electric field generated by a voltage applied across lipid bilayer 314 and/or nanopore 316. The voltage may be applied using voltage source 328 that is connected to working electrode and counter electrode 310. The tail of the tag may be positioned in the barrel of nanopore 316. The tag held in the barrel of nanopore 316 may generate a unique ionic blockade signal 340 due to the tag's distinct chemical structure and/or size, thereby electronically identifying the added base to which the tag attaches.

As used herein, a "loaded" or "threaded" tag may be one that is positioned in and/or remains in or near the nanopore for an appreciable amount of time, e.g., 0.1 millisecond (ms) to 10,000 milliseconds. In some cases, a tag is loaded in the nanopore prior to being released from the nucleotide. In some instances, the probability of a loaded tag passing through (and/or being detected by) the nanopore after being released upon a nucleotide incorporation event is suitably high, e.g., 90% to 99%.

In some embodiments, before polymerase 334 is connected to nanopore 316, the conductance of nanopore 316 may be high, such as, for example, about 300 picosiemens (300 pS). As the tag is loaded in the nanopore, a unique conductance signal (e.g., signal 340) is generated due to the tag's distinct chemical structure and/or size. For example, the conductance of the nanopore can be about 60 pS, 80 pS, 100 pS, or 120 pS, each corresponding to one of the four types of tagged nucleotides. The polymerase may then undergo an isomerization and a transphosphorylation reaction to incorporate the nucleotide into the growing nucleic acid molecule and release the tag molecule.

In some cases, some of the tagged nucleotides may not match (complementary bases) with a current position of the nucleic acid molecule (template). The tagged nucleotides that are not base-paired with the nucleic acid molecule may also pass through the nanopore. These non-paired nucleotides can be rejected by the polymerase within a time scale that is shorter than the time scale for which correctly paired nucleotides remain associated with the polymerase. Tags bound to non-paired nucleotides may pass through the nanopore quickly, and be detected for a short period of time (e.g., less than 10 ms), while tags bounded to paired nucleotides can be loaded into the nanopore and detected for a long period of time (e.g., at least 10 ms). Therefore, non-paired nucleotides may be identified by a downstream processor based at least in part on the time for which the nucleotide is detected in the nanopore.

A conductance (or equivalently the resistance) of the nanopore including the loaded (threaded) tag can be measured via a current passing through the nanopore, thereby providing an identification of the tag species and thus the nucleotide at the current position. In some embodiments, a direct current (DC) signal can be applied to the nanopore cell (e.g., so that the direction at which the tag moves through the nanopore is not reversed). However, operating a nanopore sensor for long periods of time using a direct current can change the composition of the electrode, unbalance the ion concentrations across the nanopore, and have other undesirable effects that can affect the lifetime of the nanopore cell. Applying an alternating current (AC) waveform can reduce the electro-migration to avoid these undesirable effects and have certain advantages as described below. The nucleic acid sequencing methods described herein that utilize tagged nucleotides are fully compatible with applied AC voltages, and therefore an AC waveform can be used to achieve these advantages.

The ability to re-charge the electrode during the AC detection cycle can be advantageous when sacrificial electrodes, electrodes that change molecular character in the current-carrying reactions (e.g., electrodes comprising silver), or electrodes that change molecular character in current-carrying reactions are used. An electrode may deplete during a detection cycle when a direct current signal is used. The recharging can prevent the electrode from reaching a depletion limit, such as becoming fully depleted, which can be a problem when the electrodes are small (e.g., when the electrodes are small enough to provide an array of electrodes having at least 500 electrodes per square millimeter). Electrode lifetime in some cases scales with, and is at least partly dependent on, the width of the electrode.

Suitable conditions for measuring ionic currents passing through the nanopores are known in the art and examples are provided herein. The measurement may be carried out with a voltage applied across the membrane and pore. In some embodiments, the voltage used may range from −400 mV to +400 mV. The voltage used is preferably in a range having a lower limit selected from −400 mV, −300 mV, −200 mV, −150 mV, −100 mV, −50 mV, −20 mV, and 0 mV, and an upper limit independently selected from +10 mV, +20 mV, +50 mV, +100 mV, +150 mV, +200 mV, +300 mV, and +400 mV. The voltage used may be more preferably in the range of 100 mV to 240 mV and most preferably in the range of 160 mV to 240 mV. It is possible to increase discrimination between different nucleotides by a nanopore using an increased applied potential. Sequencing nucleic acids using AC waveforms and tagged nucleotides is described in US Patent Publication No. US 2014/0134616 entitled "Nucleic Acid Sequencing Using Tags," filed on Nov. 6, 2013, which is herein incorporated by reference in its entirety. In addition to the tagged nucleotides described in US 2014/0134616, sequencing can be performed using nucleotide analogs that lack a sugar or acyclic moiety, e.g., (S)-Glycerol nucleoside triphosphates (gNTPs) of the five common nucleobases: adenine, cytosine, guanine, uracil, and thymine (Horhota et al., Organic Letters, 8:5345-5347 [2006]).

C. Electric Circuit of Nanopore Sequencing Cell

Figure 4:
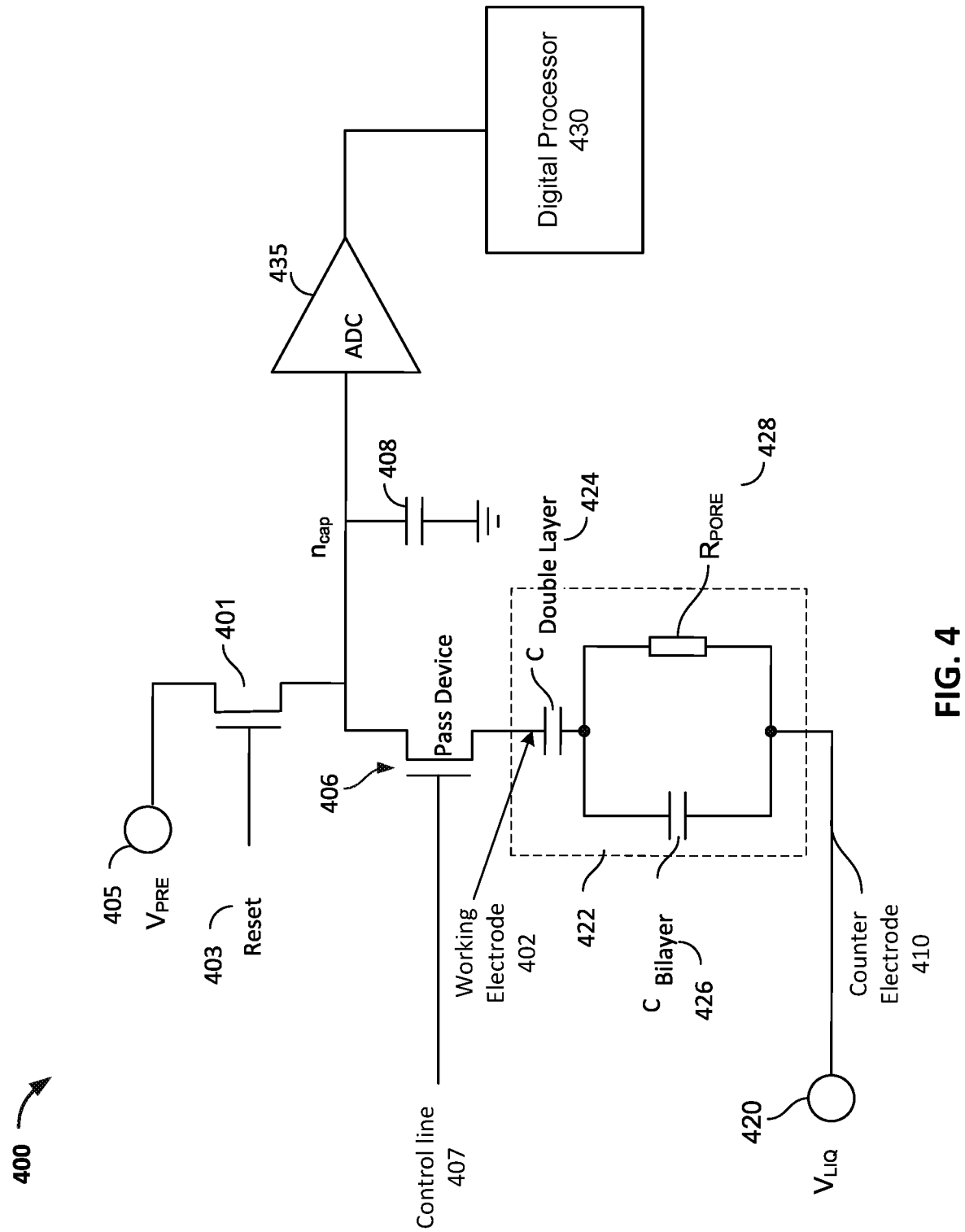
FIG. 4 illustrates an embodiment of an electric circuit in a nanopore cell.

FIG. 4 illustrates an embodiment of an electric circuit 400 (which may include portions of electric circuit 222 in FIG. 2) in a nanopore cell, such as nanopore cell 200. As described above, in some embodiments, electric circuit 400 includes a counter electrode 410 that may be shared between a plurality of nanopore cells or all nanopore cells in a nanopore sensor chip, and may therefore also be referred to as a common electrode. The common electrode can be configured to apply a common potential to the bulk electrolyte (e.g., bulk electrolyte 208) in contact with the lipid bilayer (e.g., lipid bilayer 214) in the nanopore cells by connecting to a voltage source $V_{LIQ}$ 420. In some embodiments, an AC non-Faradaic mode may be utilized to modulate voltage $V_{LIQ}$ with an AC signal (e.g., a square wave) and apply it to the bulk electrolyte in contact with the lipid bilayer in the nanopore cell. In some embodiments, $V_{LIQ}$ is a square wave with a magnitude of ±200-250 mV and a frequency between, for example, 25 and 400 Hz. The bulk electrolyte between counter electrode 410 and the lipid bilayer (e.g., lipid bilayer 214) may be modeled by a large capacitor (not shown), such as, for example, 100 µF or larger.

FIG. 4 also shows an electrical model 422 representing the electrical properties of a working electrode 402 (e.g., working electrode 202) and the lipid bilayer (e.g., lipid bilayer 214). Electrical model 422 includes a capacitor 426 ($C_{BiLayer}$) that models a capacitance associated with the lipid bilayer and a resistor 428 ($R_{PORE}$) that models a variable resistance associated with the nanopore, which can change based on the presence of a particular tag in the nanopore. Electrical model 422 also includes a capacitor 424 having a double layer capacitance ($C_{Double\ Layer}$) and representing the electrical properties of working electrode 402 and well 205. Working electrode 402 may be configured to apply a distinct potential independent from the working electrodes in other nanopore cells.

Pass device 406 is a switch that can be used to connect or disconnect the lipid bilayer and the working electrode from electric circuit 400. Pass device 406 may be controlled by control line 407 to enable or disable a voltage stimulus to be applied across the lipid bilayer in the nanopore cell. Before lipids are deposited to form the lipid bilayer, the impedance between the two electrodes may be very low because the well of the nanopore cell is not sealed, and therefore pass device 406 may be kept open to avoid a short-circuit condition. Pass device 406 may be closed after lipid solvent has been deposited to the nanopore cell to seal the well of the nanopore cell.

Circuit 400 may further include an on-chip integrating capacitor 408 ($n_{cap}$). Integrating capacitor 408 may be pre-charged by using a reset signal 403 to close switch 401, such that integrating capacitor 408 is connected to a voltage source $V_{PRE}$ 405. In some embodiments, voltage source $V_{PRE}$ 405 provides a constant reference voltage with a magnitude of, for example, 900 mV. When switch 401 is closed, integrating capacitor 408 may be pre-charged to the reference voltage level of voltage source $V_{PRE}$ 405.

After integrating capacitor 408 is pre-charged, reset signal 403 may be used to open switch 401 such that integrating capacitor 408 is disconnected from voltage source $V_{PRE}$ 405. At this point, depending on the level of voltage source $V_{LIQ}$, the potential of counter electrode 410 may be at a level higher than the potential of working electrode 402 (and integrating capacitor 408), or vice versa. For example, during a positive phase of a square wave from voltage source $V_{LIQ}$ (e.g., the bright or dark period of the AC voltage source signal cycle), the potential of counter electrode 410 is at a level higher than the potential of working electrode 402. During a negative phase of the square wave from voltage source $V_{LIQ}$ (e.g., the dark or bright period of the AC voltage source signal cycle), the potential of counter electrode 410 is at a level lower than the potential of working electrode 402. Thus, in some embodiments, integrating capacitor 408 may be further charged during the bright period from the pre-charged voltage level of voltage source $V_{PRE}$ 405 to a higher level, and discharged during the dark period to a lower level, due to the potential difference between counter electrode 410 and working electrode 402. In other embodiments, the charging and discharging may occur in dark periods and bright periods, respectively.

Integrating capacitor 408 may be charged or discharged for a fixed period of time, depending on the sampling rate of an analog-to-digital converter (ADC) 435, which may be higher than 1 kHz, 5 kHz, 10 kHz, 100 kHz, or more. For example, with a sampling rate of 1 kHz, integrating capacitor 408 may be charged/discharged for a period of about 1 ms, and then the voltage level may be sampled and converted by ADC 435 at the end of the integration period. A particular voltage level would correspond to a particular tag species in the nanopore, and thus correspond to the nucleotide at a current position on the template.

After being sampled by ADC 435, integrating capacitor 408 may be pre-charged again by using reset signal 403 to close switch 401, such that integrating capacitor 408 is connected to voltage source $V_{PRE}$ 405 again. The steps of pre-charging integrating capacitor 408, waiting for a fixed period of time for integrating capacitor 408 to charge or discharge, and sampling and converting the voltage level of integrating capacitor by ADC 435 can be repeated in cycles throughout the sequencing process.

A digital processor 430 can process the ADC output data, e.g., for normalization, data buffering, data filtering, data compression, data reduction, event extraction, or assembling ADC output data from the array of nanopore cells into various data frames. In some embodiments, digital processor 430 can perform further downstream processing, such as base determination. Digital processor 430 can be implemented as hardware (e.g., in a GPU, FPGA, ASIC, etc.) or as a combination of hardware and software.

Accordingly, the voltage signal applied across the nanopore can be used to detect particular states of the nanopore. One of the possible states of the nanopore is an open-channel state when a tag-attached polyphosphate is absent from the barrel of the nanopore, also referred to herein as the unthreaded state of the nanopore. Another four possible states of the nanopore each correspond to a state when one of the four different types of tag-attached polyphosphate nucleotides (A, T, G, or C) is held in the barrel of the nanopore. Yet another possible state of the nanopore is when the lipid bilayer is ruptured.

When the voltage level on integrating capacitor 408 is measured after a fixed period of time, the different states of a nanopore may result in measurements of different voltage levels. This is because the rate of the voltage decay (decrease by discharging or increase by charging) on integrating capacitor 408 (i.e., the steepness of the slope of a voltage on integrating capacitor 408 versus time plot) depends on the nanopore resistance (e.g., the resistance of resistor $R_{PORE}$ 428). More particularly, as the resistance associated with the nanopore in different states is different due to the molecules' (tags') distinct chemical structures, different corresponding rates of voltage decay may be observed and may be used to identify the different states of the nanopore. The voltage decay curve may be an exponential curve with an RC time constant $\tau = RC$, where R is the resistance associated with the nanopore (i.e., $R_{PORE}$ 428) and C is the capacitance associated with the membrane (i.e., capacitor 426 ($C_{Bilayer}$)) in parallel with R. A time constant of the nanopore cell can be, for example, about 200-500 ms. The decay curve may not fit exactly to an exponential curve due to the detailed implementation of the bilayer, but the decay curve may be similar to an exponential curve and is monotonic, thus allowing detection of tags.

In some embodiments, the resistance associated with the nanopore in an open-channel state may be in the range of 100 MΩ to 20 GΩ. In some embodiments, the resistance associated with the nanopore in a state where a tag is inside the barrel of the nanopore may be within the range of 200 MΩ to 40 GΩ. In other embodiments, integrating capacitor 408 may be omitted, as the voltage leading to ADC 435 will still vary due to the voltage decay in electrical model 422.

The rate of the decay of the voltage on integrating capacitor 408 may be determined in different ways. As explained above, the rate of the voltage decay may be determined by measuring a voltage decay during a fixed time interval. For example, the voltage on integrating capacitor 408 may be first measured by ADC 435 at time t1, and then the voltage is measured again by ADC 435 at time t2. The voltage difference is greater when the slope of the voltage on integrating capacitor 408 versus time curve is steeper, and the voltage difference is smaller when the slope of the voltage curve is less steep. Thus, the voltage difference may be used as a metric for determining the rate of the decay of the voltage on integrating capacitor 408, and thus the state of the nanopore cell.

In other embodiments, the rate of the voltage decay can be determined by measuring a time duration that is required for a selected amount of voltage decay. For example, the time required for the voltage to drop or increase from a first voltage level V1 to a second voltage level V2 may be measured. The time required is less when the slope of the voltage vs. time curve is steeper, and the time required is greater when the slope of the voltage vs. time curve is less steep. Thus, the measured time required may be used as a metric for determining the rate of the decay of the voltage on integrating capacitor $n_{cap}$ 408, and thus the state of the nanopore cell. One skilled in the art will appreciate the various circuits that can be used to measure the resistance of the nanopore, e.g., including current measurement techniques.

In some embodiments, electric circuit 400 may not include a pass device (e.g., pass device 406) and an extra capacitor (e.g., integrating capacitor 408 ($n_{cap}$)) that are fabricated on-chip, thereby facilitating the reduction in size of the nanopore-based sequencing chip. Due to the thin nature of the membrane (lipid bilayer), the capacitance associated with the membrane (e.g., capacitor 426 ($C_{Bilayer}$)) alone can suffice to create the required RC time constant without the need for additional on-chip capacitance. Therefore, capacitor 426 may be used as the integrating capacitor, and may be pre-charged by the voltage signal $V_{PRE}$ and subsequently be discharged or charged by the voltage signal $V_{LIQ}$. The elimination of the extra capacitor and the pass device that are otherwise fabricated on-chip in the electric circuit can significantly reduce the footprint of a single nanopore cell in the nanopore sequencing chip, thereby facilitating the scaling of the nanopore sequencing chip to include more and more cells (e.g., having millions of cells in a nanopore sequencing chip).

D. Data Sampling in Nanopore Cell

To perform sequencing of a nucleic acid, the voltage level of integrating capacitor (e.g., integrating capacitor 408 ($n_{cap}$) or capacitor 426 ($C_{Bilayer}$)) can be sampled and converted by the ADC (e.g., ADC 435) while a tagged nucleotide is being added to the nucleic acid. The tag of the nucleotide can be pushed into the barrel of the nanopore by the electric field across the nanopore that is applied through the counter electrode and the working electrode, for example, when the applied voltage is such that $V_{LIQ}$ is lower than $V_{PRE}$.

1. Threading

A threading event is when a tagged nucleotide is attached to the template (e.g., nucleic acid fragment), and the tag goes in and out of the barrel of the nanopore. This can happen multiple times during a threading event. When the tag is in the barrel of the nanopore, the resistance of the nanopore may be higher, and a lower current may flow through the nanopore.

During sequencing, a tag may not be in the nanopore in some AC cycles (referred to as an open-channel state), where the current is the highest because of the lower resistance of the nanopore. When a tag is attracted into the barrel of the nanopore, the nanopore is in a bright mode. When the tag is pushed out of the barrel of the nanopore, the nanopore is in a dark mode.

2. Bright and Dark Period

During an AC cycle, the voltage on integrating capacitor may be sampled multiple times by the ADC. For example, in one embodiment, an AC voltage signal is applied across the system at, e.g., about 100 Hz, and an acquisition rate of the ADC can be about 2000 Hz per cell. Thus, there can be about 20 data points (voltage measurements) captured per AC cycle (cycle of an AC waveform). Data points corresponding to one cycle of the AC waveform may be referred to as a set. In a set of data points for an AC cycle, there may be a subset captured when, for example, $V_{LIQ}$ is lower than $V_{PRE}$, which may correspond to a bright mode (period) where the tag is forced into the barrel of the nanopore. Another subset may correspond to a dark mode (period) where the tag is pushed out of the barrel of the nanopore by the applied electric field when, for example, $V_{LIQ}$ is higher than $V_{PRE}$.

3. Measured Voltages

For each data point, when the switch 401 is opened, the voltage at the integrating capacitor (e.g., integrating capacitor 408 ($n_{cap}$) or capacitor 426 ($C_{Bilayer}$)) will change in a decaying manner as a result of the charging/discharging by $V_{LIQ}$, e.g., as an increase from $V_{PRE}$ to $V_{LIQ}$ when $V_{LIQ}$ is higher than $V_{PRE}$ or a decrease from $V_{PRE}$ to $V_{LIQ}$ when $V_{LIQ}$ is lower than $V_{PRE}$. The final voltage values may deviate from $V_{LIQ}$ as the working electrode charges. The rate of change of the voltage level on the integrating capacitor may be governed by the value of the resistance of the bilayer, which may include the nanopore, which may in turn include a molecule (e.g., a tag of a tagged nucleotide) in the nanopore. The voltage level can be measured at a predetermined time after switch 401 opens.

Switch 401 may operate at the rate of data acquisition. Switch 401 may be closed for a relatively short time period between two acquisitions of data, typically right after a measurement by the ADC. The switch allows multiple data points to be collected during each sub-period (bright or dark) of each AC cycle of $V_{LIQ}$. If switch 401 remains open, the voltage level on the integrating capacitor, and thus the output value of the ADC, would fully decay and stay there. Instead, when switch 401 is closed, the integrating capacitor is pre-charged again (to $V_{PRE}$) and becomes ready for another measurement. Thus, switch 401 allows multiple data points to be collected for each sub-period (bright or dark) of each AC cycle. Such multiple measurements can allow higher resolution with a fixed ADC (e.g. 8-bit to 14-bit due to the greater number of measurements, which may be averaged). The multiple measurements can also provide kinetic information about the molecule threaded into the nanopore. The timing information may allow the determination of how long a threading takes place. This can also be used in helping to determine whether multiple nucleotides that are added to the nucleic acid strand are being sequenced.

Figure 5:
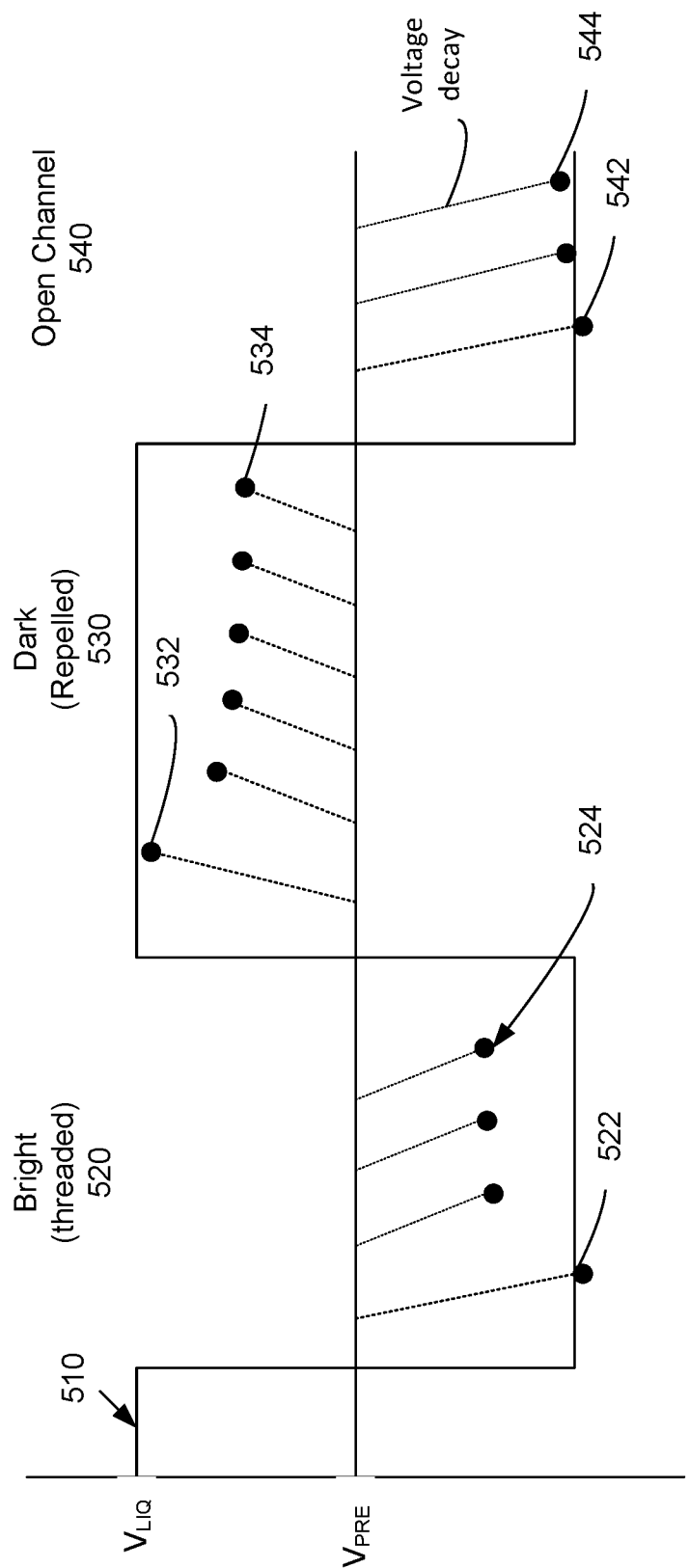
FIG. 5 shows example data points captured from a nanopore cell during bright periods and dark periods of AC cycles.

FIG. 5 shows example data points captured from a nanopore cell during bright periods and dark periods of AC cycles. In FIG. 5, the change in the data points is exaggerated for illustration purpose. The voltage ($V_{PRE}$) applied to the working electrode or the integrating capacitor is at a constant level, such as, for example, 900 mV. A voltage signal 510 ($V_{LIQ}$) applied to the counter electrode of the nanopore cells is an AC signal shown as a rectangular wave, where the duty cycle may be any suitable value, such as less than or equal to 50%, for example, about 40%.

During a bright period 520, voltage signal 510 ($V_{LIQ}$) applied to the counter electrode is lower than the voltage $V_{PRE}$ applied to the working electrode, such that a tag may be forced into the barrel of the nanopore by the electric field caused by the different voltage levels applied at the working electrode and the counter electrode (e.g., due to the charge on the tag and/or flow of the ions). When switch 401 is opened, the voltage at a node before the ADC (e.g., at an integrating capacitor) will decrease. After a voltage data point is captured (e.g., after a specified time period), switch 401 may be closed and the voltage at the measurement node will increase back to $V_{PRE}$ again. The process can repeat to measure multiple voltage data points. In this way, multiple data points may be captured during the bright period.

As shown in FIG. 5, a first data point 522 (also referred to as first point delta (FPD)) in the bright period after a change in the sign of the $V_{LIQ}$ signal may be lower than subsequent data points 524. This may be because there is no tag in the nanopore (open channel), and thus it has a low resistance and a high discharge rate. In some instances, first data point 522 may exceed the $V_{LIQ}$ level as shown in FIG. 5. This may be caused by the capacitance of the bilayer coupling the signal to the on-chip capacitor. Data points 524 may be captured after a threading event has occurred, i.e., a tag is forced into the barrel of the nanopore, where the resistance of the nanopore and thus the rate of discharging of the integrating capacitor depends on the particular type of tag that is forced into the barrel of the nanopore. Data points 524 may decrease slightly for each measurement due to charge built up at $C_{Double\ Layer}$ 424, as mentioned below.

During a dark period 530, voltage signal 510 ($V_{LIQ}$) applied to the counter electrode is higher than the voltage ($V_{PRE}$) applied to the working electrode, such that any tag would be pushed out of the barrel of the nanopore. When switch 401 is opened, the voltage at the measurement node increases because the voltage level of voltage signal 510 ($V_{LIQ}$) is higher than $V_{PRE}$. After a voltage data point is captured (e.g., after a specified time period), switch 401 may be closed and the voltage at the measurement node will decrease back to $V_{PRE}$ again. The process can repeat to measure multiple voltage data points. Thus, multiple data points may be captured during the dark period, including a first point delta 532 and subsequent data points 534. As described above, during the dark period, any nucleotide tag is pushed out of the nanopore, and thus minimal information about any nucleotide tag is obtained, besides for use in normalization.

FIG. 5 also shows that during bright period 540, even though voltage signal 510 ($V_{LIQ}$) applied to the counter electrode is lower than the voltage ($V_{PRE}$) applied to the working electrode, no threading event occurs (open-channel). Thus, the resistance of the nanopore is low, and the rate of discharging of the integrating capacitor is high. As a result, the captured data points, including a first data point 542 and subsequent data points 544, show low voltage levels.

The voltage measured during a bright or dark period might be expected to be about the same for each measurement of a constant resistance of the nanopore (e.g., made during a bright mode of a given AC cycle while one tag is in the nanopore), but this may not be the case when charge builds up at double layer capacitor 424 ($C_{Double\ Layer}$). This charge build-up can cause the time constant of the nanopore cell to become longer. As a result, the voltage level may be shifted, thereby causing the measured value to decrease for each data point in a cycle. Thus, within a cycle, the data points may change somewhat from data point to another data point, as shown in FIG. 5.

Further details regarding measurements can be found in, for example, U.S. Patent Publication No. 2016/0178577 entitled "Nanopore-Based Sequencing With Varying Voltage Stimulus," U.S. Patent Publication No. 2016/0178554 entitled "Nanopore-Based Sequencing With Varying Voltage Stimulus," U.S. patent application Ser. No. 15/085,700 entitled "Non-Destructive Bilayer Monitoring Using Measurement Of Bilayer Response To Electrical Stimulus," and U.S. patent application Ser. No. 15/085,713 entitled "Electrical Enhancement Of Bilayer Formation," the disclosures of which are incorporated by reference in their entirety for all purposes.

4. Normalization and Base Calling

For each usable nanopore cell of the nanopore sensor chip, a production mode can be run to sequence nucleic acids. The ADC output data captured during the sequencing can be normalized to provide greater accuracy. Normalization can account for offset effects, such as cycle shape, gain drift, charge injection offset, and baseline shift. In some implementations, the signal values of a bright period cycle corresponding to a threading event can be flattened so that a single signal value is obtained for the cycle (e.g., an average) or adjustments can be made to the measured signal to reduce the intra-cycle decay (a type of cycle shape effect). Gain drift generally scales entire signal and changes on the order to hundreds to thousands of seconds. As examples, gain drift can be triggered by changes in solution (pore resistance) or changes in bilayer capacitance. The baseline shift occurs with a timescale of ~100 ms, and relates to a voltage offset at the working electrode. The baseline shift can be driven by changes in an effective rectification ratio from threading as a result of a need to maintain charge balance in the sequencing cell from the bright period to the dark period.

After normalization, embodiments can determine clusters of voltages for the threaded channels, where each cluster corresponds to a different tag species, and thus a different nucleotide. The clusters can be used to determine probabilities of a given voltage corresponding to a given nucleotide. As another example, the clusters can be used to determine cutoff voltages for discriminating between different nucleotides (bases).

Example methods of determining bases of a nucleic acid based on signal measurements are provided below. Although the examples may use voltage measurements for illustration, the example techniques equally apply to other signal measurements, such as current measurements.

II. Sources of Error

Once the usable cells of a chip are identified, a production mode can be run to sequence nucleic acids, e.g., each cell sequencing one nucleic acid. The signal values measured during sequencing can be normalized to provide greater accuracy. For instance, the voltage level data that is acquired during a bright period of the AC drive voltage (referred to herein as the "bright mode voltages" or alternatively as the "bright period voltage") can be normalized. For example, the bright mode voltages can be normalized by dividing each measured bright mode data point by the bright mode voltage of the cell when the nanopore is in an unthreaded state, referred to herein as the "open channel voltage" or "bright mode open-channel voltage." By normalizing the bright mode voltage level data, the dynamic range of the raw ADC measurements is rescaled to a normalized range, generally to provide a range between 0 and 1, although values greater than 1 are possible, depending on the specific value used for bright mode open-channel voltage.

Normalization can allow compensating for changes to the system, e.g., changes in the electrical properties of a sequencing cell. For instance, the capacitances of circuit 400 may change over time. For example, the capacitance of capacitor 426 ($C_{Bilayer}$) can change because of physical changes in the bilayer area or thickness, e.g., at the edges of a well, where such change is referred to as gain drift. As another example, charge can build up in the cell as a result of differences in charge transfer between bright periods and dark periods, which is referred to as baseline shift (and sometimes fast baseline shift). A slow baseline shift can be caused by variability in the measurements circuit and changes in the electrical properties of the bilayer membrane. These examples are described in more detail below.

Such changes can affect the values measured for the exact same state, thereby causing instabilities. However, normalization can compensate for such changes to provide normalized values (e.g., voltages or currents) that are stable over time, thereby allowing greater accuracy in determining the sequence of a nucleic acid.

A. Idealized Normalization

Figure 6A:
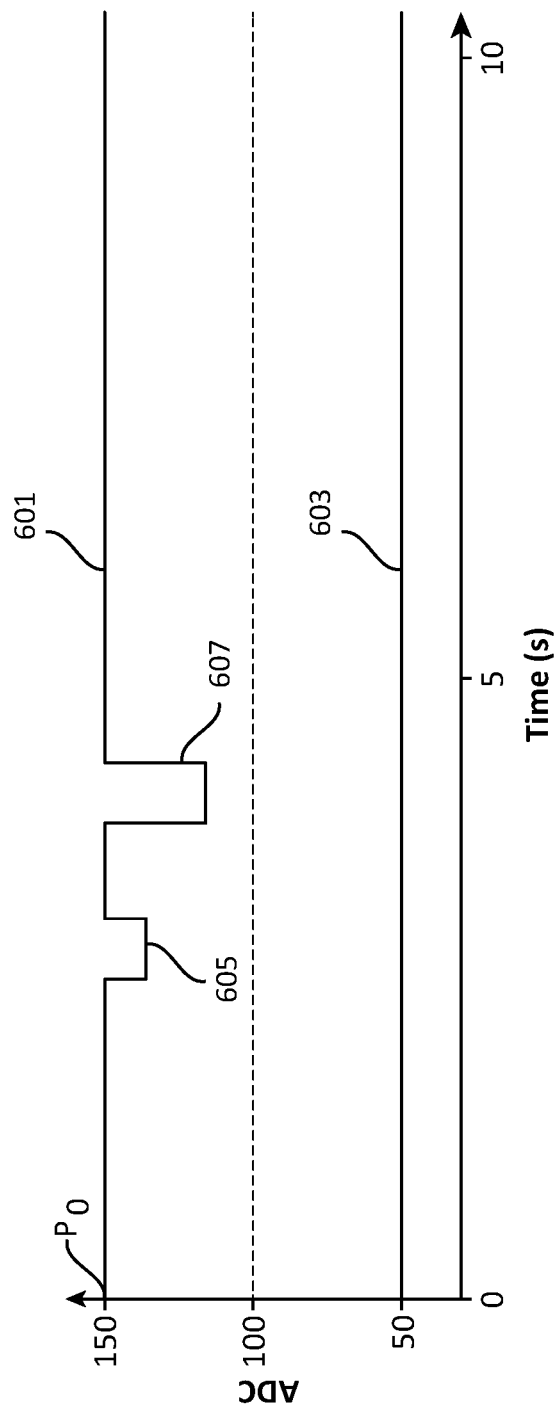
FIGS. 6A-6B illustrate the concept of normalization for an idealized ADC signal according to some embodiments.
Figure 6B:
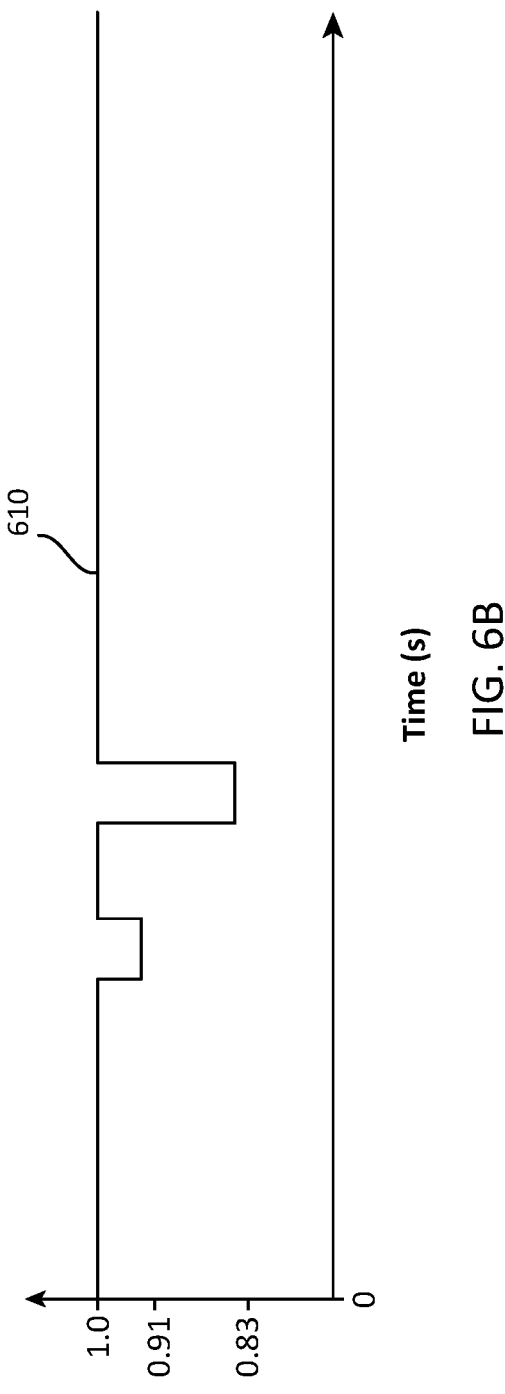

FIGS. 6A-6B illustrate the concept of normalization for an idealized ADC signal according to some embodiments. FIG. 6A shows idealized bright mode data 601 and idealized dark mode data 603 as might be measured by an ADC during a sequencing operation, e.g., as described above. The idealized ADC data of FIGS. 6A-6B is also shown on a much longer timescale than, e.g., the data described above in reference to FIG. 5. As such, the individual AC cycles are not visible in FIG. 5. Nevertheless, it should be understood that bright mode data 601 and dark mode data 603 are acquired during different half cycles of the AC drive voltage $V_{liq}$. Furthermore, the data shown in FIG. 6A are idealized in the sense that no noise, gain drift, and/or baseline shift is present, i.e., the open channel voltages (both bright mode and dark mode) are constant over an individual AC cycle as well as constant over time.

In addition, bright mode data 601 shows threading events 605 and 607 that correspond to two separate hypothetical threading events of two different tagged nucleotides. The measured voltages at threading events 605 and 607 are different due to the different tagged nucleotides being threaded. As shown here, the threading events occur over several AC cycles and occur on a fast enough timescale that during the threading events, no bright mode open-channel signal is measured. In some embodiments, one or more of threading events 605 and 607 could cause an increase in ADC values as opposed to a decrease. Such values can be referred to as above open channel.

In FIG. 6A, the open channel ADC value for the bright mode is represented by $P_0$, which may be used to normalize the ADC values for threading events 605 and 607. This normalization factor $P_0$ in this idealized example is constant at the measured value at t=0, which is 150 ADC values in this example. To perform the normalization in this case, all of the bright mode data can be divided by the same constant: $P_0=150$. For ease of description, the example of normalization by division is used throughout disclosure; however, one of ordinary skill will understand that multiplication by the inverse is mathematically equivalent, and thus may also be used without departing from the scope of the present disclosure.

FIG. 6B shows the normalized bright mode data 610 resulting from normalizing the idealized bright mode data 601 of FIG. 6A. In the normalized bright mode data, the open-channel level and the tag levels are not the raw ADC values, but rather span the range from 0 to 1. Because the bright mode open channel voltage is constant in this case, the normalization factor $P_0$ can be used to normalize the entire signal across the entire duration of the sequencing run. However, real signals suffer from a number of non-idealities that make this simple, single-valued normalization inaccurate. Two primary causes of errors in real sequencing systems are baseline shift and gain drift.

B. Gain Drift

Each sequencing cell has a voltage gain that depends on the lipid bi-layer capacitance. The gain corresponds to the voltage difference that is achieved between the two electrodes (e.g., counter electrode 210 and working electrode 202). For example, given the equation of $C=q/V$ for a capacitor, as the capacitance increases, the voltage would decrease when a same amount of charge is present. Accordingly, if the lipid bi-layer capacitance changes over time, then the voltage gain changes over time. If the voltage gain changes over time, then the bright mode and dark mode (both open channel and threaded) can change over time. In any real system, the bilayer capacitance may change over time, e.g., as the bilayer deforms. Such changes typically occur on the timescale of hundreds or thousands of seconds and, though slower than a typical threading event, still should be accounted for if high accuracy measurements are desired.

Figure 7:
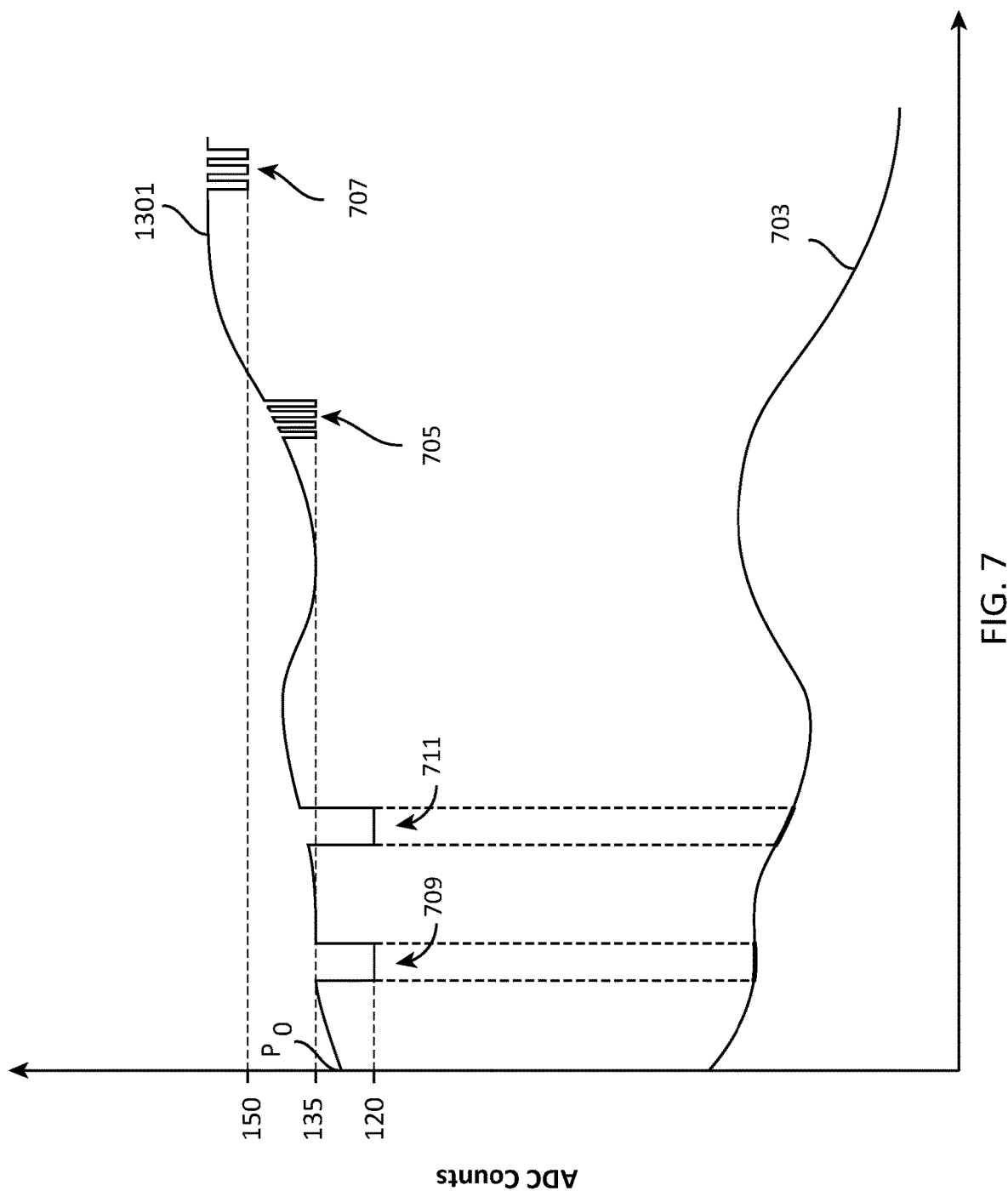
FIG. 7 shows an idealized signal that suffers from gain drift according to certain embodiments.

FIG. 7 shows an idealized signal that suffers from gain drift (with non-realistic timescales for both threading events and non-realistic gain drift to allow for both phenomena to be clearly shown on the same graph). Like FIGS. 6A-6B, FIG. 7 shows an idealized bright mode data 701 and idealized dark mode data 703 as would be measured by an ADC during a sequencing operation. The gain drift is illustrated as the overall drift in the open channel voltages for both bright and dark modes, with the drift being anti-correlated between bright and dark modes (e.g., when the bright mode increases, the dark mode decreases and vice versa). For the sake of clarifying the effect that gain drift has on measured ADC level of the same tag over time, 4 threading events are also shown, with each threading event involving the same species of tag, resulting in a same drop in voltage from the current open channel voltage. However, despite the fact that the same tag is being threaded during each event, the ADC value of this tag drifts over time. Thus, it could be the case that for this cell, the same tag could be detected anywhere within a range of 120 to 150. As a result, non-normalized levels would be error prone.

To correct for the gain drift, a normalization procedure similar to that described above in reference to FIGS. 6A-6B may be performed. However, unlike the case in FIGS. 6A-6B, the open channel voltage in the bright mode is not constant over time, so the single value normalization described above (i.e., divide everything by $P_0$) fails to normalize the entire signal over time. Instead of the constant normalization, a more complex variable normalization can be applied, e.g., the normalization can be accomplished by dividing each raw bright-mode measured ADC value with an estimate of that point's open channel value. For each non-threaded region, an estimate of the open channel voltage can be made by any number of ways, e.g., by taking a local mean value or by using more sophisticated signal processing technique such as an integrated histogram technique, as described in more detail below. Thus, a local estimate can be obtained for the open channel value for the bright mode, so as to normalize a data point using the estimated voltage that is local to that data point.

On the other hand, the threaded regions of the signal can provide a challenge. For some threading events, there may open channel data available if the threading rate is slow enough, e.g., as shown in threading events 705 and 707. When the threading rate is relatively slow, open channel values can be measured before the tag is threaded. Such open channel values can be measured for each cycle. This behavior is depicted in the comb-like lines shown for threading event 705 and 707. In these cases, the limited open channel data may be used to estimate the true open channel value during the threading event. This limited open channel data (i.e., limited relative to when no threading occurs) can be used to obtain a local estimate of the open channel value (e.g., local within time, so as to account for gain drift)

However, it may be the case that the threading is fast enough that no open channel data is captured in the bright mode, e.g., as shown for threading events 709 and 711. When the threading rate is sufficiently fast, the tag is immediately threaded, and no open channel values are measured. This lack of open channel voltages can be problematic when trying to determine a local estimate of the open channel; if there are not open channel values for a given time interval, no local estimate can be determined for that time interval. In these cases, it is possible to determine the local estimate for the open channel data in the bright mode using the dark mode data, as described in further detail below.

C. Baseline Shift

Baseline shift is a phenomenon that is related to charge imbalances that build up on certain elements (e.g., $C_{Double\ Layer}$) in the cell during the charging and discharging cycles that take place during the measurement process. For example, during the measurement process, excess charge can build up on the working electrode of the cell, represented by $C_{Double\ Layer}$ in FIG. 4. In one example, the charge imbalance is caused by the fact that both the nanopore and the tags have non-linear I-V characteristics. As a result of this nonlinearity, a charge and discharge cycle may not add or remove the same amount of charge to the capacitive elements. For example, negative and positive ions may not move from one electrode to the other electrode via the pore at the same rate over time, e.g., causing positive charge to build-up in the well. Note that the duty cycle can be 60% dark mode and 40% bright mode to address a typical difference in transmission rate of positive and negative ions, but when a rate changes, the duty cycle would have to change, which can be difficult to do.

As a result of this accumulated charge imbalance, the voltage measurements in a cell would increase (e.g., when positive charge builds up in the well). This shift in a baseline voltage can increase until it produces a voltage high enough to counterbalance the opposing voltage originally set up as a consequence of the charge imbalance. At which point, the charge can re-balance. Baseline shifts can occur in the both the dark mode and bright mode open channel states and in each of the four threaded states, with the magnitude and time constants for the shifts potentially being different in each of the open channel and four threaded states. As a result, the baseline shift can change in a generally random way that mirrors the stochastic binding events of the tags at the pore.

Figure 8:
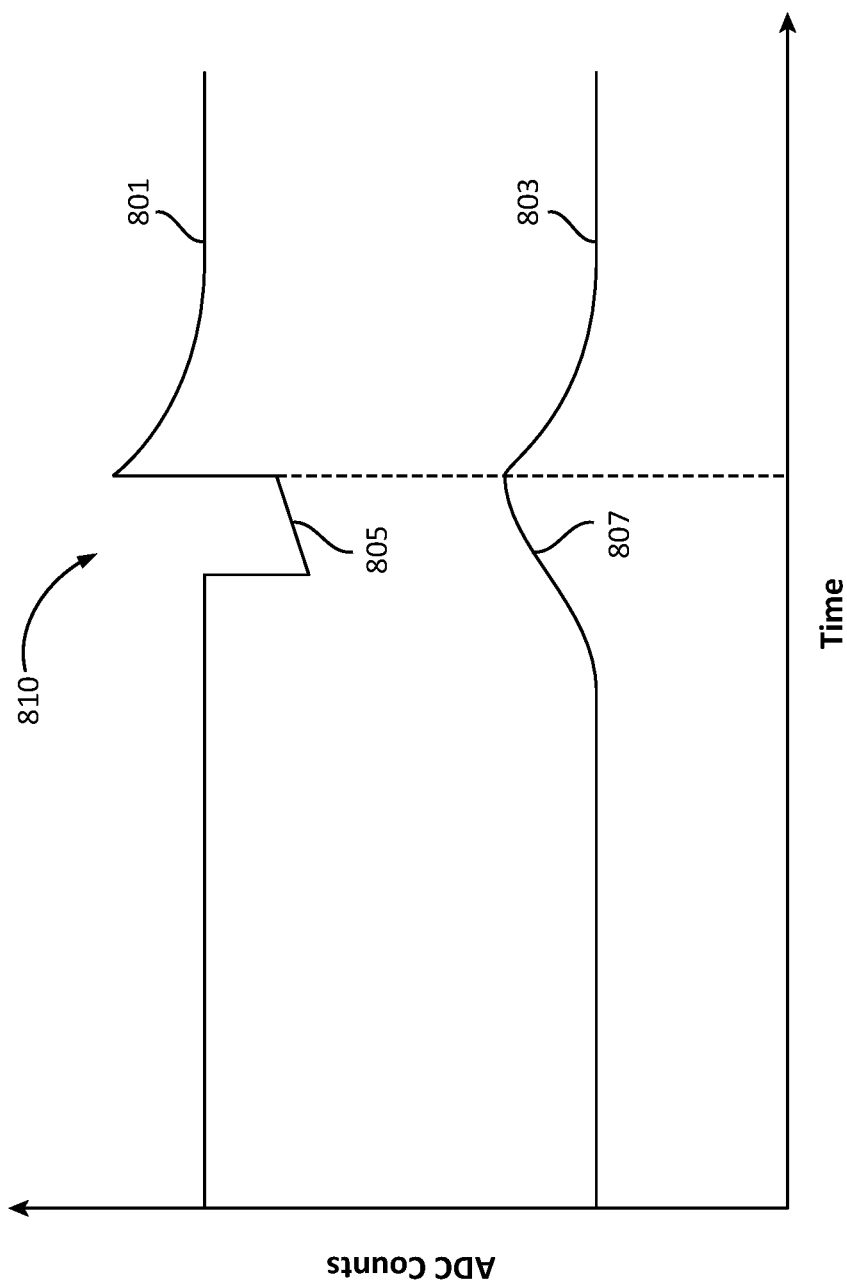
FIG. 8 shows an idealized signal that exhibits baseline shift according to certain embodiments.

FIG. 8 shows an idealized signal that exhibits baseline shift. Like FIGS. 6A-6B and FIG. 7, FIG. 8 shows an idealized bright mode data 801 and idealized dark mode data 803. This type of baseline shift generally occurs on a timescale that is on the order of the dwell time for a tag in a pore, a timescale that is generally much faster than the timescale for gain shift. Thus, gain shift is not shown in FIG. 8.

Before a threading event 810, the cell has reached equilibrium, i.e., the baseline voltage is what it needs to be to ensure equal charge transfer, e.g., to $C_{Double\ Layer}$ during the bright and dark modes. However, once the threading event 810 begins, the system is driven out of equilibrium. More specifically, while the effective resistance of the pore when the cell is in the dark mode stays the same, the effective resistance of the pore in the bright mode has increased. The increased resistance in the bright mode causes less charge to move during this mode, as compared to before the threading event occurred. Thus, a charge imbalance begins to form, which leads to upward shifts 805 and 807 in both the tag level and the dark mode open channel level, respectively.

As with the gain shift phenomenon, to compensate for baseline shift, a variable, point-by-point normalization can be applied, e.g., the normalization can be accomplished by dividing each raw bright-mode measured ADC value with an estimate of that point's open channel value. However, such a correction method can fail to properly normalize the threaded signals because of dynamical differences between the open channel and threaded channel signals. For example, if the open channel signal at time t is given by $P_{OC}(t)$ and the various threaded tag levels at time t are given by $P_i(t)$, where i=A, C, G, or T, the dynamics of the system can be modeled by the following two equations:

$$P_{OC}(t) = P_{OC}^0\left(1 + b*\left(1 - e^{-\frac{t}{T}}\right)\right) \quad (1)$$

$$P_i(t) = P_i^0\left(1 + b_i*\left(1 - e^{-\frac{t}{T}}\right)\right) \quad (2)$$

where $P_{OC}^0$ and $P_i^0$ are the values of the open channel and $i^{th}$ threaded channel at t=0, b is the open channel baseline shift at t=0, $b_i$ is the baselines shift at t=0 for the $i^{th}$ threaded channel, and T is the timescale associated with the baseline shift. A normalization method that relies on a point-by-point division of the bright mode data by a corresponding bright mode open channel signal can be effectively modeled by dividing equations (1) and (2) by equation (1), which yields Eqns. (3) and (4) for the normalized open-channel and tag levels, respectively:

$$P_{OC}^{NORM}(t) = 1 \quad (3)$$

$$P_i^{NORM}(t) = \left(\frac{P_i^0}{P_{OC}^0}\right)\frac{1 + b_i*\left(1 - e^{-\frac{t}{T}}\right)}{1 + b*\left(1 - e^{-\frac{t}{T}}\right)} \quad (4)$$

As can be seen in Eqns. (3)-(4) the OC levels are normalized perfectly for all time (by definition). In addition, if $b_i$=b then the time dependence drops out and Eqn. (4) reduces to $$P_i^{NORM}(t) = \left(\frac{P_i^0}{P_{OC}^0}\right) \quad (5)$$

However, in general, $b_i \neq b$ and the time dependence in Eqn. (4) remains resulting in the tag levels not staying constant for all time. Thus, any normalization of the tag levels that relies primarily on a point-by-point division by the open channel signal value can result in the normalized tag values still being time-dependent, even after normalization. The temporal variation of the tag levels, if large enough, can lead to downstream sequencing errors and it is therefore beneficial to employ signal processing techniques (in addition to point-by-point normalization by open channel values) to properly correct the data for baseline shift.

D. Variations in Zero Point Voltage

For electronic reasons, each cell can have a different zero-point voltage. The term zero-point voltage refers to the voltage output by a cell when 0 V is applied as input to the cell and is referred to herein as $V_0$. Variations in $V_0$ can be caused by manufacturing imperfections or variations between the analog circuitry of different cells in the chip. Also, for electrochemical reasons, a bias can be built into a cell. In addition, the surface chemistry of the electrodes may make them act as batteries, and thus each cell may have a slightly different potential that can contribute to the $V_0$ for each cell. The net effect of having a nonzero $V_0$ in a cell is that the measured ADC signal is artificially pushed up or down, depending on the value of $V_0$. Accordingly if $V_0$ varies over time, sequencing errors can result.

E. Sample Data Showing Gain Drift and Baseline Shift

Figure 9:
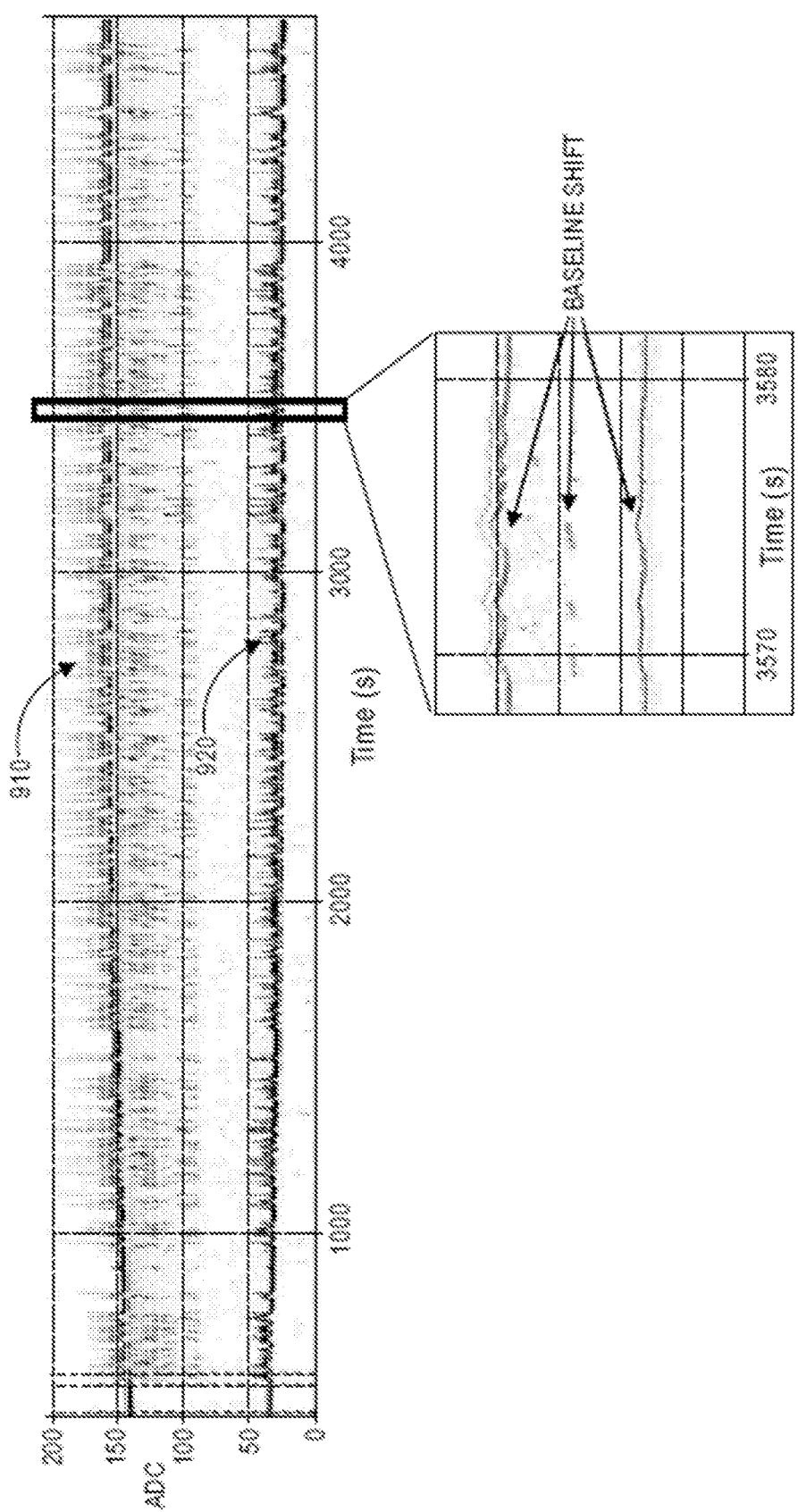
FIG. 9 shows one example of sample data for a raw sequencing signal that was measured from a nanopore cell over the course of approximately 5 seconds.

FIG. 9 shows one example of sample data for a raw sequencing signal that was measured from a nanopore cell over the course of approximately 5 seconds. The signal includes bright mode data 910 that includes multiple threading events and dark mode data 920. In response to threading events, both bright and dark mode data can suffer from relatively short term baseline shift as shown in the inset. On the longer time scale, e.g., on the order of seconds, the signal may also exhibit gain drift, which manifests in FIG. 9 as a slight and gradual change over time in the separation between the bright and dark channel signals. As can be seen in FIG. 9, the offset shift in the bright and dark channels is correlated, i.e., offset shift results in the bright and dark mode signals moving in the same directions, e.g., both modes shift upward or both shift downward. In contrast, gain drift is anti-correlated between the bright and dark channels, i.e., gain drift results in the bright and dark mode signals moving in opposite directions, e.g., if the bright mode drifts up the dark mode would drift down.

III. Signal Correction

A raw sequencing signal captured from a nanopore sequencing cell can suffer from a number of non-idealities including, e.g., gain drift, baseline shift, variations in the zero point voltage and other calibration issues as discussed above. One or more signal processing techniques can be employed to improve the raw sequencing signal such that sequencing errors are minimized.

The following sections describe methods for processing the raw sequencing signal to improve signal accuracy and stability. Section III(A) describes methods for correcting for and/or removing the effect of zero point voltage without explicit knowledge of any cell's $V_0$. Section III(B) describes methods that can minimize the effects of baseline shift, even when the dynamics of the open channel and threaded channel signals are different. Section III(C) describes methods that can be used to perform improved point-by-point normalization to correct for gain drift using open channel signal values that are tracked using a moving histogram technique. These methods may be used independently or in any combination to provide for improved signal processing methods in a nanopore sequencing cell.

A. Normalization without $V_0$

Embodiments can perform a calibration process to account for $V_0$ (also referred to as $V_{MZERO}$) as is described in U.S. patent application Ser. No. 15/632,190 entitled "Formation and Calibration of Nanopore Sequencing cells," the disclosure of which is incorporated by reference in its entirety for all purposes. For example, $V_0$ can be directly measured for each cell of the sequencing chip as part of a diagnostic routine that is run before each sequencing process. $V_0$ can be measured and updated regularly, stored in memory, and then subtracted from the measured bright mode and dark mode values before the performing 2D transformation processing and normalization procedures described above. However, inaccuracies can still result if the value of $V_0$ drifts from the stored value over the time period between the actual measurement of $V_0$ and the time that it is subtracted from the measured sequencing signal. According to certain embodiments, the system can employ improved processing methods that remove the requirement to track and remove $V_0$ and thus help alleviate errors caused by a time dependent $V_0$.

To illustrate an embodiment of the method it is useful to express the bright and dark mode voltage values in a functional from that expressly accounts for $V_0$ $$V_+ = m(V_{pos} - V_0) \quad (6)$$

$$V_- = m(V_{neg} - V_0) \quad (7)$$

where $V_+$ is the bright mode voltage measured by the ADC, $V_-$ is the dark mode voltage measured by the ADC, m is the gain of the system and $V_{pos}$ and $V_{neg}$ are voltages across the nanopore of the cell during the bright mode and dark mode respectively. Generally $V_{pos}$ can take 5 different values depending on the state of the nanopore: $V_{pos}^{OC}$ for the open channel state and $V_{pos}^{T_i}$ for each one of the threaded states corresponding to i=A, C, G, and T.

As described above in Section II(A), the normalization procedure can involve dividing the measured bright mode signal value by the corresponding open channel bright mode signal value. Using the functional form for the bright mode data introduced by Eqn. (6), the normalized values $f_i$ for each of the threaded states can be written in a form that explicitly accounts for the zero point voltage $V_0$ $$f_i = \frac{V_{pos}^{T_i} - V_0}{V_{pos}^{OC} - V_0} \quad (8)$$

where $V_{pos}^{T_i} - V_0$ is the measured bright mode threaded values for i=A, C, G, or T and $V_{pos}^{OC} - V_0$ is the measured bright mode open channel value.

Eqn. (8) shows that if $V_0$ changes over time, the particular numerical value for the normalized tag levels will also change, even if the raw threaded voltage $V_{pos}^{T_i}$ and the raw open channel voltage $V_{pos}^{OC}$ are each constant over time. Such a drift in the normalized tag levels can lead to downstream sequencing errors. As already briefly mentioned above, to correct for this source of error, the value of the zero point voltage $V_0$ can be measured frequently and subtracted from the measured open channel and threaded channel values before the normalization is done. However, this solution is problematic because it requires devoting valuable sequencing time to measuring $V_0$; and therefore introduces temporal blind spots or dead time into the sequencing process. According to certain embodiments, a modified normalization process can be employed that requires no prior knowledge of $V_0$ and thus does not require the measurement or tracking of $V_0$.

For example, an alternate normalization can be identified that does not depend on $V_0$ by recognizing that the zero point voltage $V_0$ shows up as merely an offset in both Eqs. (6) and (7). Accordingly, the offset can be eliminated by subtracting the dark mode data, expressed by Eqn. (7), from the bright mode data, expressed by Eqn. (6). Performing this subtraction on both the bright mode open channel data $V_+^{OC}$ and the bright mode threaded data $V_+^{T_i}$ results in the following alternative form for the normalization $$f_i' = \frac{V_{pos}^{T_i} - V_{neg}}{V_{pos}^{OC} - V_{neg}} = \frac{V_+^{T_i} - V_-}{V_+^{OC} - V_-} \quad (9)$$

This alternative form for the normalized values removes any explicit dependence on $V_0$ and thus $V_0$ need not be known to perform the normalization. Furthermore, the various terms in Eqn. (9) are each measured during a typical sequencing run and thus additional measurements are not required to perform the normalization. Additionally, if desired, the original normalized values, $f_i$, can be calculated from the redefined normalized values, $f_i'$ based on the following relationship $$f_i = f_i'(1 - f_-) + f_- \text{ with } i = A, C, G, \text{ or } T \text{ and } f_- = \frac{V_-}{V_+^{OC}}. \quad (10)$$

By subtracting the dark mode voltage from both the numerator and denominator of Eqn. (9) the effect of $V_0$ drift can be compensated for. In some embodiments, any variance in the raw signal values that is caused by a variance of $V_0$ is greatly reduced or even eliminated without needing to make any additional measurements to explicitly track $V_0$ during sequencing. As used herein the numerator and denominator of Eqn. (9) are referred to as the open channel and threaded channel zero point compensated signal values, respectively.

In view of the redefined normalization represented by Eqn. (9) it should be noted that the 2D transformation procedures described below in reference to Section III(B) can also benefit. More specifically, in the case of the rotation correction using the integrated history shown in FIGS. 12A-12C, the process can be modified by using the zero point compensated bright mode data as the input signal for the calculation of the integrated history (the x-axis). Likewise for the y-axis data, the zero point compensated bright mode data can be used. By using the compensated data any variance is caused by a changing $V_0$ in the bright mode data may be removed or minimized.

Figure 10:
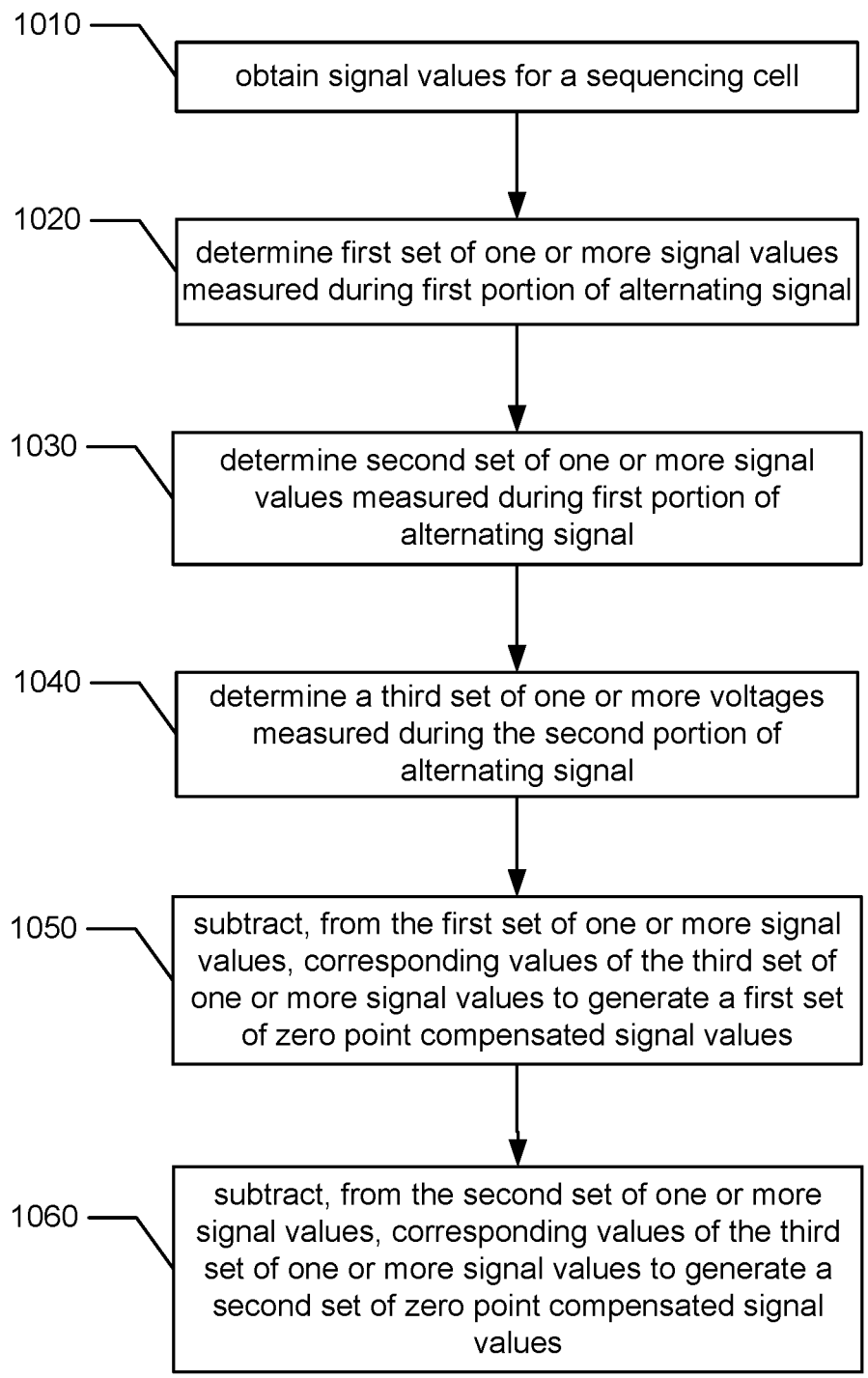
FIG. 10 shows a flow chart illustrating a method 1000 for processing a sequencing signal to remove the effects of a non-zero and varying $V_O$ according to certain embodiments.

FIG. 10 shows a flow chart illustrating a method 1000 for processing a sequencing signal to remove the effects of a non-zero and varying $V_0$ according to certain embodiments. In some embodiments, method 1000 may be performed by processor 224 of FIG. 2, digital processor 430, and/or any control logic coupled with the circuits of the sequencing cell.

In step 1010, multiple sequencing signal values $P(t_i)$ are obtained from the sequencing cell. The sequencing signal values can be voltages that are measured by an ADC and sent to a digital processor, e.g., ADC 410 and digital processor 430, as shown in FIG. 4. The digital processor can be part of a computer system that includes other components, e.g., as described in more detail below in reference to FIG. 20. The voltages may correspond to voltages that are measured over one or more bright periods that are themselves over one or more different AC cycles, i.e., it is not required that all the measured data be from the same bright period within a single AC cycle. Such measurements can occur as described herein and can occur at various times of sequencing different parts of a nucleic acid of a given cell. In some cases, the acquired voltages may vary from point to point (even for the same state of the nanopore) due to a variation in the zero point voltage of the cell over time. The applied voltage may be an alternating signal, e.g., an AC signal having a first portion (e.g., a bright period, also referred to herein as a "bright mode") and a second portion (e.g., a dark period, also referred to herein as a "dark mode") relative to a reference voltage. According to certain embodiments, the reference voltage may be a reference voltage (e.g., VPRE 405 in FIG. 4) that is applied to an integrating capacitor, e.g., ncap, as shown in FIG. 4.

In step 1020, a first set of one or more signal values is determined, e.g., one or more voltages measured during the bright period of the alternating signal are selected by the digital processor 430. The first set of voltages may correspond to various bright periods. Such measurements can occur as described herein and can occur at various times of sequencing different parts of a nucleic acid of a given cell. Furthermore, the first set of one or more signal values can correspond to various bright mode threaded channel signal values $V_+^{T_i}$ as described above in reference to Eqns. (6)-(9).

In step 1030, a second set of one or more signal values is determined, e.g., one or more voltages measured during the bright period of the alternating signal are selected by the digital processor 430. The first set of voltages may correspond to various bright periods. Such measurements can occur as described herein and can occur at various times of sequencing different parts of a nucleic acid of a given cell. Furthermore, the second set of one or more signal values can correspond to various bright mode open channel signal values $V_+^{OC}$ as described above in reference to Eqns. (6)-(9).

In step 1040, a third set of one or more signal values measured during the second portion of the alternating signal is determined, e.g., one or more voltages measured during the dark period of the alternating signal can be selected by the digital processor 430. The third set of one or more voltages can be measured across various dark periods and will correspond to the dark mode voltage signal values $V_-$ described above in reference to Eqns. (6)-(9).

In step 1050, corresponding values of the third set of one or more signal values are subtracted from the first set of one or more signal values, thereby generating a first set of one or more zero point compensated signal values. For example the subtraction shown in the numerator of Eqn. (9) can be performed by the digital processor 430. As described above, in reference to Eqn. (9), the resulting set of compensated bright mode threaded signal values will have a reduced variance due to the fact that the subtraction operation greatly reduces the effect of a fluctuating zero point voltage.

In step 1060, corresponding values of the third set of one or more signal values are subtracted from the second set of one or more signal values, thereby generating a second set of one or more zero point compensated signal values. For example the subtraction shown in the denominator of Eqn. (9) can be performed by the digital processor 430. As described above, in reference to Eqn. (9), the resulting set of compensated bright mode threaded signal values will have a reduced variance due to the fact that the subtraction operation greatly reduces the effect of a fluctuating zero point voltage.

Once the bright and dark mode zero point compensated signal values are determined, they may then be used in any other downstream signal processing method. For example, the open channel bright mode zero point compensated signal values may be used as normalization factors to normalize a set of bright mode threaded signal values. In some embodiments, the bright and/or dark mode compensated signal values can be further processed using a two-dimensional transformation to remove the effects of offset shift, as described below in Section III(B). In other embodiments, the bright mode compensated signal values may be used to form a histogram and this histogram can be used to obtain an improved estimate of the bright mode open channel value to be used for the normalization factor, as described below in Section III(C). Likewise, the zero point compensated signal values as determined by the above method can be determined by and output from the Zero Point Correction Module 1903, as described in further detail below in reference to FIG. 19.

B. Baseline Shift Removal by Two-Dimensional Transformation

As described above in reference to Eqns. (1)-(5), a point-by-point normalization technique can effectively correct for both gain drift and offset shift if the dynamics of the open channel signal and the threaded signals are the same. However, the dynamics of the open channel and threaded channel signals may not be the same. To better correct for both gain drift and baseline shift in the threaded signal, a method can be employed that processes a measured two-dimensional sequencing signal by way of a two-dimensional transformation, e.g., by using a rotation or a flattening transformation, as described in further detail below.

Figure 11:
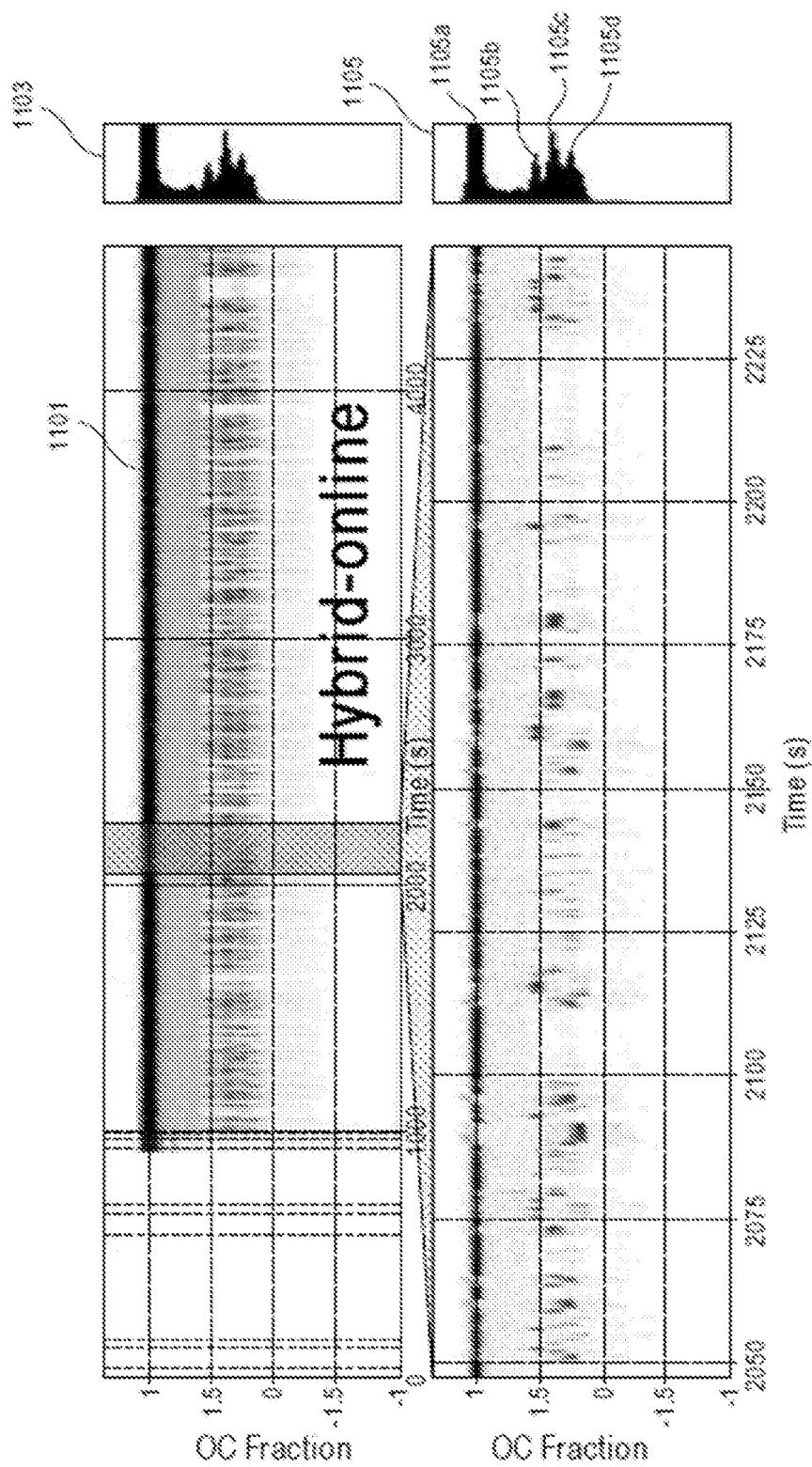
FIG. 11 shows an example of data that has been normalized using only a point-by-point open channel normalization routine that normalizes the measured bright mode signal using the open channel value according to certain embodiments.

The measured bright mode data can be represented by a one-dimensional array of signal values P ($t_i$) where, e.g., each point in the array is the bright mode signal value acquired at a time $t_i$. An example of such one-dimensional data is shown in FIG. 9, which shows bright mode data acquired over a time period of approximately 3.5 seconds. Ideally the values of the one-dimensional array P($t_i$) would only depend on the state of the nanopore and therefore would be consistent over time. In any real signal however, a given signal value that corresponds to a given pore state can vary in time and thus, the populations of signal values that correspond to the different nanopore states (open channel, and the four threaded states) are most accurately described by finite width distributions, each having some mean value. Stated another way, a histogram of the signal values acquired over some period of time will have 5 peaks of finite width, where the width of each histogram peak depends on the variance in the signal values that correspond to the different nanopore states. Histograms 1103 and 1105 in FIG. 11 show such examples. More specifically, histogram 1105 shows open channel peak 1105a and the threaded channel peaks 1105b, 1105c, and 1105d.

Having a large variance in a threaded channel value for a given pore state (e.g., a pore state corresponding to the threaded state of an "A" tag) is not ideal because it complicates the identification of that threaded tag (again, ideally a single threaded state would have a single consistent signal value over time). If the variance in one or more threaded state signal values are large enough, the signal value distributions for two different threaded states can overlap, making their identification within the sequencing signal difficult and error prone.

According to certain embodiments, the variance in the 1-dimensional data $P(t_i)$ can be accounted for and minimized by recognizing that the variance the 1-dimensional data $P(t_i)$ may be caused by the variation of some other uncontrolled variable that drifts or varies during the data acquisition period. For example, the particular value of $P(t_i)$ may depend on the amount of charge imbalance within the cell also at some time $t_i$, referred to herein as $Q(t_i)$. One way to account for the variance of $P(t_i)$ is to also measure the charge imbalance $Q(t_i)$ at every time $t_i$ and then process this two-dimensional data using some type of two-dimensional transformation to remove the variance in $P(t_i)$. More generally, each measurement of $P(t_i)$ can be paired with a measurement of another quantity $X(t_i)$, referred to herein as a correlated signal value to generate two-dimensional signal data point $S_{2D}=[X(t_i), P(t_i)]$. While the description below focuses on an example of two-dimensional signal data, the formalism can be extended to more than two dimensions without departing from the scope of the present disclosure.

This new two-dimensional dataset $S_{2D}$ can be used to find one or more two-dimensional transformations $R_{2D}$ that minimize the variance in the $P(t_i)$ dimension. In general, the two-dimensional transformation $R_{2D}$ can be represented as a two-by-two matrix as follows:

$$R_{2D} = \begin{bmatrix} \alpha & \beta \\ \gamma & \delta \end{bmatrix} \tag{11}$$

$S_{2D}$ can be represented as a column vector and thus the transformed signal values $S'_{2D}$ can be written as $$S'_{2D} = R_{2D} S_{2D} \tag{12}$$

$$\begin{bmatrix} X'(t_i) \\ P'(t_i) \end{bmatrix} = \begin{bmatrix} \alpha & \beta \\ \gamma & \delta \end{bmatrix} \begin{bmatrix} X(t_i) \\ P(t_i) \end{bmatrix} \tag{13}$$

$$X'(t_i) = \alpha X(t_i) + \beta P(t_i) \tag{14}$$

$$P'(t_i) = \gamma X(t_i) + \delta P(t_i) \tag{15}$$

According to certain embodiments, the correlated signal value $X(t_i)$ can be chosen to be anything that directly measures or is a proxy for a phenomenon that contributes to the variance of the bright mode signal values $P(t_i)$. For example, as described above, an offset shift may be the source of the variance in the measured $P(t_i)$ values because each measured bright mode point might have a slightly different offset shift. Furthermore, offset shift can be caused by a charge imbalance on one or more capacitive elements of the cell. Thus, to remove the variance in this example, the correlated signal value $X(t_i)$ should be chosen to be a measurement of the charge imbalance itself or a proxy for the charge imbalance, i.e., $X(t_i)$ should vary linearly with the charge imbalance. In the two examples that follow, the correlated signal value $X(t_i)$ is chosen to be either 1) a corresponding the dark mode signal value or 2) is what is referred to herein as an integrated history of the bright mode signal values. Both of these examples of the correlated signal value are proxies for, e.g., are linearly correlated with, the charge imbalance and can therefore be used to correct for offset drift in the bright mode signal data. As would be appreciated by one of ordinary skill in the art with the benefit of this disclosure, many other choices are possible for the correlated signal value.

In some embodiments, it can be beneficial to employ a 2D transformation that does not preserve the aspect ratio of the one or more clusters of data after they are transformed. For example such a 2D transformation is given by the transformation matrix $$R_{2D} = \begin{bmatrix} 1 & 0 \\ \rho_i & 1 \end{bmatrix} \tag{16}$$

Such a transformation can be beneficial because due to the fact that that in includes only a single transformation parameter $\rho_i$, also referred to herein as the "transformation parameter," it is computationally less demanding to both determine and apply to the data. In some embodiments, the transformation shown in Eqn (16) can be independently applied to different clusters of signal values in the 2D plane, possibly with different $\rho_i$'s being applied to different clusters, as described in more detail below. For example, a transformation parameter that is to be applied only to a cluster of bright mode open channel data (e.g., cluster 1201 in FIG. 12A) is referred to as $\rho_{OC}$, and a transformation parameter that is to be applied only to the group of bright mode threaded channel data clusters (e.g., clusters 1203, 1205, 1207, and 1209) is referred to as $\rho_{Th}$. In each case, the reduced transformation results in a linear mixing between the two dimensions of the signal data. For example, for the case of transforming bright mode open channel data $P_{OC}(t_i)$, the transformed open channel data $P'_{OC}(t_i)$ is given by the following equation $$P'_{OC}(t_i) = P_{OC}(t_i) + \rho_{OC} X(t_i) \tag{17}$$

And thus, the transformed signal value is the raw open channel signal value with some contribution from the correlated signal value added to it. The contribution from the correlated signal value is determined by the magnitude of the transformation parameter $\rho_{OC}$.

In accordance with some embodiments, the transformation parameter $\rho_{OC}$ is determined to be the transformation parameter that results in the flattest cluster of transformed open-channel data $P'_{OC}(t_i)$, e.g., the slope of a line fit through the transformed cluster is zero.

Threaded signal values can also be transformed similarly. For example the following transformation can be applied $$P'_{Th}(t_i) = P_{Th}(t_i) + \rho_{Tr} X(t_i). \tag{18}$$

The transformation parameter $\rho_{Th}$ can be chosen to provide for maximal distinguishability between then threaded peaks within a histogram of the data as described more detail below.

In illustrative examples disclosed herein, the particular form for the 2D transformation can be determined by finding the 2D transformation that maximizes the distinguishability between the different peaks in a histogram of the measured data. The histograms can be calculated from the measured time series data of the signal values by counting the number of signal values that fall within certain bins, where the bins span the dynamic range of the signal values (measured as either voltage or ADC counts). FIG. 11 shows histogram 1103 that is calculated using raw data and, as a result, has poor distinguishably between peaks, e.g., peak 1105*d* is visible as one smeared peak when ideally it should be two separate peaks. In contrast, FIG. 16B shows histogram 1605 that is calculated using data that was previously transformed using a 2D transformation with peaks that are more distinguishable than the peaks of histogram 1103.

In some embodiments, the optimal 2D transformation can be computed by optimizing properties of the histogram and stored in memory to be used for subsequent sequencing runs and/or can be updated periodically. For example, the optimal 2D transformation can be determined to be the 2D transformation that minimizes the minimum values between peaks (or subset of peaks) in the histogrammed data. In another example, the optimal 2D transformation can be determined to be the 2D transformation that maximizes the distance between the peaks (or subset of peaks) of the histogram. In some embodiments, the histogram can be modeled using a mixture model, e.g., a Gaussian or Laplacian mixture model, and the various parameters of the model, e.g., peak locations, minima values, etc.) can be used as parameters in an optimization function for determining the best 2D transformation.

In some embodiments, the optimal 2D transformation can be the transformation that leads to the flattest set of clusters or subset of clusters in the 2D plane. Such a transformation can be found by determining the 2D transformation that minimizes cluster mixing when the clusters of the 2D data are partitioned using horizontal lines (i.e., using thresholds that are constant in the x-dimension).

For the sake of simplicity, the illustrative examples discussed herein assume that the signal acquisition time is the same for both the bright mode signal values and the correlated signal values. However this need not be true in other embodiments and the bright mode and correlated signal values may be acquired at different times as long as some association can be made between the bright mode value measured at one time and the correlated signal value made at some other time.

I. 2D Transformation in the Dark-Bright Plane

According to certain embodiments, the dark mode signal data is chosen to be the correlated signal value $X(t_i)$ that has a corresponding value for each measured bright mode signal value $P(t_i)$. In this example, the dark mode signal is also used as a proxy for the charge imbalance induced baseline shift in the raw sequencing signal. Accordingly, a dark mode signal value can be measured and paired with each bright channel signal value to generate a two-dimensional sequencing signal $S_{2D}$ that can then be used to find a two-dimensional transformations $R_{2D}$ that minimize the variance in the bright mode signal $P(t_i)$.

Returning briefly to FIG. 9, it can be seen from the inset that both bright and dark channel data suffer from the baseline shift phenomena. Furthermore, it can be seen that the baseline shifts for bright mode data 910 and dark mode data 920 are correlated. According to certain embodiments, an improved method for correcting for offset shift in the bright mode data can leverage this correlation. For example, a two-dimensional sequencing signal $S_{2D}=[X(t_i), P(t_i)]$ can be captured, where in this case the correlated signal values $X(t_i)$ corresponds to the acquired dark mode signal values. This two-dimensional sequencing signal can then be used to identify a two-dimensional transformation $R_{2D}$ that when applied to the two-dimensional sequencing signal, reduces the variance in the bright mode signal data $P(t_i)$. For the sake of simplicity, this transformation will be referred to herein as a "rotation" in the dark-bright plane, but generally any two-dimensional transformation (not just rotations) may be employed without departing from the scope of the present disclosure. Furthermore, as would be appreciated by one of ordinary skill in the art with the benefit of this disclosure, a rotation of the data clusters or a rotation of the coordinate system are equivalent and thus, either method can be employed without departing from the scope of the present disclosure.

Figure 12A:
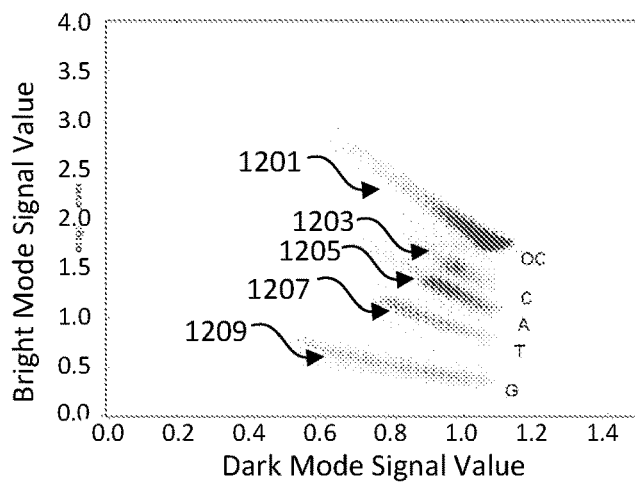
FIGS. 12A-12C show offset shift correction by rotation in the dark-bright plane according to certain embodiments.
Figure 12B:
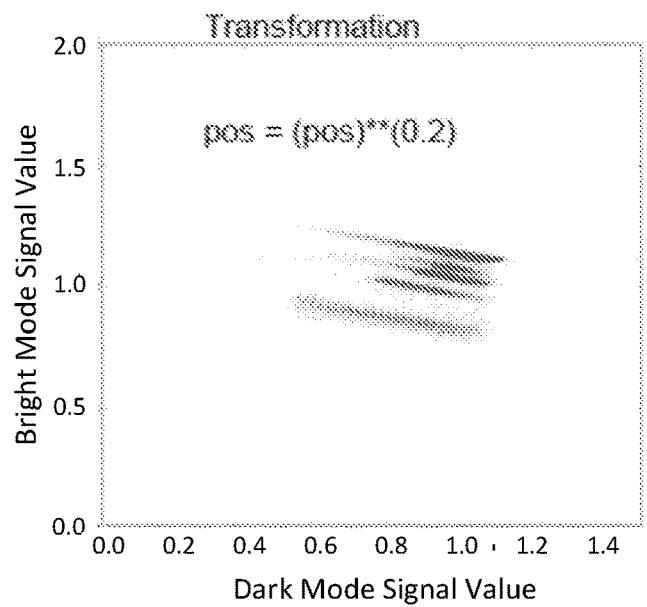
Figure 12C:
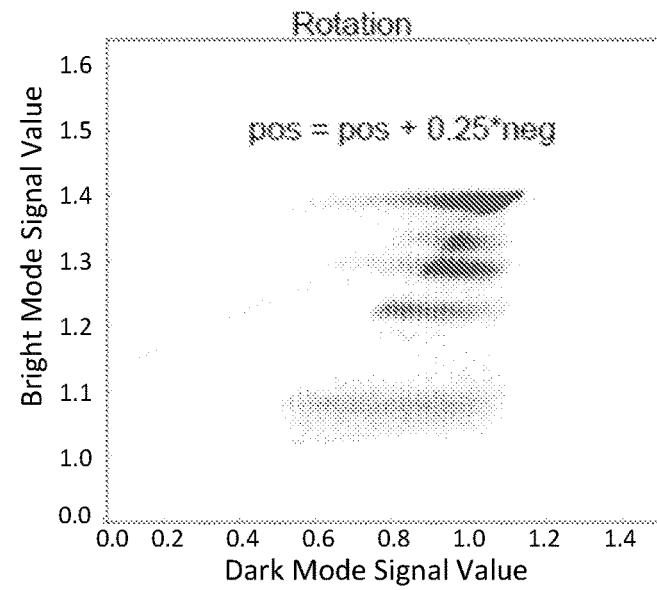

FIGS. 12A-12C show offset shift correction by rotation in the dark-bright plane according to certain embodiments. FIG. 12A shows an example of a plot of a two-dimensional sequencing signal $S_{2D}=[X(t_i), P(t_i)]$ in the dark-bright plane in order to illustrate the starting point for the method. More specifically, the x-coordinate of any point is given by a dark mode value $X(t_i)$ measured at time $t_i$ and the y-coordinate is the corresponding bright mode value $P(t_i)$. According to certain embodiments, the respective measurement times for the bright and dark points that comprise $S_{2D}$ need not be the same or simultaneous, but instead may be different times without departing from the scope of the present disclosure. In some embodiments, a bright mode signal value is paired with a dark mode signal value based on time, e.g., the first acquired bright mode point in a bright mode period is paired with the first acquired dark mode point found in the next dark mode period, or, e.g., the bright mode signal value is paired with a dark mode value that is either immediately before or immediately after the bright period from which the bright mode signal value is acquired, such that the duration of time between the bright and dark mode signal values is as small as possible. In other examples, an average dark mode value is paired with one or more bright mode values. Many other combinations are possible as can be appreciated by one of ordinary skill in the art having the benefit of his disclosure.

As can be seen in FIG. 12A, plotting the data in the dark-bright plane shows that the various data points $S_{2D}$ form natural clusters 1201, 1203, 1205, 1207, and 1209, representing the open channel measurements and threaded values for the four different tags corresponding to the C, A, T, and G bases, respectively. These clusters are generally elongated in shape, with their major axes pointing up and to the left, i.e., not horizontal relative to the dark mode axis. Thus, the preprocessed data is not optimized to minimize the variance of the data in the $P(t_i)$ dimension (i.e., the vertical dimension). In fact, the natural shape of the data clusters hints at the fact that a two-dimensional transformation $R_{2D}$ exists that can rotate and/or flatten each individual cluster such that the variance in the $P(t_i)$ dimension is minimized.

Before the data is transformed in the dark-bright plane, the data may be preprocessed by scaling to either compress or extend the dynamic range of the signal in one or more directions. For example, FIG. 12B shows the original signal, with the y-axis values scaled by taking these values to the ⅕ power, i.e., $y_{transformed}=y^{1/5}$. In this example, the original y-range of the data spanned (approximately) from 0.5 to 2.5 and after the scaling transformation the y-range is compressed to span (approximately) from 0.7 to 1.4. As would be appreciated by one of ordinary skill in the art with the benefit of this disclosure, this scaling step is optional and, in addition, any form of scaling function (in either the x or y dimension) may be applied without departing from the scope of the present disclosure.

FIG. 12C shows the resulting data after $R_{2D}$ is applied to the two-dimensional data. In this example, the 2D transformation $R_{2D}$ leaves the x-coordinate of each raw data point unchanged and maps the y-coordinate to a new position:

$$x_t^{R2D}=x_t \tag{19}$$

$$y_t^{R2D}=y_t+0.25x_t \tag{20}$$

Alternatively the 2D transformation can be represented by the matrix multiplication $$R_{2D} = \begin{pmatrix} 1 & 0 \\ 0.25 & 1 \end{pmatrix} \begin{pmatrix} x \\ y \end{pmatrix} \quad (21)$$

where in this case, the x-component is given by the dark mode value and the y-component is given by the bright mode value as already described above in reference to FIGS. 12A-12C.

In the example described above, the same transformation $R_{2D}$ is applied to every data point regardless of which cluster it belongs to. According to certain embodiments, independent transformations can be applied to each data point, based on the cluster that the data point belongs to. For example, the open channel data cluster can be flattened/rotated using one transformation, the threaded C cluster can be flattened/rotated by a different transformation. In some embodiments, the open channel cluster can be transformed using one transformation while the four clusters representing the threaded values can be transformed using a different transformation. Likewise, for applications that use dark mode data, the dark mode data cluster can be transformed using a third transformation that is different from the transformation used on the bright mode open channel and threaded values. In general, the precise entries for the 2D transformation $R_{2D}$ may be determined numerically by, e.g., optimizing the transformation such that a linear fit to the transformed data has zero slope, or e.g., by finding the transformation that maximizes the separation between the threaded levels.

2. 2D Transformation in the Integrated History—Bright Mode Plane

Rather than using the dark mode signal values, as described above, according to certain embodiments, a form of running average of the bright mode data, what is referred to herein as the "integrated history" of the bright mode data, is chosen to be the correlated signal value $X(t_i)$. In this example, the integrated history signal is also used as a proxy for the charge imbalance induced baseline shift in the raw sequencing signal. Accordingly, an integrated history signal value can be measured and paired with each bright channel signal value to generate a two-dimensional sequencing signal $S_{2D}$ that can then be used to find a two-dimensional transformations $R_{2D}$ that minimize the variance in the bright mode signal $P(t_i)$.

The integrated history may be computed by summing (i.e., integrating) the historical bright mode data over a certain time window to compute a single integrated history value. In some implementations, the integrated history may be computed on a running basis for each newly acquired measured bright mode data point $P(t_i)$. This can be accomplished using a recurrence relation (like that shown in Eqn. (22) below) that computes a corresponding updated integrated history value $H(t_i)$ using the prior value of the integrated history $H(t_{i-1})$. Older data points may also be discounted over time, e.g., historical data may be effectively discounted exponentially as that value ages by scaling this data by a weighting factor that decreases as the age if the data increases, e.g., as is done in Eqn. (22) below.

In other implementations the age of each acquired data point to be used for the integration can be stored separately and then used to apply a data point specific weighting factor before the integration is computed. For example, an exponential weighting factor $$A = e^{-\frac{ndt}{T}}$$

can be applied to each acquired data points and the integration is then performed by summing up all of the individually the weighted points. In this example, dt is the acquisition period (measured in seconds), n is the age of the data point (the number of acquisition periods that have elapsed since the data point was acquired), and T is an exponential decay parameter that can be chosen based on how quickly one desires to downgrade the contribution of the historical data to the integral.

Returning to the example of an integrated history computed by recurrence relation, the time weighted integrated history process described above may be implemented by software, hardware or any combination thereof that results in a computation of the following recurrence relation:

$$H(t_i) = (1-\alpha)H(t_{i-1}) + \alpha P(t_i) \quad (22)$$

where $0 < \alpha < 1$ is a constant that parameterizes how much to weight the historical data relative to the current data point when computing each integrated history. The parameter $\alpha$ is referred to as the decay rate and is given by $$\alpha = 1 - e^{-\frac{dt}{aT}} \quad (23)$$

where dt is the acquisition time step and T the measured time constant associated with the step response of the working electrode in the cell, and $\alpha$ is a "memory rate" parameter that can be set to increase or decrease the time it takes the algorithm to "forget" the historical data, i.e., it can set how quickly the historical data is downgraded. Eqn. (22) has the beneficial property that the nominal value of $H(t_i)$ is equal to the nominal value of the input. For example, during long open channel periods, i.e., long periods with no threading events, the integrated history equals the open channel level.

To form the 2D data points, a bright mode data point that is measured at time $t_i$ is associated with a corresponding integrated history value $H(t_i)$, and these two points can form the two-dimensional sequencing signal $S_{2D} = [H(t_i), P(t_i)]$ to be processed as 2-dimensional data, similar to the process described above in reference to FIGS. 12A-12C. For example, the transformed data can be computed using the following equation $$P'_k(t_i) = \frac{P_k(t_i) + \rho_k H(t_i)}{1 + \rho_k} \quad (24)$$

where the index k runs over the different clusters that are being transformed, e.g., open channel or threaded channel clusters. For example, one transformation with the transformation parameter $\rho_{OC} = 0.01$ could be applied to flatten the open channel data cluster and a different transformation with the transformation parameter $\rho_{Th} = 0.02$ could be applied to flatten the threaded data clusters.

For example, for the case of the threaded values, the transformed signal values can be computed by the following equation $$P'_{Th}(t_i) = \frac{P_{Th}(t_i) + \rho_{Th}H(t_i)}{1 + \rho_{Th}} \quad (25)$$

The transformed threaded signal values $P'_{Th}(t_i)$ can then be normalized according to the following equation $$N_{Th}(t_i) = \left(\frac{P'_{Th}(t_i)}{P'_{OC(t_i)}} - 1\right)(1 + \rho_{th}) + 1 \quad (26)$$

where the mathematical operations in addition to the division of $P'_{Th}(t_i)$ by $P'_{OC}(t_i)$ are added to keep the normalized levels $N_{Th}(t_i)$ in the range from 0 to 1 and also to keep the threaded tag fractions constant for all values of $\rho_{th}$. Accordingly, if $\rho_{th}$ is small, Eqn (26) reduces to usual normalization defined above in Eqn (5), i.e., $$\frac{P'_{Th}(t_i)}{P'_{OC}(t_i)}.$$

In some embodiments, the dark mode data can also be transformed via two dimensional transformation to flatten this data to remove the effects of baseline shift. For example the raw dark mode data $D(t_i)$ can be transformed according to the following equation $$D'(t_i) = \frac{D(t_i) + \rho_D H(t_i)}{1 + \rho_D}, \quad (27)$$

where $D(t_i)$ is the dark mode signal value and $\rho_N$ is the transformation parameter determined to flatten/rotate the dark mode data cluster and $H(t_i)$ again is the integrated history of the bright mode signal. In some embodiments, the transformed dark mode data $D'(t_i)$ can be used for optional zero point correction as described above in reference to Section III(A). In that case, to minimize noise propagation from the negative channel to the positive channel, the flattened negative channel data can be filtered through an exponential filter before it is used. In some embodiments, the dark mode level can be tracked with a moving histogram like the bright mode open channel values, as described below in reference to Section III(C).

Figure 13A:
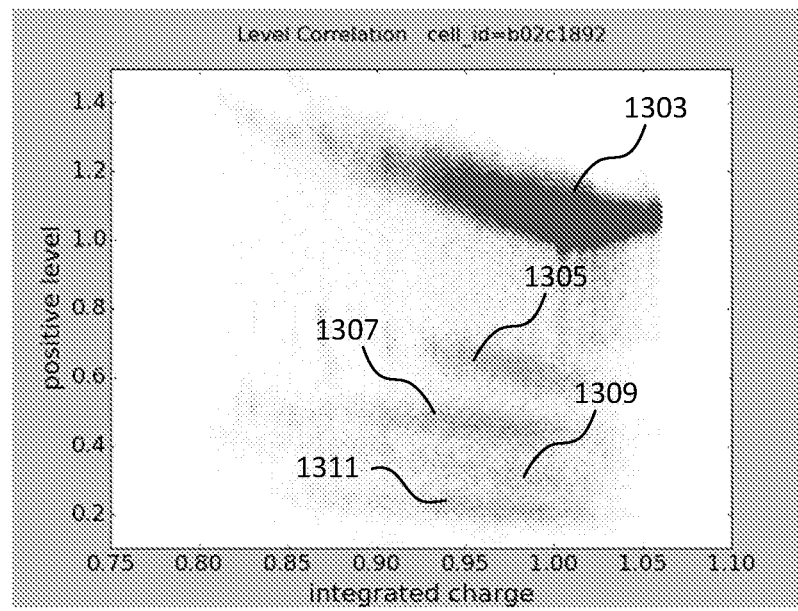
FIGS. 13A-13B show plots that illustrate a method for offset shift correction by transformation in the 2D plane defined by the integrated history value and bright value according to certain embodiments.
Figure 13B:
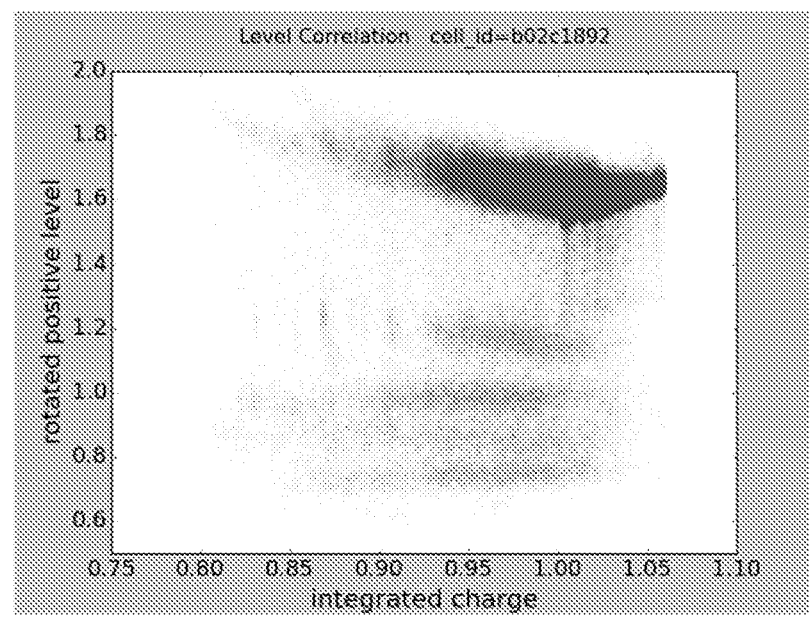

FIGS. 13A-13B show plots that illustrate a method for offset shift correction by transformation in the 2D plane defined by the integrated history value and bright value according to certain embodiments. Plotted in this two-dimensional space, the relevant bright mode signals, e.g., OC, A, C, G, and T, clearly show up as five distinct clusters of data points 1303, 1305, 1307, 1309, and 1311, respectively. Like the clusters described above in reference to FIGS. 12A-12C, they are tilted relative to the horizontal axis (the integrated history axis).

According to certain embodiments, the processing of the 2D data shown in FIGS. 13A-13B takes place in a manner that is similar to that described above in reference to FIGS. 12A-12C and the details will not be repeated here for the sake of conciseness. Like FIG. 12C, FIG. 13B shows "rotated" or "flattened" data having separations between the various levels that is improved relative to the unprocessed data.

3. Illustrative Flow Charts for 2D Transformation Methods

Figure 14:
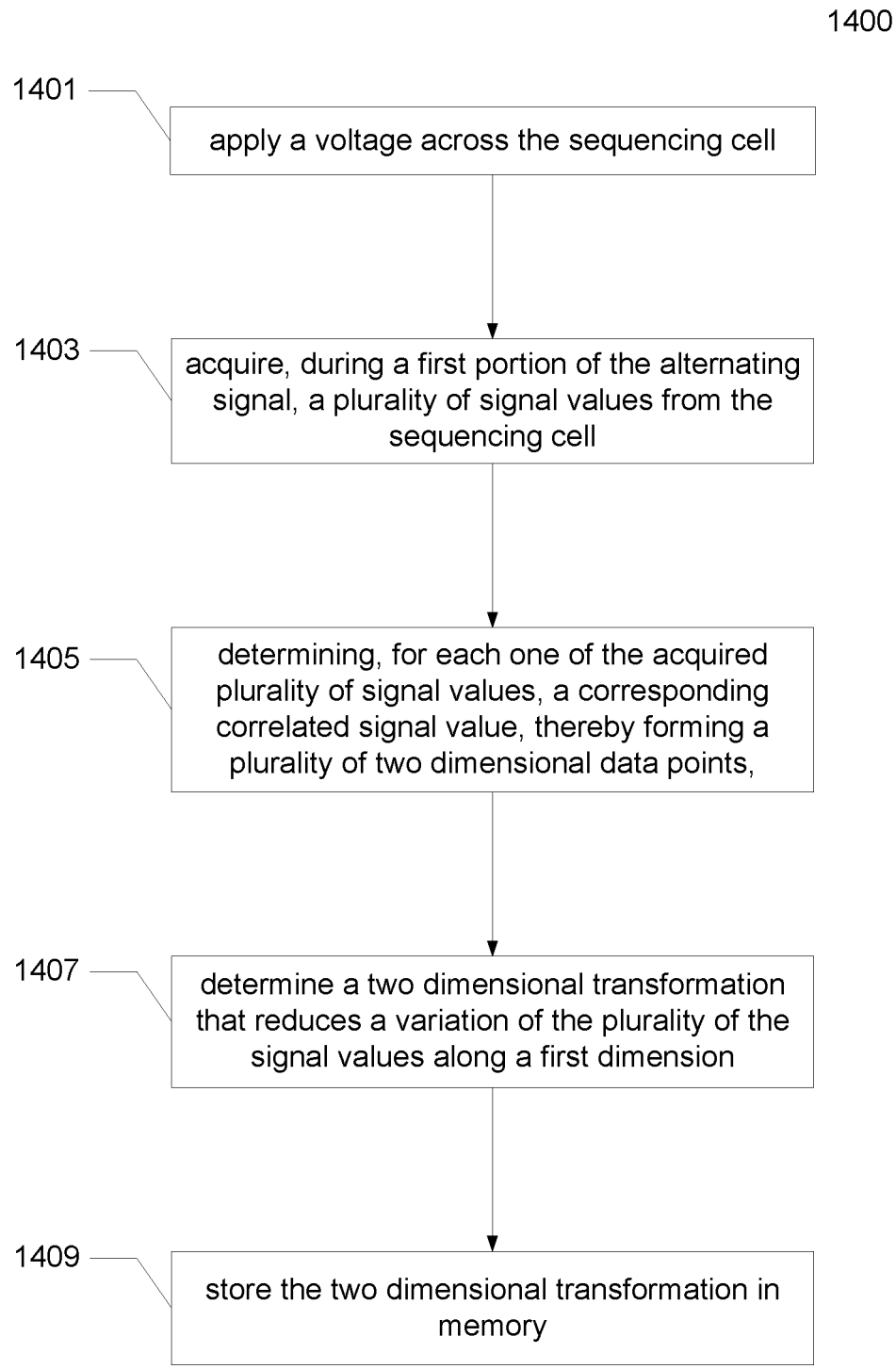
FIG. 14 shows a flow chart that illustrates a method 1400 of using a sequencing cell, according to certain embodiments.

FIG. 14 shows a flow chart that illustrates a method 1400 of using a sequencing cell, according to certain embodiments. More specifically FIG. 14 describes a method for determining a two-dimensional transformation that can be used to correct sequencing signal data. In some embodiments, method 1400 may be performed by processor 224 of FIG. 2, digital processor 430, and/or any control logic coupled with the circuits of the sequencing cell.

In step 1401, a voltage can be applied across a sequencing cell that includes a nucleic acid. The applied voltage may be an alternating signal, e.g., an AC signal having a first portion (e.g., a bright period, also referred to herein as a "bright mode") and a second portion (e.g., a dark period, also referred to herein as a "dark mode") relative to a reference voltage. According to certain embodiments, the reference voltage may be a reference voltage (e.g., $V_{PRE405}$ in FIG. 4) that is applied to an integrating capacitor, e.g., $n_{cap}$, as shown in FIG. 4.

In step 1403 multiple sequencing signal values $P(t_i)$ are acquired from the sequencing cell. According to some embodiments, the sequencing signal values can be voltages that are measured by an ADC and sent to a digital processor, e.g., ADC 410 and digital processor 430, as shown in FIG. 4. The digital processor can be part of a computer system that includes other components, e.g., as described in more detail below in reference to FIG. 20. The voltages may correspond to voltages that are measured over one or more bright periods that are themselves over one or more different AC cycles, i.e., it is not required that all the measured data be from the same bright period within a single AC cycle. Such measurements can occur as described herein and can occur at various times of sequencing different parts of a nucleic acid of a given cell. In some cases, the acquired voltages may vary from point to point (even for the same state of the nanopore) due to a variation in the offset shift of the cell. Accordingly, the set of acquired voltages taken as a population will have some variation (quantified as a variance) that is due at least in part to the variation in the offset shift.

In step 1404, a set of corresponding correlated signal values $X(t_i)$ are determined by, e.g., by the digital processor. As described above in Section III(B)(1)-(2), the correlated signal values can be determined a number of different ways, e.g., by taking a corresponding dark mode value or by computing a corresponding integrated history value (integrated histories). In either case, the data of the originally 1-dimensional measured signal values $P(t_i)$ is expanded into a set of two-dimensional data points $S_{2D}=[X(t_i), P(t_i)]$, where each signal values $P(t_i)$ measured at time $t_i$ is paired with a corresponding correlated signal value $X(t_i)$.

In step 1405, a two-dimensional transformation that reduces the variation of the plurality of measured signal values is determined by the digital processor. In some embodiments, the two-dimensional transformation is determined such that when it is applied to the set of two-dimensional data points, it compensates for the variance in the voltage offset shift of the cell. More specifically, for two-dimensional data that can be expressed in a two-dimensional space defined by the values $[X(t_i), P(t_i)]$ the transformation is chosen to minimize the variance (i.e. to flatten the data) in the $P(t_i)$ dimension, i.e., the dimension defined by the originally measured bright mode signal values $P(t_i)$. In some embodiments, the two-dimensional transformation can take the form of Eqns. (11) and/or (16) above.

As described above in reference to FIGS. 12-13, the data $S_{2D}$ can naturally form data clusters, e.g., five data clusters corresponding the open channel state of the nanopore and the four threaded states of the nanopore. In some embodiments, a single two-dimensional transformation is chosen that transforms all the of the clusters in the same way, e.g., rotates all clusters by some angle φ. In such a case, the transformation can be chosen to minimize the variance of one cluster only, to minimize the variance of more than one cluster simultaneously, or to maximize the separation between clusters, as described above in Section III(B). In other embodiments, more than one transformation can be employed, e.g., five different transformations can be found that transform the five data clusters differently to minimize the variance in each cluster separately.

In step 1407, the two-dimensional transformation is stored in memory, e.g., in a memory that is accessibly by the digital processor and/or a computer system that has been programed to transform the sequencing signal data as it is acquired.

Once a two-dimensional transformation is determined and stored in memory, it can be used to process sequencing signal data to reduce or minimize the effects of baseline shift on the signal values. For example, each new processed data point can be computed from the measured signal data using Eqns. (24), (25), or (26) depending on the cluster the data point belongs to.

Figure 15:
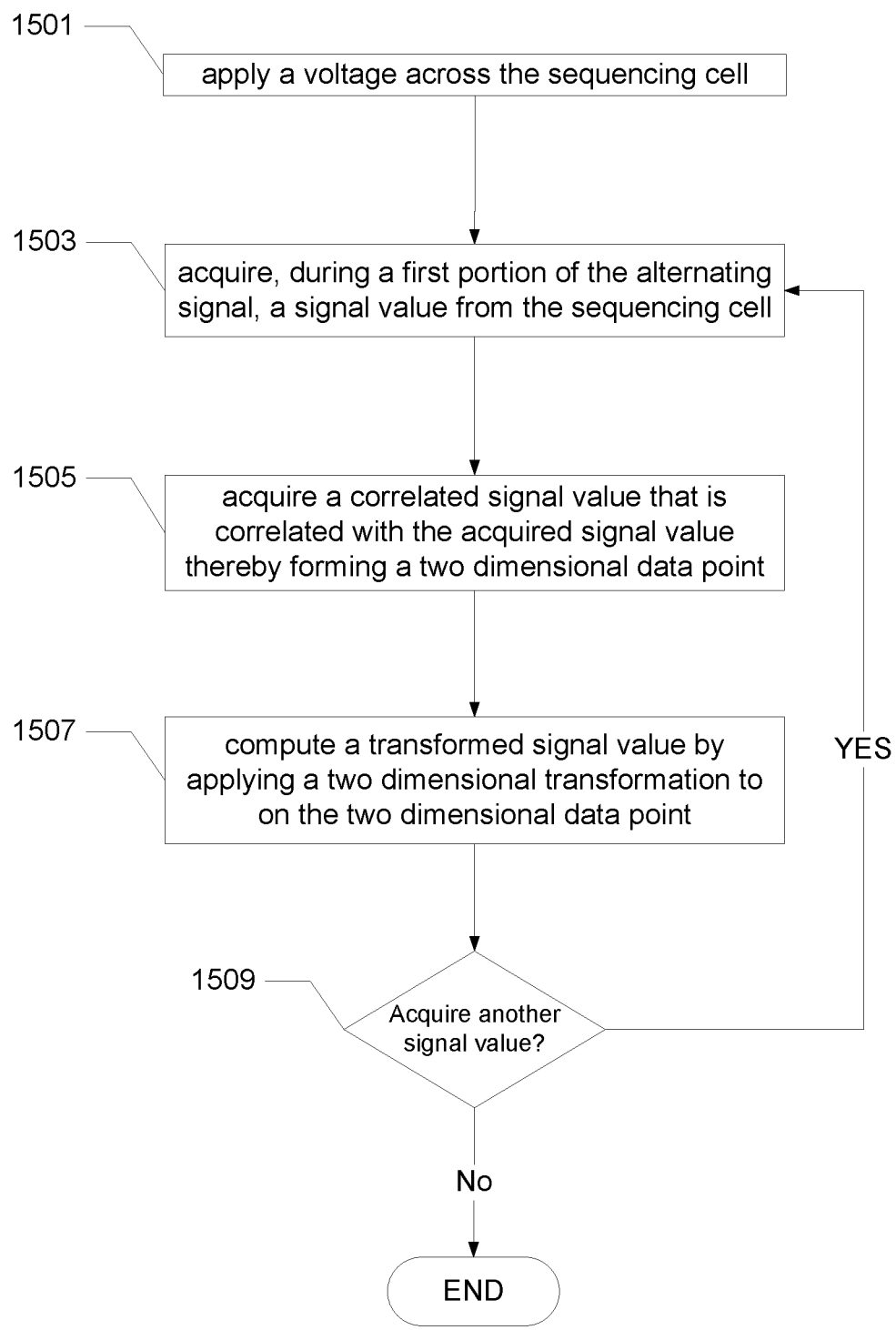
FIG. 15 shows a flow chart that illustrates a method of using a sequencing cell, according to certain embodiments.

FIG. 15 describes an acquisition and transformation loop that can provide for baseline shift removal by applying a two-dimensional transformation to sequencing signal data on a point-by-point basis, as new data points are acquired. In some embodiments, method 1500 may be performed by processor 224 of FIG. 2, digital processor 430, and/or any control logic coupled with the circuits of the sequencing cell.

In step 1501, a voltage is applied across the sequencing cell in a manner that is similar to that described above in reference to FIG. 14, step 1401.

In step 1503, one or more signal values from the sequencing cell are acquired during the first portion of the alternating signal. This step is again similar to that described above in reference to FIG. 14, step 1403.

In step 1505, one or more correlated signal values are acquired in a manner similar to that described above in reference to FIG. 14, step 1405.

In step 1507, one or more transformed signal values are computed by applying a two-dimensional transformation on the two-dimensional data points. For example, as described above in Section III, the two-dimensional transformation $R_{2D}$ can be applied to the two-dimensional data points $S_{2D}=[X(t_i), P(t_i)]$. According to certain embodiments, $R_{2D}$ can be represented as a 2-by-2 matrix and applying the transformation can involve performing a matrix multiplication $R_{2D}S_{2D}$. The components of $R_{2D}$ can be previously determined and accessible via memory, e.g., according to the method described above in reference to FIG. 14.

According to certain embodiments, the same transformation $R_{2D}$ can be applied to all the two-dimensional data points or different transformations can be applied to different classes or clusters of data points. For example, if the data point is determined to likely be an open channel data point (or belong to the cluster of open channel data points), an open channel specific transformation can be applied to that data point. Likewise, if a data point is determined to likely be a threaded data point (or belong to one or the four clusters of threaded tag data points), then a threaded-state specific transformation can be applied. Furthermore, it is also possible to apply tag specific transformations based on a determination that a data point is associated with the threaded state of a particular tag. According to certain embodiments, the particular category of the data point to be process can be estimated based on the raw value of the bright mode value of the data point, i.e., by the value of the raw $P(t_i)$ For example, one or more thresholds can be predetermined determined and the category of the data point can be estimated based on whether the value $P(t_i)$ is above, below, or within the threshold value(s). For example, $P(t_i)$ values above a certain threshold can be determined to be open channel values and thus an open channel specific transformation can be applied to these values. In some embodiment, each new processed data point can be computed from the measured signal data point by using Eqns. (24), (25), or (26) depending on the cluster the data point belongs to.

In step, 1509 a decision is made whether continue the acquisition and transformation loop, i.e., whether or not to acquire and process another data point. This consideration can take into account any number of factors, including, e.g., memory and/or bandwidth limitations or, e.g., whether or not the system was preprogramed to acquire and process a certain number of data points during the loop. While the example shown here illustrates a case where each data point is processed by two-dimensional transformation on a point-by-point basis, the transformation can be applied after acquiring a group of data points without departing form the scope of the present disclosure.

While the methods described above, e.g., in reference to FIGS. 14-15, relate to acquisition and transformation of signal values that represent voltages, other types of signals are possible and thus other types of signal values may be processed without departing from the scope of the present disclosure. For example, the circuitry of a cell may be configured such that signal values represent measurements of voltages, currents, or any other quantity (e.g., time) that may be used to derive the voltage and/or current at any point in a circuit of the sequencing cell.

4. Comparison of Point-By-Point Normalization to 2D Transformation

The raw bright mode data, e.g., raw sequencing signal 910 shown in FIG. 9, can be processed using a point-by-point open channel normalization routine that divides each measured bright mode data point by a corresponding measured (or estimated) bright mode open channel value. For example, such normalization methods may be used as described in U.S. patent application Ser. No. 15/632,190.

FIG. 11 shows an example of data that has been normalized using only a point-by-point open channel normalization routine that normalizes the measured bright mode signal using the open channel value (measured, if one is available, or estimated, if no measured value is available). The open channel values 1101 are normalized quite well; the data is generally flat and clustered around a value of 1. However, even in the normalized signal, the threaded values (tag levels) are poorly differentiated, as can be seen by the low contrast between threaded value peaks in the histograms 1103 and 1105.

Ideally, the histograms should have 5 sharply delineated peaks for the OC, A, C, G, and T threaded levels each separated by minima having approximately zero counts. Instead, the histograms show only four peaks that are easily distinguishable, e.g., peaks 1105a, 1105b, 1105c, and 1105d.

Furthermore, two of the threaded tag levels seem to be blurred together within the final peak 1105*d*. Such poor separation between the tag levels can lead to serious difficulty for any process tasked with identifying which base is being sequenced at which time.

To provide improved differentiation between the threaded signal levels, one or more embodiments can preprocess the sequencing signal using one of the 2D transformations described above in reference to Sections III(B)(1)-III(B)(3) before applying any point-by-point normalization routine.

Figure 16A:
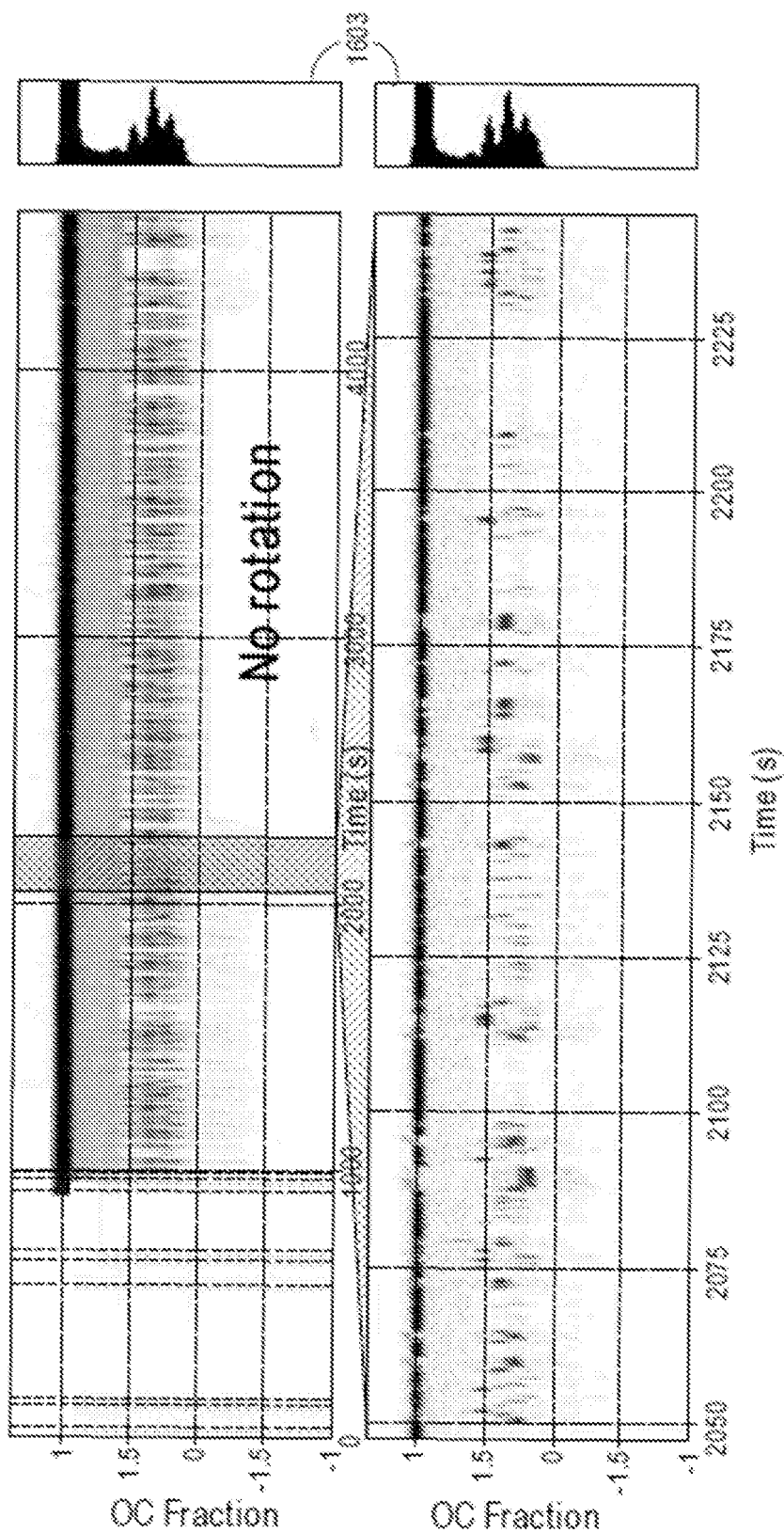
FIGS. 16A and 16B show a comparison of sample data processed by point-by-point normalization only and by two-dimensional transformation in the integrated history-bright mode plane followed by point-by-point normalization according to certain embodiments.
Figure 16B:
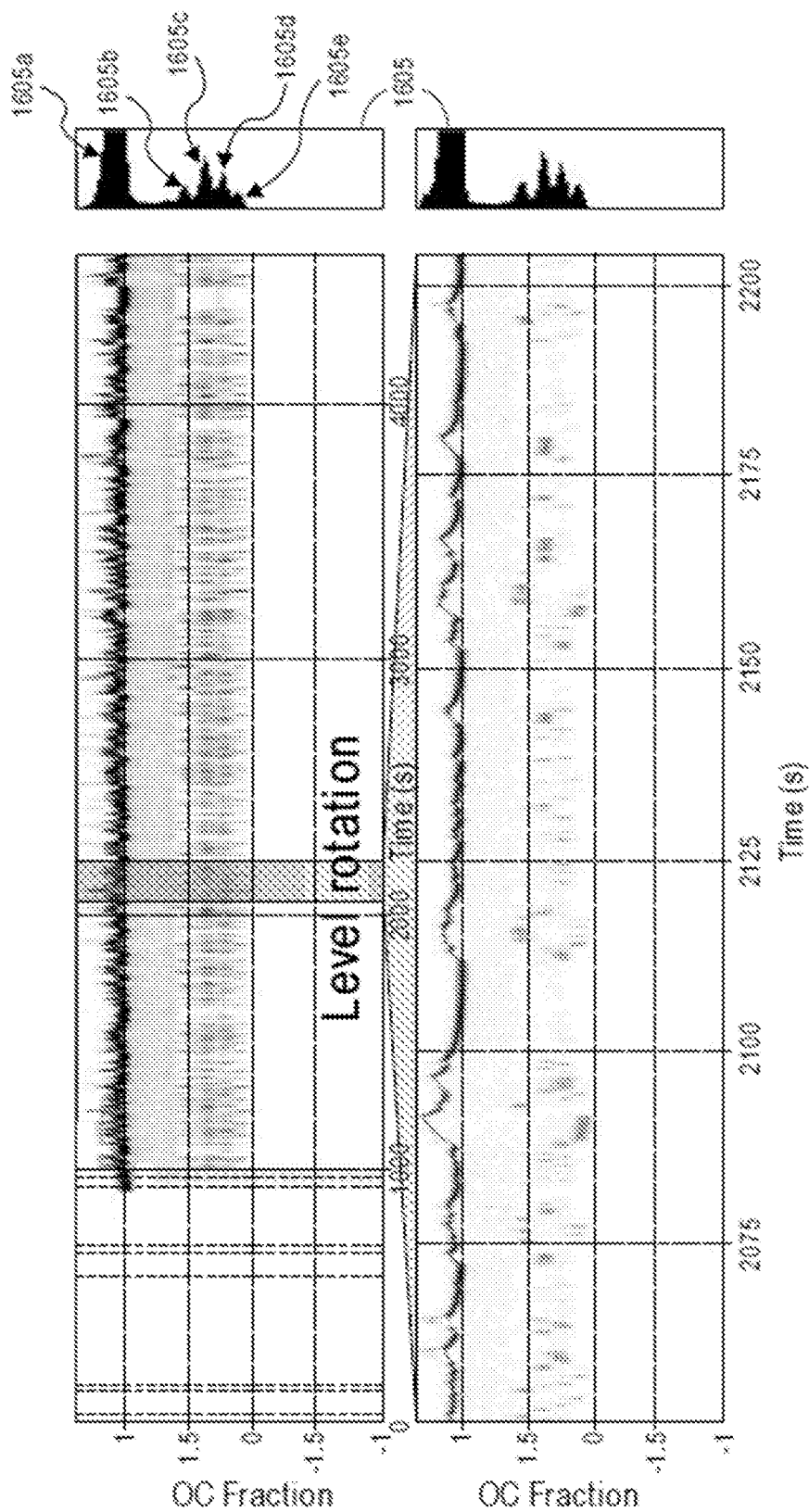

FIGS. 16A and 16B shows a comparison of sample data processed by point-by-point normalization only (FIG. 11 reproduced as FIG. 16A for convenience) and by two-dimensional transformation in the integrated history-bright mode pane followed by point-by-point normalization (bottom pane). As can be seen by the histograms 1603 and 1605 and the respective insets, the signal that has been preprocessed by 2D transformation using integrated history (shown in histograms 1605) has superior contrast to the bare point-by-point normalization (shown in histograms 1603) for all of the different signal levels. As compared to histograms 1603, histograms 1605 possess more distinguishable peaks for the open channel 1605*a* and the four threaded channels 1605*b*, 1605*c*, 1605*d*, 1605*e*. Accordingly, the processing technique that employs a two-dimensional transformation can provide for more accurate sequencing relative using only a point-by-point normalization technique.

C. Normalization Using Open Channel Tracking with Running Histogram

The bright mode open channel voltage can be tracked and used to normalize the raw sequencing signal, as briefly described above in Section III(A) and described in detail in U.S. patent application Ser. No. 15/632,190. One way to determine a bright mode open channel value to use for normalization is to choose a bright mode open channel data point that is closest in time to the data point that is to be normalized. In some situations, however, a suitable bright mode open channel value may not be present in the data. For example, for reasons having to do with threading dynamics, there may be very few, if any, open channel data points over the bright mode acquisition time period. Other methods can use a corresponding dark mode value to compute an estimated bright mode open channel value, but for certain system architectures, no dark mode data is available for this computation. For example, in certain architectures all of the ADCs of a certain region of the chip can be dedicated to obtaining only bright mode data during a certain time period. According to certain embodiments, a rolling histogram method may be employed to track an estimate of the bright mode open channel value in situations where other methods fail or produce non-ideal results.

Figure 17:
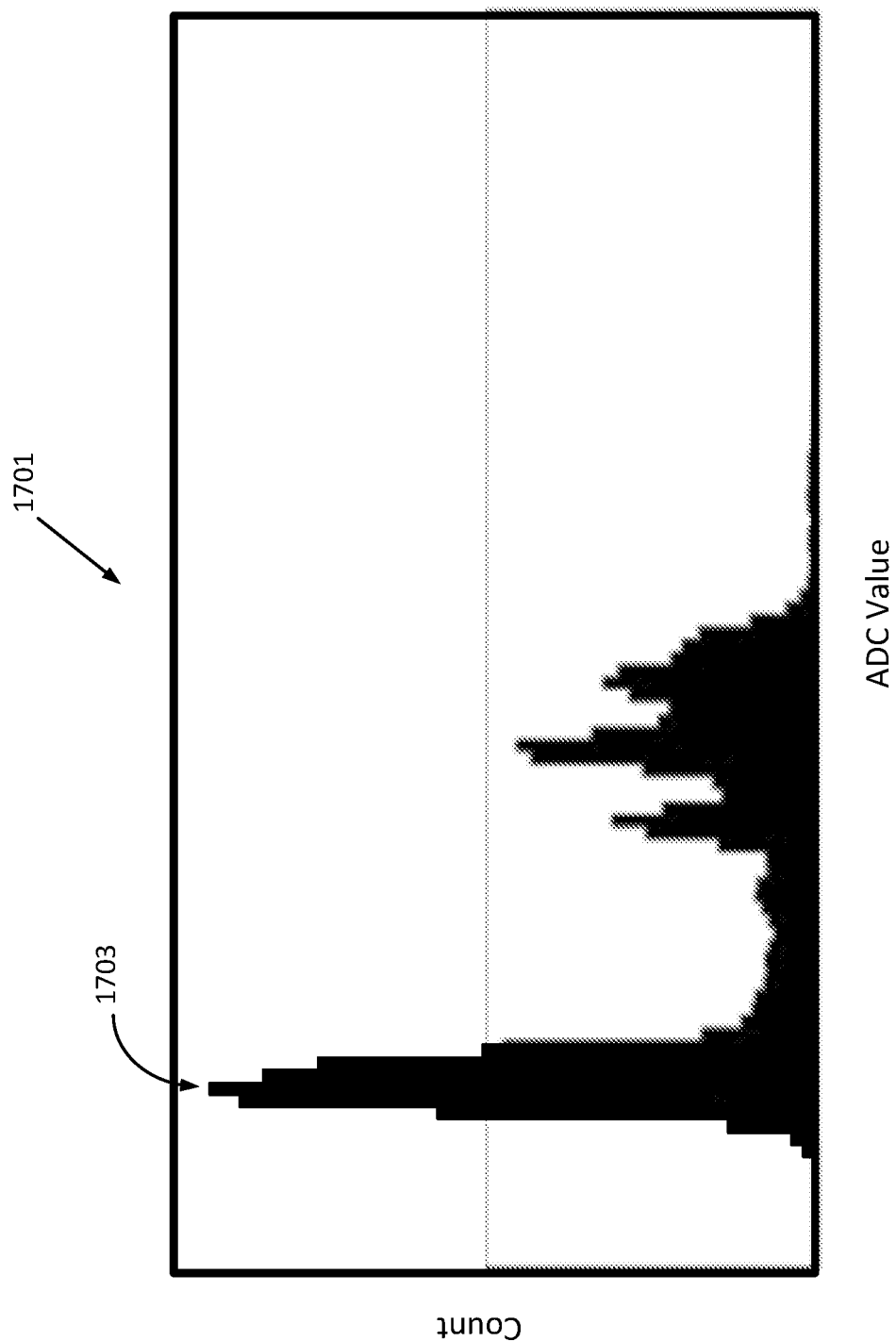
FIG. 17 shows one example running histogram 1701 that can be computed from processed sequencing signal data similar to that shown in FIG. 16B.

FIG. 17 shows one example running histogram 1701 that can be computed from processed sequencing signal data similar to that shown in FIG. 16B. According to certain embodiments, the histogram 1701 can be computed for a population of acquired bright mode data. For example, the data acquired during a window (e.g., ~4 s) of an acquisition run (like that shown in FIG. 14) could be organized into a histogram data structure like histogram 1701. To compute the histogram, bin widths can be chosen to span the dynamic range of the ADC, e.g., the histogram can include 256 bins of unit width corresponding to the ADC values of 0 to 255. As new data points are acquired, the count of the appropriate bin that maps to the acquired ADC value can be updated to keep the histogram updated over time. Once a histogram like histogram 1701 is computed, the open channel voltage can be identified by locating the bin with the largest population in the histogram, e.g., peak 1703.

1. Single Point Running Histogram

To implement a single point "running" histogram, the system can be configured to update the histogram over time by combining one or more newly acquired data points with the historical data according to one or more rules. For example, a histogram can be computed on a rolling basis whereby older data contributes less to any given bin by exponentially downgrading each point's contribution to the total count of the bin based on the age of the data point. For example, consider a bin B(i) that represents the $i^{th}$ bin in the histogram (e.g., the $128^{th}$ bin for ADC values that are equal to 127) and assume that the count of this bin is 1, i.e., it includes one previously measured data point. Further assume that this previously measured data point was acquired during the last acquisition period of the ADC. Now assume that a newly acquired data point also has an ADC value of 127 and therefore should also be added to the same bin as the previous data point. To combine the two data points according to an exponentially decreasing downgrading rule, the current data point is counted as 1 count and the previous data point is counted as some fraction of 1, where the fraction is determined by computing an downgrade coefficient and then weighting the count of the historical data based on the downgrade coefficient.

In some embodiments, an exponential downgrade coefficient such as $$A = e^{-\frac{ndt}{T}}$$

can be employed, where dt is the acquisition period (measured in seconds), n is the age of the data point (the number of acquisition periods that have elapsed since the data point was acquired), and T is an exponential decay parameter that can be chosen based on how quickly to downgrade the contribution of the historical data. In this example, assume that the T=dt for simplicity. Because the historical data point was acquired during the last acquisition cycle, n=1 and therefore $A=e^{-1} \approx 0.37$. Thus, the new bin value would be 1.37 (rather than 2, if no downgrading was used). The simple downgrading example described above can be extended to any number of bins and data sets having any number of data points with associated timestamps. According to certain embodiments, the time constant T for the exponential downgrade in the moving histogram method may be also related to the timescale for the gain change.

2. Iterative Running Histogram

In some embodiments, a running histogram method can be implemented by updating the histogram bin population values $B_t(i)$ according to the following method. First, a histogram is initialized by acquiring data over some predetermined initialization time period $t_{init}$. Then, when a new data point is acquired, it is first determined which histogram bin that new data point belongs in, referred to herein as the active histogram bin k. Next, the population B in the active bin will be updated according to the following recurrence relation $$B_t(k) = \beta * B_{t-1}(k) + (1-\beta)N_e \qquad (28)$$

and the population in the inactive bins, bins having i≠k, will be downgraded according to the following recurrence relation $$B_t(i \neq k) = \beta * B_{t-n1}(i \neq k) \qquad (29)$$

where $0<\beta<1$ is a downgrade coefficient that acts to progressively downgrade the contributions of older histogram data to the updated population. The parameter $N_e$ is referred to herein as the effective number of histogram bins and is chosen to keep the overall population of the histogram approximately constant over the course of a sequencing run. More specifically, without the scaling by $N_e$ in Eqn. (28) the total population in the histogram could decrease over time because the population in bins i≠k will be downgraded according to Eqn. (29). Accordingly, a value for $N_e$ is chosen to counteract this reduction by adding an approximately equal population to the active bin that was removed from the inactive bins as a result of the application of Eqn. (29). In some embodiments, the effective number of bins $N_e$ is set to be the number of bins in the histogram that have non-zero population and could be, e.g., half the total number of bins in the histogram.

The index n is introduced in Eqn. (29) to decouple the update rate of the non-active histogram bins from the data acquisition. For example, in some embodiments, for n=1, both the active histogram bin and the remaining bins are updated every acquisition cycle. Likewise for n=2, the non-active bins are only updated every 2 cycles. Updating the non-active bins only every n acquisition cycles can decreases the overall processing time of the running histogram method.

Employing one of the rolling histogram methods described above for locating and tracking the bright mode open channel value can be more robust than other methods because the methods do not require any dark-channel data and therefore can be used in certain high-throughput modes of the system that have no usable dark channel data. Furthermore, because the method retains historical information in the form of the running histogram, the method can be used to track the open channel level even if minimal and or no open channel data is available, e.g., due to a high rate of threading events. Finally, the rolling histogram method for tracking and estimating the open channel data can be an improvement over other methods such as the use of a Kalman filter because it does not depend on hard coded thresholds to define a range within which the likely open channel value resides. Rather, the open channel can be found based on the data in the histogram itself, e.g., using a peak finding routine. This is possible because the open channel value will often be the largest peak in the histogram, e.g., largest amplitude peak.

In some embodiments, the histogram bin having the largest population (e.g., the largest peak in the histogram) can be taken as the open channel value. Embodiments may further employ a window method that accepts the largest peak only if the largest peak is within an allowed window to avoid tracking threaded levels during long threading events (also referred to as dwell events). In some embodiments, the window width can be dynamically updated to some fraction of the open channel peak in the histogram, e.g., 2.3 times of the full width half max (FWHM).

In the case when the new open channel value is outside the window, a secondary peak (e.g., second largest) is searched between the old open channel peak and the new maximum peak. If the secondary peak is found, meets a peak height requirement, and the secondary peak is within the window, it is accepted as the new OC value. By allowing the secondary peak to possibly serve as the open channel peak, permanent open channel level jumps can be accommodated. This secondary peak search can also ensure that the proper open channel value is tracked even during long dwell events as long as there is some amount of open channel events that also occur during the dwell. Such secondary peak tracking can provide an improvement to address failure rates for open channel when looking at AOC (above open channel) levels, as well as below open channels.

In some embodiments, the input data to the running histogram is processed, e.g., flattened, by a two dimensional transformation as described above. For example, the open channel values $P_{OC}(t_i)$ can be paired with integrated history values $H(t_i)$ and can be processed according to the following equation:

$$P'_{OC}(t_i) = \frac{P_{OC}(t_i) + \rho_{OC} H(t_i)}{1 + \rho_{OC}} \qquad (30)$$

Once the open channel value is determined, that value can be used to normalize the other signal values to ensure that the values for the tag levels are constant in time. For example, a normalization can be applied that divides each threaded signal value by the estimate of the open channel value determined by the running histogram method.

3. Illustrative Flow Chart for Running Histogram Normalization Methods

Figure 18:
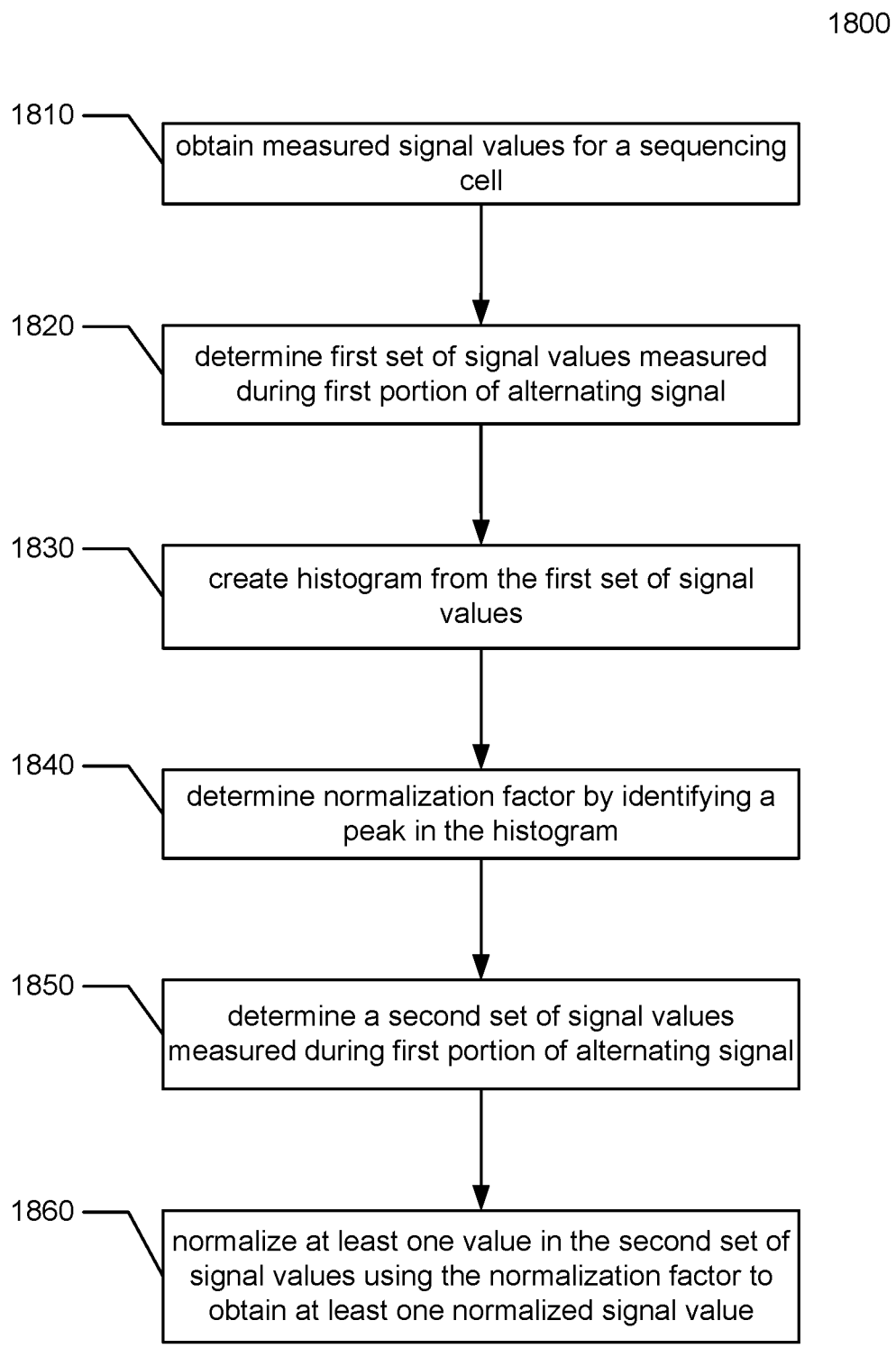
FIG. 18 shows a flow chart that illustrates a method of using a sequencing cell, according to certain embodiments.

FIG. 18 shows a flow chart that illustrates a method of using a sequencing cell, according to certain embodiments. More specifically FIG. 18 describes method for normalization of sequencing signal values using a running histogram as described above in Sections III(C)(1)-(2). In some embodiments, method 1800 may be performed by processor 224 of FIG. 2, digital processor 430, and/or any control logic coupled with the circuits of the sequencing cell.

In step 1810, multiple sequencing signal values $P(t_i)$ are obtained from the sequencing cell. The sequencing signal values can be voltages that are measured by an ADC and sent to a digital processor, e.g., ADC 410 and digital processor 430, as shown in FIG. 4. The digital processor can be part of a computer system that includes other components, e.g., as described in more detail below in reference to FIG. 20. The voltages may correspond to voltages that are measured over one or more bright periods that are themselves over one or more different AC cycles, i.e., it is not required that all the measured data be from the same bright period within a single AC cycle. Such measurements can occur as described herein and can occur at various times of sequencing different parts of a nucleic acid of a given cell. In some cases, the acquired voltages may vary from point to point (even for the same state of the nanopore) due to a variation in the zero point voltage of the cell over time. The applied voltage may be an alternating signal, e.g., an AC signal having a first portion (e.g., a bright period, also referred to herein as a "bright mode") and a second portion (e.g., a dark period, also referred to herein as a "dark mode") relative to a reference voltage. According to certain embodiments, the reference voltage may be a reference voltage (e.g., VPRE 405 in FIG. 4) that is applied to an integrating capacitor, e.g., ncap, as shown in FIG. 4.

In step 1820, a first set of signal values is determined, e.g., one or more voltages measured during the bright period of the alternating signal are selected by the digital processor 430. The first set of voltages may correspond to various bright periods. Such measurements can occur as described herein and can occur at various times of sequencing different parts of a nucleic acid of a given cell. Furthermore, the first set of one or more signal values can correspond to various bright mode threaded channel signal values.

In step 1830, a histogram is created from the first set of signal values, e.g., as described above in Sections III(C)(1)-(2). For example, a histogram (or distribution) of the measured signal can be computed by binning the measured signal values and counting the number of times a particular signal value with a particular ADC count falls within a particular bin.

In step 1840, a normalization factor is determined by identifying a peak in the histogram. According to certain embodiments, neither the peak value, nor the peak width needs to be known in advance of obtaining the measured sequencing signal data in step 1810. For example, a peak detection routine can detect boundaries and characteristics of the peaks, e.g., to identify the largest peak in the histogram. In other embodiments, a second largest peak can be chosen if the signal value of the second largest peak is within a predetermined range of signal values that correspond to the range of acceptable (or likely) open channel signal values (open channel range), e.g., as described in the section above. In some embodiments, the bins at or near the very end of the signal range can be ignored during the initial peak detection routine to avoid edge effects. The signal range for identifying the peak can be established via empirical data from other sequencing runs, cells, chips, etc.

In step 1850, a second set of signal values is determined. Again, as before, the second set of signal values may correspond to various bright periods. Such measurements can occur as described herein and can occur at various times of sequencing different parts of a nucleic acid of a given cell. Furthermore, the second set of one or more signal values can correspond to various bright mode threaded channel signal values.

In step 1860, at least one value in the second set of signal values is normalized using the normalization factor to obtain at least one normalized signal value, e.g., by dividing the at least one value in the second set of signal values by the normalization factor. A plurality of normalized signal values may be obtained.

IV. Normalization and Offset Correction System and Data Flow

Figure 19:
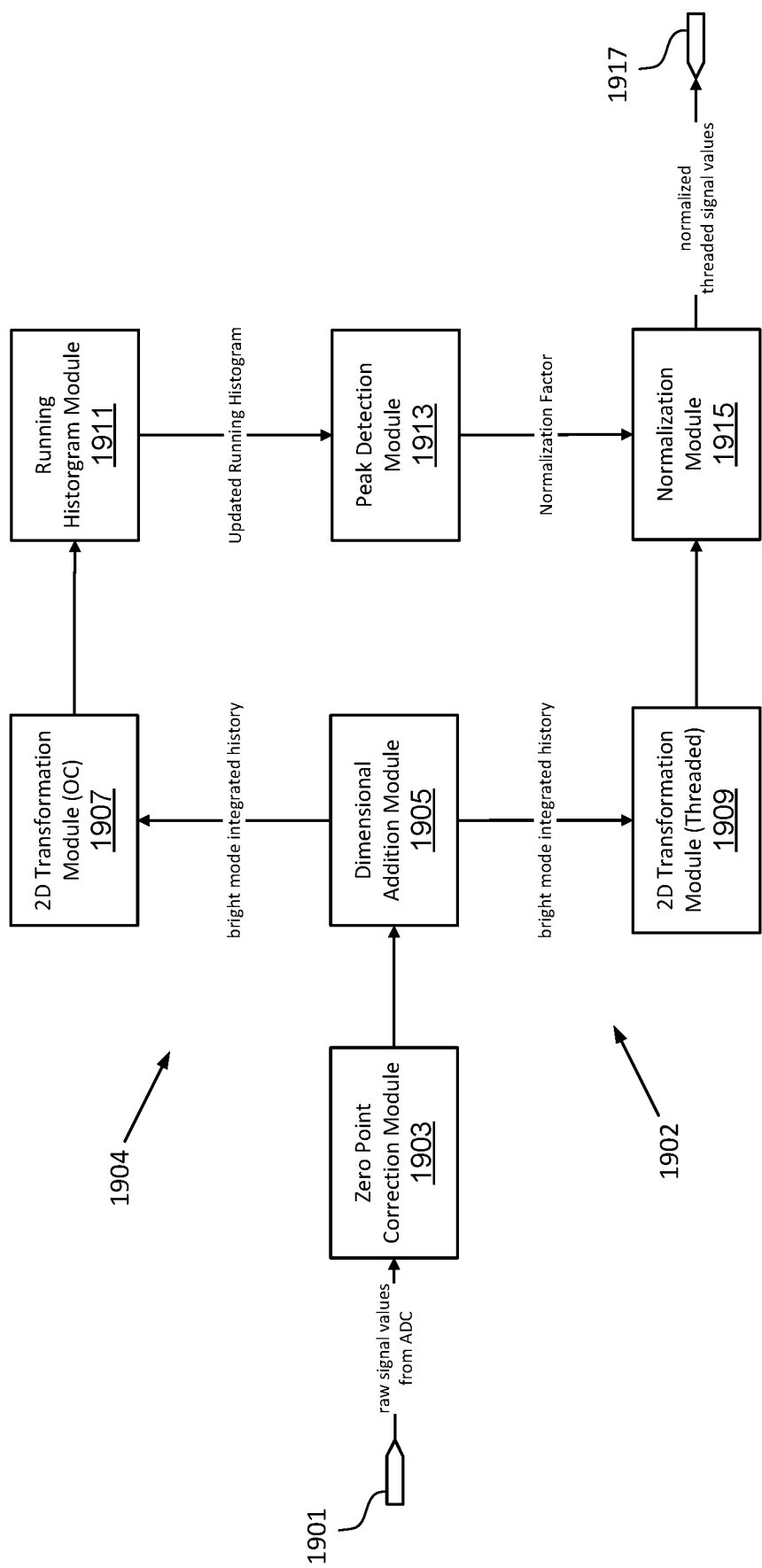
FIG. 19 shows an example system for normalization and offset correction according to some embodiments.

FIG. 19 shows an example system for normalization and offset correction according to some embodiments. More specifically, FIG. 19 illustrates and example of a data flow and logic diagram for a system employing each of the above-described data processing techniques in combination, i.e., the system in FIG. 19 employs zero point correction, baseline shift removal by two-dimensional transformation, and, normalization using a moving histogram. The modules represented in FIG. 19 may be incorporated within a nanopore sequencing system as hardware only software only or a combination of hardware and software, e.g., within one or more computer systems and digital processor of the nanopore sequencing system, e.g., the logic may be implemented within one or more of the nanochip workstation of FIG. 1, processor 224 and memory 226 of FIG. 2, and the digital processor 430 of FIG. 4. In addition, each of the modules shown in FIG. 19 can be operatively connected to one or more computer memories (not shown) such that each module can both access data stored in the one or more computer memories and can save data in the one or more computer memories. Furthermore, each module or the collection of modules can take the form of computer readable instructions or program code that can be executed by one or more processors of a computer system, e.g., the computer system shown in FIG. 20.

A. Correcting for Zero Point Voltage $V_0$

One or more raw sequencing signal values (also referred to herein as "data points") are received from the ADC at input 1901 For example, one or more voltages measured during the bright mode and or dark mode of the applied AC signal, as described above in reference to FIG. 5 above can be received. In the embodiment shown in FIG. 19, the acquired sequencing signal values are first processed zero-point correction module 1903. In some embodiments, the zero-point correction module 1903 can employ a zero-point correction scheme that does not require knowledge of the specific value of $V_0$, e.g., it can subtract corresponding dark mode signal values from the bright mode signal values to remove any effect of a varying zero point voltage $V_0$, as describe above in Section III(C) in reference to FIG. 10. Alternatively, the zero point correction module 1903 can subtract a previously measured value for $V_0$ that has been stored in memory.

The zero point corrected data is then passed to two separate processing flows, a threaded value processing flow 1902 and a normalization factor computation flow 1904. According to certain embodiments, the threaded value processing flow 1902 processes the threaded values by applying a two-dimensional transformation on the threaded values to correct these values for offset shift. According to certain embodiments, the normalization factor computation flow 1904 computes a normalization factor (to be used to correct the threaded values for gain drift) using a moving histogram method.

B. Two-Dimensional Transformation of the Threaded Signal

Turning first to the threaded value processing flow 1902, the data is first processed at the dimensional addition module 1905. The dimensional addition module 1905 can compute a second correlated data point for every acquired bright mode signal value. For example, the dimensional addition module 1905 can pair each bright channel value with a corresponding dark channel value as described above in reference to FIGS. 13A-13C. In some embodiments, dimensional addition module 1905 can perform an integrated history of the bright channel values and then pair each measured bright channel value with a correlated integrated history value, e.g., by implementing the recurrence relation embodied in Eqn. (22), as described above in Section III(B)(2).

After each bright channel data point is converted to a two-dimensional data point by dimensional addition module 1905, the bright channel values and their associated correlated values are sent to two-dimensional transformation module 1909 that applies a two-dimensional transformation to correct for offset drift in the threaded values. According to certain embodiments, two-dimensional transformation module 1909, can take the form of a matrix multiplier that applies a two-dimensional transformation such as rotation or flattening transformation to the each of the two-dimensional data points as described above in Sections III(B)(1)-(3). For example, as shown in FIGS. 14A-14B the two-dimensional transformation can result in clusters of threaded channel data that are rotated/flattened in the 2-dimension space spanning the two-dimensional data points. In other words, the transformed clusters are more horizontal relative to the x-axis in as compared to the unprocessed data. Stated yet another way, the action of the two-dimensional transformation is to reduce the overlap between the five clusters when viewed along the y-dimension. This transformed data is then normalized at by normalization module 1915 where, according to certain embodiments, each value is scaled to (i.e., divided by) an open channel value that was computed in the normalization factor computation flow 1904.

C. Normalization Factor Determination Using Running Histogram

Turning to the normalization factor computation flow 1904, the bright channel values and their associated correlated values are sent to two-dimensional transformation module 1907 that applies a two-dimensional transformation to correct for offset drift in the open channel values. According to certain embodiments, the two-dimensional transformation module 1907 can apply a transformation in the form of a matrix multiplication to the each of the two-dimensional data points. The transformation applied by the two-dimensional transformation module 1907 can result in the variance of the open channel data being reduced in one dimension, similar to how the variance of the threaded channel data was reduced by the two-dimensional transformation described above in reference to the threaded value processing flow 1902. The transformed open channel signal values are then sent to running histogram module 1911 where an updated running histogram (i.e., a population distribution) of the data is computed based off the new data and historical data that is stored in memory.

According to certain embodiments, the updated running histogram can be computed from the historical data in a number of ways as described above in reference to Section III(C). For example, the contribution of the historical data to the running histogram can be downgraded based on age. Once the newly acquired data is combined with the historical data to form an updated running histogram, the peak detection module 1913 executes a peak finding routine to locate the largest peak in the histogram (i.e., the most populous value in the sequence signal data) and then selects the corresponding signal value as the best estimate of the open channel signal value to be used as the normalization factor. The normalization factor determined by this method results in an improved estimate of the open channel voltage value, even when the most recent measurement may not include any open channel values.

Returning to the threaded value processing flow 1902, the transformed threaded data output by the 2D transformation module 1909 is normalized using the normalization factor resulting in the normalized threaded signal that is output at output node 1917, e.g., using Eqn. (5) or Eqn. (26) The threaded values are not only more horizontal (i.e. the variation in the bright channel values is smaller within each cluster of the threaded values) but the data is also scaled such that the dynamic range is approximately between 0 and 1. As a result, the processing system described herein results in threaded values (i.e., tag values) that are more easily distinguished from one another and also values that are more stable in over time because the effects of both gain drift and offset shift have been minimized.

V. Computer System

Figure 20:
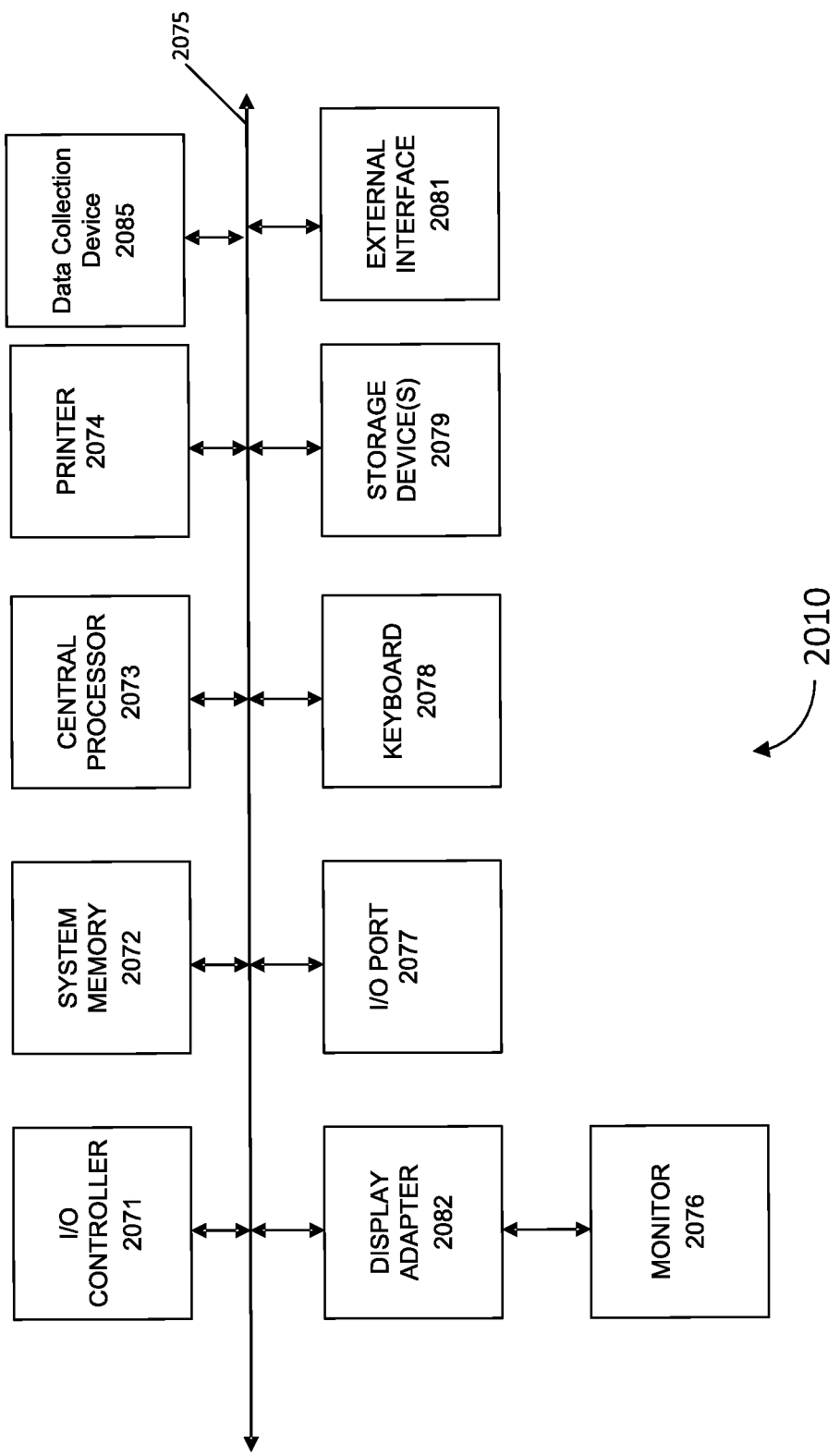
FIG. 20 is a computer system, according to certain aspects of the present disclosure.

Any of the computer systems mentioned herein may utilize any suitable number of subsystems. Examples of such subsystems are shown in FIG. 20 in computer system 2010. In some embodiments, a computer system includes a single computer apparatus, where the subsystems can be the components of the computer apparatus. In other embodiments, a computer system can include multiple computer apparatuses, each being a subsystem, with internal components. A computer system can include desktop and laptop computers, tablets, mobile phones and other mobile devices.

The subsystems shown in FIG. 20 are interconnected via a system bus 2075. Additional subsystems such as a printer 2074, keyboard 2078, storage device(s) 2079, monitor 2076, which is coupled to display adapter 2082, and others are shown. Peripherals and input/output (I/O) devices, which couple to I/O controller 2071, can be connected to the computer system by any number of means known in the art such as input/output (I/O) port 2077 (e.g., USB, FireWire). For example, I/O port 2077 or external interface 2081 (e.g. Ethernet, Wi-Fi, etc.) can be used to connect computer system 2010 to a wide area network such as the Internet, a mouse input device, or a scanner. The interconnection via system bus 2075 allows the central processor 2073 to communicate with each subsystem and to control the execution of a plurality of instructions from system memory 2072 or the storage device(s) 2079 (e.g., a fixed disk, such as a hard drive, or optical disk), as well as the exchange of information between subsystems. The system memory 2072 and/or the storage device(s) 2079 may embody a computer readable medium. Another subsystem is a data collection device 85, such as a camera, microphone, accelerometer, and the like. Any of the data mentioned herein can be output from one component to another component and can be output to the user.

A computer system can include a plurality of the same components or subsystems, e.g., connected together by external interface 2081 or by an internal interface. In some embodiments, computer systems, subsystem, or apparatuses can communicate over a network. In such instances, one computer can be considered a client and another computer a server, where each can be part of a same computer system. A client and a server can each include multiple systems, subsystems, or components.

Aspects of embodiments can be implemented in the form of control logic using hardware (e.g. an application specific integrated circuit or field programmable gate array) and/or using computer software with a generally programmable processor in a modular or integrated manner As used herein, a processor includes a single-core processor, multi-core processor on a same integrated chip, or multiple processing units on a single circuit board or networked. Based on the disclosure and teachings provided herein, a person of ordinary skill in the art will know and appreciate other ways and/or methods to implement embodiments of the present invention using hardware and a combination of hardware and software.

Any of the software components or functions described in this application may be implemented as software code to be executed by a processor using any suitable computer language such as, for example, Java, C, C++, C#, Objective-C, Swift, or scripting language such as Perl or Python using, for example, conventional or object-oriented techniques. The software code may be stored as a series of instructions or commands on a computer readable medium for storage and/or transmission. A suitable non-transitory computer readable medium can include random access memory (RAM), a read only memory (ROM), a magnetic medium such as a hard-drive or a floppy disk, or an optical medium such as a compact disk (CD) or DVD (digital versatile disk), flash memory, and the like. The computer readable medium may be any combination of such storage or transmission devices.

Such programs may also be encoded and transmitted using carrier signals adapted for transmission via wired, optical, and/or wireless networks conforming to a variety of protocols, including the Internet. As such, a computer readable medium may be created using a data signal encoded with such programs. Computer readable media encoded with the program code may be packaged with a compatible device or provided separately from other devices (e.g., via Internet download). Any such computer readable medium may reside on or within a single computer product (e.g. a hard drive, a CD, or an entire computer system), and may be present on or within different computer products within a system or network. A computer system may include a monitor, printer, or other suitable display for providing any of the results mentioned herein to a user.

Any of the methods described herein may be totally or partially performed with a computer system including one or more processors, which can be configured to perform the steps. Thus, embodiments can be directed to computer systems configured to perform the steps of any of the methods described herein, potentially with different components performing a respective steps or a respective group of steps. Although presented as numbered steps, steps of methods herein can be performed at a same time or in a different order. Additionally, portions of these steps may be used with portions of other steps from other methods. Also, all or portions of a step may be optional. Additionally, any of the steps of any of the methods can be performed with modules, units, circuits, or other means for performing these steps.

The specific details of particular embodiments may be combined in any suitable manner without departing from the spirit and scope of embodiments of the invention. However, other embodiments of the invention may be directed to specific embodiments relating to each individual aspect, or specific combinations of these individual aspects.

The above description of example embodiments of the invention has been presented for the purposes of illustration and description. It is not intended to be exhaustive or to limit the invention to the precise form described, and many modifications and variations are possible in light of the teaching above.

A recitation of "a", "an" or "the" is intended to mean "one or more" unless specifically indicated to the contrary. The use of "or" is intended to mean an "inclusive or," and not an "exclusive or" unless specifically indicated to the contrary. Reference to a "first" component does not necessarily require that a second component be provided. Moreover reference to a "first" or a "second" component does not limit the referenced component to a particular location unless expressly stated.

All patents, patent applications, publications, and descriptions mentioned herein are incorporated by reference in their entirety for all purposes. None is admitted to be prior art.

SEQUENCE LISTING (62032 sequences)

SEQ ID NO: 1 - DNA, 42 bp, Artificial Sequence
  Synthetic
acctgttccacaagtactacaacatacctgaagaggaggagc

SEQ ID NO: 2 - DNA, 47 bp, Artificial Sequence
  Synthetic
tgctgcagctgtttcatgatttactaactcatcatttaagtttggag

SEQ ID NO: 3 - DNA, 48 bp, Artificial Sequence
  Synthetic
gcagagtagcatcatctagaaaacctgtatctttcatgaataggcaaa

SEQ ID NO: 4 - DNA, 44 bp, Artificial Sequence
  Synthetic
tggcgagcataataatatagcacattgctaaaacagtggaagca

SEQ ID NO: 5 - DNA, 39 bp, Artificial Sequence
  Synthetic
ggtggggaaacggagtcgcgcactccactatttcctccc

SEQ ID NO: 6 - DNA, 39 bp, Artificial Sequence
  Synthetic
ataccccagcaccgaccaccaccagagaagctcccagaa

SEQ ID NO: 7 - DNA, 43 bp, Artificial Sequence
  Synthetic
tgagcctgattttgaaatgctacaatggggaagaggaagatgt

SEQ ID NO: 8 - DNA, 47 bp, Artificial Sequence
  Synthetic
ggacctcccaaagtctctaattctacctaatgtaaatgtgtttgtgg

SEQ ID NO: 9 - DNA, 38 bp, Artificial Sequence
  Synthetic
aatgcctcatctggagcagccgcctttacggatgacat

SEQ ID NO: 10 - DNA, 44 bp, Artificial Sequence
  Synthetic
gggttaacaatagtgtgtggcacaggctggagaaatagaaatgc

SEQ ID NO: 11 - DNA, 43 bp, Artificial Sequence
  Synthetic
ggatttcctgttaatccaatgcctatgtggaggttggaaggta

SEQ ID NO: 12 - DNA, 43 bp, Artificial Sequence
  Synthetic
ggccatttaccttatttactggtgaagcgggtattgatggtga

SEQ ID NO: 13 - DNA, 41 bp, Artificial Sequence
  Synthetic
ccagaatgcatattgtccccagaaatgtcctccagatgctg

SEQ ID NO: 14 - DNA, 46 bp, Artificial Sequence
  Synthetic
gtctgtaactaagtcctaaggatgccatggggtcaatatttttgcc

SEQ ID NO: 15 - DNA, 41 bp, Artificial Sequence
  Synthetic
aatgcctgcaataagcacgctgtattgttcaacaacagctg

SEQ ID NO: 16 - DNA, 49 bp, Artificial Sequence
  Synthetic
ggacaacaaagagaaagtccttcgaagacatttgctattagacttttgg

SEQ ID NO: 17 - DNA, 42 bp, Artificial Sequence
  Synthetic
actttcgttttagggcagctattgggaaattccctggcattg

SEQ ID NO: 18 - DNA, 50 bp, Artificial Sequence
  Synthetic
gcgccaagctttctaaagaaagattatgcattaccatttgataatgaagg

SEQ ID NO: 19 - DNA, 39 bp, Artificial Sequence
  Synthetic
gcgtgtcttggaggtcgaggaaccccagaagactccgtg

SEQ ID NO: 20 - DNA, 43 bp, Artificial Sequence
  Synthetic
ccaagtctagacagacctgttgtttgatttgtcccgtctccag

SEQ ID NO: 21 - DNA, 43 bp, Artificial Sequence
  Synthetic
ctccaggatttactctactaggagtggtctcgggattggtact

SEQ ID NO: 22 - DNA, 41 bp, Artificial Sequence
  Synthetic
acggttggatgtccactagcaggttgtaacaacacctgatc

SEQ ID NO: 23 - DNA, 43 bp, Artificial Sequence
  Synthetic
ctctggtgtgtaatgtctccaaagtgcacattttacaggtgac

SEQ ID NO: 24 - DNA, 40 bp, Artificial Sequence
  Synthetic
agcaaaatccagatcgggcgtgaccctgatgtaacaatga

SEQ ID NO: 25 - DNA, 46 bp, Artificial Sequence
  Synthetic
tcgcctatgacttggatgaagtatgtactcctctagaaccttatgc

SEQ ID NO: 26 - DNA, 44 bp, Artificial Sequence
  Synthetic
ccgaataggaaagtatgggtgaccttccatatacttccacgctg

SEQ ID NO: 27 - DNA, 42 bp, Artificial Sequence
  Synthetic
ggtctaaagatacgtcctggcgtaggagacacagaaaatccc

SEQ ID NO: 28 - DNA, 45 bp, Artificial Sequence
  Synthetic
ggtgttccaaagtacacatgtgataataggagctcaagacaatca

SEQ ID NO: 29 - DNA, 40 bp, Artificial Sequence
  Synthetic
ggtcctggaggctgtacgacacctcccctgcgaggaacca

SEQ ID NO: 30 - DNA, 40 bp, Artificial Sequence
  Synthetic
gactccgccaacgatctgccaccaaaagaaacaccgtccg

SEQ ID NO: 31 - DNA, 42 bp, Artificial Sequence
  Synthetic
gcgcctaggacagggatgtacccctcggtaaggtgatcgaca

SEQ ID NO: 32 - DNA, 42 bp, Artificial Sequence
  Synthetic
cactggttcccaacacctgctaaacagacaacgccatcctac

SEQ ID NO: 33 - DNA, 34 bp, Artificial Sequence
  Synthetic
ccattgacaaggccggcgcacgtcaccggccaca

SEQ ID NO: 34 - DNA, 42 bp, Artificial Sequence
  Synthetic
cctctcgggacagccactagaaatgactctttgcagacaggg

SEQ ID NO: 35 - DNA, 42 bp, Artificial Sequence
  Synthetic
gacgtatcttgcacggaggaccgctcatggatgaacacaacg

SEQ ID NO: 36 - DNA, 37 bp, Artificial Sequence
  Synthetic
ggggacatgtccaccctgtcttgcaattggacgcggg

SEQ ID NO: 37 - DNA, 40 bp, Artificial Sequence
  Synthetic
gccgcgttgaggtggatcaatgatgatgcttatggcccag

SEQ ID NO: 38 - DNA, 42 bp, Artificial Sequence
  Synthetic
cacgtttggagtgctgcttcacagcccttattctctggtggg

SEQ ID NO: 39 - DNA, 35 bp, Artificial Sequence
  Synthetic
aaatcccgtaggccgccggcgctggaccggcactt

SEQ ID NO: 40 - DNA, 38 bp, Artificial Sequence
  Synthetic
aacacctgcacctcgccggctacccttgtcgtgagcct

SEQ ID NO: 41 - DNA, 39 bp, Artificial Sequence
  Synthetic
acaagacaggccctcccgagtacagcgtccctactgtcc

SEQ ID NO: 42 - DNA, 42 bp, Artificial Sequence
  Synthetic
cggtgcgcacacttggatcaatgcttaatccatcagtcgcgg

SEQ ID NO: 43 - DNA, 39 bp, Artificial Sequence
  Synthetic
cccccttgatgtgttgcagggcttggcaacgatggggaa

SEQ ID NO: 44 - DNA, 41 bp, Artificial Sequence
  Synthetic
gcgagacagaatcttgcgggacgacttctccttggacccca

SEQ ID NO: 45 - DNA, 40 bp, Artificial Sequence
  Synthetic
aaacctctctgtcgggggcctactggcagtgttgttgtgg

SEQ ID NO: 46 - DNA, 41 bp, Artificial Sequence
  Synthetic
gggggctagtaactgaggcggactgccaggtaatccaactg

SEQ ID NO: 47 - DNA, 42 bp, Artificial Sequence
  Synthetic
cggcacaaacaactcccacaacctggcaaacctcttacctgc

SEQ ID NO: 48 - DNA, 41 bp, Artificial Sequence
  Synthetic
tccctggaaggctgggaagtactgcatggtcctatccgact

SEQ ID NO: 49 - DNA, 40 bp, Artificial Sequence
  Synthetic
acacgggcacttgaggtccttcgtcacaatgaccagcatt

SEQ ID NO: 50 - DNA, 37 bp, Artificial Sequence
  Synthetic
acaggaggggtctgcgcagcgagtacgcacctcccca

SEQ ID NO: 51 - DNA, 40 bp, Artificial Sequence
  Synthetic
tgggcgcaagagatctgacttcctgcccactcagccagat

SEQ ID NO: 52 - DNA, 42 bp, Artificial Sequence
  Synthetic
gctctcagtgcggatgtcttgtggcttctcatatgacacccg

SEQ ID NO: 53 - DNA, 35 bp, Artificial Sequence
  Synthetic
gtcatcgccgcagaccaggaaagcggctgcagcag

SEQ ID NO: 54 - DNA, 42 bp, Artificial Sequence
  Synthetic
cgcctgcaagtggagtgagttttgcggtctctacctcttcaa

SEQ ID NO: 55 - DNA, 48 bp, Artificial Sequence
  Synthetic
gctgattttcctcctgttattgctgatttctaaaaaatgttgctcctg

SEQ ID NO: 56 - DNA, 47 bp, Artificial Sequence
  Synthetic
agtctccagctgctttcatttgcttctagtttgaaaaaatcagaagg

SEQ ID NO: 57 - DNA, 42 bp, Artificial Sequence
  Synthetic
gtgtctattgtgtagcctgttcccaacattcccatacaccgg

SEQ ID NO: 58 - DNA, 44 bp, Artificial Sequence
  Synthetic
catggcattctgtgaccctgctttggatagaatggatgaagaac

SEQ ID NO: 59 - DNA, 44 bp, Artificial Sequence
  Synthetic
cgtttccacctacgggtaaacaaacttggctaaaaatatctgtg

SEQ ID NO: 60 - DNA, 43 bp, Artificial Sequence
  Synthetic
cccatcccattgttgatcatattgtgagtcgctggagtgaatg

SEQ ID NO: 61 - DNA, 47 bp, Artificial Sequence
  Synthetic
ttctggaatatgcaggtttctcaaaagagatggtctattagtagcag

SEQ ID NO: 62 - DNA, 47 bp, Artificial Sequence
  Synthetic
aaggttgcaacacttagcgtagaaaggaacagatctatactaaacac

SEQ ID NO: 63 - DNA, 40 bp, Artificial Sequence
  Synthetic
gcatatctggtcccccctcaccaaaagcataacaatggcc

SEQ ID NO: 64 - DNA, 45 bp, Artificial Sequence
  Synthetic
actgtatctcgggttttctttctccccagaatgtgataggcttct

SEQ ID NO: 65 - DNA, 41 bp, Artificial Sequence
  Synthetic
cgcttgtattgttgtacgatcctgtctggctgacacgtaaa

SEQ ID NO: 66 - DNA, 45 bp, Artificial Sequence
  Synthetic
atccctgaactacctcttttcgatgggacaccataaattttgaga

SEQ ID NO: 67 - DNA, 45 bp, Artificial Sequence
  Synthetic
tgccatcctccttctataaaaccagttccccagattgaatcaaga

SEQ ID NO: 68 - DNA, 43 bp, Artificial Sequence
  Synthetic
tttgtggtgtggtgtcattgtggcaaataaatcaattcagccg

SEQ ID NO: 69 - DNA, 47 bp, Artificial Sequence
  Synthetic
aacttgactttgctaagagccatttaaggagagacataagatgaaag

SEQ ID NO: 70 - DNA, 46 bp, Artificial Sequence
  Synthetic
tgggtagtaagcctttataacgtttggatagatctggtcttacagc

SEQ ID NO: 71 - DNA, 42 bp, Artificial Sequence
  Synthetic
cccattatgcctaggccagcagcatcattattgtctttgact

SEQ ID NO: 72 - DNA, 45 bp, Artificial Sequence
  Synthetic
aaccatggcatctcttataccatcacacattagtagtagcgagtg

SEQ ID NO: 73 - DNA, 48 bp, Artificial Sequence
  Synthetic
gtttgtttgttggtcttctgttggttgatttctgatcagttaccaatc

SEQ ID NO: 74 - DNA, 50 bp, Artificial Sequence
  Synthetic
tgggtgtggatatttgtttcactagccagcagatttacttataaaagaac

SEQ ID NO: 75 - DNA, 48 bp, Artificial Sequence
  Synthetic
cctgagtaagggatgatttttgcatacacacttgaaaatataacaacc

SEQ ID NO: 76 - DNA, 46 bp, Artificial Sequence
  Synthetic
ctgatgaacaatgacttgggatgattgtggttcaactaatcaaaca

SEQ ID NO: 77 - DNA, 40 bp, Artificial Sequence
  Synthetic
tgattgagagtgtcccaggtctccaaaaacaaggaccaac

SEQ ID NO: 78 - DNA, 43 bp, Artificial Sequence
  Synthetic
gcaaggtacaaagttgaacacttcaagcccaccacaaaacaac

SEQ ID NO: 79 - DNA, 43 bp, Artificial Sequence
  Synthetic
ttcccttttgacttgtgtgttctatcagaactacactgctcac

SEQ ID NO: 80 - DNA, 49 bp, Artificial Sequence
  Synthetic
gcatttgttttgaggattggcaaccaaatcaaccagaatcaaaatcaac

SEQ ID NO: 81 - DNA, 45 bp, Artificial Sequence
  Synthetic
actccatttgataagctgactacagctagaaggggaagtgaacaa

SEQ ID NO: 82 - DNA, 42 bp, Artificial Sequence
  Synthetic
actgatcctgcattgtcacagtaaagggtccaacatctgttt

SEQ ID NO: 83 - DNA, 42 bp, Artificial Sequence
  Synthetic
accactcagttgatccttgcttaactgctcctatactgcaag

SEQ ID NO: 84 - DNA, 39 bp, Artificial Sequence
  Synthetic
cactccaactacaccgagggaaataagtggagctgcaga

SEQ ID NO: 85 - DNA, 46 bp, Artificial Sequence
  Synthetic
ctgagttctctttctttgcctgtatcaaagttatcttaacaaccct

SEQ ID NO: 86 - DNA, 46 bp, Artificial Sequence
  Synthetic
tctgtagtggtatagtgttgtgcacaatagactggcagttactgag

SEQ ID NO: 87 - DNA, 46 bp, Artificial Sequence
  Synthetic
ggcgatgcaaatagttaacacttaacttagcataggaattcttggg

SEQ ID NO: 88 - DNA, 42 bp, Artificial Sequence
  Synthetic
ggaggctgcacgacactcatacatcactcccctgtgaggaac

SEQ ID NO: 89 - DNA, 39 bp, Artificial Sequence
  Synthetic
acgatctgaccgccacccgaccaaacgtaacaccaaccg

SEQ ID NO: 90 - DNA, 39 bp, Artificial Sequence
  Synthetic
tggcagcgcctccaagaggcatcgatacccttacgtgcg

SEQ ID NO: 91 - DNA, 35 bp, Artificial Sequence
  Synthetic
tcgaggcgttaccctcgcggccgatgccatcctgc

SEQ ID NO: 92 - DNA, 40 bp, Artificial Sequence
  Synthetic
ttgtgggatccggagcagcttgatgatgaactggtcccct

SEQ ID NO: 93 - DNA, 41 bp, Artificial Sequence
  Synthetic
tgggcaaaatcggtaaggcgtttcaactcttcaggctgtcc

SEQ ID NO: 94 - DNA, 42 bp, Artificial Sequence
  Synthetic
tccgcacactttggtgaatccatccttaacaacaccaggcca

SEQ ID NO: 95 - DNA, 38 bp, Artificial Sequence
  Synthetic
cggacctgtccctgtcttccaggcacaggctggaagcg

SEQ ID NO: 96 - DNA, 37 bp, Artificial Sequence
  Synthetic
acaagaccgtgcgtcccggcggctttggagaacctcg

SEQ ID NO: 97 - DNA, 40 bp, Artificial Sequence
  Synthetic
ggtccgaagatggccaggagttgtgtagtacacccgaccc

SEQ ID NO: 98 - DNA, 39 bp, Artificial Sequence
  Synthetic
cgggagaagacgactggttccaagactgggcgcacaacg

SEQ ID NO: 99 - DNA, 42 bp, Artificial Sequence
  Synthetic
cccgtggtagacagtccagcataactgctacccaaaccttcc

SEQ ID NO: 100 - DNA, 38 bp, Artificial Sequence
  Synthetic
aaagtccaccgctttagccactcacgccgtgggcctat

SEQ ID NO: 101 - DNA, 42 bp, Artificial Sequence
  Synthetic
aggaacttgccgtaggtggagtcctaatatcaggaccggggt

SEQ ID NO: 102 - DNA, 40 bp, Artificial Sequence
  Synthetic
cgagctcgtcgcacttcttctggtgatcaaggggggaaga

SEQ ID NO: 103 - DNA, 40 bp, Artificial Sequence
  Synthetic
ggacgagtcgaacatgccggagcaggactggcagggggaa

SEQ ID NO: 104 - DNA, 38 bp, Artificial Sequence
  Synthetic
gggtgttggcccatggaggccatcgtgggaccagatgt

SEQ ID NO: 105 - DNA, 41 bp, Artificial Sequence
  Synthetic
tgcttgaactgctcagcgagcgatggaagagtgctctcagc

SEQ ID NO: 106 - DNA, 39 bp, Artificial Sequence
  Synthetic
aaggcagtagcggcaccggtcaacatattgggggggtgg

SEQ ID NO: 107 - DNA, 37 bp, Artificial Sequence
  Synthetic
tgcatcgctctccggcacgctaatagccttcgcctcc

SEQ ID NO: 108 - DNA, 40 bp, Artificial Sequence
  Synthetic
gtcctaggaccgacgatcctcattatgcacactcgctgcc

SEQ ID NO: 109 - DNA, 40 bp, Artificial Sequence
  Synthetic
cgggtactcgtggagtcctactgcgcctacacaggtttgc

SEQ ID NO: 110 - DNA, 38 bp, Artificial Sequence
  Synthetic
agcggatcgaaggagtccagaacaggagatgggcggca

SEQ ID NO: 111 - DNA, 40 bp, Artificial Sequence
  Synthetic
gccggaagttgaggagctgccctatctactgccttggccg

SEQ ID NO: 112 - DNA, 40 bp, Artificial Sequence
  Synthetic
ctttggcaagcactgcgtgaagcaactcgttgctacgcca

SEQ ID NO: 113 - DNA, 41 bp, Artificial Sequence
  Synthetic
acacgatgagacgagctggctgaacgaggttttctgcgttc

SEQ ID NO: 114 - DNA, 42 bp, Artificial Sequence
  Synthetic
gcccccaacataaagcctctcaaccaatgttgtgacctggac

SEQ ID NO: 115 - DNA, 41 bp, Artificial Sequence
  Synthetic
ggggttgtagggtcacgggtaaacatcatgctcctccaacg

SEQ ID NO: 116 - DNA, 42 bp, Artificial Sequence
  Synthetic
tgcggccaccctattgatttcattcaaagactccatggcctc

SEQ ID NO: 117 - DNA, 43 bp, Artificial Sequence
  Synthetic
cccatattctttcattgccttttccactttgtgcgacaatgct

SEQ ID NO: 118 - DNA, 43 bp, Artificial Sequence
  Synthetic
ggagaaatttaggcttctcaactccgaacaatggcctggacag

SEQ ID NO: 119 - DNA, 43 bp, Artificial Sequence
  Synthetic
tgtctttggaattttctcctcgtttattacctcctggcttgga

SEQ ID NO: 120 - DNA, 44 bp, Artificial Sequence
  Synthetic
cttgcaatgtgctcaattggagttgacagattcaagttggattg

SEQ ID NO: 121 - DNA, 50 bp, Artificial Sequence
  Synthetic
tcggatcagtaagagagaattccatttataaaaggaagatcccatttgag

SEQ ID NO: 122 - DNA, 44 bp, Artificial Sequence
  Synthetic
gtctttttctttgacagaagactcggcccttttcaatcccttca

SEQ ID NO: 123 - DNA, 41 bp, Artificial Sequence
  Synthetic
gagggccttccactttctgctattgaggaattgtcaaggga

SEQ ID NO: 124 - DNA, 45 bp, Artificial Sequence
  Synthetic
ccaagcgaatctctgtagagttttactcatcggaggacttgaatg

SEQ ID NO: 125 - DNA, 43 bp, Artificial Sequence
  Synthetic
ggggttcagtagcagacattgcgaaaccggtacatataaaagc

SEQ ID NO: 126 - DNA, 41 bp, Artificial Sequence
  Synthetic
caggtcaaacggttctggttttaatgcatggaaatgtggct

SEQ ID NO: 127 - DNA, 43 bp, Artificial Sequence
  Synthetic
gcttccacaaaaaaccatccattaccatggcggataaccaagg

SEQ ID NO: 128 - DNA, 42 bp, Artificial Sequence
  Synthetic
ccgggggcttaggtccttttctggcagtccgtatgtaagtcc

SEQ ID NO: 129 - DNA, 42 bp, Artificial Sequence
  Synthetic
aggattgccatctaatgcattgctgctacaacacaatgctgg

SEQ ID NO: 130 - DNA, 40 bp, Artificial Sequence
  Synthetic
gtgttgctagggtctccattctgtcacgtttagcgctgaa

SEQ ID NO: 131 - DNA, 41 bp, Artificial Sequence
  Synthetic
gttcggtgctgtatactgtctttgcacaaggccattgaact

SEQ ID NO: 132 - DNA, 47 bp, Artificial Sequence
  Synthetic
ccacataatacactttgtgttctgcaggtgtgcagtaatatagatgc

SEQ ID NO: 133 - DNA, 44 bp, Artificial Sequence
  Synthetic
gggttaccctcatatacaggattgtcaggaccctgcctttttac

SEQ ID NO: 134 - DNA, 41 bp, Artificial Sequence
  Synthetic
aggacgtgcgggaacaaatgatacacctatacccacatcct

SEQ ID NO: 135 - DNA, 43 bp, Artificial Sequence
  Synthetic
gaggtagctacatcaaggggtaggctatggattttaaaaccct

SEQ ID NO: 136 - DNA, 44 bp, Artificial Sequence
  Synthetic
cccgttgtaaccagtatggcttataactcctagtggctctatgg

SEQ ID NO: 137 - DNA, 48 bp, Artificial Sequence
  Synthetic
gggttataccaaagttccagtcctcagatgttatggcctatattcatg

SEQ ID NO: 138 - DNA, 35 bp, Artificial Sequence
  Synthetic
tcaggaggcaccacaggcgccgccgccttacctga

SEQ ID NO: 139 - DNA, 39 bp, Artificial Sequence
  Synthetic
acgagcccccaactgtgtactacaactctgctggctcgg

SEQ ID NO: 140 - DNA, 40 bp, Artificial Sequence
  Synthetic
ctgggcttgggtttggatgagtccctcctagccagcctac

SEQ ID NO: 141 - DNA, 39 bp, Artificial Sequence
  Synthetic
tggcagtggggtcaaactgcggaagcccccagtttatgc

SEQ ID NO: 142 - DNA, 40 bp, Artificial Sequence
  Synthetic
gtctttggcactccctggcaaaggcgagaataccagcaac

SEQ ID NO: 143 - DNA, 38 bp, Artificial Sequence
  Synthetic
ggctgatttggggggggtttcctggacccccaaagaca

SEQ ID NO: 144 - DNA, 42 bp, Artificial Sequence
  Synthetic
ggcaagattacaggcggcctttggtcgtgatgccttacaaca

SEQ ID NO: 145 - DNA, 39 bp, Artificial Sequence
  Synthetic
tcgccaggttccattggctttggaggcaggccatatcga

SEQ ID NO: 146 - DNA, 40 bp, Artificial Sequence
  Synthetic
gcatttcgaacagggtgggactccggcactagatacgcct

SEQ ID NO: 147 - DNA, 40 bp, Artificial Sequence
  Synthetic
gctggcgtaaggtaggagttccctgggcgctacctgaact

SEQ ID NO: 148 - DNA, 39 bp, Artificial Sequence
  Synthetic
tggggtaggggggcatgtagccactgtggtgttccagtc

SEQ ID NO: 149 - DNA, 40 bp, Artificial Sequence
  Synthetic
gcgaacgtggtgcaaatagacgaaggcaggtcctctcagg

SEQ ID NO: 150 - DNA, 46 bp, Artificial Sequence
  Synthetic
acacatattgaggaagtcttgggaataggcaagcctagctacataa

SEQ ID NO: 151 - DNA, 40 bp, Artificial Sequence
  Synthetic
gcgcttaccgggatgagagcatggaaaggaccacaggagg

SEQ ID NO: 152 - DNA, 42 bp, Artificial Sequence
  Synthetic
gggcaggattgcagggtttagacatcctcggtgattacagcc

SEQ ID NO: 153 - DNA, 41 bp, Artificial Sequence
  Synthetic
taggggcaggtccatgattgctcttattcagacccttgttc

SEQ ID NO: 154 - DNA, 39 bp, Artificial Sequence
  Synthetic
gcgggatcctagcgtgggacataactccctcatcctgcc

SEQ ID NO: 155 - DNA, 40 bp, Artificial Sequence
  Synthetic
ggctggaggcgatgtggttgaaaccctgagtcatccctgt

SEQ ID NO: 156 - DNA, 37 bp, Artificial Sequence
  Synthetic
agagcgggagaaagaggaggaatgcgccgtgccttct

SEQ ID NO: 157 - DNA, 40 bp, Artificial Sequence
  Synthetic
tttgcctgttccatgcccggccaaggataatagcccgtcc

SEQ ID NO: 158 - DNA, 42 bp, Artificial Sequence
  Synthetic
ggaggggagtcgagggataagggagcatcagatcacctggga

SEQ ID NO: 159 - DNA, 43 bp, Artificial Sequence
  Synthetic
tgtagtactaaagatggctggcctttggacatttaccgatggc

SEQ ID NO: 160 - DNA, 39 bp, Artificial Sequence
  Synthetic
acgtcagggcctagcctgagtaaggctctgacgtctccc

SEQ ID NO: 161 - DNA, 41 bp, Artificial Sequence
  Synthetic
ggatggcggcctcaggtaaggataaaagcgtggggacagtt

SEQ ID NO: 162 - DNA, 40 bp, Artificial Sequence
  Synthetic
gccatatggtccactgtggttaatctgatgtcgcagtctc

SEQ ID NO: 163 - DNA, 44 bp, Artificial Sequence
  Synthetic
ttgtcattggtccatttctattccaggtcagatcgagtaatggt

SEQ ID NO: 164 - DNA, 46 bp, Artificial Sequence
  Synthetic
aggagaaattttgcaatcttggagtggatactaacgtcggaatcac

SEQ ID NO: 165 - DNA, 45 bp, Artificial Sequence
  Synthetic
ctagtggatctgctgatactgctcaaagtctaattattgcagcca

SEQ ID NO: 166 - DNA, 44 bp, Artificial Sequence
  Synthetic
gcacccttattttcaatgtttggagagcgggtcatcaatcaaga

SEQ ID NO: 167 - DNA, 47 bp, Artificial Sequence
  Synthetic
gcacttttgcatctttctgaaaatggacctgaatttcgttaataggg

SEQ ID NO: 168 - DNA, 41 bp, Artificial Sequence
  Synthetic
gtttcactgacctcctcaggagttgaccggtttttgagagt

SEQ ID NO: 169 - DNA, 46 bp, Artificial Sequence
  Synthetic
ccctcatttgttggaatagagtccttctttagttcctaaggccatt

SEQ ID NO: 170 - DNA, 40 bp, Artificial Sequence
  Synthetic
tccggatgtgccttcatctgaacaattctcggaaaggatg

SEQ ID NO: 171 - DNA, 40 bp, Artificial Sequence
  Synthetic
caaagagggcctgccactttcttgaggaaatgtcaaggga

SEQ ID NO: 172 - DNA, 41 bp, Artificial Sequence
  Synthetic
tccattcaagtcctccgatgagcttccaggacatactgctg

SEQ ID NO: 173 - DNA, 40 bp, Artificial Sequence
  Synthetic
tccatggctgtatggaggatctccagcgcaaaatgccata

SEQ ID NO: 174 - DNA, 47 bp, Artificial Sequence
  Synthetic
acttccattgtttcaaggcatgaattatggctttccttgaagaatcc

SEQ ID NO: 175 - DNA, 46 bp, Artificial Sequence
  Synthetic
agcctctcttattcagtctttgtttaaggagagtaagagacaacat

SEQ ID NO: 176 - DNA, 41 bp, Artificial Sequence
  Synthetic
tctcacaacatttgccagtttgggcgaaaagcttgaacagt

SEQ ID NO: 177 - DNA, 46 bp, Artificial Sequence
  Synthetic
gctggtatttgtgttcgaatcttcatgttctcaaacaaaatggcaa

SEQ ID NO: 178 - DNA, 45 bp, Artificial Sequence
  Synthetic
agcaaaatcgtcggatgattggcaaaagaaatacaccaagacaat

SEQ ID NO: 179 - DNA, 46 bp, Artificial Sequence
  Synthetic
ccaaggtcattgtttatcatgttgttctggagtaaatgaatcagct

SEQ ID NO: 180 - DNA, 39 bp, Artificial Sequence
  Synthetic
cgccaacagtaaggtgacgacagctggtgcatgtgggga

SEQ ID NO: 181 - DNA, 40 bp, Artificial Sequence
  Synthetic
gcctcgagcttgggcttctccttttactcggaggccacgg

SEQ ID NO: 182 - DNA, 42 bp, Artificial Sequence
  Synthetic
agtttcggggattgtgaaccgtcagatcacacgctctttcct

SEQ ID NO: 183 - DNA, 38 bp, Artificial Sequence
  Synthetic
agcagcgtggcggcgaaagtagacggggtagggagatc

SEQ ID NO: 184 - DNA, 39 bp, Artificial Sequence
  Synthetic
gcagtaccactaccgccacccaacggataacgcggtggc

SEQ ID NO: 185 - DNA, 43 bp, Artificial Sequence
  Synthetic
aatgttgcgttgttggagagtatcaactcttactgctctctcc

SEQ ID NO: 186 - DNA, 40 bp, Artificial Sequence
  Synthetic
caagaagcgaccgcagtgggtcataaagctgttgaccggc

SEQ ID NO: 187 - DNA, 40 bp, Artificial Sequence
  Synthetic
gcgtgctgcatagcttggcgtacgggagatacaaggagcg

SEQ ID NO: 188 - DNA, 38 bp, Artificial Sequence
  Synthetic
cggtgctttctgcagtgtgtgggcagccggcagaggat

SEQ ID NO: 189 - DNA, 38 bp, Artificial Sequence
  Synthetic
cgaaacgagaggctcagccgctgttacatcgccggcgg

SEQ ID NO: 190 - DNA, 36 bp, Artificial Sequence
  Synthetic
tccacaggtaccgcgtctgtcactcggaccgctcct

SEQ ID NO: 191 - DNA, 34 bp, Artificial Sequence
  Synthetic
ccggcggctgcagttgttgcgaactgtgcgtgcc

SEQ ID NO: 192 - DNA, 40 bp, Artificial Sequence
  Synthetic
cgcctcgttttcctcttcggtgcctgctgtgctactggtg

SEQ ID NO: 193 - DNA, 40 bp, Artificial Sequence
  Synthetic
gcgcctctctcatggatccactggtgagctggggaacagg

SEQ ID NO: 194 - DNA, 39 bp, Artificial Sequence
  Synthetic
tgacgtacccgccgggaacttccacgctgttttcgaaac

SEQ ID NO: 195 - DNA, 36 bp, Artificial Sequence
  Synthetic
tggagtttgcgcgcgtcgcaggtagcgcatgcagtg

SEQ ID NO: 196 - DNA, 37 bp, Artificial Sequence
  Synthetic
accccgtgcaacgtcgagatgcgcttcagatcgtgga

SEQ ID NO: 197 - DNA, 39 bp, Artificial Sequence
  Synthetic
gcagctatgctcgatgaccgagggctccagaaacaggca

SEQ ID NO: 198 - DNA, 36 bp, Artificial Sequence
  Synthetic
gccgtcaacagcgtgccttttggatgggctccgggt

SEQ ID NO: 199 - DNA, 40 bp, Artificial Sequence
  Synthetic
gccgacttggaggactttgccaactcctgctgctcactgt

SEQ ID NO: 200 - DNA, 37 bp, Artificial Sequence
  Synthetic
gccgtagttgtcgcggtcccaggacgtggtgacctcg

SEQ ID NO: 201 - DNA, 37 bp, Artificial Sequence
  Synthetic
cgactgccgcatggtttcctctcaccaagggcgggct

SEQ ID NO: 202 - DNA, 39 bp, Artificial Sequence
  Synthetic
cgctcgtcagcaggtagaaggctcggacaagatcacggc

SEQ ID NO: 203 - DNA, 37 bp, Artificial Sequence
  Synthetic
cccttgaacatcccgcagcacctgcggggaaacgaga

SEQ ID NO: 204 - DNA, 36 bp, Artificial Sequence
  Synthetic
gcgcggtcattctggccaatctggccgatggctgtg

SEQ ID NO: 205 - DNA, 33 bp, Artificial Sequence
  Synthetic
gctcgcagtagtggcgcacgtgtgcgcgctctt

SEQ ID NO: 206 - DNA, 38 bp, Artificial Sequence
  Synthetic
agtgcgtatacggggctgggagggctgctccaactttg

SEQ ID NO: 207 - DNA, 36 bp, Artificial Sequence
  Synthetic
aagcagccgcgtcttaagcgattgcgggacctgcgc

SEQ ID NO: 208 - DNA, 37 bp, Artificial Sequence
  Synthetic
ctacgcacctgtggccgcagggtgcacagcgacagtg

SEQ ID NO: 209 - DNA, 35 bp, Artificial Sequence
  Synthetic
taccagcggcccatggtgccgccgcggtagagcat

SEQ ID NO: 210 - DNA, 38 bp, Artificial Sequence
  Synthetic
ccgcgcacttttgccaagtcgccgctcagattccagga

SEQ ID NO: 211 - DNA, 36 bp, Artificial Sequence
  Synthetic
tggcgcagttctggcacggccaccgggaacaaagcg

SEQ ID NO: 212 - DNA, 40 bp, Artificial Sequence
  Synthetic
agacgcgcgtactcggaaacactacatcaaagggtcggct

SEQ ID NO: 213 - DNA, 42 bp, Artificial Sequence
  Synthetic
ccagacctccagcaacaccgtcatcagcaacgtgttatcggc

SEQ ID NO: 214 - DNA, 35 bp, Artificial Sequence
  Synthetic
acggtttccacgccaccgcgcagtacgggggtcga

SEQ ID NO: 215 - DNA, 35 bp, Artificial Sequence
  Synthetic
ctgcgcgaagaactgggctgaactcgcgacccacg

SEQ ID NO: 216 - DNA, 36 bp, Artificial Sequence
  Synthetic
cgtggttggagcagcaccagggtgccgcctggaaca

SEQ ID NO: 217 - DNA, 36 bp, Artificial Sequence
  Synthetic
ttctggcggtgggtcccgacgaagcccacactgacg

SEQ ID NO: 218 - DNA, 36 bp, Artificial Sequence
  Synthetic
ggcgtccgaatggtgggtagcacgccgatgtgcagc

SEQ ID NO: 219 - DNA, 37 bp, Artificial Sequence
  Synthetic
acgcggccattttgtgtttggcgggctctcgtcctgt

SEQ ID NO: 220 - DNA, 40 bp, Artificial Sequence
  Synthetic
tgtcaaccgtcgcatcacgcccagcccagcttttgtatga

SEQ ID NO: 221 - DNA, 39 bp, Artificial Sequence
  Synthetic
cgttgtggtagaacggcaaccggcttcctgcgacaccag

SEQ ID NO: 222 - DNA, 39 bp, Artificial Sequence
  Synthetic
cgcagattctcggccaacagctacccaccacgcgtttcg

SEQ ID NO: 223 - DNA, 38 bp, Artificial Sequence
  Synthetic
gcacccaggacctccggtacccgacaccgatcacgaag

SEQ ID NO: 224 - DNA, 38 bp, Artificial Sequence
  Synthetic
ccgcagaaagtcgaagatgcccggcaccaccgagacgt

SEQ ID NO: 225 - DNA, 40 bp, Artificial Sequence
  Synthetic
gtgagcaccatcagcacctgatcggaatgtcacaacgccg

SEQ ID NO: 226 - DNA, 41 bp, Artificial Sequence
  Synthetic
ggctgcagcgctttcagaattgacattcacgacctagacgc

SEQ ID NO: 227 - DNA, 37 bp, Artificial Sequence
  Synthetic
ttcgggtagctgcaggccgggccttggtacaggagca

SEQ ID NO: 228 - DNA, 39 bp, Artificial Sequence
  Synthetic
cggttgggcgcgttgatctagcgcaccaaccactggagg

SEQ ID NO: 229 - DNA, 36 bp, Artificial Sequence
  Synthetic
cagtccgccgctcattttgtgtgagcacggcgcaga

SEQ ID NO: 230 - DNA, 38 bp, Artificial Sequence
  Synthetic
tgatgcgggtgcgtagggtgctggcttttctggaggaa

SEQ ID NO: 231 - DNA, 35 bp, Artificial Sequence
  Synthetic
gaaagcgaagacggcgcccacgtggcaggcggtct

SEQ ID NO: 232 - DNA, 41 bp, Artificial Sequence
  Synthetic
gtcatggccaatcgtcgtctccagcctggtggaactcatca

SEQ ID NO: 233 - DNA, 38 bp, Artificial Sequence
  Synthetic
ggacccgaaaacgagggcgggctttcttggcgtacagc

SEQ ID NO: 234 - DNA, 38 bp, Artificial Sequence
  Synthetic
cgtgcaggatgacgtggattcttccgcgtcctcgtcga

SEQ ID NO: 235 - DNA, 37 bp, Artificial Sequence
  Synthetic
ggtgagagtagtggtggggctgtccacgccgcctcat

SEQ ID NO: 236 - DNA, 36 bp, Artificial Sequence
  Synthetic
gagaggaggagagccggcatagttgcacacggccga

SEQ ID NO: 237 - DNA, 35 bp, Artificial Sequence
  Synthetic
cggcgtcggcgtttccaactggcgccctggtacga

SEQ ID NO: 238 - DNA, 36 bp, Artificial Sequence
  Synthetic
catctctaccgccgccgtgcaagggcggcgacatct

SEQ ID NO: 239 - DNA, 39 bp, Artificial Sequence
  Synthetic
tgcgacgaacacgaagctctccgggtgacgttgtggatg

SEQ ID NO: 240 - DNA, 36 bp, Artificial Sequence
  Synthetic
caccgacacagcagcaccaggtccgtcgccgctgtt

SEQ ID NO: 241 - DNA, 41 bp, Artificial Sequence
  Synthetic
gcgtccgacgatgtgctcttctaacttgtccatcagcgacg

SEQ ID NO: 242 - DNA, 38 bp, Artificial Sequence
  Synthetic
cgtcttttcggcgctcaacaagaggcgcacctccgaaa

SEQ ID NO: 243 - DNA, 35 bp, Artificial Sequence
  Synthetic
acgcccgccagaagtacgctcggtaggcacgcgat

SEQ ID NO: 244 - DNA, 39 bp, Artificial Sequence
  Synthetic
tctgttggcggggctcacgcgtcgtaacaaagcacaggc

SEQ ID NO: 245 - DNA, 37 bp, Artificial Sequence
  Synthetic
agaggctacccgaccgtagcacaaccgcaacgatccc

SEQ ID NO: 246 - DNA, 38 bp, Artificial Sequence
  Synthetic
gacggtcgtggtctcctcggctggaggggtccggaaca

SEQ ID NO: 247 - DNA, 39 bp, Artificial Sequence
  Synthetic
acagtacgacggcaacccaacgtcttcttgcggtaccgg

SEQ ID NO: 248 - DNA, 40 bp, Artificial Sequence
  Synthetic
catcctgctgtcacacgacgaactgttgacggatgtgcaa

SEQ ID NO: 249 - DNA, 37 bp, Artificial Sequence
  Synthetic
aagcgcgtgcccacccaagtcgtcgtcatcgaaaggc

SEQ ID NO: 250 - DNA, 39 bp, Artificial Sequence
  Synthetic
acctggcatcgcagcctctttccgagaaacggctgtcgg

SEQ ID NO: 251 - DNA, 35 bp, Artificial Sequence
  Synthetic
tggcttacgacgctgacgcggcggcccagaaaacc

SEQ ID NO: 252 - DNA, 42 bp, Artificial Sequence
  Synthetic
ggtcgaacctcataacggtgggcacgcgtcctatgatgagtt

SEQ ID NO: 253 - DNA, 40 bp, Artificial Sequence
  Synthetic
cttgcgcttaccgatccgcttagattcgacggggaacgct

SEQ ID NO: 254 - DNA, 36 bp, Artificial Sequence
  Synthetic
gctcactcaacaccgccgtgacacgcgctttgggag

SEQ ID NO: 255 - DNA, 40 bp, Artificial Sequence
  Synthetic
acgtgacgatcaaaagtgcccgacgctactacatgcccct

SEQ ID NO: 256 - DNA, 36 bp, Artificial Sequence
  Synthetic
acgatgatggcccgcgacggaatttgcccgtgcgga

SEQ ID NO: 257 - DNA, 39 bp, Artificial Sequence
  Synthetic
gcaaccagtgctccactacgtcacgaccagtctccggac

SEQ ID NO: 258 - DNA, 35 bp, Artificial Sequence
  Synthetic
acatggacgccgcctctgcccgttcttcccgcgga

SEQ ID NO: 259 - DNA, 38 bp, Artificial Sequence
  Synthetic
atgcaaagacggcgcgggacgtggatccccattatccc

SEQ ID NO: 260 - DNA, 35 bp, Artificial Sequence
  Synthetic
tgttgtgtccgccgctgctggtcaccgtggtcagt

SEQ ID NO: 261 - DNA, 36 bp, Artificial Sequence
  Synthetic
cccgggcactgatcctgaccagcgtgagagccccgt

SEQ ID NO: 262 - DNA, 39 bp, Artificial Sequence
  Synthetic
cacgctgaccggcgatcaggcggaaaaagtggatgcggc

SEQ ID NO: 263 - DNA, 34 bp, Artificial Sequence
  Synthetic
ttggcccacgacgcctgacgcagcgcaaaggcca

SEQ ID NO: 264 - DNA, 40 bp, Artificial Sequence
  Synthetic
gcgactcctggacctgcgtaaaaacagcagagaaccgagg

SEQ ID NO: 265 - DNA, 37 bp, Artificial Sequence
  Synthetic
agatgtggcaggcgcgtctactggttctgctgacgcg

SEQ ID NO: 266 - DNA, 38 bp, Artificial Sequence
  Synthetic
acaaccccacgggccgaagagcgcgtacacatagatcg

SEQ ID NO: 267 - DNA, 34 bp, Artificial Sequence
  Synthetic
tctcggtgctgggcgcttggacgccagtcgcatg

SEQ ID NO: 268 - DNA, 39 bp, Artificial Sequence
  Synthetic
agggactggaggtgcgcgtagatacgtaacgtgtgcgag

SEQ ID NO: 269 - DNA, 37 bp, Artificial Sequence
  Synthetic
cgctgtgctggcatcgagttacggctggtgagtccac

SEQ ID NO: 270 - DNA, 40 bp, Artificial Sequence
  Synthetic
ccatgacctacgtgcgcaagtttcctggcacttgacgagc

SEQ ID NO: 271 - DNA, 40 bp, Artificial Sequence
  Synthetic
tcgctcgaccgttcgtacgaaagtaatggtctgcagctgc

SEQ ID NO: 272 - DNA, 40 bp, Artificial Sequence
  Synthetic
gcggtctccacgtcaggtacgaatcgagtcttcgggggtg

SEQ ID NO: 273 - DNA, 36 bp, Artificial Sequence
  Synthetic
aacgcgctgcacgaccacttccatgttacgcggcag

SEQ ID NO: 274 - DNA, 36 bp, Artificial Sequence
  Synthetic
cggaacccgccatgcaacgagcaccgcccatgggtt

SEQ ID NO: 275 - DNA, 38 bp, Artificial Sequence
  Synthetic
cgctcgagctcctgcctaaagtccggcgctggtcttga

SEQ ID NO: 276 - DNA, 40 bp, Artificial Sequence
  Synthetic
tcccagtaacagacgacccagtgcctgtccgatacacgtg

SEQ ID NO: 277 - DNA, 41 bp, Artificial Sequence
  Synthetic
gccacgtggttttcgagaacgtgacgttgttgttgcggatc

SEQ ID NO: 278 - DNA, 37 bp, Artificial Sequence
  Synthetic
gggagcgcggtggaagacaaccgtcagaatcgacggt

SEQ ID NO: 279 - DNA, 35 bp, Artificial Sequence
  Synthetic
tctcccccgattccagcgtgtcaacggcggtcgga

SEQ ID NO: 280 - DNA, 37 bp, Artificial Sequence
  Synthetic
cgctcatccgcgtgctctgaagggctgttcgatgtgg

SEQ ID NO: 281 - DNA, 37 bp, Artificial Sequence
  Synthetic
cacggcgtgtccttgctacccacctgcgagttgaggc

SEQ ID NO: 282 - DNA, 37 bp, Artificial Sequence
  Synthetic
ttcacgtccgggtggctgccgtgttcgagcacctgac

SEQ ID NO: 283 - DNA, 42 bp, Artificial Sequence
  Synthetic
ggcgctgatgatgttgacgtcgcgtagccacctgttggaacc

SEQ ID NO: 284 - DNA, 38 bp, Artificial Sequence
  Synthetic
agatgatgcaccccgaactcgccgcagaaggccatgag

SEQ ID NO: 285 - DNA, 35 bp, Artificial Sequence
  Synthetic
gcctaacctccgctcgcactggcggccgaatctcc

SEQ ID NO: 286 - DNA, 41 bp, Artificial Sequence
  Synthetic
gcggaggaagattcgtctgagccgtcttcgtcgtccctagt

SEQ ID NO: 287 - DNA, 36 bp, Artificial Sequence
  Synthetic
ggccgacgctggttctcctcgtgatgcgtgacggag

SEQ ID NO: 288 - DNA, 39 bp, Artificial Sequence
  Synthetic
ggtcgcagatgagcagcttctgcgcgaatgttaccaccc

SEQ ID NO: 289 - DNA, 36 bp, Artificial Sequence
  Synthetic
ttctccaacgcgcggcaggcatgggtacggaggcgt

SEQ ID NO: 290 - DNA, 42 bp, Artificial Sequence
  Synthetic
cgtccaggttactcggggaacagcataatctgcgaggaggac

SEQ ID NO: 291 - DNA, 39 bp, Artificial Sequence
  Synthetic
tcgtcctccccttcgtccggtctctacgctcctacgaca

SEQ ID NO: 292 - DNA, 39 bp, Artificial Sequence
  Synthetic
accactagcttggctacgtggagcactgggcgtggaaac

SEQ ID NO: 293 - DNA, 40 bp, Artificial Sequence
  Synthetic
tcgtcgcgctccagcacatacctacgatttggccatgtcg

SEQ ID NO: 294 - DNA, 41 bp, Artificial Sequence
  Synthetic
cgcgctctcttgaacacgacaattggcgcaaactttttggc

SEQ ID NO: 295 - DNA, 37 bp, Artificial Sequence
  Synthetic
cggatctgcggctcaaacacccgcgaagtgcagcagg

SEQ ID NO: 296 - DNA, 37 bp, Artificial Sequence
  Synthetic
gactttacggtgcgcggcgatggaaaccagcagcccg

SEQ ID NO: 297 - DNA, 40 bp, Artificial Sequence
  Synthetic
tctgccgccaccaaaagatctgtggcggtcaccactttca

SEQ ID NO: 298 - DNA, 35 bp, Artificial Sequence
  Synthetic
tttccctaccgcgcgctggcgctccacaccaacag

SEQ ID NO: 299 - DNA, 36 bp, Artificial Sequence
  Synthetic
tccacgatgtcggcgatgactccagcgcctgcagat

SEQ ID NO: 300 - DNA, 41 bp, Artificial Sequence
  Synthetic
cccccagggcgttgtaaaagtccttatgctgcgctacatgc

SEQ ID NO: 301 - DNA, 36 bp, Artificial Sequence
  Synthetic
ggggatgtcgtgggtctcctccagagcgtgccggta

SEQ ID NO: 302 - DNA, 40 bp, Artificial Sequence
  Synthetic
gcgcttgagaaaaatgtcgcggggcgctgctttctttcga

SEQ ID NO: 303 - DNA, 36 bp, Artificial Sequence
  Synthetic
agccctcgagcgtgtacgtcggctccttcgtgggca

SEQ ID NO: 304 - DNA, 39 bp, Artificial Sequence
  Synthetic
tgcagactcttgccctgcgctttgtgctcgacgttaacg

SEQ ID NO: 305 - DNA, 39 bp, Artificial Sequence
  Synthetic
acagcctggatctcaccgtcagcctccggatcacatggt

SEQ ID NO: 306 - DNA, 36 bp, Artificial Sequence
  Synthetic
cgctggatgacggtgatgcgtgtacacggccggcga

SEQ ID NO: 307 - DNA, 40 bp, Artificial Sequence
  Synthetic
actgctgtggtgttgccttctggtaggagcgacgctgacg

SEQ ID NO: 308 - DNA, 42 bp, Artificial Sequence
  Synthetic
gccacgacaaacactaccgtcgtgaagtgacgttaggggagg

SEQ ID NO: 309 - DNA, 39 bp, Artificial Sequence
  Synthetic
tgcatccgtccggtggtgcccacatctggtatacacccg

SEQ ID NO: 310 - DNA, 39 bp, Artificial Sequence
  Synthetic
ttccgtgctggcgatcgcgtacttttcactcccgggtgc

SEQ ID NO: 311 - DNA, 41 bp, Artificial Sequence
  Synthetic
tctacccaccctgcgagacatcgcgtacaggagtcctaggt

SEQ ID NO: 312 - DNA, 36 bp, Artificial Sequence
  Synthetic
agtgtgccgcacaaggccgtgcaagcccattccccg

SEQ ID NO: 313 - DNA, 38 bp, Artificial Sequence
  Synthetic
cccctggtcttcaagcacacttacgcagcccagcctag

SEQ ID NO: 314 - DNA, 38 bp, Artificial Sequence
  Synthetic
gagatgccaacagtgttgctacaggaagcttacagggt

SEQ ID NO: 315 - DNA, 42 bp, Artificial Sequence
  Synthetic
cgtacttttccactccaggcgatatgtgcggtatgattttgc

SEQ ID NO: 316 - DNA, 41 bp, Artificial Sequence
  Synthetic
gttaggtcgctactcgctgggatgattccgtagacgccagg

SEQ ID NO: 317 - DNA, 40 bp, Artificial Sequence
  Synthetic
gagcaagttaccatcccctgcatgcgcgaatggaaaccat

SEQ ID NO: 318 - DNA, 39 bp, Artificial Sequence
  Synthetic
agggttgagggggccgttcggatctacgtcccagtctct

SEQ ID NO: 319 - DNA, 36 bp, Artificial Sequence
  Synthetic
aacgacgacgcggttgcccgacgtcgtacgagtcgc

SEQ ID NO: 320 - DNA, 38 bp, Artificial Sequence
  Synthetic
gccacaaaagccaccgcggcgagagattctccagcccg

SEQ ID NO: 321 - DNA, 38 bp, Artificial Sequence
  Synthetic
tgcgcgctgctggtgttttattgcaacagcttcgacgg

SEQ ID NO: 322 - DNA, 36 bp, Artificial Sequence
  Synthetic
acgaaggtccaagcggcgggcggatgctggtcgttg

SEQ ID NO: 323 - DNA, 38 bp, Artificial Sequence
  Synthetic
cgcgtgactctctgttcgatggcagctccaagcgccgt

SEQ ID NO: 324 - DNA, 38 bp, Artificial Sequence
  Synthetic
cccaacggtcacacgtccggaaagccgtcccggtcatt

SEQ ID NO: 325 - DNA, 35 bp, Artificial Sequence
  Synthetic
caacgcggcacttccaacagtgtggtgcacggcgt

SEQ ID NO: 326 - DNA, 35 bp, Artificial Sequence
  Synthetic
ttcgcacacccagcccctgggatcggtcgtcgcgt

SEQ ID NO: 327 - DNA, 35 bp, Artificial Sequence
  Synthetic
ccgacgtcccgcatccaactggcgtgcgaggaaga

SEQ ID NO: 328 - DNA, 38 bp, Artificial Sequence
  Synthetic
gaacacgcgcaacagggccgatgtcgggcgtccaccta

SEQ ID NO: 329 - DNA, 39 bp, Artificial Sequence
  Synthetic
tatcgtcgggtcggctgtccaaagcctggttggatctcg

SEQ ID NO: 330 - DNA, 39 bp, Artificial Sequence
  Synthetic
cctcgtcatcctccgtgtcggtagcctcctccaccacgg

SEQ ID NO: 331 - DNA, 40 bp, Artificial Sequence
  Synthetic
ggcccactttcgggtggaggcttgaagtacagcatgccca

SEQ ID NO: 332 - DNA, 41 bp, Artificial Sequence
  Synthetic
ggtgccgaaatcaccgtgtgaaaaaccgcgactttccacac

SEQ ID NO: 333 - DNA, 37 bp, Artificial Sequence
  Synthetic
atgtcgcgacacccgggtcgcccacccccattacacg

SEQ ID NO: 334 - DNA, 43 bp, Artificial Sequence
  Synthetic
agaacatatataatcgccgtttcgtacggatcaagaggtccat

SEQ ID NO: 335 - DNA, 35 bp, Artificial Sequence
  Synthetic
agcacggggtactcgtggcgctctcggggccgtat

SEQ ID NO: 336 - DNA, 42 bp, Artificial Sequence
  Synthetic
gaaggaaaccgaccccgaaactagcgttcataacaatcccgg

SEQ ID NO: 337 - DNA, 37 bp, Artificial Sequence
  Synthetic
ctcaacctgtgcgccacagcgttgcaggccacgaaca

SEQ ID NO: 338 - DNA, 39 bp, Artificial Sequence
  Synthetic
ccctcactgggctacgagtgcaccggtgtgcagctaagc

SEQ ID NO: 339 - DNA, 37 bp, Artificial Sequence
  Synthetic
tcatctacgtgccccccggggacccaagccagactgc

SEQ ID NO: 340 - DNA, 37 bp, Artificial Sequence
  Synthetic
tcagcgaaaccggcacccgggccggcgagtaatagca

SEQ ID NO: 341 - DNA, 35 bp, Artificial Sequence
  Synthetic
ggctgtcatgggtctgcgcagccgccgaaacacga

SEQ ID NO: 342 - DNA, 37 bp, Artificial Sequence
  Synthetic
atcgttcacgtcgccgccgccgaaagcgtcgtgagca

SEQ ID NO: 343 - DNA, 37 bp, Artificial Sequence
  Synthetic
acagcagccgcgcttgtctaggggactacctcctcga

SEQ ID NO: 344 - DNA, 39 bp, Artificial Sequence
  Synthetic
gcgtctacgtggtgatgctgcccaatcggcgtcgcttag

SEQ ID NO: 345 - DNA, 37 bp, Artificial Sequence
  Synthetic
aggcctggttacagcgcgggggacctgtttcagcgtg

SEQ ID NO: 346 - DNA, 40 bp, Artificial Sequence
  Synthetic
gcaaccccgccaactggttcgcgtaaatctgcgggatagc

SEQ ID NO: 347 - DNA, 36 bp, Artificial Sequence
  Synthetic
tgttcgacagcggcgtagactcgcctcgacagagcc

SEQ ID NO: 348 - DNA, 38 bp, Artificial Sequence
  Synthetic
ggtcatgacaccgacgcgttgaagttcacgtcgcgtcc

SEQ ID NO: 349 - DNA, 35 bp, Artificial Sequence
  Synthetic
gtcgctcggcattccgcactccggcatggtgctgc

SEQ ID NO: 350 - DNA, 38 bp, Artificial Sequence
  Synthetic
agttgtgccgccggagctataacgccatgggatcctca

SEQ ID NO: 351 - DNA, 39 bp, Artificial Sequence
  Synthetic
aaccagatggcgacggacgtcctgaacagaccgctaacc

SEQ ID NO: 352 - DNA, 39 bp, Artificial Sequence
  Synthetic
tgctaaccacgcaaccggatctgatgctgttgtcgtgca

SEQ ID NO: 353 - DNA, 36 bp, Artificial Sequence
  Synthetic
atcccggcaagttgcgcgccaccaccgcattaaccg

SEQ ID NO: 354 - DNA, 38 bp, Artificial Sequence
  Synthetic
cgcctgctctctccaggtccggaccttctgggaccagt

SEQ ID NO: 355 - DNA, 40 bp, Artificial Sequence
  Synthetic
gccttccagactgcacggccataggcagcgacgtgtatgg

SEQ ID NO: 356 - DNA, 36 bp, Artificial Sequence
  Synthetic
cagaaaacacccccccgcccggacgcccgacatcca

SEQ ID NO: 357 - DNA, 43 bp, Artificial Sequence
  Synthetic
tcttccccatattccttcattgtctctttgtgcgacagtgctt

SEQ ID NO: 358 - DNA, 44 bp, Artificial Sequence
  Synthetic
tgtagtcgtatagatccggaagaaatggacagtggtgaatagca

SEQ ID NO: 359 - DNA, 40 bp, Artificial Sequence
  Synthetic
ttcgcctctctcggactgactaagacaggaaatggcaagc

SEQ ID NO: 360 - DNA, 44 bp, Artificial Sequence
  Synthetic
tcctcaaagtccaatttttccggaaacaagccaattaatgtggg

SEQ ID NO: 361 - DNA, 40 bp, Artificial Sequence
  Synthetic
caatgtgctcaattggggcagattcgagctggatagaact

SEQ ID NO: 362 - DNA, 47 bp, Artificial Sequence
  Synthetic
ccatactcacaaagttcaccacgtgttcattataaaaggaaggtccc

SEQ ID NO: 363 - DNA, 44 bp, Artificial Sequence
  Synthetic
tctctttgatagaagactcagcctctgccttcttcaatctcttc

SEQ ID NO: 364 - DNA, 44 bp, Artificial Sequence
  Synthetic
cagatgccctgatctcagtagcgatcctatgaacagatggaaac

SEQ ID NO: 365 - DNA, 44 bp, Artificial Sequence
  Synthetic
cctctttgtcatacaggatcagctaggtccaatttacaggagaa

SEQ ID NO: 366 - DNA, 43 bp, Artificial Sequence
  Synthetic
ccattttcgcctctccagaaattcatggaactgattcggatga

SEQ ID NO: 367 - DNA, 43 bp, Artificial Sequence
  Synthetic
ttgaagcaatttgaacccctctattagagggacaagaatggtc

SEQ ID NO: 368 - DNA, 43 bp, Artificial Sequence
  Synthetic
gcatttcagttttcgcgcctaaagaaatgatgttttttgggcg

SEQ ID NO: 369 - DNA, 41 bp, Artificial Sequence
  Synthetic
tccaatatgtcgtcagcttcctgggcgccattatgagaact

SEQ ID NO: 370 - DNA, 41 bp, Artificial Sequence
  Synthetic
ccgaatcgctacagggaaagcccacaactgcaccctgaaga

SEQ ID NO: 371 - DNA, 38 bp, Artificial Sequence
  Synthetic
acatctacgcctcccagtcagaagtgcggttccagaag

SEQ ID NO: 372 - DNA, 42 bp, Artificial Sequence
  Synthetic
tactgcaagagctggcgaactcttagtaatggagttggaaac

SEQ ID NO: 373 - DNA, 42 bp, Artificial Sequence
  Synthetic
gcgccagcgagtaaatgcaaacacatgtcaatgcagctgtgg

SEQ ID NO: 374 - DNA, 44 bp, Artificial Sequence
  Synthetic
gcgcatgaagtaatggttactgtttgcttttgctaaattggcct

SEQ ID NO: 375 - DNA, 47 bp, Artificial Sequence
  Synthetic
aggcattttctgaagctgcattagtgtacttgctttaattgtagagg

SEQ ID NO: 376 - DNA, 45 bp, Artificial Sequence
  Synthetic
accccatttaaacacactctagaaagtaacttcagccactcaaac

SEQ ID NO: 377 - DNA, 42 bp, Artificial Sequence
  Synthetic
ggcgagggtccaatagttgcataggatctacagtggacggtc

SEQ ID NO: 378 - DNA, 43 bp, Artificial Sequence
  Synthetic
aggctcatctttacaaaatactggagtaagctcttgaccaccg

SEQ ID NO: 379 - DNA, 48 bp, Artificial Sequence
  Synthetic
tggttctccacaatatgaatccaagtgattgtattttgagattggcaa

SEQ ID NO: 380 - DNA, 42 bp, Artificial Sequence
  Synthetic
tgggaagtctcagttgttgcgtacagtttctggagcaggtgt

SEQ ID NO: 381 - DNA, 40 bp, Artificial Sequence
  Synthetic
cgcaacgaggaagtttgctggagcttcagcagttgcaagc

SEQ ID NO: 382 - DNA, 42 bp, Artificial Sequence
  Synthetic
ttaaatgccttcagtgtcctcacaagacaaagcctctgtagc

SEQ ID NO: 383 - DNA, 45 bp, Artificial Sequence
  Synthetic
tggtcagaattcctgtacgaggatccgtatacagatttaaggggt

SEQ ID NO: 384 - DNA, 40 bp, Artificial Sequence
  Synthetic
gtgtactcacccaaccagttgcttggtcttcatcgctttc

SEQ ID NO: 385 - DNA, 42 bp, Artificial Sequence
  Synthetic
ccaccattttccccacctggaattgcggcaatattgagttgc

SEQ ID NO: 386 - DNA, 38 bp, Artificial Sequence
  Synthetic
atgcatcggccctcacacacgcccgctcataggggtta

SEQ ID NO: 387 - DNA, 42 bp, Artificial Sequence
  Synthetic
ggttcttaccgtgcagatgcaaggtattcctccttatccttc

SEQ ID NO: 388 - DNA, 43 bp, Artificial Sequence
  Synthetic
ggacgtccctggaccctttaaaataatattttgccagctcttg

SEQ ID NO: 389 - DNA, 47 bp, Artificial Sequence
  Synthetic
actttctactgcttaaccccagaaatgtaagcggtttctataggtac

SEQ ID NO: 390 - DNA, 42 bp, Artificial Sequence
  Synthetic
acactgcgcacgcttttacaaaaagtagaaatctcgtcggcg

SEQ ID NO: 391 - DNA, 39 bp, Artificial Sequence
  Synthetic
ctggacatgcaggtcgagggtgcattgccactaccgttt

SEQ ID NO: 392 - DNA, 36 bp, Artificial Sequence
  Synthetic
ttcctccgggagctcgtccgacggttccacggtgca

SEQ ID NO: 393 - DNA, 45 bp, Artificial Sequence
  Synthetic
cactattgaacgtgcgggacatgttatcttggtaggcaatttctg

SEQ ID NO: 394 - DNA, 41 bp, Artificial Sequence
  Synthetic
cgtcgcggcgaaatgattgaaagtgggggttgtcttcttcg

SEQ ID NO: 395 - DNA, 38 bp, Artificial Sequence
  Synthetic
ttgctcagcttcctggtactcagtcacagtcacaaggt

SEQ ID NO: 396 - DNA, 40 bp, Artificial Sequence
  Synthetic
accgctttgtagatgtggatgacaagcactgcctgttgaa

SEQ ID NO: 397 - DNA, 39 bp, Artificial Sequence
  Synthetic
gctgccggcatcacatggatcttccaacatgaggcggtg

SEQ ID NO: 398 - DNA, 41 bp, Artificial Sequence
  Synthetic
ggatcctgccggtttcgaaccccgtggtttggtggaaaagt

SEQ ID NO: 399 - DNA, 39 bp, Artificial Sequence
  Synthetic
gcgaaacatgttctgacgaggcctcctgagcgtcaccca

SEQ ID NO: 400 - DNA, 42 bp, Artificial Sequence
  Synthetic
agcttctacaaagtcccaaagatggcacactaatagcgcgag

SEQ ID NO: 401 - DNA, 37 bp, Artificial Sequence
  Synthetic
cgcttggctgccaccgtaggacgggagcaggaacaga

SEQ ID NO: 402 - DNA, 42 bp, Artificial Sequence
  Synthetic
gctttgctatccaacaaagcatttcagtagtgccgtctcgta

SEQ ID NO: 403 - DNA, 43 bp, Artificial Sequence
  Synthetic
aaaagtaatcgggtccagactgatagccttgcgactaatggtt

SEQ ID NO: 404 - DNA, 44 bp, Artificial Sequence
  Synthetic
gcatttgtaaagtattccccgttcatcgagctttcattaatcgc

SEQ ID NO: 405 - DNA, 40 bp, Artificial Sequence
  Synthetic
ttttgcgtcgctgccaacgtgaatgggaggaaagacagcc

SEQ ID NO: 406 - DNA, 45 bp, Artificial Sequence
  Synthetic
ggcatgttggtatgtaagatggttttggcacgcaaactattaact

SEQ ID NO: 407 - DNA, 40 bp, Artificial Sequence
  Synthetic
ctaattgggtttcggggtccctgctggaaagtgacattgg

SEQ ID NO: 408 - DNA, 45 bp, Artificial Sequence
  Synthetic
agttgtaactgcgtcctttgggccttaaataaggctgctaggatt

SEQ ID NO: 409 - DNA, 40 bp, Artificial Sequence
  Synthetic
cgcactggatgttggctagaccgtaacaacacgggctggg

SEQ ID NO: 410 - DNA, 36 bp, Artificial Sequence
  Synthetic
gctgcccgcatcatagctcgcggccagagcgttggt

SEQ ID NO: 411 - DNA, 40 bp, Artificial Sequence
  Synthetic
aactcgacgccgtctgctgacaagcgcgatatcaagcatg

SEQ ID NO: 412 - DNA, 41 bp, Artificial Sequence
  Synthetic
cctctaacttttgccgcttaggttaaaagggaagccatgga

SEQ ID NO: 413 - DNA, 40 bp, Artificial Sequence
  Synthetic
tgatggacctcgtctacggctagggtaccgtgggacaact

SEQ ID NO: 414 - DNA, 38 bp, Artificial Sequence
  Synthetic
aacggatccgggcacagtttgcccgacgaggtaatggt

SEQ ID NO: 415 - DNA, 41 bp, Artificial Sequence
  Synthetic
gccatcttgaaagcgctggtgcctatgttagcgccagagga

SEQ ID NO: 416 - DNA, 40 bp, Artificial Sequence
  Synthetic
ccacgatccagtacccctcgaactttacgctggctgtggg

SEQ ID NO: 417 - DNA, 42 bp, Artificial Sequence
  Synthetic
tgtttgctgcattgttagctgagacaatccaaggatgacaac

SEQ ID NO: 418 - DNA, 40 bp, Artificial Sequence
  Synthetic
actgcggaattccacaaggacagttaatgctggatgcttt

SEQ ID NO: 419 - DNA, 47 bp, Artificial Sequence
  Synthetic
ggtagttttatgtttcctggagtgtgaagcttcttgtactcaaatgt

SEQ ID NO: 420 - DNA, 42 bp, Artificial Sequence
  Synthetic
agtgtgctctgaagaatcatgtttcccggttcctacacttac

SEQ ID NO: 421 - DNA, 41 bp, Artificial Sequence
  Synthetic
aggtgccgtctaaatagggaatgctgggttcagggtttgac

SEQ ID NO: 422 - DNA, 43 bp, Artificial Sequence
  Synthetic
agttgttatgttgaaactctacggtgagtaggcaagttgtgga

SEQ ID NO: 423 - DNA, 40 bp, Artificial Sequence
  Synthetic
gggtccacagcctagatctcgaccctcccagactgctgta

SEQ ID NO: 424 - DNA, 42 bp, Artificial Sequence
  Synthetic
gaacatacaacaaaacaggccgtaccctagaaaagtcaaccc

SEQ ID NO: 425 - DNA, 40 bp, Artificial Sequence
  Synthetic
gctccccccctaggcttgttatggttggtgggcagggata

SEQ ID NO: 426 - DNA, 39 bp, Artificial Sequence
  Synthetic
cttttatgctggccgactacccactggcataaggagacg

SEQ ID NO: 427 - DNA, 42 bp, Artificial Sequence
  Synthetic
ctgcgtgtgggagcataagtgtcaccatctccattccatgca

SEQ ID NO: 428 - DNA, 38 bp, Artificial Sequence
  Synthetic
gttgttgttcgcaatccggcgcttccatgcctttttcc

SEQ ID NO: 429 - DNA, 40 bp, Artificial Sequence
  Synthetic
tcctcggggggagtctcgtactactcataccccaagacgc

SEQ ID NO: 430 - DNA, 43 bp, Artificial Sequence
  Synthetic
gacaggataggggtattttgtgattagtttttgcagtgccaga

SEQ ID NO: 431 - DNA, 41 bp, Artificial Sequence
  Synthetic
gcctccgggtcttgcaagttttgagcgcagtgatgaatcag

SEQ ID NO: 432 - DNA, 40 bp, Artificial Sequence
  Synthetic
aagcattgctgccaaacaccctgcatttaccttttcctgt

SEQ ID NO: 433 - DNA, 43 bp, Artificial Sequence
  Synthetic
attgctgtcagactgcggtcactgaactattaagtgaaagtca

SEQ ID NO: 434 - DNA, 40 bp, Artificial Sequence
  Synthetic
ttgcggctttcggggacatgttccatcacctttgtgtgct

SEQ ID NO: 435 - DNA, 40 bp, Artificial Sequence
  Synthetic
catgagcagtagccccgacgtgggacaccattgaaaccag

SEQ ID NO: 436 - DNA, 40 bp, Artificial Sequence
  Synthetic
tcgtgttcttgacctcgactgaaaacgcatttttcccact

SEQ ID NO: 437 - DNA, 41 bp, Artificial Sequence
  Synthetic
gagagcggcttgttctagcagtccccacatgatttccaggg

SEQ ID NO: 438 - DNA, 43 bp, Artificial Sequence
  Synthetic
cgggaacaggacaaatgcaatagctattggtggaaaaagatca

SEQ ID NO: 439 - DNA, 42 bp, Artificial Sequence
  Synthetic
aaatgcttgcgtacagggtgatttcaacctattaacctggga

SEQ ID NO: 440 - DNA, 47 bp, Artificial Sequence
  Synthetic
agccagaaggtaaagaaaagagaaactaacttgtttctagtgcaaca

SEQ ID NO: 441 - DNA, 47 bp, Artificial Sequence
  Synthetic
ccgtagtaccatcgactgacattattgtcacattacaattaactgca

SEQ ID NO: 442 - DNA, 48 bp, Artificial Sequence
  Synthetic
gaaccgtcaccatactgtaagaaatttctaaaacagaacctcttatgc

SEQ ID NO: 443 - DNA, 49 bp, Artificial Sequence
  Synthetic
ttggatattcgggaagatcatcagtctcctctgtagtttctttacaact

SEQ ID NO: 444 - DNA, 45 bp, Artificial Sequence
  Synthetic
tgttctttgcctggtaaagattcataaaaggacttttttgcctgg

SEQ ID NO: 445 - DNA, 42 bp, Artificial Sequence
  Synthetic
gtttgcaagtctgtcaggtttgaccatggtctccgtgtactc

SEQ ID NO: 446 - DNA, 44 bp, Artificial Sequence
  Synthetic
aaggggctccaaaacattgatatcggaataaaacttaatgccca

SEQ ID NO: 447 - DNA, 42 bp, Artificial Sequence
  Synthetic
gggtaagagcgttgttgcgaactgtaaattctagcggtgccc

SEQ ID NO: 448 - DNA, 46 bp, Artificial Sequence
  Synthetic
gctcgcatcaaagggataattaacagggtcatgaaagtaaacgttg

SEQ ID NO: 449 - DNA, 50 bp, Artificial Sequence
  Synthetic
ggttgatgtgattaatcttccctgtcctaaatatccaaagtactactacc

SEQ ID NO: 450 - DNA, 45 bp, Artificial Sequence
  Synthetic
gcaatttgtgttttgtgtgtgtttaaatcagcctttctctacacc

SEQ ID NO: 451 - DNA, 43 bp, Artificial Sequence
  Synthetic
gatggacactgactgttgttactttgtcactcaagcggcattc

SEQ ID NO: 452 - DNA, 42 bp, Artificial Sequence
  Synthetic
gatgcttttgggacgctggtacaccttttgttaattaaggcg

SEQ ID NO: 453 - DNA, 46 bp, Artificial Sequence
  Synthetic
aaagctacgttgagtacttcggatgtaaagtcagactattacactc

SEQ ID NO: 454 - DNA, 45 bp, Artificial Sequence
  Synthetic
tgccacctgcgagatttacgcaaggtagaggcataaaaacttaat

SEQ ID NO: 455 - DNA, 46 bp, Artificial Sequence
  Synthetic
tgctggcttctgatttgtatgatttagatttacattaggctccaca

SEQ ID NO: 456 - DNA, 38 bp, Artificial Sequence
  Synthetic
aagcatgtttcagaggtcgcgttccgtaaagactccgg

SEQ ID NO: 457 - DNA, 44 bp, Artificial Sequence
  Synthetic
gcctaaacaagagggcgactcccatgtggaggtataacaaaatt

SEQ ID NO: 458 - DNA, 42 bp, Artificial Sequence
  Synthetic
cttctcgtaggcactttgcggaccggtacccttgtatacgct

SEQ ID NO: 459 - DNA, 42 bp, Artificial Sequence
  Synthetic
agggagacatcaaggctgggtttttctcaagacccgtccaag

SEQ ID NO: 460 - DNA, 40 bp, Artificial Sequence
  Synthetic
ccactgccaccaacaaacatccgccatggggagatctgga

SEQ ID NO: 461 - DNA, 42 bp, Artificial Sequence
  Synthetic
gtgcggtagctttaatggcctccattgctcctatcaaatcag

SEQ ID NO: 462 - DNA, 45 bp, Artificial Sequence
  Synthetic
tctttgttcttctgaagaaatgggagccttcaatcatcatgtcac

SEQ ID NO: 463 - DNA, 43 bp, Artificial Sequence
  Synthetic
gtgtgaaattcgcccatagggaatgaatgataacacaaatgcc

SEQ ID NO: 464 - DNA, 41 bp, Artificial Sequence
  Synthetic
gcaggtattgggtggctctggctaagccaaaacatacaaca

SEQ ID NO: 465 - DNA, 43 bp, Artificial Sequence
  Synthetic
cctatggttccatgtacacacaacggtgaaggaccatgttctc

SEQ ID NO: 466 - DNA, 45 bp, Artificial Sequence
  Synthetic
acttgtcaccaatccattccaagtggttgaaaaagtttactgagt

SEQ ID NO: 467 - DNA, 42 bp, Artificial Sequence
  Synthetic
ggtctcttccatctggattttgactggctacaaccaacagga

SEQ ID NO: 468 - DNA, 41 bp, Artificial Sequence
  Synthetic
ccccggagttgaatcatctccagtgtgtggagtacaatctc

SEQ ID NO: 469 - DNA, 46 bp, Artificial Sequence
  Synthetic
tccacatcattttcatctgtgacaaagtagaggacacaattctgat

SEQ ID NO: 470 - DNA, 42 bp, Artificial Sequence
  Synthetic
ggttctttttcaccggggaatataaagcctatcaacacacca

SEQ ID NO: 471 - DNA, 43 bp, Artificial Sequence
  Synthetic
aaacacccttctgaagttagctgagggaaaacaagagctatcg

SEQ ID NO: 472 - DNA, 41 bp, Artificial Sequence
  Synthetic
gaggccagaaacggctatcttgatgtgatagcttcataccc

SEQ ID NO: 473 - DNA, 42 bp, Artificial Sequence
  Synthetic
gtcgtccaaggttgcaggtcacagtgcatttctactaaatcc

SEQ ID NO: 474 - DNA, 46 bp, Artificial Sequence
  Synthetic
ctcctcctctgtaatctcatactcaaaatgacttagtgttaccagc

SEQ ID NO: 475 - DNA, 47 bp, Artificial Sequence
  Synthetic
ttctgcttcatggacaatataccaaaagaagtcttaacagaaatggc

SEQ ID NO: 476 - DNA, 47 bp, Artificial Sequence
  Synthetic
ggagttattttcacagcctgcaaccgaaagtataacaaaagtccaga

SEQ ID NO: 477 - DNA, 49 bp, Artificial Sequence
  Synthetic
aactctctgttaacatagcatgcttatatcaaatgttatgtgatcctcc

SEQ ID NO: 478 - DNA, 44 bp, Artificial Sequence
  Synthetic
tcagaattgcttcttgaagtgcatcctgaagaggaaaacaatgg

SEQ ID NO: 479 - DNA, 47 bp, Artificial Sequence
  Synthetic
acagtccagttctgctaaatctttgcgggagaaagagcttattttac

SEQ ID NO: 480 - DNA, 40 bp, Artificial Sequence
  Synthetic
gggccctgattttccttctcgtccaccacgtcccctgaaa

SEQ ID NO: 481 - DNA, 45 bp, Artificial Sequence
  Synthetic
actcatgaataagaagttgcagcaatattgttaaagggcacagca

SEQ ID NO: 482 - DNA, 41 bp, Artificial Sequence
  Synthetic
tcagcaaacgatcagcaagagtgcaattgcctacctgatgt

SEQ ID NO: 483 - DNA, 44 bp, Artificial Sequence
  Synthetic
gatgttgttgggtctattgcatctatacagtgcctgtggaaagt

SEQ ID NO: 484 - DNA, 40 bp, Artificial Sequence
  Synthetic
gccaatgctatccgttttgtggtaacgccattgcagtgtt

SEQ ID NO: 485 - DNA, 45 bp, Artificial Sequence
  Synthetic
agtaggtatttgctgaacccttctacaccacgtgacgttttaaat

SEQ ID NO: 486 - DNA, 44 bp, Artificial Sequence
  Synthetic
acttctagtttttattgtgcctcggtttcagagacagatgctgg

SEQ ID NO: 487 - DNA, 48 bp, Artificial Sequence
  Synthetic
gtctggcaaattgaatctaaacactcacaaagtattagttcctaaggt

SEQ ID NO: 488 - DNA, 46 bp, Artificial Sequence
  Synthetic
tccaaagaaaaacaagctatctccaattgccacagtttgtaaatgg

SEQ ID NO: 489 - DNA, 46 bp, Artificial Sequence
  Synthetic
cctcaattccagagggaggtgtcctaatattttggataattggcag

SEQ ID NO: 490 - DNA, 48 bp, Artificial Sequence
  Synthetic
ccaaatgactcagagagactggatgtgaactatagtgaaataaactgc

SEQ ID NO: 491 - DNA, 38 bp, Artificial Sequence
  Synthetic
gttggcagctgacgccggttgtccacgacctactcacc

SEQ ID NO: 492 - DNA, 41 bp, Artificial Sequence
  Synthetic
ttgcacagccagttgacgttttggtaatggtcattcagttc

SEQ ID NO: 493 - DNA, 46 bp, Artificial Sequence
  Synthetic
tccatccgttataaaaaagcccgaacctgataaatactcatgaagg

SEQ ID NO: 494 - DNA, 39 bp, Artificial Sequence
  Synthetic
gcacatacattgctccgtccctcgcgccttcagacctga

SEQ ID NO: 495 - DNA, 42 bp, Artificial Sequence
  Synthetic
tggaggtggccctgtataggtcaacccatatttgatgtttct

SEQ ID NO: 496 - DNA, 46 bp, Artificial Sequence
  Synthetic
gcttaaaaaatccttcccccattctttgatatcagttccttgttgg

SEQ ID NO: 497 - DNA, 46 bp, Artificial Sequence
  Synthetic
gcattgagagaagtaacagtagtctgtgagaaattgaaagaaagcg

SEQ ID NO: 498 - DNA, 45 bp, Artificial Sequence
  Synthetic
gcagctgtaaaatcaactccttcattgtccaatcttgctatggaa

SEQ ID NO: 499 - DNA, 49 bp, Artificial Sequence
  Synthetic
ttaaacatgtcgcaaaccatttgataccctattgaatacagatatgaga

SEQ ID NO: 500 - DNA, 40 bp, Artificial Sequence
  Synthetic
tatggtcgttgcagacgtgggccctaaaatttagcaaacg

SEQ ID NO: 501 - DNA, 45 bp, Artificial Sequence
  Synthetic
gttgttgcatatccagcataatcaagtgctgcctagaatttcatg

SEQ ID NO: 502 - DNA, 46 bp, Artificial Sequence
  Synthetic
agctgtctactaattgctcatagcaggatattgtattagacctgca

SEQ ID NO: 503 - DNA, 44 bp, Artificial Sequence
  Synthetic
gcactatagcttctaccataaaccaggacgattcaggtacagaa

SEQ ID NO: 504 - DNA, 45 bp, Artificial Sequence
  Synthetic
ctttccactgcctcggctatgaaagtatttaggtagtccatatgt

SEQ ID NO: 505 - DNA, 39 bp, Artificial Sequence
  Synthetic
tgctcccgtacactgtttgtgaagggacatagaggggga

SEQ ID NO: 506 - DNA, 45 bp, Artificial Sequence
  Synthetic
actctcctcgcatatgtcattatcaggcagacagtcagtttaaat

SEQ ID NO: 507 - DNA, 45 bp, Artificial Sequence
  Synthetic
cttcctcgtcctcagaatcctgggaaatgtttttttgaaagactg

SEQ ID NO: 508 - DNA, 43 bp, Artificial Sequence
  Synthetic
cggttccatactatactcagtccttgtccgaagcaaaaggaca

SEQ ID NO: 509 - DNA, 38 bp, Artificial Sequence
  Synthetic
gtttccactgtccacgggtcgagtccaacagtcccctt

SEQ ID NO: 510 - DNA, 45 bp, Artificial Sequence
  Synthetic
tggtagggggtatttttacaacatcaaacatgccattgtaactgt

SEQ ID NO: 511 - DNA, 50 bp, Artificial Sequence
  Synthetic
ggttgttaatagcagccacaatagtatggatatctgagtttattgtgtac

SEQ ID NO: 512 - DNA, 41 bp, Artificial Sequence
  Synthetic
ctatataggcccacacgaggctcatctagtgatagcggtcc

SEQ ID NO: 513 - DNA, 43 bp, Artificial Sequence
  Synthetic
ggaaaagttatatcagggccagattggggtaacaccacagttc

SEQ ID NO: 514 - DNA, 43 bp, Artificial Sequence
  Synthetic
gcatgataaaatatgttggtgcgagcctcctcctaaccctgta

SEQ ID NO: 515 - DNA, 43 bp, Artificial Sequence
  Synthetic
ggaacatctgatttattggtctgcaacaggatggcgatatggt

SEQ ID NO: 516 - DNA, 38 bp, Artificial Sequence
  Synthetic
gtccctgggctttttgtagcggctctttggtgtcctct

SEQ ID NO: 517 - DNA, 38 bp, Artificial Sequence
  Synthetic
taaggcaataccgcaccctgccaagttgcttgccaagt

SEQ ID NO: 518 - DNA, 41 bp, Artificial Sequence
  Synthetic
tcaccggttccgaagaccactagtgttgtacagcctccagg

SEQ ID NO: 519 - DNA, 42 bp, Artificial Sequence
  Synthetic
ctgcgcggcaacaagtaaactcaatggacgttaagttcccgg

SEQ ID NO: 520 - DNA, 38 bp, Artificial Sequence
  Synthetic
ctgacaccatgtgccagggccgccgacctcatgggata

SEQ ID NO: 521 - DNA, 36 bp, Artificial Sequence
  Synthetic
cggtaggagtaagggccacccttgcgtgccctgcgt

SEQ ID NO: 522 - DNA, 41 bp, Artificial Sequence
  Synthetic
cccagtggcctccagagagtaaaccttagttctcgcccagg

SEQ ID NO: 523 - DNA, 40 bp, Artificial Sequence
  Synthetic
gccttggccgtagctgtcaagacagctcagggtgttccga

SEQ ID NO: 524 - DNA, 42 bp, Artificial Sequence
  Synthetic
cggtactgttcatccacacgcattttgaactcgaccagaccg

SEQ ID NO: 525 - DNA, 40 bp, Artificial Sequence
  Synthetic
caggggtgatagctctacccgaggcatgcaactggaccag

SEQ ID NO: 526 - DNA, 42 bp, Artificial Sequence
  Synthetic
caggagaaaacagggccacagctctgcattgtctggcatgtc

SEQ ID NO: 527 - DNA, 40 bp, Artificial Sequence
  Synthetic
aatcactgagtcgcgaggcctatagctaggaccgaggctg

SEQ ID NO: 528 - DNA, 40 bp, Artificial Sequence
  Synthetic
cccttatgatgtctccgcacgcgtgttcacgcccatggag

SEQ ID NO: 529 - DNA, 40 bp, Artificial Sequence
  Synthetic
accgcagtacccaggaaggaagaattgtggcgaagtgcag

SEQ ID NO: 530 - DNA, 36 bp, Artificial Sequence
  Synthetic
acgaagtctaccgccttggcgcgccggcatattccg

SEQ ID NO: 531 - DNA, 41 bp, Artificial Sequence
  Synthetic
cgtggtgatggtcctgactccacatgtccaaggcatatggc

SEQ ID NO: 532 - DNA, 40 bp, Artificial Sequence
  Synthetic
ccccccttgatcagctccagaggccaacaacgggggaaat

SEQ ID NO: 533 - DNA, 40 bp, Artificial Sequence
  Synthetic
cctaccagtgcggcctctccgattacaaccgttccccagg

SEQ ID NO: 534 - DNA, 40 bp, Artificial Sequence
  Synthetic
tggagcgagccagaccttggatcgggtgagaatttcccgt

SEQ ID NO: 535 - DNA, 42 bp, Artificial Sequence
  Synthetic
ggtagagcacttcgcgatcagggtgattgttgggagagtcgt

SEQ ID NO: 536 - DNA, 42 bp, Artificial Sequence
  Synthetic
agggtttgttgggtggtcagagcattgcttccctcatgtcct

SEQ ID NO: 537 - DNA, 35 bp, Artificial Sequence
  Synthetic
tggcggcgcaaaatcgccattctatcgcccggagc

SEQ ID NO: 538 - DNA, 41 bp, Artificial Sequence
  Synthetic
ggggatgcctggcattaagggtgctgagtgacttcaagacg

SEQ ID NO: 539 - DNA, 41 bp, Artificial Sequence
  Synthetic
gatgccgtccacttccgtgaaacaacatcaagttcccctgc

SEQ ID NO: 540 - DNA, 38 bp, Artificial Sequence
  Synthetic
acgtggcctgaagaagacggcgaccctcgctagctagt

SEQ ID NO: 541 - DNA, 39 bp, Artificial Sequence
  Synthetic
acagggggctgctttgccgaagcagcaggactaccaagc

SEQ ID NO: 542 - DNA, 42 bp, Artificial Sequence
  Synthetic
gccccagtccacgagtatgacatcagactcttggtccactgt

SEQ ID NO: 543 - DNA, 38 bp, Artificial Sequence
  Synthetic
ttgcgggaatggctccgaacccccactcagccagatca

SEQ ID NO: 544 - DNA, 42 bp, Artificial Sequence
  Synthetic
ggagtcaaagcagcgggtatcaagcgggtggaatttcttctg

SEQ ID NO: 545 - DNA, 35 bp, Artificial Sequence
  Synthetic
ctacgccgtcgctctcagcgcggcgctgagagact

SEQ ID NO: 546 - DNA, 40 bp, Artificial Sequence
  Synthetic
atcgagtttggcagcggcagtacctctttaactgggcggt

SEQ ID NO: 547 - DNA, 44 bp, Artificial Sequence
  Synthetic
tgctgtgaccataagacaatatgaatcgtaatgagcaattccgg

SEQ ID NO: 548 - DNA, 44 bp, Artificial Sequence
  Synthetic
gcctcaacattgggtgaattcaagaaccagttaaagatctcatg

SEQ ID NO: 549 - DNA, 45 bp, Artificial Sequence
  Synthetic
cttgagtgcatctggtaatttccattggatagtaagacatggaca

SEQ ID NO: 550 - DNA, 47 bp, Artificial Sequence
  Synthetic
accaataaacaggtttgtcccaaaagttacctcataccactaaatgc

SEQ ID NO: 551 - DNA, 44 bp, Artificial Sequence
  Synthetic
cctgatgtccatggtattgtcattagcaatgctaggtactcatg

SEQ ID NO: 552 - DNA, 44 bp, Artificial Sequence
  Synthetic
acctaagccttcagtgagtgcttaggctgatgaaagatactcaa

SEQ ID NO: 553 - DNA, 39 bp, Artificial Sequence
  Synthetic
tgccatgtgtaatcgcccacaagccatgtatgttccaca

SEQ ID NO: 554 - DNA, 38 bp, Artificial Sequence
  Synthetic
gtagggtagtgctctgggtgttatcacagggcaaagct

SEQ ID NO: 555 - DNA, 44 bp, Artificial Sequence
  Synthetic
tggaatagtaaacacctgatgtacgtagtctcaacaggaggaca

SEQ ID NO: 556 - DNA, 44 bp, Artificial Sequence
  Synthetic
tgtcgtatgtcagcaaaacaaacatatgcatacatggtcccatt

SEQ ID NO: 557 - DNA, 45 bp, Artificial Sequence
  Synthetic
ggagatccatcacatccaagtagtagaaatcatgatgacttggtc

SEQ ID NO: 558 - DNA, 45 bp, Artificial Sequence
  Synthetic
cgtcccacaatggatgttgttaaagtgtgtgtattaatccatggt

SEQ ID NO: 559 - DNA, 49 bp, Artificial Sequence
  Synthetic
tgtgttagaatttgtggaggctagaccaatggctagtttagataacaag

SEQ ID NO: 560 - DNA, 50 bp, Artificial Sequence
  Synthetic
gggggtgctactcaaattaataagtactttaccaacactatcttagaagt

SEQ ID NO: 561 - DNA, 48 bp, Artificial Sequence
  Synthetic
ccttgtcacctggaaaaacatcataggagtttaacataaatccagtca

SEQ ID NO: 562 - DNA, 46 bp, Artificial Sequence
  Synthetic
ggttgcctagtttcattctcatgttaaagtccgattagggaaaagt

SEQ ID NO: 563 - DNA, 38 bp, Artificial Sequence
  Synthetic
tctgggggtgtgatggttagtggatccacaagtgttgg

SEQ ID NO: 564 - DNA, 38 bp, Artificial Sequence
  Synthetic
aacagcccatgggtccagcttgcaaagccgctatgtcc

SEQ ID NO: 565 - DNA, 40 bp, Artificial Sequence
  Synthetic
actgagccctcctgcgacaaaccacaaaagatgctcgact

SEQ ID NO: 566 - DNA, 38 bp, Artificial Sequence
  Synthetic
gcaggcagcagtggatgtgtacgcgtctcggaaaaacg

SEQ ID NO: 567 - DNA, 40 bp, Artificial Sequence
  Synthetic
cgatgagagcggaatgtcccgaaaccaaattcttccgcgc

SEQ ID NO: 568 - DNA, 40 bp, Artificial Sequence
  Synthetic
accaggataccccgtggattgtcaccatgtccaccccatg

SEQ ID NO: 569 - DNA, 43 bp, Artificial Sequence
  Synthetic
ggcgtaagataattcctgcagaaatactgcgactacttcaaca

SEQ ID NO: 570 - DNA, 43 bp, Artificial Sequence
  Synthetic
actctggctgtacaagaattacacccagaggaggagttactgt

SEQ ID NO: 571 - DNA, 45 bp, Artificial Sequence
  Synthetic
gctattccactgtcctcaaacagtggaagcaattagtctttctcc

SEQ ID NO: 572 - DNA, 45 bp, Artificial Sequence
  Synthetic
tgtttgttttacaacccaatctggtcggctgcgctatatttttac

SEQ ID NO: 573 - DNA, 50 bp, Artificial Sequence
  Synthetic
acaatctagtaatggctgaatccaaagaggtaaagtagtatcatacatga

SEQ ID NO: 574 - DNA, 39 bp, Artificial Sequence
  Synthetic
ggtggggctgcttgatctccgtcttcacctgtctccccg

SEQ ID NO: 575 - DNA, 41 bp, Artificial Sequence
  Synthetic
cctgatcgtggaacagatcgaagaacgtcatatcctctctg

SEQ ID NO: 576 - DNA, 42 bp, Artificial Sequence
  Synthetic
catggaggtacccttaggaagtgtgcaaacagtaatcaacgc

SEQ ID NO: 577 - DNA, 42 bp, Artificial Sequence
  Synthetic
tccctccctaggtgtttgagcaacttgggtattggtacggga

SEQ ID NO: 578 - DNA, 47 bp, Artificial Sequence
  Synthetic
tcatctatttcaaactgcgccatagacattggtgatccagaatacat

SEQ ID NO: 579 - DNA, 46 bp, Artificial Sequence
  Synthetic
ctgtctagaggagttgtcagctggtgatttgacagacatattcaat

SEQ ID NO: 580 - DNA, 44 bp, Artificial Sequence
  Synthetic
gggtcgaaagatacattttgcctataaactgggtgacactgaaa

SEQ ID NO: 581 - DNA, 46 bp, Artificial Sequence
  Synthetic
tctgtataaaatccggccatttgctttagtactttttcagcgagtc

SEQ ID NO: 582 - DNA, 49 bp, Artificial Sequence
  Synthetic
cctcactagtaactagagaaccactcctaaaaatggattagggaatcac

SEQ ID NO: 583 - DNA, 49 bp, Artificial Sequence
  Synthetic
acctaaaggtgtctgatccaaatcaccatataagggcttaaatttttgg

SEQ ID NO: 584 - DNA, 49 bp, Artificial Sequence
  Synthetic
cgaagttaaagtgatagaacaccgaggtttctatttgaagtttgtacac

SEQ ID NO: 585 - DNA, 40 bp, Artificial Sequence
  Synthetic
tgctggtgagagagaaaaggccctctagcagcggccaact

SEQ ID NO: 586 - DNA, 42 bp, Artificial Sequence
  Synthetic
gcgggtaggggcagtataccaaaaccctaatgtggtccaccg

SEQ ID NO: 587 - DNA, 38 bp, Artificial Sequence
  Synthetic
acaggacctcaggcgggaggcgaggctatgttccgcca

SEQ ID NO: 588 - DNA, 38 bp, Artificial Sequence
  Synthetic
agggcgtaggtgatggctccgccattggctgccacttt

SEQ ID NO: 589 - DNA, 40 bp, Artificial Sequence
  Synthetic
agcgacctcagaggcgttccgctacaaggttactgtgggc

SEQ ID NO: 590 - DNA, 39 bp, Artificial Sequence
  Synthetic
aaaaccaacacccgtgggtcatacgctcagtgtaggcgc

SEQ ID NO: 591 - DNA, 36 bp, Artificial Sequence
  Synthetic
tgccagggacgacgtaggaatgtcgaccccgctgaa

SEQ ID NO: 592 - DNA, 41 bp, Artificial Sequence
  Synthetic
cagaggcggcataggtgagacttttgatgccagtcagagca

SEQ ID NO: 593 - DNA, 39 bp, Artificial Sequence
  Synthetic
ccttagagccatccgggtaggtccggccataacccacca

SEQ ID NO: 594 - DNA, 41 bp, Artificial Sequence
  Synthetic
gcagcctcaagcatctttgggtatacattaaccccccggcc

SEQ ID NO: 595 - DNA, 40 bp, Artificial Sequence
  Synthetic
gccagatttgctgtccgtgcaaccaataggccgacctgcc

SEQ ID NO: 596 - DNA, 35 bp, Artificial Sequence
  Synthetic
aatgacaacccggcgccccggcttcgctgctttca

SEQ ID NO: 597 - DNA, 42 bp, Artificial Sequence
  Synthetic
ggaggacccgactagtggtctgctgcggatgtatgtgagctg

SEQ ID NO: 598 - DNA, 38 bp, Artificial Sequence
  Synthetic
gagatgcccacctcgcgaaggcgccacactgagaagtg

SEQ ID NO: 599 - DNA, 40 bp, Artificial Sequence
  Synthetic
aggtcgagctcaaggacggcttgtacgagctagtggaggc

SEQ ID NO: 600 - DNA, 38 bp, Artificial Sequence
  Synthetic
ccagggccccaattcttctcagccttggcgcgcttcct

SEQ ID NO: 601 - DNA, 35 bp, Artificial Sequence
  Synthetic
tgggcctggtcacgccaaggggctggacctcgtgt

SEQ ID NO: 602 - DNA, 41 bp, Artificial Sequence
  Synthetic
gggagacccgcgtgttggtatctttgccctcgaacttgagt

SEQ ID NO: 603 - DNA, 40 bp, Artificial Sequence
  Synthetic
agactgggccggtcgaagagtgtgctttggctttctctca

SEQ ID NO: 604 - DNA, 42 bp, Artificial Sequence
  Synthetic
gcacccaggctagtggtgtaagactgctagtgaccaactgct

SEQ ID NO: 605 - DNA, 40 bp, Artificial Sequence
  Synthetic
attggctgcatatcgacgacaacaatataccaaaacggcg

SEQ ID NO: 606 - DNA, 40 bp, Artificial Sequence
  Synthetic
ccaccaacgattcaggaacattaccgaaagacacagtgtt

SEQ ID NO: 607 - DNA, 48 bp, Artificial Sequence
  Synthetic
gcatgccagatttaccggttatggggttgtttattaagtttaaatcgg

SEQ ID NO: 608 - DNA, 49 bp, Artificial Sequence
  Synthetic
aaactctttcatatgccgttcctatgattcgggctatagagtattttac

SEQ ID NO: 609 - DNA, 40 bp, Artificial Sequence
  Synthetic
acaacatccaacgccgttttagtggaaacgaaaaaccgtc

SEQ ID NO: 610 - DNA, 44 bp, Artificial Sequence
  Synthetic
aatcgagtcttttcgttcccataatgtttactgctattggacga

SEQ ID NO: 611 - DNA, 40 bp, Artificial Sequence
  Synthetic
tgattaaacaatgggccgttgaggctatgttacctgcact

SEQ ID NO: 612 - DNA, 45 bp, Artificial Sequence
  Synthetic
ggaaagaccgtttgttttatagtggaggggtatgtatattagcgc

SEQ ID NO: 613 - DNA, 43 bp, Artificial Sequence
  Synthetic
tgagtggattattcgacgggactttttcatcgtcgttacttcc

SEQ ID NO: 614 - DNA, 45 bp, Artificial Sequence
  Synthetic
cctctatggttgacagcacatttcttgctgggttatttaacatcc

SEQ ID NO: 615 - DNA, 42 bp, Artificial Sequence
  Synthetic
acctcatcgaaatgcgtatagccagaaactatccgacagaga

SEQ ID NO: 616 - DNA, 38 bp, Artificial Sequence
  Synthetic
ttttcggtttaggcagccggcgtttcctccttgcagac

SEQ ID NO: 617 - DNA, 37 bp, Artificial Sequence
  Synthetic
tgtggccgcccggttttggacgaaccgtgttccgtcg

SEQ ID NO: 618 - DNA, 38 bp, Artificial Sequence
  Synthetic
cagtacgtgctgccgggtttcccagaccccgagactgt

SEQ ID NO: 619 - DNA, 38 bp, Artificial Sequence
  Synthetic
ccatccaacagggtgcggttcatcctcccagtgaccct

SEQ ID NO: 620 - DNA, 39 bp, Artificial Sequence
  Synthetic
aggaaacatgatgcccggggtatctaggtttgccccccg

SEQ ID NO: 621 - DNA, 49 bp, Artificial Sequence
  Synthetic
ccctgcttgcccatactatatgtttattagatcgatgggaaaaaattcg

SEQ ID NO: 622 - DNA, 43 bp, Artificial Sequence
  Synthetic
gtgtcctgtgtcagctgctgtttagacaagatagaggaagagc

SEQ ID NO: 623 - DNA, 39 bp, Artificial Sequence
  Synthetic
atctggcctggtgcaataggccatcaatgaggaagctgc

SEQ ID NO: 624 - DNA, 40 bp, Artificial Sequence
  Synthetic
gttcgcattttggaccaacaaggagcaagcttcacaggag

SEQ ID NO: 625 - DNA, 46 bp, Artificial Sequence
  Synthetic
tggaatattgctggtgatcctttcccaccagggattagatatcagt

SEQ ID NO: 626 - DNA, 45 bp, Artificial Sequence
  Synthetic
tctgtatgtcattgacagtccagcccatcctgataaatggacagt

SEQ ID NO: 627 - DNA, 44 bp, Artificial Sequence
  Synthetic
tggttattttttgcactgcctctgatatgcaagaatgaggggtg

SEQ ID NO: 628 - DNA, 50 bp, Artificial Sequence
  Synthetic
ccattgctctccaattactgtgatatcaggaaagtactatttttagatgg

SEQ ID NO: 629 - DNA, 45 bp, Artificial Sequence
  Synthetic
actggccatcttcctgctaattttagaagcagaagttattccagc

SEQ ID NO: 630 - DNA, 43 bp, Artificial Sequence
  Synthetic
gtgggatgtgtacttctgaacttatggaaagctaggggatggt

SEQ ID NO: 631 - DNA, 46 bp, Artificial Sequence
  Synthetic
gccaagtattgtagagatcctacctattaggacacatagttagccc

SEQ ID NO: 632 - DNA, 49 bp, Artificial Sequence
  Synthetic
gcagaattcttattatggcttccaccttagggcaacatatctatgaaac

SEQ ID NO: 633 - DNA, 43 bp, Artificial Sequence
  Synthetic
tgcttccttccacacaggtactgtagtgctacagaaaaattgt

SEQ ID NO: 634 - DNA, 45 bp, Artificial Sequence
  Synthetic
agttgatactactggcctaattccatggaacaggaccatgtacaa

SEQ ID NO: 635 - DNA, 43 bp, Artificial Sequence
  Synthetic
tctcttgttaatagcagccctgtaacaatgtatgcccctccca

SEQ ID NO: 636 - DNA, 41 bp, Artificial Sequence
  Synthetic
cgcctcaatagccctcagcaaacaatgacgctgacggtaca

SEQ ID NO: 637 - DNA, 41 bp, Artificial Sequence
  Synthetic
gctcccaccctatctgctgcttggatggcctactgtaaggg

SEQ ID NO: 638 - DNA, 42 bp, Artificial Sequence
  Synthetic
agcaagctcgatgtcagcagtttagcatttcatcacgtggcc

SEQ ID NO: 639 - DNA, 40 bp, Artificial Sequence
  Synthetic
cgtcagagattcccacctcggtcaacgacatgcagtggct

SEQ ID NO: 640 - DNA, 39 bp, Artificial Sequence
  Synthetic
ccaggggctcagtctggacagtttaggcgcaggtttccg

SEQ ID NO: 641 - DNA, 36 bp, Artificial Sequence
  Synthetic
cccccttcagcacctacgtggagccggtcagcagct

SEQ ID NO: 642 - DNA, 37 bp, Artificial Sequence
  Synthetic
tcttcgccgggctggacgacttcgagggcgtagtggc

SEQ ID NO: 643 - DNA, 36 bp, Artificial Sequence
  Synthetic
ttcgaggctgtgctgcgcggcgaactccaccgaggt

SEQ ID NO: 644 - DNA, 41 bp, Artificial Sequence
  Synthetic
cgcgtacatggccaagctccaacacaacaaactccccctcg

SEQ ID NO: 645 - DNA, 39 bp, Artificial Sequence
  Synthetic
aggtcctggactgcgtggttaacgtacatgttctgcgcc

SEQ ID NO: 646 - DNA, 37 bp, Artificial Sequence
  Synthetic
agctcgtgctcccagaggcagtacatccccgcgtacg

SEQ ID NO: 647 - DNA, 38 bp, Artificial Sequence
  Synthetic
gctccggggacagttctccaggacctccgggacttcga

SEQ ID NO: 648 - DNA, 41 bp, Artificial Sequence
  Synthetic
gggcaggactagctcgtcgtctcctgaacacgctaatgtgc

SEQ ID NO: 649 - DNA, 39 bp, Artificial Sequence
  Synthetic
cgatacacggcaacccccggctctcctccacccaaacga

SEQ ID NO: 650 - DNA, 37 bp, Artificial Sequence
  Synthetic
ctggtgttcgaactgggccacaccgcgtcctccgaca

SEQ ID NO: 651 - DNA, 39 bp, Artificial Sequence
  Synthetic
tggagcttgtggccctacacccagacggaacagctccca

SEQ ID NO: 652 - DNA, 40 bp, Artificial Sequence
  Synthetic
gcaagggggagctgctgatctaatgggcgtaaagacgggc

SEQ ID NO: 653 - DNA, 38 bp, Artificial Sequence
  Synthetic
tgaccacatggggccggtacctaaggcccaccgtcacg

SEQ ID NO: 654 - DNA, 36 bp, Artificial Sequence
  Synthetic
gctgctgccgacacaacgtctgggcggtcagcgaga

SEQ ID NO: 655 - DNA, 37 bp, Artificial Sequence
  Synthetic
tcgggctggcggtcgatctcgctaaccagcagctcca

SEQ ID NO: 656 - DNA, 36 bp, Artificial Sequence
  Synthetic
ccacgacatccgcggctttacacgatctggcgctgc

SEQ ID NO: 657 - DNA, 39 bp, Artificial Sequence
  Synthetic
caaggcggcccacttggaatcatcatctctaagcgcgcg

SEQ ID NO: 658 - DNA, 41 bp, Artificial Sequence
  Synthetic
acgaagtgaaccaactgccgaatacagcgtcctgaacacgt

SEQ ID NO: 659 - DNA, 34 bp, Artificial Sequence
  Synthetic
acgatcgtgctgcgcgagcgggtggaccacgtca

SEQ ID NO: 660 - DNA, 39 bp, Artificial Sequence
  Synthetic
gctgacgcgtgcttttgttccgccagcgcgtgtatgagt

SEQ ID NO: 661 - DNA, 40 bp, Artificial Sequence
  Synthetic
agagctacgcgtacctctgcccggaaagaccactagcccg

SEQ ID NO: 662 - DNA, 35 bp, Artificial Sequence
  Synthetic
ccaccaacgtgccctacccccaggggcaggacgaa

SEQ ID NO: 663 - DNA, 37 bp, Artificial Sequence
  Synthetic
ttgtgcgggaggggcttggcttgggggattcgcaggc

SEQ ID NO: 664 - DNA, 41 bp, Artificial Sequence
  Synthetic
ccccgcgggatcggatacaagtaggtgataaacagcgggcg

SEQ ID NO: 665 - DNA, 36 bp, Artificial Sequence
  Synthetic
tggcacaacagacccgcggcagggcgttgtagtgcg

SEQ ID NO: 666 - DNA, 36 bp, Artificial Sequence
  Synthetic
ggtccatgttcgagggcggcgccggccaattcttcc

SEQ ID NO: 667 - DNA, 40 bp, Artificial Sequence
  Synthetic
tcgaaggcggaatagtggcgcgtcctgtctctgcagtcgt

SEQ ID NO: 668 - DNA, 35 bp, Artificial Sequence
  Synthetic
tgcaggcggttgtcgaggctgcttcggcggctcct

SEQ ID NO: 669 - DNA, 40 bp, Artificial Sequence
  Synthetic
cgtcagcaccttcatcgacctggtgtagacctccaggggc

SEQ ID NO: 670 - DNA, 38 bp, Artificial Sequence
  Synthetic
gccgcacctcaaggaggaactccaatcagcgcccgaac

SEQ ID NO: 671 - DNA, 39 bp, Artificial Sequence
  Synthetic
tccagcgcaaccagctcccacgcgatggtctctatgtcc

SEQ ID NO: 672 - DNA, 35 bp, Artificial Sequence
  Synthetic
agaagttctgccggcggctttgccccccacaaccc

SEQ ID NO: 673 - DNA, 36 bp, Artificial Sequence
  Synthetic
aggttccgaacgccgtcggtggtaccgcctcaagcc

SEQ ID NO: 674 - DNA, 37 bp, Artificial Sequence
  Synthetic
tctgcgccaagtgcctgggagacgaactcgaaggcgg

SEQ ID NO: 675 - DNA, 35 bp, Artificial Sequence
  Synthetic
acgccggtgttctgcacgcatgaacgactgggccg

SEQ ID NO: 676 - DNA, 37 bp, Artificial Sequence
  Synthetic
gctgatccacatgctggccatacgacgtcaaggggcg

SEQ ID NO: 677 - DNA, 36 bp, Artificial Sequence
  Synthetic
acgtgagggctcgcaggacacaacaggtgggtgctt

SEQ ID NO: 678 - DNA, 38 bp, Artificial Sequence
  Synthetic
tccctcagatgatagggcgtgtgatgcgacgcctgtgc

SEQ ID NO: 679 - DNA, 37 bp, Artificial Sequence
  Synthetic
ggagtcgaggaccttcagggcggcgttcaacgacgcc

SEQ ID NO: 680 - DNA, 38 bp, Artificial Sequence
  Synthetic
cctgcatgccaatgcccatggaaacccacgccccagtg

SEQ ID NO: 681 - DNA, 37 bp, Artificial Sequence
  Synthetic
cggcgggatccatggcgatatacagcgctccgatcgg

SEQ ID NO: 682 - DNA, 38 bp, Artificial Sequence
  Synthetic
ccacgaacacgagctcggtctcaaccaccttcgctccc

SEQ ID NO: 683 - DNA, 36 bp, Artificial Sequence
  Synthetic
tcatccacgacgccccggacagctcggcgatggtca

SEQ ID NO: 684 - DNA, 36 bp, Artificial Sequence
  Synthetic
accgaggaggcgtgggtgaccttgtcgcggtggttc

SEQ ID NO: 685 - DNA, 37 bp, Artificial Sequence
  Synthetic
acggatcggcgggcaaaaaccgatggcgtccaccaga

SEQ ID NO: 686 - DNA, 38 bp, Artificial Sequence
  Synthetic
gcgaatagctacggccgcttgtccagacggacagcacc

SEQ ID NO: 687 - DNA, 37 bp, Artificial Sequence
  Synthetic
cccgtcggtcgcatacagcactgcgatcacgaagggc

SEQ ID NO: 688 - DNA, 35 bp, Artificial Sequence
  Synthetic
tgcacaacgtacggggcggtcctgcgccgacaaga

SEQ ID NO: 689 - DNA, 38 bp, Artificial Sequence
  Synthetic
tgacatagtccccgcccaggccccatgttttccgcggc

SEQ ID NO: 690 - DNA, 36 bp, Artificial Sequence
  Synthetic
gttggtcccgacgctcagcctgcgcttcaagcacgg

SEQ ID NO: 691 - DNA, 36 bp, Artificial Sequence
  Synthetic
tggtgaagggcgacgaacggacacccagatgcgcct

SEQ ID NO: 692 - DNA, 37 bp, Artificial Sequence
  Synthetic
agctgcaccagggtctggcacacgaaaatcacccgcc

SEQ ID NO: 693 - DNA, 42 bp, Artificial Sequence
  Synthetic
cgtggcattcagacagtacgggtcgaacctgtttttacgggc

SEQ ID NO: 694 - DNA, 37 bp, Artificial Sequence
  Synthetic
accacacgacatgcaggcttccatgcccagcccccaa

SEQ ID NO: 695 - DNA, 34 bp, Artificial Sequence
  Synthetic
aagtcgacacaccgcgcggcggaaggaaacgggc

SEQ ID NO: 696 - DNA, 37 bp, Artificial Sequence
  Synthetic
cccgtgcatgaagacctggatccaccggggtgttgca

SEQ ID NO: 697 - DNA, 36 bp, Artificial Sequence
  Synthetic
gcatcatcccgcccgcatccgtcgccccatgcacgt

SEQ ID NO: 698 - DNA, 35 bp, Artificial Sequence
  Synthetic
acgcgtggtaggtcgctgggtttccgggagcgctg

SEQ ID NO: 699 - DNA, 38 bp, Artificial Sequence
  Synthetic
tgggatcggccatcttaagcgatgggactccgcgtcgt

SEQ ID NO: 700 - DNA, 40 bp, Artificial Sequence
  Synthetic
ggcatgtaggagcacgctgccccgatcactgtgtactacg

SEQ ID NO: 701 - DNA, 39 bp, Artificial Sequence
  Synthetic
ccaaaacaaaccggctggcgtcggtctgtatgtcctgcg

SEQ ID NO: 702 - DNA, 40 bp, Artificial Sequence
  Synthetic
cgtgctggccccttgatacgatgctggttgggtgggggta

SEQ ID NO: 703 - DNA, 42 bp, Artificial Sequence
  Synthetic
ccagccttgcaagcactctagtacttatcctggggagaaggg

SEQ ID NO: 704 - DNA, 43 bp, Artificial Sequence
  Synthetic
acagcaatacaatacagcaaacagtgatctggaggggaacttg

SEQ ID NO: 705 - DNA, 42 bp, Artificial Sequence
  Synthetic
ccgtatcccagtgttgcttgcttcagtgtccattttgccagg

SEQ ID NO: 706 - DNA, 45 bp, Artificial Sequence
  Synthetic
acctccatagcacttatctcactatgacaaaacaacatcacagca

SEQ ID NO: 707 - DNA, 49 bp, Artificial Sequence
  Synthetic
gcactggtttacaattatttctggctgctgctttattcttctatcatag

SEQ ID NO: 708 - DNA, 41 bp, Artificial Sequence
  Synthetic
gacaccgcttattcacatactgtagacactacaagacagcg

SEQ ID NO: 709 - DNA, 48 bp, Artificial Sequence
  Synthetic
ggtgataaccaaaaatgtgacccatcttaacaaatttttggatggaca

SEQ ID NO: 710 - DNA, 43 bp, Artificial Sequence
  Synthetic
cccatttccacaatacaacttctgtggcagccagttaccctaa

SEQ ID NO: 711 - DNA, 38 bp, Artificial Sequence
  Synthetic
ggggttctctccctcgtggacagcgccctggtaaatgt

SEQ ID NO: 712 - DNA, 47 bp, Artificial Sequence
  Synthetic
tgcctagcaagcattgtttaatgatcaagattcctaaaaacattggg

SEQ ID NO: 713 - DNA, 38 bp, Artificial Sequence
  Synthetic
cactggatatggacgggcgtcgggcattggcacaggac

SEQ ID NO: 714 - DNA, 40 bp, Artificial Sequence
  Synthetic
gtcaattgtgtccccccgggccgtaggtgacaatgctgaa

SEQ ID NO: 715 - DNA, 40 bp, Artificial Sequence
  Synthetic
gccagtagtgcgcctctggtacgtagtgacacagacctgc

SEQ ID NO: 716 - DNA, 40 bp, Artificial Sequence
  Synthetic
gcgtagggtctcctctcacagaactagatgtactgggtga

SEQ ID NO: 717 - DNA, 41 bp, Artificial Sequence
  Synthetic
gcagcatggaggaaagtactgatacaacggacattgaacac

SEQ ID NO: 718 - DNA, 45 bp, Artificial Sequence
  Synthetic
agggattttcagcatcatcaaacttgattgaggtttctaggggac

SEQ ID NO: 719 - DNA, 44 bp, Artificial Sequence
  Synthetic
actcatgtctgcatcctcaatgtaaagcagatgacaaatgtcct

SEQ ID NO: 720 - DNA, 47 bp, Artificial Sequence
  Synthetic
ggtgtgccttaaaaactcaaaaaacctaactttaccatcagtgttcc

SEQ ID NO: 721 - DNA, 45 bp, Artificial Sequence
  Synthetic
acctcccaaaacttaagatctttgtaaatgtccctctaaggatgc

SEQ ID NO: 722 - DNA, 42 bp, Artificial Sequence
  Synthetic
ggggctattggcaagacagaccccaacattggcaaacgtctc

SEQ ID NO: 723 - DNA, 45 bp, Artificial Sequence
  Synthetic
tctccttcacaatcggatgacatatgccaattaatttactgtgtg

SEQ ID NO: 724 - DNA, 45 bp, Artificial Sequence
  Synthetic
ggtgatatgtgaacagcatgcagcgaaagtatgtgataagtccac

SEQ ID NO: 725 - DNA, 44 bp, Artificial Sequence
  Synthetic
aggagctctctcatacagattcatttggaaacacaacagacact

SEQ ID NO: 726 - DNA, 49 bp, Artificial Sequence
  Synthetic
gatcagcaagtgtttcaccttctatataggaattgtcaaatatctggtg

SEQ ID NO: 727 - DNA, 43 bp, Artificial Sequence
  Synthetic
ttgaactgcgcgggaaactttattcagcaagttaaaacaacca

SEQ ID NO: 728 - DNA, 47 bp, Artificial Sequence
  Synthetic
gctcaggaattgctgataaatccattaagggaactattcataccaga

SEQ ID NO: 729 - DNA, 47 bp, Artificial Sequence
  Synthetic
ggtttccttcacatattcatccgtagaatctggaaaattgtatctgc

SEQ ID NO: 730 - DNA, 46 bp, Artificial Sequence
  Synthetic
aggaccacccctatccatttgatcctaatagagaacgtttagtctg

SEQ ID NO: 731 - DNA, 50 bp, Artificial Sequence
  Synthetic
tttctgtaaaaatcagcaagctgttctctttacaatgtatattttgtggc

SEQ ID NO: 732 - DNA, 44 bp, Artificial Sequence
  Synthetic
ccgttgcgcactaaatagaagtgatggcaatgttagatcttgtt

SEQ ID NO: 733 - DNA, 40 bp, Artificial Sequence
  Synthetic
gaagagtacgaacagcagtagcacacctgttgtcacactt

SEQ ID NO: 734 - DNA, 47 bp, Artificial Sequence
  Synthetic
gagagatacatgaaccgtctgtacatgcgtagattttaattctctgg

SEQ ID NO: 735 - DNA, 45 bp, Artificial Sequence
  Synthetic
atagcgactacctgagaagtacttttaaactttcaggacagtgga

SEQ ID NO: 736 - DNA, 45 bp, Artificial Sequence
  Synthetic
tgctgaagctgttcgatgatctaatatggtgagtttccatcatgg

SEQ ID NO: 737 - DNA, 50 bp, Artificial Sequence
  Synthetic
tgcccaagtatcattggttatttcatttccaaataaattacctgtcactg

SEQ ID NO: 738 - DNA, 40 bp, Artificial Sequence
  Synthetic
atgtggacggggtgttgctggggaacccaccaaaaggaaa

SEQ ID NO: 739 - DNA, 39 bp, Artificial Sequence
  Synthetic
cccgttcgctgagttgatcgagccaactgctgtcccaac

SEQ ID NO: 740 - DNA, 43 bp, Artificial Sequence
  Synthetic
agcgcgctttgatctatacatttttaaacctccaaaacacacg

SEQ ID NO: 741 - DNA, 43 bp, Artificial Sequence
  Synthetic
tggtacagtctccggtaaaggtataggtccggaagaggatcag

SEQ ID NO: 742 - DNA, 43 bp, Artificial Sequence
  Synthetic
tccgctgcatctgtatatatttcatcttcctgatccagcactt

SEQ ID NO: 743 - DNA, 47 bp, Artificial Sequence
  Synthetic
tgatcctattcaagggttgtaactctccggactttaatgtatttgtg

SEQ ID NO: 744 - DNA, 45 bp, Artificial Sequence
  Synthetic
ctctctaagatcccgctcaaactctttgaatttgaaaatcccgcg

SEQ ID NO: 745 - DNA, 44 bp, Artificial Sequence
  Synthetic
cctccccctaatccatctactataggaccctgatgtgtctgatg

SEQ ID NO: 746 - DNA, 41 bp, Artificial Sequence
  Synthetic
gatgacccgatgttcccaatcgagggtaagaggtatccaaa

SEQ ID NO: 747 - DNA, 44 bp, Artificial Sequence
  Synthetic
agccaatatcacacatatccccattgattgtcctccaattcagc

SEQ ID NO: 748 - DNA, 47 bp, Artificial Sequence
  Synthetic
tcacagttgaacattcacagtacatactgtgaactagtatactgtga

SEQ ID NO: 749 - DNA, 43 bp, Artificial Sequence
  Synthetic
tctgaacttgcacttacctttacaacctagggctactttccga

SEQ ID NO: 750 - DNA, 47 bp, Artificial Sequence
  Synthetic
cgtagtgtagtttgatacagttcctaaggaatacaaaagactatgcc

SEQ ID NO: 751 - DNA, 42 bp, Artificial Sequence
  Synthetic
gtactgctctgacaccttggatatggcccatgctactcaaga

SEQ ID NO: 752 - DNA, 48 bp, Artificial Sequence
  Synthetic
acctttttgtcactaggaaggtctatctctgataatcttgaagcattt

SEQ ID NO: 753 - DNA, 44 bp, Artificial Sequence
  Synthetic
gctaacgaagtgtccatgtgttcgtcatggaatagcgataaggg

SEQ ID NO: 754 - DNA, 45 bp, Artificial Sequence
  Synthetic
aggaaatcctcaaaatgaattccctctaggctttctgctaggtat

SEQ ID NO: 755 - DNA, 50 bp, Artificial Sequence
  Synthetic
gacaaaacctcgttgcttaaaaggtaatgatctagaaataaagctggaag

SEQ ID NO: 756 - DNA, 40 bp, Artificial Sequence
  Synthetic
gactcaactcagcaacagtctgtaagcgccctaaaacgaa

SEQ ID NO: 757 - DNA, 45 bp, Artificial Sequence
  Synthetic
gcagaaatatgatttcccagtgtcactttcttacagggtgttcca

SEQ ID NO: 758 - DNA, 44 bp, Artificial Sequence
  Synthetic
ggatcttaaatcagtttctccccttcacaggaaactctgacaga

SEQ ID NO: 759 - DNA, 40 bp, Artificial Sequence
  Synthetic
tgctccggaggttcgttctcccggcccacaatcttcgatc

SEQ ID NO: 760 - DNA, 49 bp, Artificial Sequence
  Synthetic
cgatctgctaatgtattgccttctagaatttgtatagacactgtaaagc

SEQ ID NO: 761 - DNA, 39 bp, Artificial Sequence
  Synthetic
tgcttctgcatgcacacttgcagtccctatgaacctcct

SEQ ID NO: 762 - DNA, 48 bp, Artificial Sequence
  Synthetic
ggcgggattttcaaattcaaattgagttacattcaacaaatcagaaca

SEQ ID NO: 763 - DNA, 44 bp, Artificial Sequence
  Synthetic
aggctctataggttcaattgcactattagtaccagaagcggtac

SEQ ID NO: 764 - DNA, 41 bp, Artificial Sequence
  Synthetic
tttgccacaggtttagccggtgttttgatgttttgcagatg

SEQ ID NO: 765 - DNA, 45 bp, Artificial Sequence
  Synthetic
cgttcaggattgaaaattgactgatccaatatcgagtgtttaggc

SEQ ID NO: 766 - DNA, 41 bp, Artificial Sequence
  Synthetic
taggtggacagtctcctgcatattgggatgttgctaaacca

SEQ ID NO: 767 - DNA, 44 bp, Artificial Sequence
  Synthetic
aatggcgagcatacgactgcgatgtttatggcgataaatgtttc

SEQ ID NO: 768 - DNA, 46 bp, Artificial Sequence
  Synthetic
gacatcttgttgccaaagatgttatgaatggcaattagcttttgtg

SEQ ID NO: 769 - DNA, 45 bp, Artificial Sequence
  Synthetic
ggctatgttccaaacaacttaccttgctggacaggtagtattgtc

SEQ ID NO: 770 - DNA, 41 bp, Artificial Sequence
  Synthetic
cccttatcaacaaaactgcttgctcgttggatgatgctgaa

SEQ ID NO: 771 - DNA, 43 bp, Artificial Sequence
  Synthetic
gcaacaaaaaaaagccttacacctctggagccagcaaatcctt

SEQ ID NO: 772 - DNA, 47 bp, Artificial Sequence
  Synthetic
tccacaggttcatcgtctagtaaaagtttaacagctttagatgactt

SEQ ID NO: 773 - DNA, 44 bp, Artificial Sequence
  Synthetic
attcattatggcggttcccatggtggaattgtagaagatgaagc

SEQ ID NO: 774 - DNA, 40 bp, Artificial Sequence
  Synthetic
gatggtgtttcggaactgatcgggtcctctccagtctctc

SEQ ID NO: 775 - DNA, 44 bp, Artificial Sequence
  Synthetic
ttgctgttccaccaattggtttatttggcaatttaggaataggg

SEQ ID NO: 776 - DNA, 41 bp, Artificial Sequence
  Synthetic
gtgcttgtactaggacccgcagaagaaattgaattaggccc

SEQ ID NO: 777 - DNA, 44 bp, Artificial Sequence
  Synthetic
cctgtgacttttggtacttctacttgatcgcctcttaacagtgg

SEQ ID NO: 778 - DNA, 48 bp, Artificial Sequence
  Synthetic
ggccatatctaatctgttgtcttctaattagttgatgtagaaaaccct

SEQ ID NO: 779 - DNA, 50 bp, Artificial Sequence
  Synthetic
accgtcttcctaaataagactgacttccttataaagacctaaagttttgg

SEQ ID NO: 780 - DNA, 43 bp, Artificial Sequence
  Synthetic
aattgttgggtgcggtaaggaatttccatcaagcaatactgac

SEQ ID NO: 781 - DNA, 46 bp, Artificial Sequence
  Synthetic
tgcatgtgtctaaatcttcttgtctcgacaaaacagtcaaatcaac

SEQ ID NO: 782 - DNA, 40 bp, Artificial Sequence
  Synthetic
tggtgctatgtttcttggagccgtccgtagaaatgaaggg

SEQ ID NO: 783 - DNA, 46 bp, Artificial Sequence
  Synthetic
ccgcttttaatgcatctgaaacattaagaagatctgtggatacctc

SEQ ID NO: 784 - DNA, 40 bp, Artificial Sequence
  Synthetic
gcaggctaggacacggtcacccctccactagtttggtcga

SEQ ID NO: 785 - DNA, 40 bp, Artificial Sequence
  Synthetic
gtgaattcagtgctggtgcctccatctaagttcacagagc

SEQ ID NO: 786 - DNA, 44 bp, Artificial Sequence
  Synthetic
gccaaatactcccatgtccttaagaaaagctacttccaaaggct

SEQ ID NO: 787 - DNA, 39 bp, Artificial Sequence
  Synthetic
tgttgtagatggcgtcgctgatccaggagatcgaggtat

SEQ ID NO: 788 - DNA, 43 bp, Artificial Sequence
  Synthetic
ccagtaaattctgtgcacattggtgacccactggatcttctcc

SEQ ID NO: 789 - DNA, 46 bp, Artificial Sequence
  Synthetic
accaatgtagagttttgtgccaaatcaaattacctcataccactgc

SEQ ID NO: 790 - DNA, 46 bp, Artificial Sequence
  Synthetic
ggattgtaagccaatatcccatacagtggtccagaagatagaaagg

SEQ ID NO: 791 - DNA, 44 bp, Artificial Sequence
  Synthetic
tgcgttcttgtttttgatttctgtcgatgtagagagcttcctcg

SEQ ID NO: 792 - DNA, 41 bp, Artificial Sequence
  Synthetic
ctttgccatgtgtaatcatcccaaggcaatgtatgtgcctc

SEQ ID NO: 793 - DNA, 41 bp, Artificial Sequence
  Synthetic
tgcttccacatgtttggctctgatgttcataccacgattgt

SEQ ID NO: 794 - DNA, 41 bp, Artificial Sequence
  Synthetic
ggagtagtaaacaccggatgtgcctactggagcacatggag

SEQ ID NO: 795 - DNA, 42 bp, Artificial Sequence
  Synthetic
gcaaaacagacataaccgcctctagatgtatacatggcccca

SEQ ID NO: 796 - DNA, 43 bp, Artificial Sequence
  Synthetic
cgagtcatgtatggatgctatttgtaagccagggaaaagcttg

SEQ ID NO: 797 - DNA, 44 bp, Artificial Sequence
  Synthetic
tggatgtagttagtgatttgccagaaaagaactgagccagtgtg

SEQ ID NO: 798 - DNA, 45 bp, Artificial Sequence
  Synthetic
agtggggggacttagagtgtgttgtttactagtaactttgtgttg

SEQ ID NO: 799 - DNA, 42 bp, Artificial Sequence
  Synthetic
gtgttggtaagacacagatacgatcaccacagagaaagggga

SEQ ID NO: 800 - DNA, 46 bp, Artificial Sequence
  Synthetic
gccatggttattggtcctacatctactactttagtagtgcactcca

SEQ ID NO: 801 - DNA, 48 bp, Artificial Sequence
  Synthetic
cttggttttggtgggtgtgtttaattgtatctaaacaaaaggtgagag

SEQ ID NO: 802 - DNA, 42 bp, Artificial Sequence
  Synthetic
cctccccatactctttcattgtttattttgtgcgacaatgct

SEQ ID NO: 803 - DNA, 45 bp, Artificial Sequence
  Synthetic
attcggaagtctaagtggtcgtgaagtaaatgctagaattgaacc

SEQ ID NO: 804 - DNA, 42 bp, Artificial Sequence
  Synthetic
ctcatgcttgcaatgtgttcaatgctggatagagcttgatga

SEQ ID NO: 805 - DNA, 43 bp, Artificial Sequence
  Synthetic
gtcagtgagagaaaactccatgcatcccacttaaggaatgaca

SEQ ID NO: 806 - DNA, 40 bp, Artificial Sequence
  Synthetic
tttgacagaggactcagcttcacgttgtctcctccagtca

SEQ ID NO: 807 - DNA, 43 bp, Artificial Sequence
  Synthetic
ggattcttctcctgtcttcctgatgcactcgcgagatactgac

SEQ ID NO: 808 - DNA, 46 bp, Artificial Sequence
  Synthetic
catgttttagcctttcgaccttttccaagcacagtccattatccaa

SEQ ID NO: 809 - DNA, 44 bp, Artificial Sequence
  Synthetic
ccaccattaaaggggcaattttgacatcagagtcacagttaacg

SEQ ID NO: 810 - DNA, 45 bp, Artificial Sequence
  Synthetic
ggcacatctccaaaagcgaaggctgctagaaatattgttagaaga

SEQ ID NO: 811 - DNA, 42 bp, Artificial Sequence
  Synthetic
cccgaccattgtgaattcctcataggcaacctccaaacattg

SEQ ID NO: 812 - DNA, 39 bp, Artificial Sequence
  Synthetic
aggacctttgcatccttttggaaaccagcggctaaatcc

SEQ ID NO: 813 - DNA, 40 bp, Artificial Sequence
  Synthetic
cagcttttctgttccctgtgttcagaggggaaacgtactc

SEQ ID NO: 814 - DNA, 39 bp, Artificial Sequence
  Synthetic
catcctactctgcttcggcgcgtactgggaacatttgac

SEQ ID NO: 815 - DNA, 48 bp, Artificial Sequence
  Synthetic
gctaccaaatcaaatttctcttgcaaccattgcatcaaatttacatga

SEQ ID NO: 816 - DNA, 48 bp, Artificial Sequence
  Synthetic
cgagactgtagaatcacaatcacttattgtatggatgacatagagact

SEQ ID NO: 817 - DNA, 45 bp, Artificial Sequence
  Synthetic
gttcagcttcatcttcgcctaaaagaaagacaaagtaaaaggaga

SEQ ID NO: 818 - DNA, 40 bp, Artificial Sequence
  Synthetic
gctcagcgacagagttggtggtaacagcaacggtcggagg

SEQ ID NO: 819 - DNA, 43 bp, Artificial Sequence
  Synthetic
gaagtcgttcaagtctcgatagacctgctgaggaagttggaag

SEQ ID NO: 820 - DNA, 43 bp, Artificial Sequence
  Synthetic
tgacctccaccacccttaccttggaagtattctttatttgggt

SEQ ID NO: 821 - DNA, 43 bp, Artificial Sequence
  Synthetic
acaccagttacttcagaaacaagatgtcctggtttgcctacag

SEQ ID NO: 822 - DNA, 48 bp, Artificial Sequence
  Synthetic
gcgccttatattagcaggatgtatcagcaatattttacctcttactcc

SEQ ID NO: 823 - DNA, 47 bp, Artificial Sequence
  Synthetic
cgtcattcaaaacgtcaaagtaaggtctttattttcatgccaattcg

SEQ ID NO: 824 - DNA, 43 bp, Artificial Sequence
  Synthetic
gggcataaacattaggattttccgtcctctaggcataggaacg

SEQ ID NO: 825 - DNA, 41 bp, Artificial Sequence
  Synthetic
ggaggctgcacgacactcatactcactcccctgtgaggaac

SEQ ID NO: 826 - DNA, 39 bp, Artificial Sequence
  Synthetic
accaacgatctggccgccgaaagaaacaccaaccgtcgc

SEQ ID NO: 827 - DNA, 38 bp, Artificial Sequence
  Synthetic
gctctcacgcaaggcacacatagtgctggaagcggagg

SEQ ID NO: 828 - DNA, 42 bp, Artificial Sequence
  Synthetic
ttcgggcactctcagaatgctcatgatgatgaactggtcgcc

SEQ ID NO: 829 - DNA, 40 bp, Artificial Sequence
  Synthetic
gttccaagggcttgcatgcgaccgcagcaatttcaactcc

SEQ ID NO: 830 - DNA, 40 bp, Artificial Sequence
  Synthetic
agagttcatccacgtgcaccctcatgctagagagcctgcg

SEQ ID NO: 831 - DNA, 41 bp, Artificial Sequence
  Synthetic
gggcatggtggtaaagctgcagtcccctcctcttttcaacc

SEQ ID NO: 832 - DNA, 36 bp, Artificial Sequence
  Synthetic
acaccaaccggcggtaccccggcaaggtcgaagcag

SEQ ID NO: 833 - DNA, 36 bp, Artificial Sequence
  Synthetic
acgcagcggtgtctgcaccgccgtagctgttgagcc

SEQ ID NO: 834 - DNA, 42 bp, Artificial Sequence
  Synthetic
agccagcaccgtgataaacagtaacagccactcagagtttcc

SEQ ID NO: 835 - DNA, 38 bp, Artificial Sequence
  Synthetic
ttggccacgcccctcgtaccatcagggcacgtagtagg

SEQ ID NO: 836 - DNA, 42 bp, Artificial Sequence
  Synthetic
ggagtggcactcgtcacagatgatatgggaagtttctggccg

SEQ ID NO: 837 - DNA, 40 bp, Artificial Sequence
  Synthetic
cgcctgaggtggggatcacattaggtctcaatgctgtcgc

SEQ ID NO: 838 - DNA, 39 bp, Artificial Sequence
  Synthetic
agcttcacagagcacgacgcaaagccgggggtgtatagg

SEQ ID NO: 839 - DNA, 42 bp, Artificial Sequence
  Synthetic
taggaggggggtaggacctgtggggacgtgatgtggaaatgt

SEQ ID NO: 840 - DNA, 42 bp, Artificial Sequence
  Synthetic
cagcccaaggaccttttgcttggctctaagcacatcccctac

SEQ ID NO: 841 - DNA, 38 bp, Artificial Sequence
  Synthetic
aagctgtggacgcggagggtcaacatattgggcggctg

SEQ ID NO: 842 - DNA, 40 bp, Artificial Sequence
  Synthetic
gtttgatgcgtccgtctcgggatagcctttgcctccaggg

SEQ ID NO: 843 - DNA, 41 bp, Artificial Sequence
  Synthetic
tccggggtcctgtgatcttcatgtgtgtcacaccacttgct

SEQ ID NO: 844 - DNA, 42 bp, Artificial Sequence
  Synthetic
gcccacagagaagctcacctcaaggatacatcgttatgcgcc

SEQ ID NO: 845 - DNA, 42 bp, Artificial Sequence
  Synthetic
ggtggtctatggcactctgctgtcctcgactcgtttgatcct

SEQ ID NO: 846 - DNA, 40 bp, Artificial Sequence
  Synthetic
gccggctattgaccctccgacaacagctggctgataaggt

SEQ ID NO: 847 - DNA, 42 bp, Artificial Sequence
  Synthetic
acccgcacggataagtctggatagtcttctgtgtagacccgt

SEQ ID NO: 848 - DNA, 38 bp, Artificial Sequence
  Synthetic
tggcacggcatctgcgatagccctcacagaacgcctct

SEQ ID NO: 849 - DNA, 42 bp, Artificial Sequence
  Synthetic
tggtacagtcacgggtgaggtaaacatcatgctcgtccaacg

SEQ ID NO: 850 - DNA, 40 bp, Artificial Sequence
  Synthetic
cgctcccaccctgttgagtttggtatggcagctttttccc

SEQ ID NO: 851 - DNA, 44 bp, Artificial Sequence
  Synthetic
gcaatgtaggcttcaatgttctcatgtcaaaacagaaagacgcc

SEQ ID NO: 852 - DNA, 45 bp, Artificial Sequence
  Synthetic
gtcaattcaacaactgcatggtagggattccattgggatcagact

SEQ ID NO: 853 - DNA, 45 bp, Artificial Sequence
  Synthetic
cgatgtgcttttccattatccattttctgctgaattgttcactct

SEQ ID NO: 854 - DNA, 43 bp, Artificial Sequence
  Synthetic
ggagtgatgcttctgcgatggtaaaagcaaactacaatgatgc

SEQ ID NO: 855 - DNA, 46 bp, Artificial Sequence
  Synthetic
ctaaccatagcagagaccaaactggtattaatgatggcatgctttg

SEQ ID NO: 856 - DNA, 46 bp, Artificial Sequence
  Synthetic
tggttttttgggtcttttcactcttacaccctttctttttcgaatt

SEQ ID NO: 857 - DNA, 42 bp, Artificial Sequence
  Synthetic
gccaaatcttgtaagcatacaggaaacgtttggggtatcgtt

SEQ ID NO: 858 - DNA, 39 bp, Artificial Sequence
  Synthetic
acacctgttccacaagtgtgagaggaggagcagcaagaa

SEQ ID NO: 859 - DNA, 50 bp, Artificial Sequence
  Synthetic
tcttctaggattccactgtcatcaaactttatcatctagaaagcaaactc

SEQ ID NO: 860 - DNA, 47 bp, Artificial Sequence
  Synthetic
ccaaacacatatgaagcatttccaaaaaattcgtagtgtacctgttg

SEQ ID NO: 861 - DNA, 47 bp, Artificial Sequence
  Synthetic
gaaggttctgttggcacatctatatagatagtaaacatagacagcct

SEQ ID NO: 862 - DNA, 43 bp, Artificial Sequence
  Synthetic
cattgtattcagaaactaccagtgccacgtcagcaaggcatta

SEQ ID NO: 863 - DNA, 43 bp, Artificial Sequence
  Synthetic
gcacagtccattctccagttttacttacagagccatcagggga

SEQ ID NO: 864 - DNA, 44 bp, Artificial Sequence
  Synthetic
gcatttgcccctcctctaattatatctgtctagacttagagcgt

SEQ ID NO: 865 - DNA, 42 bp, Artificial Sequence
  Synthetic
tgccatctggaattactctgctaggtacaggaggttctatgg

SEQ ID NO: 866 - DNA, 45 bp, Artificial Sequence
  Synthetic
cgtatcctattcaaaccttgactgaaatcaaagggaggagtttca

SEQ ID NO: 867 - DNA, 43 bp, Artificial Sequence
  Synthetic
agcctcagtaaatgctgtattctgtgttgatcagcttgccgaa

SEQ ID NO: 868 - DNA, 48 bp, Artificial Sequence
  Synthetic
gaccaacaccttagattgatctacattcattctgctactgatagactc

SEQ ID NO: 869 - DNA, 48 bp, Artificial Sequence
  Synthetic
ccttgttctcgctttccataaaagaatggcctgatttacttaaaatgt

SEQ ID NO: 870 - DNA, 50 bp, Artificial Sequence
  Synthetic
cctgtagtggaattttacaaagctgaacattatctcagacatgtagaaga

SEQ ID NO: 871 - DNA, 47 bp, Artificial Sequence
  Synthetic
actcaagctgaagtgtgcaaattgattactactgtgaaactactctg

SEQ ID NO: 872 - DNA, 44 bp, Artificial Sequence
  Synthetic
acgttatctccctcttaagtttcctcctcaatgggaatggagat

SEQ ID NO: 873 - DNA, 43 bp, Artificial Sequence
  Synthetic
cgcatttgaaaaaaagacgatcaagttgccgcgagtatcattg

SEQ ID NO: 874 - DNA, 44 bp, Artificial Sequence
  Synthetic
tcatctgatatagcatcccctgtttggtacgggatgtaatggat

SEQ ID NO: 875 - DNA, 46 bp, Artificial Sequence
  Synthetic
ctgctgagtttccacttcagtataaaaaggagattatttgaaagcg

SEQ ID NO: 876 - DNA, 43 bp, Artificial Sequence
  Synthetic
tgtgttagtattttgtcctgacacagaggacgaggacaaggaa

SEQ ID NO: 877 - DNA, 45 bp, Artificial Sequence
  Synthetic
gcacttccactgtatatccatgtttacattacaagacgttagcct

SEQ ID NO: 878 - DNA, 46 bp, Artificial Sequence
  Synthetic
aggtgtggtatcagttgaagtagtaaacatctgtaccttccattcc

SEQ ID NO: 879 - DNA, 46 bp, Artificial Sequence
  Synthetic
gcttacaaccttagatactgggacatttttcagatgtctctttggc

SEQ ID NO: 880 - DNA, 40 bp, Artificial Sequence
  Synthetic
ctacacaggcccaaaccagcaagtttggttttcctgacac

SEQ ID NO: 881 - DNA, 42 bp, Artificial Sequence
  Synthetic
tcaccatcctgaataactgtgtttaaggatccccatgtacca

SEQ ID NO: 882 - DNA, 50 bp, Artificial Sequence
  Synthetic
cagtagacccagagcctttaatgtattagacatttatttaatagggctgg

SEQ ID NO: 883 - DNA, 49 bp, Artificial Sequence
  Synthetic
ctgatctaggtctgcagaaaactttccccttaaaaaatacactttttgg

SEQ ID NO: 884 - DNA, 43 bp, Artificial Sequence
  Synthetic
gcaggaaacgtacaagtttaaaccacggttgcatgctttttgg

SEQ ID NO: 885 - DNA, 47 bp, Artificial Sequence
  Synthetic
tgtgcataactgtggtaactttctgcaaaagagaactgcaatgtttc

SEQ ID NO: 886 - DNA, 47 bp, Artificial Sequence
  Synthetic
tctttgctttttgtccagatgtcttgtgtattaactgtcaaaagcca

SEQ ID NO: 887 - DNA, 43 bp, Artificial Sequence
  Synthetic
gttctgcttgtccagctggaactgttatgagcaattaaatgac

SEQ ID NO: 888 - DNA, 44 bp, Artificial Sequence
  Synthetic
tcgattttcggatcttccccatatgcttcaatccaatgatcgtc

SEQ ID NO: 889 - DNA, 45 bp, Artificial Sequence
  Synthetic
agtcatacagatccgggagaaattggtgaatagtatctgcaacac

SEQ ID NO: 890 - DNA, 42 bp, Artificial Sequence
  Synthetic
tcttcatgttctttgtccttggaaggtgctagcagaacttca

SEQ ID NO: 891 - DNA, 41 bp, Artificial Sequence
  Synthetic
ccgtctcatgcttgcaatgtagaacttgatgaaatagggga

SEQ ID NO: 892 - DNA, 44 bp, Artificial Sequence
  Synthetic
cttgggtcggtaagggaaaattcatttgaggaatgataccgacg

SEQ ID NO: 893 - DNA, 47 bp, Artificial Sequence
  Synthetic
tcaaagaattctttggtcaggtcttcagattgagagcatgattgaag

SEQ ID NO: 894 - DNA, 46 bp, Artificial Sequence
  Synthetic
ttctctgtgtgaccattttcttgggattacaacacatttccagagg

SEQ ID NO: 895 - DNA, 41 bp, Artificial Sequence
  Synthetic
gctttcttctcattccctccgaccgaggagcatctgtgaga

SEQ ID NO: 896 - DNA, 44 bp, Artificial Sequence
  Synthetic
tgtgtccgtaacttcatactcttactgttctcaaacaagatggc

SEQ ID NO: 897 - DNA, 38 bp, Artificial Sequence
  Synthetic
tctgaggattggagtccgtcatctcgggcagaagaagt

SEQ ID NO: 898 - DNA, 45 bp, Artificial Sequence
  Synthetic
ctggtccaagatcgttgtttatcatagtgtccgggattaatgagt

SEQ ID NO: 899 - DNA, 43 bp, Artificial Sequence
  Synthetic
atcaattcccatttcaagcagacctagggccaaacctgtacaa

SEQ ID NO: 900 - DNA, 45 bp, Artificial Sequence
  Synthetic
caagagaaattcccaccagagtttgttctaacacgaacgtttacg

SEQ ID NO: 901 - DNA, 43 bp, Artificial Sequence
  Synthetic
tcagatacctcgaaagactcctgatttgcttgttgtcagtgct

SEQ ID NO: 902 - DNA, 45 bp, Artificial Sequence
  Synthetic
cctcagcaggtatatcctcataacaagagcagccaaatataggtg

SEQ ID NO: 903 - DNA, 43 bp, Artificial Sequence
  Synthetic
tgcctcatccacaatataccaatcactgtgtgccattcgacac

SEQ ID NO: 904 - DNA, 38 bp, Artificial Sequence
  Synthetic
ggcagtctctgtggcacttgcagaacgagcaggaccta

SEQ ID NO: 905 - DNA, 43 bp, Artificial Sequence
  Synthetic
ggcaagtagagcagatcttgtattagtacagtctctgggaggt

SEQ ID NO: 906 - DNA, 46 bp, Artificial Sequence
  Synthetic
aagtctaactggctccaaaaccttgcattttccttaacagacatca

SEQ ID NO: 907 - DNA, 43 bp, Artificial Sequence
  Synthetic
tgaggccactaagataaagagtcatcaagttgtgccttccctt

SEQ ID NO: 908 - DNA, 42 bp, Artificial Sequence
  Synthetic
cgatttcgggtggtgtctcgacaggacaatccacccaaactg

SEQ ID NO: 909 - DNA, 47 bp, Artificial Sequence
  Synthetic
cgtcgtttacgtactcttaacatgattctgttattttaggggcattt

SEQ ID NO: 910 - DNA, 43 bp, Artificial Sequence
  Synthetic
tgggaacgtgtgattgtacgtgatctagttcagctgttcttca

SEQ ID NO: 911 - DNA, 43 bp, Artificial Sequence
  Synthetic
agaaacgtgtaggcctttcctaactgagttcacaactagtaca

SEQ ID NO: 912 - DNA, 47 bp, Artificial Sequence
  Synthetic
gccatcatttgaggagatagagctagaagtggtgttactataggtgc

SEQ ID NO: 913 - DNA, 47 bp, Artificial Sequence
  Synthetic
atgaactaatttgcgacgtttacgtttagataattcaacaggggatt

SEQ ID NO: 914 - DNA, 44 bp, Artificial Sequence
  Synthetic
ctggaaatctaacacgaaagactctccgtgcaaatgataacact

SEQ ID NO: 915 - DNA, 41 bp, Artificial Sequence
  Synthetic
ttgaccagtgttccccagtgcaaaatgttgcttttgatgca

SEQ ID NO: 916 - DNA, 40 bp, Artificial Sequence
  Synthetic
cagtttttggaacagaacgctgttcctttaggccgcaaat

SEQ ID NO: 917 - DNA, 48 bp, Artificial Sequence
  Synthetic
gtcatgaggctatatgactaggcaattgttaataaacgtttatgctgc

SEQ ID NO: 918 - DNA, 45 bp, Artificial Sequence
  Synthetic
cagatgctctgatttctgtggcgatcatatgaacaaatggagact

SEQ ID NO: 919 - DNA, 47 bp, Artificial Sequence
  Synthetic
cctccagaaatttcggtcattgatgaacaatagcaatggagttaatc

SEQ ID NO: 920 - DNA, 41 bp, Artificial Sequence
  Synthetic
gtcatgcccacttgctactgcatgaggggatcagttgcaca

SEQ ID NO: 921 - DNA, 45 bp, Artificial Sequence
  Synthetic
tggacccctcttgtggaaagcaagtttcataagaggaaagaaagt

SEQ ID NO: 922 - DNA, 48 bp, Artificial Sequence
  Synthetic
gagaacatgaaataaagggctctctaagacaatagcataagaattggt

SEQ ID NO: 923 - DNA, 44 bp, Artificial Sequence
  Synthetic
cgttgtattttaatacagccactgccatgggctggctaacaatc

SEQ ID NO: 924 - DNA, 45 bp, Artificial Sequence
  Synthetic
tctgcacacacacatcactttgaattctcactatgaggaatgttc

SEQ ID NO: 925 - DNA, 43 bp, Artificial Sequence
  Synthetic
gatcccaaatcatctcaaacccattggtgtttggataggaagg

SEQ ID NO: 926 - DNA, 43 bp, Artificial Sequence
  Synthetic
gagttttcaaagatccctgggtgcagattgtgtattggaagca

SEQ ID NO: 927 - DNA, 43 bp, Artificial Sequence
  Synthetic
gccttcttttcattccctccgatactttgtcgaaacactagcg

SEQ ID NO: 928 - DNA, 48 bp, Artificial Sequence
  Synthetic
ctttccctaatcttgccatcttgtgtttagaaatgtcttaagcattgc

SEQ ID NO: 929 - DNA, 41 bp, Artificial Sequence
  Synthetic
gtccgtcccaccagtatgtgagtcttaggagtttcaatcct

SEQ ID NO: 930 - DNA, 42 bp, Artificial Sequence
  Synthetic
accaatgctcatgtcagccgatagccaacttcagtatggagc

SEQ ID NO: 931 - DNA, 45 bp, Artificial Sequence
  Synthetic
atcctcaaagcgcgccatagcgaaaacggtgtatataaaagatgt

SEQ ID NO: 932 - DNA, 44 bp, Artificial Sequence
  Synthetic
tgtctccatacacagagtctgaatatgctgcatgccataaatgt

SEQ ID NO: 933 - DNA, 48 bp, Artificial Sequence
  Synthetic
ttggggctctaaatgcaatacaaaatattaagtatgcatggacctaag

SEQ ID NO: 934 - DNA, 39 bp, Artificial Sequence
  Synthetic
gcatcattgtggacctcctgaacattttgtgaacaggca

SEQ ID NO: 935 - DNA, 38 bp, Artificial Sequence
  Synthetic
atacattgccgccatgttcgtgttctgaagtggaagca

SEQ ID NO: 936 - DNA, 43 bp, Artificial Sequence
  Synthetic
acatctaaatcgtatccactgtgacgtgccacaatgtgcaaac

SEQ ID NO: 937 - DNA, 44 bp, Artificial Sequence
  Synthetic
atgttcccttgctgcaaagaatgacatagacagccaaatacagt

SEQ ID NO: 938 - DNA, 45 bp, Artificial Sequence
  Synthetic
ccatgttcctgcatcagtcatatggcaacaaagacaattgtatga

SEQ ID NO: 939 - DNA, 40 bp, Artificial Sequence
  Synthetic
ggtgctggaatacggtgagggcggtatccgctactcagct

SEQ ID NO: 940 - DNA, 48 bp, Artificial Sequence
  Synthetic
tgccaggtggatgatatatctctatacagtttaaaatgtttacggtac

SEQ ID NO: 941 - DNA, 40 bp, Artificial Sequence
  Synthetic
ataccaatacccatgcatacgctatgtgtgctgccatgtc

SEQ ID NO: 942 - DNA, 50 bp, Artificial Sequence
  Synthetic
aacatcactacgaggatcaaatgtttcctctttaattacatatgacaacc

SEQ ID NO: 943 - DNA, 41 bp, Artificial Sequence
  Synthetic
agggtccatgtcatctgcatattgcagcctttagtatctgc

SEQ ID NO: 944 - DNA, 42 bp, Artificial Sequence
  Synthetic
cacagcccaaaatacataactgtgtgaggacgttagggacaa

SEQ ID NO: 945 - DNA, 44 bp, Artificial Sequence
  Synthetic
tgctctattccaaaaatgcctagcgggattccatgtttttttgc

SEQ ID NO: 946 - DNA, 45 bp, Artificial Sequence
  Synthetic
gagactgtgtagaagcacatattgttgtttgctggcataatcaat

SEQ ID NO: 947 - DNA, 42 bp, Artificial Sequence
  Synthetic
tgctgtaaggtgtgcagttttaatttgtgtttgtggtatggg

SEQ ID NO: 948 - DNA, 43 bp, Artificial Sequence
  Synthetic
cggtataagggaaagttgtgcttatggatgtcaatccgacctt

SEQ ID NO: 949 - DNA, 45 bp, Artificial Sequence
  Synthetic
cgagttttcaaaaataccaggatggacagattgtgtattggaagc

SEQ ID NO: 950 - DNA, 38 bp, Artificial Sequence
  Synthetic
tctcattgcctccaactggcttgagacactggcaagga

SEQ ID NO: 951 - DNA, 42 bp, Artificial Sequence
  Synthetic
ccatcccaccagtaagtagtcttgttaggcgtctccatcctg

SEQ ID NO: 952 - DNA, 39 bp, Artificial Sequence
  Synthetic
ctgactcgttgctcccagactttgttgccaatttcagca

SEQ ID NO: 953 - DNA, 47 bp, Artificial Sequence
  Synthetic
actgctggggaagaatttttcaaattgaatacaagtcaaagaggagt

SEQ ID NO: 954 - DNA, 36 bp, Artificial Sequence
  Synthetic
acaggatccaccgcctttcgcgccccaccacctcaa

SEQ ID NO: 955 - DNA, 39 bp, Artificial Sequence
  Synthetic
ggagcccacaacaatagtgggctcggggacagctatgcg

SEQ ID NO: 956 - DNA, 37 bp, Artificial Sequence
  Synthetic
ggctccgccaaacttcccaatggagttgctacgcggc

SEQ ID NO: 957 - DNA, 38 bp, Artificial Sequence
  Synthetic
gtgcctcgcccaccactaaattggtgttggagcaacgc

SEQ ID NO: 958 - DNA, 42 bp, Artificial Sequence
  Synthetic
gccgacactgtgccaagaacctccgagagggaactgtgtgga

SEQ ID NO: 959 - DNA, 42 bp, Artificial Sequence
  Synthetic
gctcacagtcatgttgaccccaaaggccaaaatacctgggtc

SEQ ID NO: 960 - DNA, 40 bp, Artificial Sequence
  Synthetic
ggcggccctttttgacatggatgcgtggacgtctgcaatg

SEQ ID NO: 961 - DNA, 41 bp, Artificial Sequence
  Synthetic
ggcggcgttactgactgaatcaccccactgtcaagcctttg

SEQ ID NO: 962 - DNA, 41 bp, Artificial Sequence
  Synthetic
agcatctggcagtgccgagaactggggttcctagcagtgtg

SEQ ID NO: 963 - DNA, 39 bp, Artificial Sequence
  Synthetic
gcggttgcctatgggagtgtctggtgcgtgttctaccaa

SEQ ID NO: 964 - DNA, 35 bp, Artificial Sequence
  Synthetic
ctggcttcacagcgacgggcagcggcagagcggtt

SEQ ID NO: 965 - DNA, 39 bp, Artificial Sequence
  Synthetic
ctggttgaccaccacctggctcatggcactaacgggagg

SEQ ID NO: 966 - DNA, 39 bp, Artificial Sequence
  Synthetic
gacccgattgccacgatgcaatcttgtgtgacgagggcc

SEQ ID NO: 967 - DNA, 42 bp, Artificial Sequence
  Synthetic
catgcccagaacactaacgccgggccatgacgtggtgatctg

SEQ ID NO: 968 - DNA, 41 bp, Artificial Sequence
  Synthetic
cgtcctctcgcactcaacctttttgcaagatacgccactgg

SEQ ID NO: 969 - DNA, 40 bp, Artificial Sequence
  Synthetic
ccagcgcggagtagtagtgtcctgaggatgcaacgcaggg

SEQ ID NO: 970 - DNA, 38 bp, Artificial Sequence
  Synthetic
ggcccccccacctgagtaataatgggcccccagctgat

SEQ ID NO: 971 - DNA, 35 bp, Artificial Sequence
  Synthetic
tcacaggggtagcgctccccggcgaggagtcccaa

SEQ ID NO: 972 - DNA, 41 bp, Artificial Sequence
  Synthetic
ccaccccgagaggtggattccttttcaccaatggtcgctcg

SEQ ID NO: 973 - DNA, 40 bp, Artificial Sequence
  Synthetic
gccaggcaggagatgatgcattgacctcctttctggcaag

SEQ ID NO: 974 - DNA, 38 bp, Artificial Sequence
  Synthetic
agagggattttgaggcgcgggccttggtcgctacctgt

SEQ ID NO: 975 - DNA, 37 bp, Artificial Sequence
  Synthetic
cgtcaccgtaaccgtgccagccagcttggttgcgcag

SEQ ID NO: 976 - DNA, 41 bp, Artificial Sequence
  Synthetic
catcctccagagcctgcaaggttgaggctatagggtctgca

SEQ ID NO: 977 - DNA, 41 bp, Artificial Sequence
  Synthetic
caatgtcccccactgtgtctgtatccgtgatgaggtgaggg

SEQ ID NO: 978 - DNA, 42 bp, Artificial Sequence
  Synthetic
acagttatcgcagccggatgttccaaaccagcgtgtaaaagc

SEQ ID NO: 979 - DNA, 42 bp, Artificial Sequence
  Synthetic
gccgagcaacactcagctgtatttaaggctgctttggctgac

SEQ ID NO: 980 - DNA, 41 bp, Artificial Sequence
  Synthetic
atccggtgatgaaccacttcggacccagtggtgagatacgt

SEQ ID NO: 981 - DNA, 49 bp, Artificial Sequence
  Synthetic
tgccacagaaattgcaaggtattatacctttaagtattagagacttagc

SEQ ID NO: 982 - DNA, 42 bp, Artificial Sequence
  Synthetic
attcccttccaggcgttccttagaaaagttagattgctgtgg

SEQ ID NO: 983 - DNA, 50 bp, Artificial Sequence
  Synthetic
tgctccagttcagtatcatctaacaacaattatttgagagagatacagac

SEQ ID NO: 984 - DNA, 43 bp, Artificial Sequence
  Synthetic
gcagtgtaatgtatatctacgtcccgtggaggtaccggctatt

SEQ ID NO: 985 - DNA, 46 bp, Artificial Sequence
  Synthetic
ggacccagatatagtcacaatgccatgatgatctatttgaaagctc

SEQ ID NO: 986 - DNA, 48 bp, Artificial Sequence
  Synthetic
tggtatgctatatctgcttcgtctaggcaagtacttttgatttttcag

SEQ ID NO: 987 - DNA, 47 bp, Artificial Sequence
  Synthetic
acactctacccttcaacactcttattgcattttaatttatggtcctc

SEQ ID NO: 988 - DNA, 48 bp, Artificial Sequence
  Synthetic
gccttgtaaaaaaagatttccagcttatgaaagcagataatacacctc

SEQ ID NO: 989 - DNA, 35 bp, Artificial Sequence
  Synthetic
gtcgcgggggtggtgtttgcagctccacgcctcca

SEQ ID NO: 990 - DNA, 38 bp, Artificial Sequence
  Synthetic
ctccccttctgcaggtggttgtcgggcccttacaagca

SEQ ID NO: 991 - DNA, 42 bp, Artificial Sequence
  Synthetic
agcttcttccagtaatcttccaaggagggtcacttcgatcag

SEQ ID NO: 992 - DNA, 43 bp, Artificial Sequence
  Synthetic
caggttgccataggccttatcaaggagagattttgatgaagcg

SEQ ID NO: 993 - DNA, 42 bp, Artificial Sequence
  Synthetic
gcccctcaggtacaggatggattctaactgagtccacaggcg

SEQ ID NO: 994 - DNA, 48 bp, Artificial Sequence
  Synthetic
ggttcttcaaagacatccagatcatttcgttttgcatttgataatcct

SEQ ID NO: 995 - DNA, 49 bp, Artificial Sequence
  Synthetic
tttctgcattattacgtgactctggcatactatacacaagacacaaagg

SEQ ID NO: 996 - DNA, 48 bp, Artificial Sequence
  Synthetic
ggatcaaaagatgtatcctgtctgtaaagatacagaaaacagtaatgc

SEQ ID NO: 997 - DNA, 49 bp, Artificial Sequence
  Synthetic
ccactaacagttgggaaatacatggcaaaaatcagttttacattccagg

SEQ ID NO: 998 - DNA, 43 bp, Artificial Sequence
  Synthetic
cgttttgttcctctattagacccttccaagctgggttacaaca

SEQ ID NO: 999 - DNA, 48 bp, Artificial Sequence
  Synthetic
tgggttggtacattcattgaaatgtgacaatatgtttactcatgcaga

SEQ ID NO: 1000 - DNA, 45 bp, Artificial Sequence
  Synthetic
acataaggttctcttgtcacccaaactttctccaaggacaactca

SEQ ID NO: 1001 - DNA, 41 bp, Artificial Sequence
  Synthetic
ccccagtgacacaaacatgtaacatagcatggtccagctca

SEQ ID NO: 1002 - DNA, 38 bp, Artificial Sequence
  Synthetic
ataccgggggtaacaggagccacattggtccactgtca

SEQ ID NO: 1003 - DNA, 40 bp, Artificial Sequence
  Synthetic
agcgcgaatctttcttgattgtggtgggcctttgacaatg

SEQ ID NO: 1004 - DNA, 47 bp, Artificial Sequence
  Synthetic
ggtgttttatcgattgttccggtatgcttcgagcactaataaaactg

SEQ ID NO: 1005 - DNA, 44 bp, Artificial Sequence
  Synthetic
gtccagctttgaccatcatctgagagataaagaagagcgtctac

SEQ ID NO: 1006 - DNA, 47 bp, Artificial Sequence
  Synthetic
tgggattgactttgtttttgtctgatgattcaatggcaaagaaaacc

SEQ ID NO: 1007 - DNA, 43 bp, Artificial Sequence
  Synthetic
ccgaaagtggtgcatagtttcttaaacctttaagttttggcgc

SEQ ID NO: 1008 - DNA, 48 bp, Artificial Sequence
  Synthetic
ctacagcaatttctccaatgacaacaattgattgttgttatgctgaac

SEQ ID NO: 1009 - DNA, 43 bp, Artificial Sequence
  Synthetic
gctctccaatcaataattgctcaaacttgtggagcaggtgtac

SEQ ID NO: 1010 - DNA, 45 bp, Artificial Sequence
  Synthetic
gttcattaaacaatgccagggaattactgatggatctgatgtctc

SEQ ID NO: 1011 - DNA, 43 bp, Artificial Sequence
  Synthetic
tggctcatcatggagattgttatcagtcatgagtcagctgcta

SEQ ID NO: 1012 - DNA, 47 bp, Artificial Sequence
  Synthetic
cacccaggataggttacatcatctaacagatgtagtacattttggtt

SEQ ID NO: 1013 - DNA, 48 bp, Artificial Sequence
  Synthetic
tggatcttctttaggctctagatcatactaataaaacctggacatgtt

SEQ ID NO: 1014 - DNA, 41 bp, Artificial Sequence
  Synthetic
tcgtcttggggtttgcggtacctccggatctcttcaagggt

SEQ ID NO: 1015 - DNA, 47 bp, Artificial Sequence
  Synthetic
tgatgtggtgtctgttacaatgtttaccagatacaatagtgacaact

SEQ ID NO: 1016 - DNA, 48 bp, Artificial Sequence
  Synthetic
tgctagtagttggtaagtcctcaattaacatttggtgaggaaatacca

SEQ ID NO: 1017 - DNA, 48 bp, Artificial Sequence
  Synthetic
tgcgtttcagtacactaggatgtattacctctaatacctggaagatcc

SEQ ID NO: 1018 - DNA, 47 bp, Artificial Sequence
  Synthetic
tgtttggatctggaaattgtagtctttaccgatgagtctaaagtagc

SEQ ID NO: 1019 - DNA, 43 bp, Artificial Sequence
  Synthetic
ccccatcctctgcttgcttttaataagtatgtggatgctgaga

SEQ ID NO: 1020 - DNA, 45 bp, Artificial Sequence
  Synthetic
aggccaaatactgatttcattcgtatggaaatgcaaactttgagc

SEQ ID NO: 1021 - DNA, 41 bp, Artificial Sequence
  Synthetic
tggctcctaatgccctatgtaaaagtggctcacttgtctcc

SEQ ID NO: 1022 - DNA, 50 bp, Artificial Sequence
  Synthetic
gctgtcctctttgatacaaaaatcgtaaacttgagtgaaaagttaactgg

SEQ ID NO: 1023 - DNA, 42 bp, Artificial Sequence
  Synthetic
gggaatgtggtgcttatggcagatgtcaatccgactctactg

SEQ ID NO: 1024 - DNA, 41 bp, Artificial Sequence
  Synthetic
tcaaagatacctgggtgggattacaaacagactgtgtcctg

SEQ ID NO: 1025 - DNA, 46 bp, Artificial Sequence
  Synthetic
ggtcatgttgtctcttactctccttaggatgtgatggaatcaatgg

SEQ ID NO: 1026 - DNA, 42 bp, Artificial Sequence
  Synthetic
attacccccaaccggaagtccgttgaaactttagctagaagc

SEQ ID NO: 1027 - DNA, 45 bp, Artificial Sequence
  Synthetic
tctcttactctcgaacatgtatcctcatcgcaccaataatgttct

SEQ ID NO: 1028 - DNA, 41 bp, Artificial Sequence
  Synthetic
gcccatcccaccagtatgttgagtctcggtactgaatcttg

SEQ ID NO: 1029 - DNA, 45 bp, Artificial Sequence
  Synthetic
ccaaggtcattgtttatcatgttgttggagtgtctggaataaacg

SEQ ID NO: 1030 - DNA, 44 bp, Artificial Sequence
  Synthetic
ggatgtgaaggttccggatattgtaccaatcaagggcaggacta

SEQ ID NO: 1031 - DNA, 40 bp, Artificial Sequence
  Synthetic
ctcgaacaagttgcagcacttagccaaaggggaattcttg

SEQ ID NO: 1032 - DNA, 41 bp, Artificial Sequence
  Synthetic
tcagtctccttcaaatctgtgctagacgtgacaaccgacta

SEQ ID NO: 1033 - DNA, 48 bp, Artificial Sequence
  Synthetic
tcagattctgctatgtcatcagtttcctgatattgttttagaagagct

SEQ ID NO: 1034 - DNA, 38 bp, Artificial Sequence
  Synthetic
atgcaccgctgaaagtctcgaagttttatgccaccccg

SEQ ID NO: 1035 - DNA, 43 bp, Artificial Sequence
  Synthetic
gctagtgacagaggaatgaatagttttcaacctgatgccactg

SEQ ID NO: 1036 - DNA, 42 bp, Artificial Sequence
  Synthetic
gcaatttagcatcacccctgtatcgttgtagctctgcatgga

SEQ ID NO: 1037 - DNA, 46 bp, Artificial Sequence
  Synthetic
tccaattcccaaattgccaaagtataatttgaaggcaacacaatcg

SEQ ID NO: 1038 - DNA, 44 bp, Artificial Sequence
  Synthetic
atcagttccacctgctgcagtcaatagttccattagtagaaggc

SEQ ID NO: 1039 - DNA, 48 bp, Artificial Sequence
  Synthetic
aaacgttccaaaggtatctcttcattgttaatgtattagttgacccca

SEQ ID NO: 1040 - DNA, 46 bp, Artificial Sequence
  Synthetic
cccgctcaaagtataggctcatgttcagtttgaatatagaaatccc

SEQ ID NO: 1041 - DNA, 43 bp, Artificial Sequence
  Synthetic
gcgtgcatgaaagtaaacatcagttaagtactcctgttgccag

SEQ ID NO: 1042 - DNA, 48 bp, Artificial Sequence
  Synthetic
gatgaccagtagatccaacacctattggaaactagtaggtatagaagt

SEQ ID NO: 1043 - DNA, 45 bp, Artificial Sequence
  Synthetic
aggaaagtttgcattaccaaatcctaagtgtcctccaatacaact

SEQ ID NO: 1044 - DNA, 48 bp, Artificial Sequence
  Synthetic
cgttacaaagcagattaacaggcaaaggttgatattaaggacattgtc

SEQ ID NO: 1045 - DNA, 45 bp, Artificial Sequence
  Synthetic
actgtccacaaatagacgtcttttaagatgtagatttgagtccgc

SEQ ID NO: 1046 - DNA, 40 bp, Artificial Sequence
  Synthetic
ctggtgtccccgtcgctttggacgaagacccagatcatcc

SEQ ID NO: 1047 - DNA, 43 bp, Artificial Sequence
  Synthetic
agcgatatctccagcattttaatgtctacaagaagaggctcgg

SEQ ID NO: 1048 - DNA, 42 bp, Artificial Sequence
  Synthetic
acaggttcaaccactatgtttggtggaggtggtggaagagtc

SEQ ID NO: 1049 - DNA, 38 bp, Artificial Sequence
  Synthetic
tataggggctgctggttgcacccgctgtttctacaact

SEQ ID NO: 1050 - DNA, 46 bp, Artificial Sequence
  Synthetic
gctctactaaaagctcttggtgtaggaatttaatattgaagagcca

SEQ ID NO: 1051 - DNA, 44 bp, Artificial Sequence
  Synthetic
catgtgagttactgaaatcctctgtgaaaacagtgatgcacctt

SEQ ID NO: 1052 - DNA, 47 bp, Artificial Sequence
  Synthetic
ggcagccaatatgacatctgtaaagtattacatcccagtcatatccc

SEQ ID NO: 1053 - DNA, 45 bp, Artificial Sequence
  Synthetic
accctattgcaacacgtttacgagacggtttgtttatcaaattgg

SEQ ID NO: 1054 - DNA, 46 bp, Artificial Sequence
  Synthetic
caggatatacctatgaagggtgggttttccaatcttctcatctgac

SEQ ID NO: 1055 - DNA, 47 bp, Artificial Sequence
  Synthetic
gcgacaaaaggtacaaggtagtctactactcctgtaactattaccga

SEQ ID NO: 1056 - DNA, 44 bp, Artificial Sequence
  Synthetic
caaactctgcacactgaatctattcacgaagttttgtcaccaga

SEQ ID NO: 1057 - DNA, 45 bp, Artificial Sequence
  Synthetic
ccactgttctcaaacaatcgtctttgcagacatagatttgagtcc

SEQ ID NO: 1058 - DNA, 48 bp, Artificial Sequence
  Synthetic
tgtagcatttccagttgtacacttatattcaaattatgtgtgaccctc

SEQ ID NO: 1059 - DNA, 49 bp, Artificial Sequence
  Synthetic
gttgaatccaaaaatgactgtgactgtattcactaatacgttttctgga

SEQ ID NO: 1060 - DNA, 39 bp, Artificial Sequence
  Synthetic
gcttcttgcacagcatcgaactcaccagaagaagagcag

SEQ ID NO: 1061 - DNA, 46 bp, Artificial Sequence
  Synthetic
agaggtaacagagggagaaatagttttgatgaaaaagcacaaacct

SEQ ID NO: 1062 - DNA, 50 bp, Artificial Sequence
  Synthetic
caattgtctttgtgcagtgtctttaatgggtagattatgatagtagtagc

SEQ ID NO: 1063 - DNA, 42 bp, Artificial Sequence
  Synthetic
ccttcatttagaggcaccaaagctggatcctttgggacctac

SEQ ID NO: 1064 - DNA, 43 bp, Artificial Sequence
  Synthetic
tgtacttgttgtacccgcctattctaaggcttttcaaagagca

SEQ ID NO: 1065 - DNA, 46 bp, Artificial Sequence
  Synthetic
agtggttgtgctatatctgttacaaatcacaatgccaactattcct

SEQ ID NO: 1066 - DNA, 42 bp, Artificial Sequence
  Synthetic
ggatctggcagcataacccttaatacaaggttgtggtgccta

SEQ ID NO: 1067 - DNA, 46 bp, Artificial Sequence
  Synthetic
tccccataggattcctttgtcatttgtgtacctttggacatagtgg

SEQ ID NO: 1068 - DNA, 44 bp, Artificial Sequence
  Synthetic
ggaacaaatgctaaattccagtcttttcctctggaacctgatgt

SEQ ID NO: 1069 - DNA, 44 bp, Artificial Sequence
  Synthetic
caatgaaacattaaggtgcaagcatacatgttttgagcctctcc

SEQ ID NO: 1070 - DNA, 38 bp, Artificial Sequence
  Synthetic
gcagttaccactcccggtacacagtctttggctgcaac

SEQ ID NO: 1071 - DNA, 42 bp, Artificial Sequence
  Synthetic
aggcagtcccccgtgatagtctccatctcgggggtctctagc

SEQ ID NO: 1072 - DNA, 36 bp, Artificial Sequence
  Synthetic
gacgcaatggacccgagggatgctctggggcacaca

SEQ ID NO: 1073 - DNA, 37 bp, Artificial Sequence
  Synthetic
gcgggagtcgtatctggcgattggggctggacgttcg

SEQ ID NO: 1074 - DNA, 37 bp, Artificial Sequence
  Synthetic
ctggacaaggtcgccatctgcgccacgtacgcgctgt

SEQ ID NO: 1075 - DNA, 39 bp, Artificial Sequence
  Synthetic
ccccctgccttacgtggtctttgttggtgttgacgacgg

SEQ ID NO: 1076 - DNA, 35 bp, Artificial Sequence
  Synthetic
agagccaggaccaggacgcgccacgaccagctgct

SEQ ID NO: 1077 - DNA, 40 bp, Artificial Sequence
  Synthetic
cacgcctacctgaaggtgaccccgtaagcacggggagggt

SEQ ID NO: 1078 - DNA, 35 bp, Artificial Sequence
  Synthetic
agacggcgtccctggagtctctggcggacggaaca

SEQ ID NO: 1079 - DNA, 41 bp, Artificial Sequence
  Synthetic
ccaggtacatcagcagacaggcttctccctgttcaacccca

SEQ ID NO: 1080 - DNA, 40 bp, Artificial Sequence
  Synthetic
tcgtcgtcgaacggttttacgtcagttgccactgggtcct

SEQ ID NO: 1081 - DNA, 38 bp, Artificial Sequence
  Synthetic
gcggtggcgctgttcaagattgcttttggccatctgca

SEQ ID NO: 1082 - DNA, 39 bp, Artificial Sequence
  Synthetic
cccgatgacgtgctggacctatcgaacaccagctgcatg

SEQ ID NO: 1083 - DNA, 37 bp, Artificial Sequence
  Synthetic
cgtcagtttacggaccgcgtggtggtcacgtccccga

SEQ ID NO: 1084 - DNA, 40 bp, Artificial Sequence
  Synthetic
cgggaaaaactaccgcgctgatacactcgtgtccggagag

SEQ ID NO: 1085 - DNA, 40 bp, Artificial Sequence
  Synthetic
ggacgtaaaccaggtgggccagcagatcaccgtcctgttg

SEQ ID NO: 1086 - DNA, 37 bp, Artificial Sequence
  Synthetic
ctcgccgagctatgggcctcgttgtttcggcagcagc

SEQ ID NO: 1087 - DNA, 35 bp, Artificial Sequence
  Synthetic
ggagggcgtaacgttccgcttgctgggtcctgcgg

SEQ ID NO: 1088 - DNA, 35 bp, Artificial Sequence
  Synthetic
gcccgttaaccccccacgtgcccggggcttttcgt

SEQ ID NO: 1089 - DNA, 35 bp, Artificial Sequence
  Synthetic
actgtcgtcggtggcgctgacacaggcgggacacc

SEQ ID NO: 1090 - DNA, 38 bp, Artificial Sequence
  Synthetic
tcaaccccgccctacactacaccagaccccccgaagct

SEQ ID NO: 1091 - DNA, 36 bp, Artificial Sequence
  Synthetic
ttggtgagcgcctggacgctcgctgcttcctcgagt

SEQ ID NO: 1092 - DNA, 38 bp, Artificial Sequence
  Synthetic
cggtttgttggcgcctttatggcgcgcgggactttagc

SEQ ID NO: 1093 - DNA, 37 bp, Artificial Sequence
  Synthetic
ctcctgtgcaccctcacgttctcgggggtttcctccg

SEQ ID NO: 1094 - DNA, 40 bp, Artificial Sequence
  Synthetic
cttcctaacccagaccccggggggcgcgtcagatacagaa

SEQ ID NO: 1095 - DNA, 36 bp, Artificial Sequence
  Synthetic
cccacccccgaaccatgaacccgtggccgagatcgt

SEQ ID NO: 1096 - DNA, 37 bp, Artificial Sequence
  Synthetic
tcagaacgggccggtcgtcggccgattccttcatgca

SEQ ID NO: 1097 - DNA, 36 bp, Artificial Sequence
  Synthetic
aaggtcatccgaggcgccgtcccccaacactgacgt

SEQ ID NO: 1098 - DNA, 38 bp, Artificial Sequence
  Synthetic
aaggctgccgctttacgagggtctcctagttggcccgc

SEQ ID NO: 1099 - DNA, 35 bp, Artificial Sequence
  Synthetic
aatcgtggcgcggctcgtgcggggtttctggggct

SEQ ID NO: 1100 - DNA, 36 bp, Artificial Sequence
  Synthetic
gcgcctgatcgtggagacggctgtacgtcgctggcg

SEQ ID NO: 1101 - DNA, 38 bp, Artificial Sequence
  Synthetic
cgctttgtgactgagaacgtgctggagctggcccagga

SEQ ID NO: 1102 - DNA, 37 bp, Artificial Sequence
  Synthetic
ggctcgtggtccagtgcatcagttcacgaacgccgcg

SEQ ID NO: 1103 - DNA, 41 bp, Artificial Sequence
  Synthetic
gaccagatgctgcacgtgctgtgcatcggcaacaacaaagc

SEQ ID NO: 1104 - DNA, 40 bp, Artificial Sequence
  Synthetic
ctcgtgcgctttctggagctagctccggaaacttggtaca

SEQ ID NO: 1105 - DNA, 35 bp, Artificial Sequence
  Synthetic
accttcagtccggacgggcggtgggcggcagcatt

SEQ ID NO: 1106 - DNA, 35 bp, Artificial Sequence
  Synthetic
taagctccatcgcgggcggacccacgcccacatcc

SEQ ID NO: 1107 - DNA, 36 bp, Artificial Sequence
  Synthetic
tcctggcccagcagacccaggcgttgtagtgtgccc

SEQ ID NO: 1108 - DNA, 34 bp, Artificial Sequence
  Synthetic
tgctcgcgacgtcgggttgcagaccgcgccgttt

SEQ ID NO: 1109 - DNA, 35 bp, Artificial Sequence
  Synthetic
tcgaccgcctggccaaacgcgaatcgcggccagca

SEQ ID NO: 1110 - DNA, 35 bp, Artificial Sequence
  Synthetic
gtggcgtgaaactcccgcaacgaagccatacgcgc

SEQ ID NO: 1111 - DNA, 38 bp, Artificial Sequence
  Synthetic
ggagggggaaggaacgaaacactcttctgcgtgcccgt

SEQ ID NO: 1112 - DNA, 41 bp, Artificial Sequence
  Synthetic
gggaactcgggggtgatgaagtgacgtctgggaacacaggc

SEQ ID NO: 1113 - DNA, 41 bp, Artificial Sequence
  Synthetic
tcttggacatacggccgtcccaccatcacggactttcccct

SEQ ID NO: 1114 - DNA, 36 bp, Artificial Sequence
  Synthetic
gaggccaagctagccgaggctgcgctccatggcaga

SEQ ID NO: 1115 - DNA, 42 bp, Artificial Sequence
  Synthetic
acatcaccaccgtcagcaccttcaaactcgtgatcctccagc

SEQ ID NO: 1116 - DNA, 35 bp, Artificial Sequence
  Synthetic
accccaacgccatcgcctcacgtcgccgagcatcc

SEQ ID NO: 1117 - DNA, 39 bp, Artificial Sequence
  Synthetic
gcgacgcacatcaaggtgggcgatcagaaagcccccatt

SEQ ID NO: 1118 - DNA, 37 bp, Artificial Sequence
  Synthetic
cgagatgctgcgctccgatggatatggcgtcggaaga

SEQ ID NO: 1119 - DNA, 35 bp, Artificial Sequence
  Synthetic
ttccccaacggcaagcccgccgtccagaaccactg

SEQ ID NO: 1120 - DNA, 40 bp, Artificial Sequence
  Synthetic
atcaattccaaccggtgctgcgccgacagaaacccgttgt

SEQ ID NO: 1121 - DNA, 35 bp, Artificial Sequence
  Synthetic
agtacgtggaccaggcggtgcctcgcggttggtga

SEQ ID NO: 1122 - DNA, 39 bp, Artificial Sequence
  Synthetic
acaaggtaaccataggcggggctgaacagctgcaacggg

SEQ ID NO: 1123 - DNA, 36 bp, Artificial Sequence
  Synthetic
caccatcaaggtcccccccgttcggacggacacgcg

SEQ ID NO: 1124 - DNA, 36 bp, Artificial Sequence
  Synthetic
cggtaaaacagagcggggcgttcgaggcggaggtgg

SEQ ID NO: 1125 - DNA, 38 bp, Artificial Sequence
  Synthetic
cgcgagcggatctgctttcgagagcctcctcagcatcc

SEQ ID NO: 1126 - DNA, 39 bp, Artificial Sequence
  Synthetic
atcttgtcgcccacggccgactccatctttgtgctgtgc

SEQ ID NO: 1127 - DNA, 36 bp, Artificial Sequence
  Synthetic
ccacttacgggggccacatgtagtgcaggtgggcgg

SEQ ID NO: 1128 - DNA, 39 bp, Artificial Sequence
  Synthetic
gctcttaacgaggctctctgcggggcggcacacctatca

SEQ ID NO: 1129 - DNA, 36 bp, Artificial Sequence
  Synthetic
acatgctggccatcatcggcctcggcgacctggaca

SEQ ID NO: 1130 - DNA, 40 bp, Artificial Sequence
  Synthetic
ccgccaaccaagggctgatagataatgtcgcggatgctgc

SEQ ID NO: 1131 - DNA, 37 bp, Artificial Sequence
  Synthetic
acacgttcttcgccggcccccctagggggccaatggt

SEQ ID NO: 1132 - DNA, 37 bp, Artificial Sequence
  Synthetic
tcgtggtcaccggtgctcggcatgcacgataccgacc

SEQ ID NO: 1133 - DNA, 36 bp, Artificial Sequence
  Synthetic
ttccccgcccggtcgagttggagatagcccagccca

SEQ ID NO: 1134 - DNA, 39 bp, Artificial Sequence
  Synthetic
cggttcttggccctggtgagttctatgcgctggaggtgc

SEQ ID NO: 1135 - DNA, 37 bp, Artificial Sequence
  Synthetic
accccacagccaaacgcggtgtgtatacggacgcgcc

SEQ ID NO: 1136 - DNA, 37 bp, Artificial Sequence
  Synthetic
tccacatcgcgcaggggtactcaggacatcggtgtgt

SEQ ID NO: 1137 - DNA, 35 bp, Artificial Sequence
  Synthetic
tagcccgatgcccccgttgacaaggcgaccctgcg

SEQ ID NO: 1138 - DNA, 38 bp, Artificial Sequence
  Synthetic
aggttggagccggcgatggtgttcaaagacgcggtgaa

SEQ ID NO: 1139 - DNA, 39 bp, Artificial Sequence
  Synthetic
atcgccgacaggtttctggagtccttgtagaacgcgggt

SEQ ID NO: 1140 - DNA, 37 bp, Artificial Sequence
  Synthetic
gccagtgacgtggacgcctagagctgggtctggagtc

SEQ ID NO: 1141 - DNA, 40 bp, Artificial Sequence
  Synthetic
agtgttccaggggcaggaacaccggggcatccttatccat

SEQ ID NO: 1142 - DNA, 35 bp, Artificial Sequence
  Synthetic
tgggcgtggcactatcggctgacgaggccgcagct

SEQ ID NO: 1143 - DNA, 42 bp, Artificial Sequence
  Synthetic
ttccggaatttatacccgggccggtgtgtgatgatttcgcca

SEQ ID NO: 1144 - DNA, 37 bp, Artificial Sequence
  Synthetic
cacggggttacgcgggtagtggagggtcagccgttca

SEQ ID NO: 1145 - DNA, 35 bp, Artificial Sequence
  Synthetic
tgggcacgtacacccccctcgtacaggggctgggt

SEQ ID NO: 1146 - DNA, 37 bp, Artificial Sequence
  Synthetic
acgcgcagactgtcgacggcgccgtctaagtggagct

SEQ ID NO: 1147 - DNA, 37 bp, Artificial Sequence
  Synthetic
gggctgtcattcctcgggaacggaccggacggacctt

SEQ ID NO: 1148 - DNA, 37 bp, Artificial Sequence
  Synthetic
tggtgaatccagacgtggtgccgcagaacgccctcga

SEQ ID NO: 1149 - DNA, 38 bp, Artificial Sequence
  Synthetic
gctcgacctctccacacctgctgcgcggacaattaggc

SEQ ID NO: 1150 - DNA, 35 bp, Artificial Sequence
  Synthetic
agaacgactggcgcgccactcctgatgggccgcca

SEQ ID NO: 1151 - DNA, 39 bp, Artificial Sequence
  Synthetic
gagaaccgtggacgacgtacgcgacaagatcggactgcg

SEQ ID NO: 1152 - DNA, 35 bp, Artificial Sequence
  Synthetic
tgttggccccgacgctcagttaagcacggccgggc

SEQ ID NO: 1153 - DNA, 36 bp, Artificial Sequence
  Synthetic
accacacgagcacgaggcctccctgcagcacctctc

SEQ ID NO: 1154 - DNA, 36 bp, Artificial Sequence
  Synthetic
atcggcgttggtggagggcgtgcgtctggtggtcgt

SEQ ID NO: 1155 - DNA, 36 bp, Artificial Sequence
  Synthetic
attccaggtcgtcgcggcgtggacctctccgacagc

SEQ ID NO: 1156 - DNA, 34 bp, Artificial Sequence
  Synthetic
tttcggcctgccaggtggcgggccccggacataa

SEQ ID NO: 1157 - DNA, 35 bp, Artificial Sequence
  Synthetic
tcgaccgaacagccgtccgcgcgcccgagttttgc

SEQ ID NO: 1158 - DNA, 38 bp, Artificial Sequence
  Synthetic
tctggacacccccacggaccattggcacggacaacagg

SEQ ID NO: 1159 - DNA, 38 bp, Artificial Sequence
  Synthetic
tggggagtagggccttttccatggatgcgccccaaagc

SEQ ID NO: 1160 - DNA, 38 bp, Artificial Sequence
  Synthetic
cgccctcgacgagtgggatcttcacccccagtaccctc

SEQ ID NO: 1161 - DNA, 34 bp, Artificial Sequence
  Synthetic
aaaccgccccccaagcctaggatgaagccccccg

SEQ ID NO: 1162 - DNA, 41 bp, Artificial Sequence
  Synthetic
actgaccctctgatcgccgttaccggatagcagatgtgagg

SEQ ID NO: 1163 - DNA, 35 bp, Artificial Sequence
  Synthetic
cagccccttggagagcacccggtgcagcagtcgga

SEQ ID NO: 1164 - DNA, 35 bp, Artificial Sequence
  Synthetic
ggcagtgccgcattttggctggccggacgaacgac

SEQ ID NO: 1165 - DNA, 37 bp, Artificial Sequence
  Synthetic
gggccccggggttttaaggatacgggggggtaggtca

SEQ ID NO: 1166 - DNA, 35 bp, Artificial Sequence
  Synthetic
agtccaggcacgcgtcctcgccgtcccgggtgttt

SEQ ID NO: 1167 - DNA, 40 bp, Artificial Sequence
  Synthetic
ctcttccgcggtaaatcccgtgccccccggtatacgacga

SEQ ID NO: 1168 - DNA, 40 bp, Artificial Sequence
  Synthetic
cgccttcacgattacccgttggtcggaggggtgtgtcttt

SEQ ID NO: 1169 - DNA, 40 bp, Artificial Sequence
  Synthetic
tgggttcaggcgcctactcatctggtcctccccaagtacc

SEQ ID NO: 1170 - DNA, 36 bp, Artificial Sequence
  Synthetic
tcgcacgggccccttttggactgccgtccacaacgc

SEQ ID NO: 1171 - DNA, 37 bp, Artificial Sequence
  Synthetic
tggcggtgggagagtcggttcgtccctcgcatgaagc

SEQ ID NO: 1172 - DNA, 36 bp, Artificial Sequence
  Synthetic
cgcgcatgcttcatgggtcccggggcggtcattgga

SEQ ID NO: 1173 - DNA, 36 bp, Artificial Sequence
  Synthetic
gggtggcggcaagaacagcgcgcagtctggcatctg

SEQ ID NO: 1174 - DNA, 38 bp, Artificial Sequence
  Synthetic
gtgttgttgggtgccctccgccccccaaaccatgtccg

SEQ ID NO: 1175 - DNA, 38 bp, Artificial Sequence
  Synthetic
cccggcgtccacaaatgagttccagcctggttgtccgt

SEQ ID NO: 1176 - DNA, 35 bp, Artificial Sequence
  Synthetic
tttggcgcgtcaccgaccgcaacgcgggactatgc

SEQ ID NO: 1177 - DNA, 34 bp, Artificial Sequence
  Synthetic
aggccgctgtccgtctctgcggccgtggttaacc

SEQ ID NO: 1178 - DNA, 37 bp, Artificial Sequence
  Synthetic
gcttcgaccgaaactggcgagtcagcgcgatccgaca

SEQ ID NO: 1179 - DNA, 37 bp, Artificial Sequence
  Synthetic
agccacatcaggagcgcccgatcgcctgtctcctcgt

SEQ ID NO: 1180 - DNA, 50 bp, Artificial Sequence
  Synthetic
tgttcccaatttgtaacatcaagctatcagaagataataaccattggatc

SEQ ID NO: 1181 - DNA, 39 bp, Artificial Sequence
  Synthetic
attgtcaaccaactggtgccaaggtttgagtctgttgct

SEQ ID NO: 1182 - DNA, 47 bp, Artificial Sequence
  Synthetic
atcaggataacaggagcactccgaaaaagggaaagtagttaaatcag

SEQ ID NO: 1183 - DNA, 48 bp, Artificial Sequence
  Synthetic
cctggaattagtgcttttggttctcaaagggttttcatttaaatacgg

SEQ ID NO: 1184 - DNA, 42 bp, Artificial Sequence
  Synthetic
ttccgaaagcccaggatgatggtgtatccctcctgttgctgt

SEQ ID NO: 1185 - DNA, 48 bp, Artificial Sequence
  Synthetic
cccataacatccaatgacataacccctttgggtatacatttaaaccct

SEQ ID NO: 1186 - DNA, 40 bp, Artificial Sequence
  Synthetic
gtggtctccatgcgacgtgccgtctgtgccttctcatctg

SEQ ID NO: 1187 - DNA, 41 bp, Artificial Sequence
  Synthetic
gttccccccagcaaagaattgttagagtctcctgagcattg

SEQ ID NO: 1188 - DNA, 42 bp, Artificial Sequence
  Synthetic
tggaaagattctgccccatgctgaaacaacacatagcgcctc

SEQ ID NO: 1189 - DNA, 45 bp, Artificial Sequence
  Synthetic
tgtggtttttgtcagtatctcgcaataaaagaactacggaacctg

SEQ ID NO: 1190 - DNA, 41 bp, Artificial Sequence
  Synthetic
ccacgggtccatttctattccagatcagatcgagtgatggt

SEQ ID NO: 1191 - DNA, 41 bp, Artificial Sequence
  Synthetic
agatgctagtggatctgctgatctaattattgcggccagga

SEQ ID NO: 1192 - DNA, 43 bp, Artificial Sequence
  Synthetic
acccctcatgtactcttatcttcaaaagcgggtcatcagtcaa

SEQ ID NO: 1193 - DNA, 43 bp, Artificial Sequence
  Synthetic
aatgccttaaaagctgatgcatggacctgaatttcgtcaacag

SEQ ID NO: 1194 - DNA, 42 bp, Artificial Sequence
  Synthetic
gtttcactgacctcctcaggagtgatcggtttttgagagttc

SEQ ID NO: 1195 - DNA, 43 bp, Artificial Sequence
  Synthetic
caagtacgtctctcatttgttggaaccaaggccattagaagcc

SEQ ID NO: 1196 - DNA, 38 bp, Artificial Sequence
  Synthetic
gaaaccctctcaagacggcggaaaagatgccggcactt

SEQ ID NO: 1197 - DNA, 46 bp, Artificial Sequence
  Synthetic
cacacaaatcacgacgacagaaatattttgatgttactcctgatgt

SEQ ID NO: 1198 - DNA, 46 bp, Artificial Sequence
  Synthetic
cgcgataatatcaatcttctcctcaaagagttaaatgtgaggtgtc

SEQ ID NO: 1199 - DNA, 48 bp, Artificial Sequence
  Synthetic
gcaacaacaacgacacgaattactaggagcatccagtatataaagttg

SEQ ID NO: 1200 - DNA, 50 bp, Artificial Sequence
  Synthetic
tgtcgtctaacagatttgagatgttgtggatgatatacaatgtattgatg

SEQ ID NO: 1201 - DNA, 45 bp, Artificial Sequence
  Synthetic
gatctctacctgcgacgtaaaagtattgaattttcaggacagtgg

SEQ ID NO: 1202 - DNA, 48 bp, Artificial Sequence
  Synthetic
tgaggccttcttttctcccataattggactcccaaataaattattgga

SEQ ID NO: 1203 - DNA, 41 bp, Artificial Sequence
  Synthetic
tttcggtgggactggaaacggcagctctgcaagttccttct

SEQ ID NO: 1204 - DNA, 44 bp, Artificial Sequence
  Synthetic
gttcctatacccagtcctccaaaatcgactcttgctgatcgatt

SEQ ID NO: 1205 - DNA, 47 bp, Artificial Sequence
  Synthetic
agttgtaagtacaggtggttctgccaacattaattgaatcaggagga

SEQ ID NO: 1206 - DNA, 43 bp, Artificial Sequence
  Synthetic
gatctggagtagcagctacattctctttagcactgacgtcact

SEQ ID NO: 1207 - DNA, 39 bp, Artificial Sequence
  Synthetic
tcgcctgaatgttggcctatctataggttctgacgctgc

SEQ ID NO: 1208 - DNA, 43 bp, Artificial Sequence
  Synthetic
ctgtaccagcatagaaaaacagactcaagaccaatcgccagag

SEQ ID NO: 1209 - DNA, 48 bp, Artificial Sequence
  Synthetic
ttaaataatggattgcctgttgtggttaagaggtattgaaataggtcg

SEQ ID NO: 1210 - DNA, 48 bp, Artificial Sequence
  Synthetic
caccaaagccaatgtcacacatattccacctgtgcaattaattaattc

SEQ ID NO: 1211 - DNA, 44 bp, Artificial Sequence
  Synthetic
tcgttcagtcatatctatttgccaactaagtgtcctactgctgc

SEQ ID NO: 1212 - DNA, 50 bp, Artificial Sequence
  Synthetic
agtacattcagagaccattcacagtattgtgataaaatactgtgaatccc

SEQ ID NO: 1213 - DNA, 40 bp, Artificial Sequence
  Synthetic
cctttggcgccaaaaacttaccgagggtcgatactgccaa

SEQ ID NO: 1214 - DNA, 47 bp, Artificial Sequence
  Synthetic
cgtcagaaattaagttagcaggcaagggagataaggctactattcct

SEQ ID NO: 1215 - DNA, 42 bp, Artificial Sequence
  Synthetic
gcttagatgctctctcaggcgacagatctcagagctaagtcc

SEQ ID NO: 1216 - DNA, 42 bp, Artificial Sequence
  Synthetic
gcagagtcggaccccaatttccccgagagaatctggaaccac

SEQ ID NO: 1217 - DNA, 43 bp, Artificial Sequence
  Synthetic
atcccccagacccttttccatttggaagtttggtatattttgg

SEQ ID NO: 1218 - DNA, 48 bp, Artificial Sequence
  Synthetic
gctggatctctaaaggtgaatagttgggcctgatatatcttttattgc

SEQ ID NO: 1219 - DNA, 50 bp, Artificial Sequence
  Synthetic
tctcttcaaatatgttgtccccaatgtgatactaatgtgtttgtagatcc

SEQ ID NO: 1220 - DNA, 44 bp, Artificial Sequence
  Synthetic
gctatttacatcacgctggaactgtttgagtttgaaaatcccgc

SEQ ID NO: 1221 - DNA, 44 bp, Artificial Sequence
  Synthetic
cgctctgtcatatctaaagtccagacctactgctgaaccagaag

SEQ ID NO: 1222 - DNA, 45 bp, Artificial Sequence
  Synthetic
caggagtttataggtcagaacccatgaatattttaccgtggtgtc

SEQ ID NO: 1223 - DNA, 43 bp, Artificial Sequence
  Synthetic
gccaatctggtattatcccttccaggaggagacatagaatcct

SEQ ID NO: 1224 - DNA, 38 bp, Artificial Sequence
  Synthetic
ccagctcctcccatgtccctctgaggctgcagggactt

SEQ ID NO: 1225 - DNA, 40 bp, Artificial Sequence
  Synthetic
gcgccaacctgctagggatttctgttaggacccttctcgc

SEQ ID NO: 1226 - DNA, 41 bp, Artificial Sequence
  Synthetic
cgggccgtaacctaactttttctgcgagaaactccgtcttg

SEQ ID NO: 1227 - DNA, 40 bp, Artificial Sequence
  Synthetic
ccgcttgttgcacggggtagacaagtagaccaacagcacc

SEQ ID NO: 1228 - DNA, 44 bp, Artificial Sequence
  Synthetic
gcctatacatccactggatctgttccaagagggtctgacatagc

SEQ ID NO: 1229 - DNA, 40 bp, Artificial Sequence
  Synthetic
cgagtgtccctcctttccacagggaccaagccctatccca

SEQ ID NO: 1230 - DNA, 44 bp, Artificial Sequence
  Synthetic
gacatgcctaaggctgtcagaataccataatgacaggagatacc

SEQ ID NO: 1231 - DNA, 48 bp, Artificial Sequence
  Synthetic
ccttttctttttggctagtcctgcaaataaggtgactcaagatttcac

SEQ ID NO: 1232 - DNA, 43 bp, Artificial Sequence
  Synthetic
ccctaggccatttagaagttctttgacaggacaggtttagagc

SEQ ID NO: 1233 - DNA, 43 bp, Artificial Sequence
  Synthetic
gttcctggctcaagataattttgttcagaagaagtgcagtgga

SEQ ID NO: 1234 - DNA, 46 bp, Artificial Sequence
  Synthetic
gcctggtataggatctcctactagggagtgggactttgtatctacc

SEQ ID NO: 1235 - DNA, 44 bp, Artificial Sequence
  Synthetic
gccttgacttactaaatggtctactagtctatgttgcatgggtc

SEQ ID NO: 1236 - DNA, 42 bp, Artificial Sequence
  Synthetic
tgcgttattggccacctactgggaagcagaagtcatcccaca

SEQ ID NO: 1237 - DNA, 44 bp, Artificial Sequence
  Synthetic
tcttgttctgtggtaatcatgttgaaagaaggggaggaataggg

SEQ ID NO: 1238 - DNA, 46 bp, Artificial Sequence
  Synthetic
ggtaacatctgtccagaacttttctgaacctaacaccagaaaaagg

SEQ ID NO: 1239 - DNA, 43 bp, Artificial Sequence
  Synthetic
acacctggaaaatgagctctcgccatagaagccttaaacaggg

SEQ ID NO: 1240 - DNA, 45 bp, Artificial Sequence
  Synthetic
gggtgtctccatgtctattatggataggaagaagccttaagacat

SEQ ID NO: 1241 - DNA, 39 bp, Artificial Sequence
  Synthetic
actcacttgtctggtgcagaaagacgaagaaggactcca

SEQ ID NO: 1242 - DNA, 47 bp, Artificial Sequence
  Synthetic
gcttgacacatggttttattgatgttggaataatacagtgacagaac

SEQ ID NO: 1243 - DNA, 46 bp, Artificial Sequence
  Synthetic
gcaatgtctcatgtaacatgtgcccatggtatttagaagatgtggt

SEQ ID NO: 1244 - DNA, 48 bp, Artificial Sequence
  Synthetic
gagagtgaaacactaatcctgacatgtaagagaccaggaaataagaca

SEQ ID NO: 1245 - DNA, 46 bp, Artificial Sequence
  Synthetic
ttttccctactttatgccaggtattcaattgggtagaagacaagaa

SEQ ID NO: 1246 - DNA, 41 bp, Artificial Sequence
  Synthetic
cgcacatccccatgaatttagcaagagtcactgctatcgag

SEQ ID NO: 1247 - DNA, 42 bp, Artificial Sequence
  Synthetic
cagccagtccctgattgctgttactatccaagaactccccga

SEQ ID NO: 1248 - DNA, 43 bp, Artificial Sequence
  Synthetic
tgctgcctatacaaatctttctgtcagagtacatgaacagccc

SEQ ID NO: 1249 - DNA, 41 bp, Artificial Sequence
  Synthetic
cagcatggagtcaaactgccaacaagcagacatgatgatga

SEQ ID NO: 1250 - DNA, 39 bp, Artificial Sequence
  Synthetic
agggaacacccaggctctaccgagaggctggcagatcga

SEQ ID NO: 1251 - DNA, 44 bp, Artificial Sequence
  Synthetic
tcccagtgcagattcgatctgaaggcaataattgtactactcat

SEQ ID NO: 1252 - DNA, 44 bp, Artificial Sequence
  Synthetic
gcaggtttgacttcatggagtattgcctaggcagaccaaaatgc

SEQ ID NO: 1253 - DNA, 43 bp, Artificial Sequence
  Synthetic
actggatttattgctgtcttgttgtatgggaacggcttcttca

SEQ ID NO: 1254 - DNA, 45 bp, Artificial Sequence
  Synthetic
tccaggtttttgtaccatgtaatcaccaaatcaaacagaagacga

SEQ ID NO: 1255 - DNA, 44 bp, Artificial Sequence
  Synthetic
tcctttaatagttttgcaggcggtccaatatgggtgaaaacacc

SEQ ID NO: 1256 - DNA, 43 bp, Artificial Sequence
  Synthetic
gctcttagatcatccactttttcgtcggagcaatgaatgagct

SEQ ID NO: 1257 - DNA, 39 bp, Artificial Sequence
  Synthetic
gcattaaaggtgccagcagctgctttgaaaccaaacaca

SEQ ID NO: 1258 - DNA, 47 bp, Artificial Sequence
  Synthetic
gccccatggaatgttatttctcttttggagatccaaacaatatggat

SEQ ID NO: 1259 - DNA, 41 bp, Artificial Sequence
  Synthetic
tcgatccagccatctgctccatgagaacagaatggtgctgg

SEQ ID NO: 1260 - DNA, 43 bp, Artificial Sequence
  Synthetic
cacaatatcaagtgcagtatcccaagcagcgattcaagtgatc

SEQ ID NO: 1261 - DNA, 43 bp, Artificial Sequence
  Synthetic
tccgcgcaataattcttcaaaaaggtgtaagggtttgtgttgc

SEQ ID NO: 1262 - DNA, 49 bp, Artificial Sequence
  Synthetic
gcttgttatacaatgccagggaattctaacgtttcccaattaatagacg

SEQ ID NO: 1263 - DNA, 46 bp, Artificial Sequence
  Synthetic
tcttgtaactctaattgcactgcaaaaattactgatgctgaatgga

SEQ ID NO: 1264 - DNA, 46 bp, Artificial Sequence
  Synthetic
tccattgtaatctgcatcaccttttgggattggatatactatcagg

SEQ ID NO: 1265 - DNA, 50 bp, Artificial Sequence
  Synthetic
ggacaatcaccagtaaagcattgtttgacagtttataatgtatagagctg

SEQ ID NO: 1266 - DNA, 41 bp, Artificial Sequence
  Synthetic
accaataggctccacaggtactgaggtacaacaaggcctat

SEQ ID NO: 1267 - DNA, 50 bp, Artificial Sequence
  Synthetic
gcctgaacgtggttcattatttacaatgatactgcagctatattagatgt

SEQ ID NO: 1268 - DNA, 45 bp, Artificial Sequence
  Synthetic
cgttcaactatttgggtgggagttggctgaatttgaaataatgga

SEQ ID NO: 1269 - DNA, 46 bp, Artificial Sequence
  Synthetic
caccttcacggctcactcttaattacataggcctacttatactaca

SEQ ID NO: 1270 - DNA, 45 bp, Artificial Sequence
  Synthetic
acatctgagcgtttgcgtttcatcagatgactattttctacatcc

SEQ ID NO: 1271 - DNA, 47 bp, Artificial Sequence
  Synthetic
tgggatctggacacagtaatctaaagaacacagtctgtagtagtacc

SEQ ID NO: 1272 - DNA, 50 bp, Artificial Sequence
  Synthetic
gtgcaacctactataaacacctgatgatgaaaatgatcacagattgaatg

SEQ ID NO: 1273 - DNA, 43 bp, Artificial Sequence
  Synthetic
ctccggagatatcctttgacatttagatctggtgttcctttgg

SEQ ID NO: 1274 - DNA, 46 bp, Artificial Sequence
  Synthetic
cccaatcatctaacactgttggatttttgcaaagtttctctggatc

SEQ ID NO: 1275 - DNA, 45 bp, Artificial Sequence
  Synthetic
cagtttttctggatactttcggagacgccgctttctatatcaaac

SEQ ID NO: 1276 - DNA, 39 bp, Artificial Sequence
  Synthetic
gacaaacagctttcgcaacagaaacagctgagtctggtt

SEQ ID NO: 1277 - DNA, 39 bp, Artificial Sequence
  Synthetic
atgactcctcctctggggtgagcccatctattgtgtgaa

SEQ ID NO: 1278 - DNA, 46 bp, Artificial Sequence
  Synthetic
cctagtccactgtcctgaaacagttggaagcaataagaatttctcc

SEQ ID NO: 1279 - DNA, 49 bp, Artificial Sequence
  Synthetic
gcttgagaagccatttgatgatttctgggaaatcatatatttatggaac

SEQ ID NO: 1280 - DNA, 46 bp, Artificial Sequence
  Synthetic
agtcattaattgctcttgtagtgcaacccgaagataatgaatcaga

SEQ ID NO: 1281 - DNA, 40 bp, Artificial Sequence
  Synthetic
ttttcctcttcggcctcggcgtctctatccgactcccctg

SEQ ID NO: 1282 - DNA, 42 bp, Artificial Sequence
  Synthetic
tgacatcttctggacagtccctaaacgaataaagcgagcttc

SEQ ID NO: 1283 - DNA, 45 bp, Artificial Sequence
  Synthetic
gcatctggagtgattggtagtacttccccaagaccttctattcca

SEQ ID NO: 1284 - DNA, 43 bp, Artificial Sequence
  Synthetic
aggaacctgttgaacaaatctatgaagggccctttaaggagta

SEQ ID NO: 1285 - DNA, 45 bp, Artificial Sequence
  Synthetic
gtgtcaggaatgttaacaaatgtgttataggagggttcagggatg

SEQ ID NO: 1286 - DNA, 47 bp, Artificial Sequence
  Synthetic
gcaaactggttaggatctggtaattaataatgtccaagttccaaagg

SEQ ID NO: 1287 - DNA, 50 bp, Artificial Sequence
  Synthetic
cccgccgtccataaaaaaataatttattaattctacatgtaaatggccag

SEQ ID NO: 1288 - DNA, 44 bp, Artificial Sequence
  Synthetic
ccagctgccagttttctaatattgacctttagaggctgatgtgt

SEQ ID NO: 1289 - DNA, 45 bp, Artificial Sequence
  Synthetic
ggtcgggtatcaaatacagcagtttacatatcagtcgttcaaagg

SEQ ID NO: 1290 - DNA, 43 bp, Artificial Sequence
  Synthetic
cctgtcttcctgatgtgtacttcttcactcgcgagatactgac

SEQ ID NO: 1291 - DNA, 39 bp, Artificial Sequence
  Synthetic
ggtccatttctgttccaccacgctggatcagacagggta

SEQ ID NO: 1292 - DNA, 45 bp, Artificial Sequence
  Synthetic
cctttgttattgtcagctgtgattcgtcgttttcccaaatgaagt

SEQ ID NO: 1293 - DNA, 43 bp, Artificial Sequence
  Synthetic
cctgacaatgttcctagcagcgggaggtaagaaatgatgatgt

SEQ ID NO: 1294 - DNA, 46 bp, Artificial Sequence
  Synthetic
gtccaaccattgtgaattcctcataaagagaggaagaagtgcttac

SEQ ID NO: 1295 - DNA, 41 bp, Artificial Sequence
  Synthetic
ggagttggtgcatgggattcaccgaggtgatttgaatttcg

SEQ ID NO: 1296 - DNA, 43 bp, Artificial Sequence
  Synthetic
tgtttcactaacttcttcaggggatcgtttcttaagggtccga

SEQ ID NO: 1297 - DNA, 41 bp, Artificial Sequence
  Synthetic
cccaaaacatcacgcatctgcgccagaagccaatatagtgg

SEQ ID NO: 1298 - DNA, 42 bp, Artificial Sequence
  Synthetic
tcctgctgttccttcatctggttacaatacttgggaaggacg

SEQ ID NO: 1299 - DNA, 41 bp, Artificial Sequence
  Synthetic
actttggttccgtttgacacggcgatcattccaacaaatgc

SEQ ID NO: 1300 - DNA, 47 bp, Artificial Sequence
  Synthetic
tcttcattcacgaatttcccaggatccgatttaattattgagaggcg

SEQ ID NO: 1301 - DNA, 42 bp, Artificial Sequence
  Synthetic
ccagtttgtttccactcccatatgggatccatcattccgtat

SEQ ID NO: 1302 - DNA, 40 bp, Artificial Sequence
  Synthetic
ttgtccctccactatgatagcatccagagtggagtacagg

SEQ ID NO: 1303 - DNA, 43 bp, Artificial Sequence
  Synthetic
tctgaaaccataccaaccatcaatttttggtgctatagcgggt

SEQ ID NO: 1304 - DNA, 42 bp, Artificial Sequence
  Synthetic
tgtccatttctgaatcagccagctgaactcttggtagcaatg

SEQ ID NO: 1305 - DNA, 42 bp, Artificial Sequence
  Synthetic
acttgccattctgccttaacaagggtttaaccgaaaacggtg

SEQ ID NO: 1306 - DNA, 47 bp, Artificial Sequence
  Synthetic
gcttttgacatatagcacagcgaatattttggcatacagtagaacaa

SEQ ID NO: 1307 - DNA, 47 bp, Artificial Sequence
  Synthetic
ttctgtaacgttgtatgtcctgtttaatttgacacctcagatgaaga

SEQ ID NO: 1308 - DNA, 39 bp, Artificial Sequence
  Synthetic
tttcctgattttcctgcacccacgggagtatgggtaacg

SEQ ID NO: 1309 - DNA, 46 bp, Artificial Sequence
  Synthetic
gcgattcttgccacatttaaatctcatacaatggttaacctgtacc

SEQ ID NO: 1310 - DNA, 45 bp, Artificial Sequence
  Synthetic
cagcacgttgggcatattcagcatatgataatgatttaaccgaag

SEQ ID NO: 1311 - DNA, 42 bp, Artificial Sequence
  Synthetic
acgcatctaaacgtttggccgaatttcaagaatcagaggacg

SEQ ID NO: 1312 - DNA, 44 bp, Artificial Sequence
  Synthetic
gcgtccctgtttttttaaacactttccatggacattgcaagaga

SEQ ID NO: 1313 - DNA, 42 bp, Artificial Sequence
  Synthetic
ggtcggggtggggtctttgtatcacctacacccacaaccatc

SEQ ID NO: 1314 - DNA, 47 bp, Artificial Sequence
  Synthetic
cacgcagcaacaactataaacaatattactgtgagtccactattgtg

SEQ ID NO: 1315 - DNA, 46 bp, Artificial Sequence
  Synthetic
ctaaaaaccacagcagcagccttgtacatacgtgataatatggtac

SEQ ID NO: 1316 - DNA, 47 bp, Artificial Sequence
  Synthetic
tgcagaggacgtaatattaaacccaattgattctagcataccagtgc

SEQ ID NO: 1317 - DNA, 39 bp, Artificial Sequence
  Synthetic
tgatggcctagtgattgggctgggctcgtattgggtcta

SEQ ID NO: 1318 - DNA, 46 bp, Artificial Sequence
  Synthetic
gaggaggcagataaaccttgttgtaccatatttttttgcagatgtc

SEQ ID NO: 1319 - DNA, 43 bp, Artificial Sequence
  Synthetic
accatcctgaataacactgttttgtctgcttgctctgcacaat

SEQ ID NO: 1320 - DNA, 50 bp, Artificial Sequence
  Synthetic
cgtctagtatgtcaggattcatggttgcaaaattacattatctgtagagg

SEQ ID NO: 1321 - DNA, 48 bp, Artificial Sequence
  Synthetic
gcatgtgcttgctaaatttaatggacaatcctccattttagtacatgc

SEQ ID NO: 1322 - DNA, 44 bp, Artificial Sequence
  Synthetic
cttaattgaaatgtgtctgcctgtggtgtgttacctgaatgggt

SEQ ID NO: 1323 - DNA, 47 bp, Artificial Sequence
  Synthetic
cactgtgccattgtcatatttttcaacaggtcaagtttgtaaaagac

SEQ ID NO: 1324 - DNA, 41 bp, Artificial Sequence
  Synthetic
cctccgaccgtctcttcagtctctgaatcccagagcaacgg

SEQ ID NO: 1325 - DNA, 39 bp, Artificial Sequence
  Synthetic
agacctgctgctggtactgactgctgacattactgctga

SEQ ID NO: 1326 - DNA, 43 bp, Artificial Sequence
  Synthetic
ccaactacttctgaaactggatcaagcccaggtcttgatgttg

SEQ ID NO: 1327 - DNA, 47 bp, Artificial Sequence
  Synthetic
caggccatttacaagtggagttaaacttttcagcattttcagaaagt

SEQ ID NO: 1328 - DNA, 38 bp, Artificial Sequence
  Synthetic
accactgggcgtcggataatgacaatgctacacctcca

SEQ ID NO: 1329 - DNA, 39 bp, Artificial Sequence
  Synthetic
gggctagcacatcagcttcctttgaagtggagcttgtga

SEQ ID NO: 1330 - DNA, 48 bp, Artificial Sequence
  Synthetic
acgggaattaagtaatcccatctgaatttgcgagataaatttacctcc

SEQ ID NO: 1331 - DNA, 45 bp, Artificial Sequence
  Synthetic
atgagtcagcaatgccttgtttaacatatggtgctatgtatcctg

SEQ ID NO: 1332 - DNA, 44 bp, Artificial Sequence
  Synthetic
acgatcgttaacggttggatttgttgaacttagaccgaatttgg

SEQ ID NO: 1333 - DNA, 40 bp, Artificial Sequence
  Synthetic
gccgtagtgctggctagtaccaggcagatggcgactacca

SEQ ID NO: 1334 - DNA, 45 bp, Artificial Sequence
  Synthetic
ccacaatatcaagtgcaatatcccagcaaatgcagagattcaagt

SEQ ID NO: 1335 - DNA, 43 bp, Artificial Sequence
  Synthetic
gagctctggattggcataagctggataatgagaaacaacatgc

SEQ ID NO: 1336 - DNA, 46 bp, Artificial Sequence
  Synthetic
tgaccagaactatccagatctgtattcaacaattgaagaccttgtc

SEQ ID NO: 1337 - DNA, 46 bp, Artificial Sequence
  Synthetic
tgttgcatggctctattttgtacaacaactatcctgccatatggag

SEQ ID NO: 1338 - DNA, 45 bp, Artificial Sequence
  Synthetic
tcttcccaagaatccatgatttgattttagagtttgcttgcaact

SEQ ID NO: 1339 - DNA, 42 bp, Artificial Sequence
  Synthetic
gaccacagtctcagctctactagaaactgtacagagaggacc

SEQ ID NO: 1340 - DNA, 48 bp, Artificial Sequence
  Synthetic
gtgttcctgatgattctgtctgtatgaaaatctcaaaaacaacaacca

SEQ ID NO: 1341 - DNA, 50 bp, Artificial Sequence
  Synthetic
cctgcatgtcgatatagatcaggtagaaaagatcaagaaaactaggtttg

SEQ ID NO: 1342 - DNA, 46 bp, Artificial Sequence
  Synthetic
ttgactttgagtggtaatggttctatacacattcccagaatcatca

SEQ ID NO: 1343 - DNA, 43 bp, Artificial Sequence
  Synthetic
tggcatcgaacagcattcctataaaaccagaactatacccatg

SEQ ID NO: 1344 - DNA, 44 bp, Artificial Sequence
  Synthetic
ttcccaactccttttgcgataatcaagagtggatgcaattttcc

SEQ ID NO: 1345 - DNA, 47 bp, Artificial Sequence
  Synthetic
gggatgatcagtctatccaataacctagaagactctaactcttgtgg

SEQ ID NO: 1346 - DNA, 42 bp, Artificial Sequence
  Synthetic
tctgagtgttcagcagcctagtgattactcaatcaccctcca

SEQ ID NO: 1347 - DNA, 46 bp, Artificial Sequence
  Synthetic
ctccttgattaggtggttgattgattgcaaactgtataacaaccac

SEQ ID NO: 1348 - DNA, 49 bp, Artificial Sequence
  Synthetic
ccagtattccatctcgaatttggataatccaactctactcatacaattg

SEQ ID NO: 1349 - DNA, 45 bp, Artificial Sequence
  Synthetic
gaagaccagacgtgcacctctaacacatgatgtaggtataaaacc

SEQ ID NO: 1350 - DNA, 42 bp, Artificial Sequence
  Synthetic
aagacctccatacccgagaaattatgctgcactatacccatc

SEQ ID NO: 1351 - DNA, 39 bp, Artificial Sequence
  Synthetic
tgactgggttcactctcgattcacagggagcattgtgtc

SEQ ID NO: 1352 - DNA, 42 bp, Artificial Sequence
  Synthetic
gcagagtttgaaccgtaagcatttgcctcctgtgacattacc

SEQ ID NO: 1353 - DNA, 50 bp, Artificial Sequence
  Synthetic
ctctgaccaaaagacacatctagattagcaaaagaatctattatgatggg

SEQ ID NO: 1354 - DNA, 48 bp, Artificial Sequence
  Synthetic
gcaggtattaaagaggcatattgcaatcaatccaactataacacagaa

SEQ ID NO: 1355 - DNA, 50 bp, Artificial Sequence
  Synthetic
ccttcctcctgataaatgaatccacatcagatatgaagatatgtgttcag

SEQ ID NO: 1356 - DNA, 46 bp, Artificial Sequence
  Synthetic
agtgtaaaatttgcacgtgtttgtgatgggcatttggtaatgatga

SEQ ID NO: 1357 - DNA, 45 bp, Artificial Sequence
  Synthetic
ctacgactccagcatcaaagatggactttgtgtctacttttctca

SEQ ID NO: 1358 - DNA, 40 bp, Artificial Sequence
  Synthetic
aaaccattgctagcggcctcaatttctgcaaatggctgtt

SEQ ID NO: 1359 - DNA, 45 bp, Artificial Sequence
  Synthetic
cttagtaagccaagcacaaacgtaattatggcagtttgttgacca

SEQ ID NO: 1360 - DNA, 46 bp, Artificial Sequence
  Synthetic
ccacaagtacattgaactaatgcactctcctgttatgacaaatggt

SEQ ID NO: 1361 - DNA, 45 bp, Artificial Sequence
  Synthetic
atgttcctcttctacaaaagtggaaagagtgattgctcttcagag

SEQ ID NO: 1362 - DNA, 45 bp, Artificial Sequence
  Synthetic
acagcacagtcaaagacagtttgatgcctgagaagtttttgaatg

SEQ ID NO: 1363 - DNA, 43 bp, Artificial Sequence
  Synthetic
agcagtgctacgttcaacacaaagttaagtatgcaacagttgt

SEQ ID NO: 1364 - DNA, 46 bp, Artificial Sequence
  Synthetic
tcctcaaaccaagactcgttactactttatgtgagagactatgttg

SEQ ID NO: 1365 - DNA, 43 bp, Artificial Sequence
  Synthetic
agtgtctaaaaacgcattataggccgaacatgtgcaaagcgtt

SEQ ID NO: 1366 - DNA, 50 bp, Artificial Sequence
  Synthetic
gtcaaaatgtgtagggtctgcaattcaggattaagtcttttagtactttc

SEQ ID NO: 1367 - DNA, 48 bp, Artificial Sequence
  Synthetic
tcccagtcaccttcatgtttaattttgagtttgaagatgaaaaacttg

SEQ ID NO: 1368 - DNA, 50 bp, Artificial Sequence
  Synthetic
gcatagtcaccatcaagtataccagtactcaaacaattggataacaactg

SEQ ID NO: 1369 - DNA, 43 bp, Artificial Sequence
  Synthetic
agtgggcgtacaaaacaaaacaaaatgtagttgtaccagtggt

SEQ ID NO: 1370 - DNA, 48 bp, Artificial Sequence
  Synthetic
gcgttcaacttctctttaacaacaaaagttgaaatatctgttacacca

SEQ ID NO: 1371 - DNA, 47 bp, Artificial Sequence
  Synthetic
tggttctattttaggttgctcaactaaggttaaggattttgtgtctg

SEQ ID NO: 1372 - DNA, 44 bp, Artificial Sequence
  Synthetic
acgtgtgcatcgttgaacattagttctgttgttgtctacatgtg

SEQ ID NO: 1373 - DNA, 47 bp, Artificial Sequence
  Synthetic
cgacccaatcaacatctattgcttttaaggacaaagatctttctggt

SEQ ID NO: 1374 - DNA, 43 bp, Artificial Sequence
  Synthetic
cctctaacacttctaacacgtgaattgtgctagtgtcaaacgt

SEQ ID NO: 1375 - DNA, 45 bp, Artificial Sequence
  Synthetic
agctgctgacgcttttaagttatgttaaaataatggccaaagcac

SEQ ID NO: 1376 - DNA, 47 bp, Artificial Sequence
  Synthetic
tggctaaattgacttaactcttggttcaaggatgattactgtgatgg

SEQ ID NO: 1377 - DNA, 44 bp, Artificial Sequence
  Synthetic
gggaatctcttaagtctagcactcttgtgctttttggttgtgaa

SEQ ID NO: 1378 - DNA, 44 bp, Artificial Sequence
  Synthetic
aacgatgtgcattagaaatagcacttatgtctttagccgagtgc

SEQ ID NO: 1379 - DNA, 47 bp, Artificial Sequence
  Synthetic
gcgtgacagcttggttttcattacgcaagtatattgtaaaaactagc

SEQ ID NO: 1380 - DNA, 46 bp, Artificial Sequence
  Synthetic
gccagcgacagtattaacaatttcaggcttcacacctttaaacaag

SEQ ID NO: 1381 - DNA, 41 bp, Artificial Sequence
  Synthetic
attcacctacgcggcagtatcaaggctttggttttagaaca

SEQ ID NO: 1382 - DNA, 50 bp, Artificial Sequence
  Synthetic
gcaattaaatatgcagcacaccaaaattgtatttctttgctactagaagc

SEQ ID NO: 1383 - DNA, 47 bp, Artificial Sequence
  Synthetic
ccagcctgtaatgtagaaccataaccttttcgcgtgatcataatgac

SEQ ID NO: 1384 - DNA, 48 bp, Artificial Sequence
  Synthetic
ctaaaagaatgtctaggtgtgtgcatgcatggagtaactcttaaaatt

SEQ ID NO: 1385 - DNA, 46 bp, Artificial Sequence
  Synthetic
gcaaccacattaactgttaacatctggttttgaagaccaacctaat

SEQ ID NO: 1386 - DNA, 47 bp, Artificial Sequence
  Synthetic
acccaaatagtggtggtataaacaaaatccataagcttatttgctgg

SEQ ID NO: 1387 - DNA, 44 bp, Artificial Sequence
  Synthetic
accaatgtgtacaacgctctttaatttgtctttttgttgcactg

SEQ ID NO: 1388 - DNA, 48 bp, Artificial Sequence
  Synthetic
ggctggactaacacagaaatcataagctgtatgtactatggtttgttg

SEQ ID NO: 1389 - DNA, 44 bp, Artificial Sequence
  Synthetic
gcccactcctttgaattagaagctacaaacgtcgttctaatggg

SEQ ID NO: 1390 - DNA, 47 bp, Artificial Sequence
  Synthetic
gcttgttcagccattctgttaatttttgaagaaggctatgaatgttg

SEQ ID NO: 1391 - DNA, 48 bp, Artificial Sequence
  Synthetic
tgcacattcttaccatcattatcctaaatgatggtagatggttttgtg

SEQ ID NO: 1392 - DNA, 43 bp, Artificial Sequence
  Synthetic
ccagagtcatgttcccatttaacatggtggacgtgcattcatg

SEQ ID NO: 1393 - DNA, 43 bp, Artificial Sequence
  Synthetic
acatctttacacaattgccaacaggcagctgcagcctatcttg

SEQ ID NO: 1394 - DNA, 46 bp, Artificial Sequence
  Synthetic
cccggactcgtttaaataactgtttaatcatggctgtacatgtgac

SEQ ID NO: 1395 - DNA, 48 bp, Artificial Sequence
  Synthetic
cagtctttttcatcaaagttacgcatatggtaatgttagtagacagga

SEQ ID NO: 1396 - DNA, 46 bp, Artificial Sequence
  Synthetic
tgacgtgcagtagggtattcctcttaatgggaatttctatgacttc

SEQ ID NO: 1397 - DNA, 44 bp, Artificial Sequence
  Synthetic
cgggtacaccatcaataaacacttttcttcgcaaccacaattcc

SEQ ID NO: 1398 - DNA, 48 bp, Artificial Sequence
  Synthetic
cccctgagaacgtaagaagtcataagctttgagtacaggattaacatc

SEQ ID NO: 1399 - DNA, 45 bp, Artificial Sequence
  Synthetic
aagagacgccacccactgtatgactcagttaaatcttaaatacgc

SEQ ID NO: 1400 - DNA, 48 bp, Artificial Sequence
  Synthetic
caatgtaaccaagtccagcataagtgcaaaagcatttttctatgatga

SEQ ID NO: 1401 - DNA, 44 bp, Artificial Sequence
  Synthetic
ggtaggcatctatagccagagaaacatcactaagactgatgctg

SEQ ID NO: 1402 - DNA, 45 bp, Artificial Sequence
  Synthetic
gcagaacttttgtacaaaccaaagaaccacaaaccacatctttca

SEQ ID NO: 1403 - DNA, 48 bp, Artificial Sequence
  Synthetic
accgtaatctactttctcaaacacacatgcttccaaattacaaaagac

SEQ ID NO: 1404 - DNA, 39 bp, Artificial Sequence
  Synthetic
tcgctccagggtaatacacactcctcctggtagtggaaa

SEQ ID NO: 1405 - DNA, 47 bp, Artificial Sequence
  Synthetic
tgttgaggatcaccaacatatacaatctatgtgcactaactatgact

SEQ ID NO: 1406 - DNA, 50 bp, Artificial Sequence
  Synthetic
cctggcagctacataattttgactaagcgatttatacataaaaactccac

SEQ ID NO: 1407 - DNA, 44 bp, Artificial Sequence
  Synthetic
agacaatgacaaataagtagtggcagtttaaggattgtgcacgt

SEQ ID NO: 1408 - DNA, 41 bp, Artificial Sequence
  Synthetic
tgccaacattgtcacctgtgatcatgtcagaggttggttag

SEQ ID NO: 1409 - DNA, 43 bp, Artificial Sequence
  Synthetic
gctccaatcttaacaaaataacgcaggtgtttgtactttgggc

SEQ ID NO: 1410 - DNA, 48 bp, Artificial Sequence
  Synthetic
gcccttgtttatggcattttcattagtatgactgctttgttaagaatg

SEQ ID NO: 1411 - DNA, 44 bp, Artificial Sequence
  Synthetic
cccaccatttacaccttcaaggtgaattctcaattgtttgcagg

SEQ ID NO: 1412 - DNA, 46 bp, Artificial Sequence
  Synthetic
tctgtgaatgtctgccacaaattataacatttttactcaagctggt

SEQ ID NO: 1413 - DNA, 41 bp, Artificial Sequence
  Synthetic
aagcttgtcaagggacgctcttgtcgccacatataagtttg

SEQ ID NO: 1414 - DNA, 47 bp, Artificial Sequence
  Synthetic
cgaccttgggtataaaaaccatcatttaactggtttgtttacgtacg

SEQ ID NO: 1415 - DNA, 47 bp, Artificial Sequence
  Synthetic
caacagtcaaatccaaagacttcaatcctagttctaagactgtttgt

SEQ ID NO: 1416 - DNA, 50 bp, Artificial Sequence
  Synthetic
gcacccaagtgtaacactctcatattgtgtcaatattttaacagtaccac

SEQ ID NO: 1417 - DNA, 48 bp, Artificial Sequence
  Synthetic
cgccaaaatacataatttgcgtgtagttgtcggaattaactatcttgg

SEQ ID NO: 1418 - DNA, 44 bp, Artificial Sequence
  Synthetic
cgttgcaaacagagtaactagtgtttgccttgttgcatattgct

SEQ ID NO: 1419 - DNA, 45 bp, Artificial Sequence
  Synthetic
acgtagtttcattgccaatagtagtgatgctcacataccatttgg

SEQ ID NO: 1420 - DNA, 45 bp, Artificial Sequence
  Synthetic
agcgacacaatagacacaggtaagatggtttttattctacaagcc

SEQ ID NO: 1421 - DNA, 50 bp, Artificial Sequence
  Synthetic
tgaagttgatgtgtacgtaattccaaatatttatgatgtatctggtgtgg

SEQ ID NO: 1422 - DNA, 50 bp, Artificial Sequence
  Synthetic
gaaacattacgtggttgaacagcaagttttaacttattctagttttggcg

SEQ ID NO: 1423 - DNA, 45 bp, Artificial Sequence
  Synthetic
gctaaggttgtagtcaccaaaactactgcagatgttagtgagatg

SEQ ID NO: 1424 - DNA, 47 bp, Artificial Sequence
  Synthetic
tgcctgaattgctaatgaaaatggtttctttaattggtggaattgct

SEQ ID NO: 1425 - DNA, 47 bp, Artificial Sequence
  Synthetic
ccaatctaccagtaatcagcctatctctatgacagacttgacactat

SEQ ID NO: 1426 - DNA, 43 bp, Artificial Sequence
  Synthetic
tgccttctttgtaaagagcaagattggttgtgcgttgatggta

SEQ ID NO: 1427 - DNA, 47 bp, Artificial Sequence
  Synthetic
gtgctaatttcactggtcaaattcatacaaattgccaaattacactg

SEQ ID NO: 1428 - DNA, 44 bp, Artificial Sequence
  Synthetic
tgtggatcttttcaacgtcgtaatggcttctttagttgttttgc

SEQ ID NO: 1429 - DNA, 49 bp, Artificial Sequence
  Synthetic
aaaattacagcaatcaaagttgcgtttctaatccttttcgtttatgtgc

SEQ ID NO: 1430 - DNA, 42 bp, Artificial Sequence
  Synthetic
atcactataagcaccacacaccaagctagtggatgatcatgc

SEQ ID NO: 1431 - DNA, 41 bp, Artificial Sequence
  Synthetic
agcccaggtgtcaaagattgattgaagatgcttgtactgtg

SEQ ID NO: 1432 - DNA, 45 bp, Artificial Sequence
  Synthetic
acgtagaaaacccagcctgtgtaatttatagtagagtcggaaggt

SEQ ID NO: 1433 - DNA, 46 bp, Artificial Sequence
  Synthetic
ttctgaaacgtttttgaacattccatacccatcaacaagaaagaca

SEQ ID NO: 1434 - DNA, 43 bp, Artificial Sequence
  Synthetic
acctaaagatttaagagccgcagggaatccttcaagtgacaga

SEQ ID NO: 1435 - DNA, 43 bp, Artificial Sequence
  Synthetic
ggccaaaacattgtgtgacattagaaaatgcaaaagccacggt

SEQ ID NO: 1436 - DNA, 45 bp, Artificial Sequence
  Synthetic
gagatgggttgaattctagtgcaattcactagagaaatgcaacaa

SEQ ID NO: 1437 - DNA, 47 bp, Artificial Sequence
  Synthetic
accactggcttaccattgtgtattcagagctgcttttaattaacatg

SEQ ID NO: 1438 - DNA, 40 bp, Artificial Sequence
  Synthetic
ccaggtgtggcaaatggacactcatgtcctgtttctgtgt

SEQ ID NO: 1439 - DNA, 40 bp, Artificial Sequence
  Synthetic
agaaacatctgtcccatcgctgcgatgagtgtctagactc

SEQ ID NO: 1440 - DNA, 42 bp, Artificial Sequence
  Synthetic
gcgatgctaccttttccaccctaaaagacggctgtttgaggg

SEQ ID NO: 1441 - DNA, 43 bp, Artificial Sequence
  Synthetic
ggcattacaccctctgtaaagctaaccgcggcataaaagtgtt

SEQ ID NO: 1442 - DNA, 47 bp, Artificial Sequence
  Synthetic
ggcgcatttcgtatcttttatacatgcatggctaaaaagtaacaatc

SEQ ID NO: 1443 - DNA, 42 bp, Artificial Sequence
  Synthetic
tccacttgtgcaccacctttagtcatgaactgtatacaacac

SEQ ID NO: 1444 - DNA, 45 bp, Artificial Sequence
  Synthetic
gcagaagtgtcagaagcagattctagaaagaaaacatagatcgcg

SEQ ID NO: 1445 - DNA, 49 bp, Artificial Sequence
  Synthetic
tcagctaatgtggtttgttctacttatatatatagacattgtgtggggt

SEQ ID NO: 1446 - DNA, 41 bp, Artificial Sequence
  Synthetic
cgtgtcgggggttaccacatctcttaggccaagtgtggtgg

SEQ ID NO: 1447 - DNA, 43 bp, Artificial Sequence
  Synthetic
acagaaatatatgatggggtggcatcacttccacgcctaaacg

SEQ ID NO: 1448 - DNA, 40 bp, Artificial Sequence
  Synthetic
tgacgtgggcggtttaagaagttccaaagggcaagggacc

SEQ ID NO: 1449 - DNA, 43 bp, Artificial Sequence
  Synthetic
agaaacaccctgaaggcctgttagaagatacttatgctgagga

SEQ ID NO: 1450 - DNA, 42 bp, Artificial Sequence
  Synthetic
ggtaaccacagtgacatctgaaacttggtacgtaaacgcaaa

SEQ ID NO: 1451 - DNA, 41 bp, Artificial Sequence
  Synthetic
ccaacgcaagcttgttaggatatctgggaatcagtacagag

SEQ ID NO: 1452 - DNA, 42 bp, Artificial Sequence
  Synthetic
gccatcccgtgtaaaaaagtgactgccatgtttttctttggt

SEQ ID NO: 1453 - DNA, 45 bp, Artificial Sequence
  Synthetic
ggggtacaaagcctaactgctctcatattaatgtaatggatccag

SEQ ID NO: 1454 - DNA, 36 bp, Artificial Sequence
  Synthetic
tgcccatctccacgcgaaggtccgcggaaatccagc

SEQ ID NO: 1455 - DNA, 41 bp, Artificial Sequence
  Synthetic
tgcttgtgaggcatgactccaggcatggacatctctccgtc

SEQ ID NO: 1456 - DNA, 39 bp, Artificial Sequence
  Synthetic
gcgttcagcagcgcctcagagtgtcgttggatctgaggg

SEQ ID NO: 1457 - DNA, 38 bp, Artificial Sequence
  Synthetic
ccaccggcatagtgatggtcacgcctggtgacctgcct

SEQ ID NO: 1458 - DNA, 41 bp, Artificial Sequence
  Synthetic
gccgtgctgcacctcaaacattaacatgtacccggcagtcc

SEQ ID NO: 1459 - DNA, 37 bp, Artificial Sequence
  Synthetic
acaaggcaggacgcagcccaacattagcatcccggcg

SEQ ID NO: 1460 - DNA, 42 bp, Artificial Sequence
  Synthetic
ctacctgaactaagactgggtgtaccatccttttgccaatca

SEQ ID NO: 1461 - DNA, 42 bp, Artificial Sequence
  Synthetic
cgaggcaggcttacatgggagtccaggggggactttatgtga

SEQ ID NO: 1462 - DNA, 35 bp, Artificial Sequence
  Synthetic
cgggttggtccagggccttgtcgctgactccgcca

SEQ ID NO: 1463 - DNA, 39 bp, Artificial Sequence
  Synthetic
ctcgtctgggttcttggccccagctcctaagaaggcacc

SEQ ID NO: 1464 - DNA, 36 bp, Artificial Sequence
  Synthetic
aagaggcccctctccgcgagaccctaggcgtcccct

SEQ ID NO: 1465 - DNA, 39 bp, Artificial Sequence
  Synthetic
cctctggtaggactgggcgacccacacacccacccgtct

SEQ ID NO: 1466 - DNA, 39 bp, Artificial Sequence
  Synthetic
cgtaaacgcgctggactgagaaaaggtcagggcccaagg

SEQ ID NO: 1467 - DNA, 39 bp, Artificial Sequence
  Synthetic
gccttcttaggagctgtccgagacacccaggcacacact

SEQ ID NO: 1468 - DNA, 42 bp, Artificial Sequence
  Synthetic
gagttgagctgcctaccatgctccaaaattggtgccttgctc

SEQ ID NO: 1469 - DNA, 38 bp, Artificial Sequence
  Synthetic
cctcgtcttcggtctcagcttcacacgttagggggcgc

SEQ ID NO: 1470 - DNA, 38 bp, Artificial Sequence
  Synthetic
aggggctggtctgtgacctgttgtcggaggtggagagg

SEQ ID NO: 1471 - DNA, 38 bp, Artificial Sequence
  Synthetic
agtccaggcccgggacataaactctaggcctgtggagc

SEQ ID NO: 1472 - DNA, 38 bp, Artificial Sequence
  Synthetic
agagcccagaccggtctccgctccagggaatctttggg

SEQ ID NO: 1473 - DNA, 38 bp, Artificial Sequence
  Synthetic
gcaacgtccaggagctgttctctccccgctgaccagtc

SEQ ID NO: 1474 - DNA, 38 bp, Artificial Sequence
  Synthetic
tcgtggtggaggctgccaggcagcttgtccttgaggag

SEQ ID NO: 1475 - DNA, 35 bp, Artificial Sequence
  Synthetic
cacgttggaccccaagcggtcgggagaggcgcctt

SEQ ID NO: 1476 - DNA, 35 bp, Artificial Sequence
  Synthetic
ggcggagagaatggaggccagagggccggtctcga

SEQ ID NO: 1477 - DNA, 34 bp, Artificial Sequence
  Synthetic
aatgcggccctgcacgtggccgaggccaccttgt

SEQ ID NO: 1478 - DNA, 39 bp, Artificial Sequence
  Synthetic
aaagctggaagcgcctcctatccctgttgtctggccacg

SEQ ID NO: 1479 - DNA, 42 bp, Artificial Sequence
  Synthetic
gccctcctttggggatgatgcatctaggtcagacaggtagcg

SEQ ID NO: 1480 - DNA, 37 bp, Artificial Sequence
  Synthetic
acccgtgggacaaacgcccgagaatggccgcgagttt

SEQ ID NO: 1481 - DNA, 37 bp, Artificial Sequence
  Synthetic
tccccccgccactactccactggatgccctccacgac

SEQ ID NO: 1482 - DNA, 36 bp, Artificial Sequence
  Synthetic
ccgctttctggtctcgggtgagctgcccccgtcaag

SEQ ID NO: 1483 - DNA, 38 bp, Artificial Sequence
  Synthetic
cggccgccttcatcgagttcagctcgttggagaggacc

SEQ ID NO: 1484 - DNA, 41 bp, Artificial Sequence
  Synthetic
gcttgaagaagagctcggggacgagaaccacgagaggtgcc

SEQ ID NO: 1485 - DNA, 42 bp, Artificial Sequence
  Synthetic
acggcgcagttgacgatagagagacagcgggcaagttttgtg

SEQ ID NO: 1486 - DNA, 35 bp, Artificial Sequence
  Synthetic
cgggaggcagatgttggccgtgctgcagccctcga

SEQ ID NO: 1487 - DNA, 37 bp, Artificial Sequence
  Synthetic
agacaacgtgggcctcaacggccttcactggccctgt

SEQ ID NO: 1488 - DNA, 39 bp, Artificial Sequence
  Synthetic
cgagggtgtctctggccttgccacctccgccacctccta

SEQ ID NO: 1489 - DNA, 41 bp, Artificial Sequence
  Synthetic
ctcatgagcaccctggcaacaacgtgacatggagaaactgg

SEQ ID NO: 1490 - DNA, 35 bp, Artificial Sequence
  Synthetic
aatccgcatggagcccccgccaggcccgcatgagt

SEQ ID NO: 1491 - DNA, 34 bp, Artificial Sequence
  Synthetic
tccaccacgtggcgggttcagccgcttcttgggc

SEQ ID NO: 1492 - DNA, 40 bp, Artificial Sequence
  Synthetic
ccttcagatatgccaccccccaggggtactgggggtggtt

SEQ ID NO: 1493 - DNA, 39 bp, Artificial Sequence
  Synthetic
cccgagggtcatgggctcatcaacatgagacgtgaccgg

SEQ ID NO: 1494 - DNA, 37 bp, Artificial Sequence
  Synthetic
tcagtcagggaagccgccgcacctggcttctgaccgg

SEQ ID NO: 1495 - DNA, 40 bp, Artificial Sequence
  Synthetic
cagcagcgtgttcacaaacttatagcctcagccatctacc

SEQ ID NO: 1496 - DNA, 38 bp, Artificial Sequence
  Synthetic
gcctgtgctaccggacacggagcagctcagggaatggc

SEQ ID NO: 1497 - DNA, 35 bp, Artificial Sequence
  Synthetic
aacggggtggatttggcgtgcattagacgcgcgcg

SEQ ID NO: 1498 - DNA, 41 bp, Artificial Sequence
  Synthetic
caccctcctcttgaacaggcctttgtcaatccatggcaggc

SEQ ID NO: 1499 - DNA, 39 bp, Artificial Sequence
  Synthetic
ggacattgtccccccctgactgtatgggttaccgcacgc

SEQ ID NO: 1500 - DNA, 39 bp, Artificial Sequence
  Synthetic
acttggctgaaccaccggccaacttagcagttcggcacc

SEQ ID NO: 1501 - DNA, 36 bp, Artificial Sequence
  Synthetic
ctgaagcccggtgcccaaacgagtcactgctgctgg

SEQ ID NO: 1502 - DNA, 42 bp, Artificial Sequence
  Synthetic
agccagatgttcaggaaccaaagcatcgcttaagtatgagtg

SEQ ID NO: 1503 - DNA, 39 bp, Artificial Sequence
  Synthetic
gggaacagcaggggaggtccagggaatgaaagctcacgg

SEQ ID NO: 1504 - DNA, 40 bp, Artificial Sequence
  Synthetic
gctctcgctgtagtcagactcgtgagggcagtgatagcga

SEQ ID NO: 1505 - DNA, 35 bp, Artificial Sequence
  Synthetic
ttggtgctgtgcccctgccgcagttcgcccagctc

SEQ ID NO: 1506 - DNA, 35 bp, Artificial Sequence
  Synthetic
catgcaccaggggcagctgcgttccagcttcgtcc

SEQ ID NO: 1507 - DNA, 35 bp, Artificial Sequence
  Synthetic
gcagcgggtcagcagtcatcgccgctggagttcct

SEQ ID NO: 1508 - DNA, 40 bp, Artificial Sequence
  Synthetic
gggaagagcacatgcagcctgaggagcgacgagtatgtgg

SEQ ID NO: 1509 - DNA, 39 bp, Artificial Sequence
  Synthetic
gctgatggtgcttgccggatgcgaaaatactgccccgcg

SEQ ID NO: 1510 - DNA, 39 bp, Artificial Sequence
  Synthetic
atccgggccttgacgtgggttctacaatgccagggggga

SEQ ID NO: 1511 - DNA, 38 bp, Artificial Sequence
  Synthetic
gctctacgccttcctccgcaggcttggtgcctctgtgg

SEQ ID NO: 1512 - DNA, 39 bp, Artificial Sequence
  Synthetic
ggaccaacaacccccacctgtggcatgtctgttccccct

SEQ ID NO: 1513 - DNA, 46 bp, Artificial Sequence
  Synthetic
gtctcagttgagcattcaccttttaactggaccctttaaaacatcc

SEQ ID NO: 1514 - DNA, 42 bp, Artificial Sequence
  Synthetic
tgccggactctgtcatccgtaaattgtctgcgtacgctttcc

SEQ ID NO: 1515 - DNA, 40 bp, Artificial Sequence
  Synthetic
ccgatccgacccgctctactttgacagcacctccaacagc

SEQ ID NO: 1516 - DNA, 42 bp, Artificial Sequence
  Synthetic
gcaaaaggggccctattctgctaatgcctctatgttggcaca

SEQ ID NO: 1517 - DNA, 36 bp, Artificial Sequence
  Synthetic
gcacagtgcggctcaggctgcaccgagctgatgggt

SEQ ID NO: 1518 - DNA, 39 bp, Artificial Sequence
  Synthetic
caccgacaacgttctgcgccaatctggttgtcggcctcc

SEQ ID NO: 1519 - DNA, 38 bp, Artificial Sequence
  Synthetic
tcccttcgcaggagggccacagacggatgtcaggtcgg

SEQ ID NO: 1520 - DNA, 38 bp, Artificial Sequence
  Synthetic
tcccgatggcaggtgcacgctcaagtgtaagcagcccg

SEQ ID NO: 1521 - DNA, 39 bp, Artificial Sequence
  Synthetic
ggggctccggtgcctttttcgtgctctcatccctgcaac

SEQ ID NO: 1522 - DNA, 41 bp, Artificial Sequence
  Synthetic
gcacacgttgttttggcaataaaccagaaagatacccagag

SEQ ID NO: 1523 - DNA, 41 bp, Artificial Sequence
  Synthetic
cggccgtttcaaatgctgtggacacgcatccctgtcttctc

SEQ ID NO: 1524 - DNA, 34 bp, Artificial Sequence
  Synthetic
tgctgtccaccgccctgtggctagcccccgcaaa

SEQ ID NO: 1525 - DNA, 39 bp, Artificial Sequence
  Synthetic
cggggtttacagtggcctcattgaaaagggggtggcggt

SEQ ID NO: 1526 - DNA, 39 bp, Artificial Sequence
  Synthetic
gctgaagcggctaagtgggaggtgtcttgggcatcatcc

SEQ ID NO: 1527 - DNA, 35 bp, Artificial Sequence
  Synthetic
tcccgctctgccagctcgagccccaagccttcgca

SEQ ID NO: 1528 - DNA, 42 bp, Artificial Sequence
  Synthetic
tgctcttcaaccttggcagtgtgacaaggcagtagaggacac

SEQ ID NO: 1529 - DNA, 39 bp, Artificial Sequence
  Synthetic
aggcaggcgtccttgggtgcaggcaccgtctgtatacgt

SEQ ID NO: 1530 - DNA, 38 bp, Artificial Sequence
  Synthetic
tggcgccctaagaccacctggccaccacagcacaagtg

SEQ ID NO: 1531 - DNA, 36 bp, Artificial Sequence
  Synthetic
gcagcacacgcccccattccttccccgggaatgtgt

SEQ ID NO: 1532 - DNA, 40 bp, Artificial Sequence
  Synthetic
aaggctggcaaagatccccagtctcctaggaatgccgagc

SEQ ID NO: 1533 - DNA, 39 bp, Artificial Sequence
  Synthetic
tcagcctacaagagcacccagagttgcgctcgacgaact

SEQ ID NO: 1534 - DNA, 38 bp, Artificial Sequence
  Synthetic
gccgagaagaccttctcctgcccgtcagcacccccaca

SEQ ID NO: 1535 - DNA, 40 bp, Artificial Sequence
  Synthetic
gccatcaagtgcacgtgcaacggggaaagaggccgttggc

SEQ ID NO: 1536 - DNA, 38 bp, Artificial Sequence
  Synthetic
gccgggacaagctcagcctccccagtaggtgcctggct

SEQ ID NO: 1537 - DNA, 39 bp, Artificial Sequence
  Synthetic
aggaggccgggcgctataggaccccctctatgtcttcgc

SEQ ID NO: 1538 - DNA, 40 bp, Artificial Sequence
  Synthetic
gggacgtggtctactgggagcgaaggcccgtctgtagagg

SEQ ID NO: 1539 - DNA, 38 bp, Artificial Sequence
  Synthetic
cgctgtgtgggcgagctgatgtcccctctgccgtggaa

SEQ ID NO: 1540 - DNA, 38 bp, Artificial Sequence
  Synthetic
agctagagaaggagccccatgggccgcatccacgtcct

SEQ ID NO: 1541 - DNA, 41 bp, Artificial Sequence
  Synthetic
tgtggctgcgttacaccgatatgcaaagatctgcgtggaca

SEQ ID NO: 1542 - DNA, 38 bp, Artificial Sequence
  Synthetic
ccctggccacctaccctcttagacctgtggcccgcgta

SEQ ID NO: 1543 - DNA, 40 bp, Artificial Sequence
  Synthetic
tcaaggcctccctgaggaaggacgatgtcggctgtcctgc

SEQ ID NO: 1544 - DNA, 37 bp, Artificial Sequence
  Synthetic
cctcccctacggttaccccaccgggaggccgtgcttt

SEQ ID NO: 1545 - DNA, 43 bp, Artificial Sequence
  Synthetic
cgagtcagccatggaagaagaaagagcggtctgtataaaaacg

SEQ ID NO: 1546 - DNA, 50 bp, Artificial Sequence
  Synthetic
aggtagtactaaagcatgcaaatctagacaaatatgattggaaatagacc

SEQ ID NO: 1547 - DNA, 48 bp, Artificial Sequence
  Synthetic
cgtttgtactggagaaccaactaacgttagtgcaagattccaataacg

SEQ ID NO: 1548 - DNA, 48 bp, Artificial Sequence
  Synthetic
tgaaagaagaaaatggcaactggtgactgtactgaattccaaatgatt

SEQ ID NO: 1549 - DNA, 49 bp, Artificial Sequence
  Synthetic
ggtctatttgtgtggcgagttttcagtttatgaaataactaatgccacc

SEQ ID NO: 1550 - DNA, 43 bp, Artificial Sequence
  Synthetic
accatatctttgggcatctgatgtattttgaggatgcaaacgg

SEQ ID NO: 1551 - DNA, 40 bp, Artificial Sequence
  Synthetic
cgaaaacggtcgtgtaggtcttaacaattgcaccgactcg

SEQ ID NO: 1552 - DNA, 49 bp, Artificial Sequence
  Synthetic
aggttggggttcttcaatttcaaattggagaagaaattcctttagatcc

SEQ ID NO: 1553 - DNA, 44 bp, Artificial Sequence
  Synthetic
tgcctccatgaaagtaatatccagtatcttccacctcaaaagcc

SEQ ID NO: 1554 - DNA, 48 bp, Artificial Sequence
  Synthetic
gcatttccaaatccaaattcacacagagattgtcctcctattgaatta

SEQ ID NO: 1555 - DNA, 44 bp, Artificial Sequence
  Synthetic
tgcaggacattttgtagctaatgatgggaacttgcctttgtacc

SEQ ID NO: 1556 - DNA, 50 bp, Artificial Sequence
  Synthetic
ggtatgttggcttggctttatactccacgtatattttatttttcaaccgc

SEQ ID NO: 1557 - DNA, 45 bp, Artificial Sequence
  Synthetic
cgcatggtagcctatacatattgtgctactggtcctgttatgtgc

SEQ ID NO: 1558 - DNA, 43 bp, Artificial Sequence
  Synthetic
gtcgatgaaatctcctggataacatctgcttccagtgagatca

SEQ ID NO: 1559 - DNA, 43 bp, Artificial Sequence
  Synthetic
acttctttccctttcttgttcacatatttgctatggctgacgg

SEQ ID NO: 1560 - DNA, 43 bp, Artificial Sequence
  Synthetic
agcataccttggtgctattagatttttgctaaaacccggagac

SEQ ID NO: 1561 - DNA, 42 bp, Artificial Sequence
  Synthetic
aaccggcaatggctccaaatgttacaggactaaggaacattc

SEQ ID NO: 1562 - DNA, 50 bp, Artificial Sequence
  Synthetic
cccattgattccaatttcactccattgattatcccaaatattcagaagag

SEQ ID NO: 1563 - DNA, 39 bp, Artificial Sequence
  Synthetic
acgtgccaagacttaccgttacaaggttcgttggcagac

SEQ ID NO: 1564 - DNA, 44 bp, Artificial Sequence
  Synthetic
acaccaaatcctcctctgtcctgagctacttaattttgatcaca

SEQ ID NO: 1565 - DNA, 50 bp, Artificial Sequence
  Synthetic
cctttccagctgtttctgaccttattaagttattagacttagtggagaag

SEQ ID NO: 1566 - DNA, 45 bp, Artificial Sequence
  Synthetic
accagttgtatatcacccagcaaacgtgcttgctacaaatttagg

SEQ ID NO: 1567 - DNA, 41 bp, Artificial Sequence
  Synthetic
ccctgtacagcatctccatcatatttgacgaagggacagac

SEQ ID NO: 1568 - DNA, 43 bp, Artificial Sequence
  Synthetic
ctgttgttggtggattggccaaatgaagctgaagatctttctg

SEQ ID NO: 1569 - DNA, 47 bp, Artificial Sequence
  Synthetic
tggtggcatataatgtagccaaattgaatgatgacttaattgaaagc

SEQ ID NO: 1570 - DNA, 45 bp, Artificial Sequence
  Synthetic
agtcaaattgtgtagcatttgcagtcctgaatggatacttacaca

SEQ ID NO: 1571 - DNA, 46 bp, Artificial Sequence
  Synthetic
ggtcagtaagttcaaattgtggtttcagcagagttaaatcctttgc

SEQ ID NO: 1572 - DNA, 44 bp, Artificial Sequence
  Synthetic
ccccaatcgcataactccatttagactttaagacaagagcaaat

SEQ ID NO: 1573 - DNA, 38 bp, Artificial Sequence
  Synthetic
accccgacctggaaagggtgtcttcgccaccaactgga

SEQ ID NO: 1574 - DNA, 37 bp, Artificial Sequence
  Synthetic
ggtgggggtagtggagtctgcaaaggggaggggagcg

SEQ ID NO: 1575 - DNA, 39 bp, Artificial Sequence
  Synthetic
gcacttaagcacattggcgtccacgattactggctgagg

SEQ ID NO: 1576 - DNA, 48 bp, Artificial Sequence
  Synthetic
cgaaccatgttagttagtatgggttatgatctgtaagctttactaacg

SEQ ID NO: 1577 - DNA, 40 bp, Artificial Sequence
  Synthetic
cctggcccttcccctaatggaataagtacaggccgtggca

SEQ ID NO: 1578 - DNA, 47 bp, Artificial Sequence
  Synthetic
accttctgttacaactggagtatctagaatcaattgctgagatacac

SEQ ID NO: 1579 - DNA, 49 bp, Artificial Sequence
  Synthetic
ggcgttgtacatctaaaaattgccttgaggtcacacaaatatttgaaag

SEQ ID NO: 1580 - DNA, 42 bp, Artificial Sequence
  Synthetic
actttcaactgggccttgtactgaaatgcaattattggggga

SEQ ID NO: 1581 - DNA, 44 bp, Artificial Sequence
  Synthetic
gcaaacggtcactaattgcatgatacagtggcgagagttcaaag

SEQ ID NO: 1582 - DNA, 40 bp, Artificial Sequence
  Synthetic
acctgatgttccaacccctaaagtttgggcctgtagaggt

SEQ ID NO: 1583 - DNA, 47 bp, Artificial Sequence
  Synthetic
tgctggcaaaaagaaattatgatccttatgttagaggaggttcagtt

SEQ ID NO: 1584 - DNA, 43 bp, Artificial Sequence
  Synthetic
aggggccgttttttatcgaaattagatcactgaaagccagaga

SEQ ID NO: 1585 - DNA, 40 bp, Artificial Sequence
  Synthetic
atgcacagctagcgccatatctttcttctagcatggacca

SEQ ID NO: 1586 - DNA, 42 bp, Artificial Sequence
  Synthetic
tgttgggatcttctggcctattctcaagggcgttatattgga

SEQ ID NO: 1587 - DNA, 43 bp, Artificial Sequence
  Synthetic
gcttaatgccactgtatcgtttcaagcaagaagcttgtggatg

SEQ ID NO: 1588 - DNA, 42 bp, Artificial Sequence
  Synthetic
acacgttaacagtactcgattcctggcaggagaaatcccatc

SEQ ID NO: 1589 - DNA, 42 bp, Artificial Sequence
  Synthetic
cgttttgatttagcctcagtcttcatgggggttaaagggaga

SEQ ID NO: 1590 - DNA, 42 bp, Artificial Sequence
  Synthetic
gtgaaatggcgaactgtttgttcgcatggtatcaacagtggg

SEQ ID NO: 1591 - DNA, 43 bp, Artificial Sequence
  Synthetic
agaacggttaggattcgtttttcttgtgtagctgcttctggtg

SEQ ID NO: 1592 - DNA, 44 bp, Artificial Sequence
  Synthetic
actcggagacaagtgatataatggacagttagtctggacggatg

SEQ ID NO: 1593 - DNA, 49 bp, Artificial Sequence
  Synthetic
ccatctttacatgagaaggcattccctaccttcctttagtaaagaatgt

SEQ ID NO: 1594 - DNA, 42 bp, Artificial Sequence
  Synthetic
aaccatgatccaccatgttcaatattgggttgattggtttgg

SEQ ID NO: 1595 - DNA, 45 bp, Artificial Sequence
  Synthetic
cgcaccttgacaaatcctttagaaattctcaaaagggattgacgg

SEQ ID NO: 1596 - DNA, 44 bp, Artificial Sequence
  Synthetic
agcatcaactgatgagccagaatctgaagctaacagaacattgc

SEQ ID NO: 1597 - DNA, 41 bp, Artificial Sequence
  Synthetic
agacaaagagtatgcagcggtcatcgcaatcgtaagtatcc

SEQ ID NO: 1598 - DNA, 43 bp, Artificial Sequence
  Synthetic
tgttccatagtcccttgtcgatatcctctttgtgaacagtgtc

SEQ ID NO: 1599 - DNA, 44 bp, Artificial Sequence
  Synthetic
atcaccctctacaaaaagctcctatacagggtgttatgttttgc

SEQ ID NO: 1600 - DNA, 45 bp, Artificial Sequence
  Synthetic
cacagtatcgcaagttgaaggttaactttttggatatctgccttc

SEQ ID NO: 1601 - DNA, 45 bp, Artificial Sequence
  Synthetic
tttgcaggcctgtagtccctgaagaagataaaactaagaatcagg

SEQ ID NO: 1602 - DNA, 42 bp, Artificial Sequence
  Synthetic
cccccgaaaagctctatccatgggctcttttgttgagtttga

SEQ ID NO: 1603 - DNA, 45 bp, Artificial Sequence
  Synthetic
gccaaccattgcttatccgaaatcaatgttctgttatctccagat

SEQ ID NO: 1604 - DNA, 41 bp, Artificial Sequence
  Synthetic
cctttgctacctcttccatggaatgcggttttaaagatggc

SEQ ID NO: 1605 - DNA, 47 bp, Artificial Sequence
  Synthetic
ttttgctatccaatttcctgagtcttctgattgagggacttctatca

SEQ ID NO: 1606 - DNA, 46 bp, Artificial Sequence
  Synthetic
aaagcgttctagttgtgtgtgataagtttctcggaaatcacaaact

SEQ ID NO: 1607 - DNA, 43 bp, Artificial Sequence
  Synthetic
gttcgcatattggaagacggagctgaataggaattcctcgacc

SEQ ID NO: 1608 - DNA, 41 bp, Artificial Sequence
  Synthetic
aggtttaacaaaagccaaggaggcttcgccaagctttgagt

SEQ ID NO: 1609 - DNA, 46 bp, Artificial Sequence
  Synthetic
cggagtagagaaatcagcagactgcttcgcattcttattaccaatg

SEQ ID NO: 1610 - DNA, 42 bp, Artificial Sequence
  Synthetic
catgcaccaatagttacggtgttttacagtttgtggagggtt

SEQ ID NO: 1611 - DNA, 47 bp, Artificial Sequence
  Synthetic
gcttgtgtgtcttttgtctttttcataaacaatatgctcaatacggg

SEQ ID NO: 1612 - DNA, 42 bp, Artificial Sequence
  Synthetic
gtttcacctcctaagaagaaccgctttcggaacaacaactgc

SEQ ID NO: 1613 - DNA, 45 bp, Artificial Sequence
  Synthetic
catcctgttcagctttacgaaggaaagcctgtacagaatacaaga

SEQ ID NO: 1614 - DNA, 48 bp, Artificial Sequence
  Synthetic
ccttcggttatcggagtagttacaagtttaacagtagatcaactttcc

SEQ ID NO: 1615 - DNA, 44 bp, Artificial Sequence
  Synthetic
ggaagcagataatttagaggaagctcttgccctttatgtggtct

SEQ ID NO: 1616 - DNA, 49 bp, Artificial Sequence
  Synthetic
cctaagatagcgatcaaaggttgatcctacttaacctattttacagatg

SEQ ID NO: 1617 - DNA, 42 bp, Artificial Sequence
  Synthetic
gcaggtttagatgttgtgggttttggctatggcttttatggg

SEQ ID NO: 1618 - DNA, 44 bp, Artificial Sequence
  Synthetic
aatgttctaaaggggatgtggatttaagcactcctcctatcaca

SEQ ID NO: 1619 - DNA, 42 bp, Artificial Sequence
  Synthetic
ggagtggattcctcggttgttccaacaacattatactcccct

SEQ ID NO: 1620 - DNA, 44 bp, Artificial Sequence
  Synthetic
catgggtgatttcttctgggaattactgttgaagtacgtccctt

SEQ ID NO: 1621 - DNA, 43 bp, Artificial Sequence
  Synthetic
agaactgctgcctctaaaagatcaggctgataaatgttttcgg

SEQ ID NO: 1622 - DNA, 43 bp, Artificial Sequence
  Synthetic
ctggtaaaagaagggctgtttgatattgtcgcgaatagtcaca

SEQ ID NO: 1623 - DNA, 43 bp, Artificial Sequence
  Synthetic
ggctgcagaggctattgaagtttgattttctctactaagtcgt

SEQ ID NO: 1624 - DNA, 38 bp, Artificial Sequence
  Synthetic
agacgtcacaggtgtggtaagttatccccaggcatgac

SEQ ID NO: 1625 - DNA, 42 bp, Artificial Sequence
  Synthetic
gattgctcctcagaggtattggtagtttggcaagcaaacaac

SEQ ID NO: 1626 - DNA, 41 bp, Artificial Sequence
  Synthetic
tggtttcttgcccaagatctcacctcttacaaaccgcattt

SEQ ID NO: 1627 - DNA, 45 bp, Artificial Sequence
  Synthetic
ttcacagatcctccgtaaagaatgattgcttctctcttttccaaa

SEQ ID NO: 1628 - DNA, 42 bp, Artificial Sequence
  Synthetic
aggttatggaatcgcggttatcaggagcctgtgcagaatgtg

SEQ ID NO: 1629 - DNA, 42 bp, Artificial Sequence
  Synthetic
tggaatttctcgaggcgctctaaagtaacaggactatcccct

SEQ ID NO: 1630 - DNA, 43 bp, Artificial Sequence
  Synthetic
gaagtggatactgagacagaaagttaccggtactttgcaacac

SEQ ID NO: 1631 - DNA, 47 bp, Artificial Sequence
  Synthetic
ggtgcatattacgctgtccttcgaaacaagaagttctttttcaacac

SEQ ID NO: 1632 - DNA, 43 bp, Artificial Sequence
  Synthetic
tggtcaaagacgcaagctgtgaccttatctttgggatacagat

SEQ ID NO: 1633 - DNA, 40 bp, Artificial Sequence
  Synthetic
atgattttgttcgttggcggagagaaaacaggcaagccat

SEQ ID NO: 1634 - DNA, 45 bp, Artificial Sequence
  Synthetic
agctagcttcatggagtatgtctaccaacataaaactggagttct

SEQ ID NO: 1635 - DNA, 45 bp, Artificial Sequence
  Synthetic
gggaaaggggttttcaagaagaatatcattctctgtaacaacctc

SEQ ID NO: 1636 - DNA, 47 bp, Artificial Sequence
  Synthetic
tttcaggaatttctgtcggtggcggtcttaattccattaataagact

SEQ ID NO: 1637 - DNA, 39 bp, Artificial Sequence
  Synthetic
agaaggaagaccgcaaaggaagcagacactacatgccaa

SEQ ID NO: 1638 - DNA, 42 bp, Artificial Sequence
  Synthetic
catggtagtcgtaaaagaaagggattgttgtgtccttccgtt

SEQ ID NO: 1639 - DNA, 39 bp, Artificial Sequence
  Synthetic
tagaggcccaggaatggagacgtagcaaaaatctcccca

SEQ ID NO: 1640 - DNA, 41 bp, Artificial Sequence
  Synthetic
gctcagtatttagcagggcagtcttcccaaaagacttcaga

SEQ ID NO: 1641 - DNA, 42 bp, Artificial Sequence
  Synthetic
gttagcatggcaggagaatttcttaactgacaaaagctgccg

SEQ ID NO: 1642 - DNA, 42 bp, Artificial Sequence
  Synthetic
aggctgctaatatgtcttcacgttccgtagtggttcgggatt

SEQ ID NO: 1643 - DNA, 38 bp, Artificial Sequence
  Synthetic
tcagaaagggctgaaggcagaaacggtgcaactcgatc

SEQ ID NO: 1644 - DNA, 48 bp, Artificial Sequence
  Synthetic
agttgcacagaaataacagctcccaaaaataggattagaagaacttcc

SEQ ID NO: 1645 - DNA, 46 bp, Artificial Sequence
  Synthetic
tgctttcgagaggatacaaaggggctggattcacaatagtaaatgc

SEQ ID NO: 1646 - DNA, 41 bp, Artificial Sequence
  Synthetic
taaggggtccccagacatggcagaacacatcacttcagaag

SEQ ID NO: 1647 - DNA, 41 bp, Artificial Sequence
  Synthetic
tggctcagtcggttcttcagtaatccagactcttcctcatc

SEQ ID NO: 1648 - DNA, 40 bp, Artificial Sequence
  Synthetic
tctacggcgagcttgtttactaaggcagaaggatcttgtt

SEQ ID NO: 1649 - DNA, 44 bp, Artificial Sequence
  Synthetic
cttgaatttcgaaagaggatgttgccttgcttgcgttattttcg

SEQ ID NO: 1650 - DNA, 43 bp, Artificial Sequence
  Synthetic
ggttgtcagtaagatcgtcggacctttaattacagctgggatg

SEQ ID NO: 1651 - DNA, 43 bp, Artificial Sequence
  Synthetic
acaggattcttgctttggcagaatttcaacattgcgatcatca

SEQ ID NO: 1652 - DNA, 46 bp, Artificial Sequence
  Synthetic
cattgatcgttttgctagggatttcttaaacacgtacagaaagcaa

SEQ ID NO: 1653 - DNA, 41 bp, Artificial Sequence
  Synthetic
cacgagtgtttgagtgctaagtctgactgcgctatgaggat

SEQ ID NO: 1654 - DNA, 43 bp, Artificial Sequence
  Synthetic
gtaggggctcaaggacgaactcaaatcaatgatttccacttca

SEQ ID NO: 1655 - DNA, 42 bp, Artificial Sequence
  Synthetic
gattgtagagtgggatcagcaagttggacaataaaatgcgcg

SEQ ID NO: 1656 - DNA, 49 bp, Artificial Sequence
  Synthetic
cctacctggttgattatggagaaattaccgaatctctaataatggatca

SEQ ID NO: 1657 - DNA, 38 bp, Artificial Sequence
  Synthetic
aaagctcctttttcgtgcccgtgctgctatccccgata

SEQ ID NO: 1658 - DNA, 40 bp, Artificial Sequence
  Synthetic
tcccattctcttcacgaggtttatccaccatccctgcttc

SEQ ID NO: 1659 - DNA, 43 bp, Artificial Sequence
  Synthetic
tgttcaatgttcctttggagcagaaattcactgctttagcctg

SEQ ID NO: 1660 - DNA, 38 bp, Artificial Sequence
  Synthetic
cgtgcgtgctagaacttcttaaaacgacgaggacccta

SEQ ID NO: 1661 - DNA, 46 bp, Artificial Sequence
  Synthetic
gcatttgtacgttgatatcgagcatgtgctgcttgagaattcttac

SEQ ID NO: 1662 - DNA, 43 bp, Artificial Sequence
  Synthetic
gcatgcagggttgctatcaacgaaaactcgaatccaaactttc

SEQ ID NO: 1663 - DNA, 42 bp, Artificial Sequence
  Synthetic
tggtataagaacggtcgtgtgcgacgctgtagcataatcaat

SEQ ID NO: 1664 - DNA, 41 bp, Artificial Sequence
  Synthetic
gatggcgctattgcaaatgcaagaacgcaaagattttcacg

SEQ ID NO: 1665 - DNA, 44 bp, Artificial Sequence
  Synthetic
agaagaaaactccaatcaaaacgtggtgtgcccaatcatttcag

SEQ ID NO: 1666 - DNA, 42 bp, Artificial Sequence
  Synthetic
ggcagctcctcaattccgagatatgctgatcaaattttggct

SEQ ID NO: 1667 - DNA, 45 bp, Artificial Sequence
  Synthetic
gggaagcagaccagagaagaagaatccccttagaagttacttaaa

SEQ ID NO: 1668 - DNA, 42 bp, Artificial Sequence
  Synthetic
tccccagggaatttctttgcaaggattaaccagcaaatacac

SEQ ID NO: 1669 - DNA, 42 bp, Artificial Sequence
  Synthetic
gggaggtaaatcaagactccgatttcctgctttcatcatggg

SEQ ID NO: 1670 - DNA, 43 bp, Artificial Sequence
  Synthetic
atcgtagagtcttgtatcacctgaaaaattgggatagcgctct

SEQ ID NO: 1671 - DNA, 42 bp, Artificial Sequence
  Synthetic
ttacgctaaaaacgggcctattttgattaaccaaaagagcgc

SEQ ID NO: 1672 - DNA, 41 bp, Artificial Sequence
  Synthetic
tcatcaagctatcggcgatgtatagctttcgatgctcaacc

SEQ ID NO: 1673 - DNA, 41 bp, Artificial Sequence
  Synthetic
gcaagagcagcttctttgtctatcgcagaagaaaaattccc

SEQ ID NO: 1674 - DNA, 39 bp, Artificial Sequence
  Synthetic
ctccaggagttgcggatacaacctatgaagaagctcgtc

SEQ ID NO: 1675 - DNA, 45 bp, Artificial Sequence
  Synthetic
caatcaatgcagaattcgtcacaaaagactttaggagatcgtgtg

SEQ ID NO: 1676 - DNA, 47 bp, Artificial Sequence
  Synthetic
gctatcgaagtggattgccgaattatcctttatctaacagtctctct

SEQ ID NO: 1677 - DNA, 48 bp, Artificial Sequence
  Synthetic
cttcgtcaagggttcttgtgattgtctctttactattaggaattaacg

SEQ ID NO: 1678 - DNA, 42 bp, Artificial Sequence
  Synthetic
ttgcgcatggatgactgttagtcaatgaccttcctatgtctc

SEQ ID NO: 1679 - DNA, 44 bp, Artificial Sequence
  Synthetic
cgagcagcaagaaggaattaattgtcatcgacaagattccctcc

SEQ ID NO: 1680 - DNA, 41 bp, Artificial Sequence
  Synthetic
gctgtttcatctgcggaactttaaagcagtgaaaacttgcc

SEQ ID NO: 1681 - DNA, 45 bp, Artificial Sequence
  Synthetic
gagaagtctttattcaagccaaaggctttcaatcttcgggacaac

SEQ ID NO: 1682 - DNA, 39 bp, Artificial Sequence
  Synthetic
aacagaaagcctgagccagctcgtgcaagtatgttcaac

SEQ ID NO: 1683 - DNA, 48 bp, Artificial Sequence
  Synthetic
gtcctccgctgatgatattagaagacgtttagaaattctagaagatgc

SEQ ID NO: 1684 - DNA, 42 bp, Artificial Sequence
  Synthetic
cagcaaatggtgaatgctgcctaaaaattcgtctaactgctg

SEQ ID NO: 1685 - DNA, 41 bp, Artificial Sequence
  Synthetic
tgcgagtgttatatgagcacgaacttctacaatagcgtgca

SEQ ID NO: 1686 - DNA, 43 bp, Artificial Sequence
  Synthetic
tgtccatttatttggtcttggagtctcttgaacgcaacgagaa

SEQ ID NO: 1687 - DNA, 41 bp, Artificial Sequence
  Synthetic
cgcttcatcgataggcatagccaacaggaaaatggagaggt

SEQ ID NO: 1688 - DNA, 43 bp, Artificial Sequence
  Synthetic
tccaagaattagacaaaagatcgcaccatttgttcgcgagtca

SEQ ID NO: 1689 - DNA, 43 bp, Artificial Sequence
  Synthetic
caaccaccttgatgaaaaacaaagtttgtctcggacgttttgc

SEQ ID NO: 1690 - DNA, 46 bp, Artificial Sequence
  Synthetic
cgatgtagtattttgctcttgccttacatttctcgcatatgaacag

SEQ ID NO: 1691 - DNA, 44 bp, Artificial Sequence
  Synthetic
agctaatcactcacagcaccatctgtgcgatcaaaaatacgttt

SEQ ID NO: 1692 - DNA, 41 bp, Artificial Sequence
  Synthetic
taccgtcgtatgtcggctgaccattttcaccatttcacaga

SEQ ID NO: 1693 - DNA, 45 bp, Artificial Sequence
  Synthetic
ctttccgactgcagttgatcatttatcacagatacatcaagagct

SEQ ID NO: 1694 - DNA, 43 bp, Artificial Sequence
  Synthetic
gttgttcttttgggtacaacaatctccaaagcgacgaagaact

SEQ ID NO: 1695 - DNA, 39 bp, Artificial Sequence
  Synthetic
caaaggagttgccggacctccaagagatgcaaccagaag

SEQ ID NO: 1696 - DNA, 46 bp, Artificial Sequence
  Synthetic
cgttgaaaccgattttgttgctaactcggacaataaactcgtaacg

SEQ ID NO: 1697 - DNA, 39 bp, Artificial Sequence
  Synthetic
acctgcggaagaagctgttgagcttcatcttgagcttct

SEQ ID NO: 1698 - DNA, 46 bp, Artificial Sequence
  Synthetic
ggatcctaaatagcgcttcactaaagtcattttctgttcatttcgg

SEQ ID NO: 1699 - DNA, 42 bp, Artificial Sequence
  Synthetic
tcacctaacctaggattatgcgttcgctatcgtcaacagcat

SEQ ID NO: 1700 - DNA, 39 bp, Artificial Sequence
  Synthetic
gccctttcccaactccttgagtttagtgcaccgttacga

SEQ ID NO: 1701 - DNA, 43 bp, Artificial Sequence
  Synthetic
ttaggcccagaggtcgattgtcgtctattaatccttctaacga

SEQ ID NO: 1702 - DNA, 45 bp, Artificial Sequence
  Synthetic
gtcaccggagcatcattatttactttacgctcttttgaacatgtc

SEQ ID NO: 1703 - DNA, 42 bp, Artificial Sequence
  Synthetic
gtgggagcgttcgagacatgattagttgctatgtctacctct

SEQ ID NO: 1704 - DNA, 41 bp, Artificial Sequence
  Synthetic
ggacaattccgcataatttcggaagctctgtttggttcctt

SEQ ID NO: 1705 - DNA, 41 bp, Artificial Sequence
  Synthetic
caatgcaccccttctttctgatccaagaggttccttctcaa

SEQ ID NO: 1706 - DNA, 43 bp, Artificial Sequence
  Synthetic
ccaccttcaatcacagcacttaaggaattcgatacttggattc

SEQ ID NO: 1707 - DNA, 45 bp, Artificial Sequence
  Synthetic
cgggatgattgaagtacagtccatgacttttttcaagctaacatc

SEQ ID NO: 1708 - DNA, 47 bp, Artificial Sequence
  Synthetic
ccagtcctcttgtctttcgacttcttagatagtcgcttattagtgaa

SEQ ID NO: 1709 - DNA, 42 bp, Artificial Sequence
  Synthetic
ctgttttattcttgcgtattggctgttgacaatggcttgagc

SEQ ID NO: 1710 - DNA, 44 bp, Artificial Sequence
  Synthetic
cggctttgcgcataaaaaacattttcaggttgagtatatggaag

SEQ ID NO: 1711 - DNA, 49 bp, Artificial Sequence
  Synthetic
gcgattttaaccacaagcttcaaatagaaactattgatcaaagtatccg

SEQ ID NO: 1712 - DNA, 45 bp, Artificial Sequence
  Synthetic
caaagttctggcattacagatcctagagttagtggtcatacaagg

SEQ ID NO: 1713 - DNA, 45 bp, Artificial Sequence
  Synthetic
gccctgaagtcagattttcttgccaaaaaaattatcaggacgctt

SEQ ID NO: 1714 - DNA, 40 bp, Artificial Sequence
  Synthetic
atgcagggttcgggaaaacaccatcacacacagcttttac

SEQ ID NO: 1715 - DNA, 44 bp, Artificial Sequence
  Synthetic
cctccgtagacaaaaacaacggactggaatatacacttcttccg

SEQ ID NO: 1716 - DNA, 45 bp, Artificial Sequence
  Synthetic
gcactctttaaatgattgctgcctaaggaagtgatgattcgaaga

SEQ ID NO: 1717 - DNA, 38 bp, Artificial Sequence
  Synthetic
gagtttgggcaagccgatgaagaaatccccgccagaaa

SEQ ID NO: 1718 - DNA, 39 bp, Artificial Sequence
  Synthetic
ctgttcgaaacgcatggcagcccatggatcgtttagagc

SEQ ID NO: 1719 - DNA, 43 bp, Artificial Sequence
  Synthetic
tcccaaccaactgcttaaacatctagctttgatcaattccgta

SEQ ID NO: 1720 - DNA, 42 bp, Artificial Sequence
  Synthetic
agtgattgttacctctttgcaacctttggcagtcattgagga

SEQ ID NO: 1721 - DNA, 41 bp, Artificial Sequence
  Synthetic
ccataggatctggaaccggagttgctgattttgtggttctt

SEQ ID NO: 1722 - DNA, 43 bp, Artificial Sequence
  Synthetic
actctttttagactctgtgcgtgtcagcagagcaatacgttgg

SEQ ID NO: 1723 - DNA, 43 bp, Artificial Sequence
  Synthetic
gccccaatcgaaaatctctcctattattcccccttaggtctgg

SEQ ID NO: 1724 - DNA, 45 bp, Artificial Sequence
  Synthetic
tgggatgcgatcttctgtgtattagcttttcttctttcagttctg

SEQ ID NO: 1725 - DNA, 42 bp, Artificial Sequence
  Synthetic
aggagaacacataccctcttctttattcatgcttcgatccca

SEQ ID NO: 1726 - DNA, 41 bp, Artificial Sequence
  Synthetic
tgaagaaccaggatccagctaatttctcggaagggagttgt

SEQ ID NO: 1727 - DNA, 38 bp, Artificial Sequence
  Synthetic
gctcgcaatagcagttctcctttttgggcttctctgcg

SEQ ID NO: 1728 - DNA, 39 bp, Artificial Sequence
  Synthetic
agagtgcgcaataaccacccgtgaaagcacaggttcatg

SEQ ID NO: 1729 - DNA, 46 bp, Artificial Sequence
  Synthetic
gtcacgaatattttcctgagaaggaatgacaatgctctttatcgac

SEQ ID NO: 1730 - DNA, 46 bp, Artificial Sequence
  Synthetic
aagaccctgctttccctgtaaagaattattaagcaaggatttaccg

SEQ ID NO: 1731 - DNA, 43 bp, Artificial Sequence
  Synthetic
ccaaagctccgtacactttttccttgcaaccgatagattctga

SEQ ID NO: 1732 - DNA, 38 bp, Artificial Sequence
  Synthetic
atctcccgcagccatatcacccggaagtggctactacc

SEQ ID NO: 1733 - DNA, 43 bp, Artificial Sequence
  Synthetic
gtgtctcgaaaagctgcttctaaatgtttgttcctttcgatcg

SEQ ID NO: 1734 - DNA, 41 bp, Artificial Sequence
  Synthetic
cgatttccctaacgcttccttatttatgcctttgttgctgc

SEQ ID NO: 1735 - DNA, 42 bp, Artificial Sequence
  Synthetic
accacaactcttgctcgcttatcaaagagcatcatacgaaga

SEQ ID NO: 1736 - DNA, 44 bp, Artificial Sequence
  Synthetic
catccgcaaaagttactttgttttgtgtcgttcggaaaatctcc

SEQ ID NO: 1737 - DNA, 40 bp, Artificial Sequence
  Synthetic
acaagcttgctgttaaactcctccttatggctcagcttca

SEQ ID NO: 1738 - DNA, 43 bp, Artificial Sequence
  Synthetic
gcgcattgaaactatgcagatcaatatttgttttcctccggga

SEQ ID NO: 1739 - DNA, 40 bp, Artificial Sequence
  Synthetic
tccagcacacatgagacaggttggagattgaaagacacga

SEQ ID NO: 1740 - DNA, 46 bp, Artificial Sequence
  Synthetic
ccagaaagtttaatctgcgctctttgtgtcagtcttttttctggat

SEQ ID NO: 1741 - DNA, 45 bp, Artificial Sequence
  Synthetic
cctactcatgcggaatgttttggtccgaataattacatctgttgc

SEQ ID NO: 1742 - DNA, 44 bp, Artificial Sequence
  Synthetic
cctaatccacaacgaggtcctggtgctttggttaaaattgctac

SEQ ID NO: 1743 - DNA, 42 bp, Artificial Sequence
  Synthetic
ttcctcattatctttggtcttgccaccacaggatacggcata

SEQ ID NO: 1744 - DNA, 45 bp, Artificial Sequence
  Synthetic
acaaaccgatcgcgaattggagcttagtctatttgtaaagtagtg

SEQ ID NO: 1745 - DNA, 39 bp, Artificial Sequence
  Synthetic
cgcaaatgattacgcccctctagtttggttggtgagtga

SEQ ID NO: 1746 - DNA, 41 bp, Artificial Sequence
  Synthetic
gccctgatagaaggagctatggtgaaatggcgttatgttcc

SEQ ID NO: 1747 - DNA, 45 bp, Artificial Sequence
  Synthetic
ttggaggtggcatcctttccgataagactatcatgattaaagctg

SEQ ID NO: 1748 - DNA, 43 bp, Artificial Sequence
  Synthetic
accggccaaactccatcaaggcccattaaagataatcattgga

SEQ ID NO: 1749 - DNA, 44 bp, Artificial Sequence
  Synthetic
ccagcagctacattgctactaaagaactctggatcagtttcctt

SEQ ID NO: 1750 - DNA, 43 bp, Artificial Sequence
  Synthetic
tgaatgcgcagatcgtatatctaaagcgagtagcttctttggt

SEQ ID NO: 1751 - DNA, 40 bp, Artificial Sequence
  Synthetic
aggttttcatatgctggttcccatttgttcggagatgcgt

SEQ ID NO: 1752 - DNA, 40 bp, Artificial Sequence
  Synthetic
acccgctgctgaattattttgtgcttccggactatcgaag

SEQ ID NO: 1753 - DNA, 46 bp, Artificial Sequence
  Synthetic
gacaaaccatgattcacctcgatacagccttgtttttattaaaccc

SEQ ID NO: 1754 - DNA, 42 bp, Artificial Sequence
  Synthetic
ccgcatctgtaagctcacagaatgcaagaagatataatcgcc

SEQ ID NO: 1755 - DNA, 39 bp, Artificial Sequence
  Synthetic
tcatcttcccgacggatgctagatggaaactgatgggga

SEQ ID NO: 1756 - DNA, 46 bp, Artificial Sequence
  Synthetic
gccagattcgccttatttcttctttaggacccatatacaagagagt

SEQ ID NO: 1757 - DNA, 42 bp, Artificial Sequence
  Synthetic
tctccagaagttccgatcattgagacaatggtgatggagttg

SEQ ID NO: 1758 - DNA, 45 bp, Artificial Sequence
  Synthetic
ggcccagtacctgcttcttagcaaatgaaaacatggatactatgg

SEQ ID NO: 1759 - DNA, 41 bp, Artificial Sequence
  Synthetic
ccttggaaccgattcttacactgctctgccctgttagtgga

SEQ ID NO: 1760 - DNA, 42 bp, Artificial Sequence
  Synthetic
tgtactttaacacagccactgcccaagtgcttgtcatgatgg

SEQ ID NO: 1761 - DNA, 50 bp, Artificial Sequence
  Synthetic
cactagaatcaggataacaggagcagaaaagggaaagatagtcaaatcag

SEQ ID NO: 1762 - DNA, 47 bp, Artificial Sequence
  Synthetic
aaaccgtttcttgaactaatgctttggagtaaaagggttttcattca

SEQ ID NO: 1763 - DNA, 43 bp, Artificial Sequence
  Synthetic
tcagaccgtgtttaaagaagcgtattgtggattcttgatcgtc

SEQ ID NO: 1764 - DNA, 47 bp, Artificial Sequence
  Synthetic
ttgtgtaggctgaagctactgtagaggctgaaaaaataaagatatgc

SEQ ID NO: 1765 - DNA, 44 bp, Artificial Sequence
  Synthetic
tccacatccttggtaaaggtagtcttctttgtctggtggatcct

SEQ ID NO: 1766 - DNA, 41 bp, Artificial Sequence
  Synthetic
aagctgttgttgcaattttttgccttggtgaatgccttgga

SEQ ID NO: 1767 - DNA, 46 bp, Artificial Sequence
  Synthetic
cctgttatctagtcctccaacaacttgtgacaactactttcaagtg

SEQ ID NO: 1768 - DNA, 41 bp, Artificial Sequence
  Synthetic
cctgacagcaactccctcatcatacattggagaagctgatg

SEQ ID NO: 1769 - DNA, 45 bp, Artificial Sequence
  Synthetic
tggttacagtggtatcagttccacaatccattccaaaaatcccag

SEQ ID NO: 1770 - DNA, 49 bp, Artificial Sequence
  Synthetic
agcttcagatcttgcattttcaattgaatgacagaatttctcatgatga

SEQ ID NO: 1771 - DNA, 48 bp, Artificial Sequence
  Synthetic
cagatcaatttttgtgtcaagagggtattttcaagttcaacgaaactg

SEQ ID NO: 1772 - DNA, 47 bp, Artificial Sequence
  Synthetic
gttgaatagcttagtgacacctcctatacaagaagctcaaaagagaa

SEQ ID NO: 1773 - DNA, 40 bp, Artificial Sequence
  Synthetic
tagcaacctccatggcctccgtagcactacggcaaaggct

SEQ ID NO: 1774 - DNA, 44 bp, Artificial Sequence
  Synthetic
ggaacactttcactgcctgtattgccatagaaaaacacgtaacc

SEQ ID NO: 1775 - DNA, 40 bp, Artificial Sequence
  Synthetic
tcaatgggctggacaaggtcggaaacaggctactatacca

SEQ ID NO: 1776 - DNA, 46 bp, Artificial Sequence
  Synthetic
ccatctacatcactacaatcagcttgcaaaaatggcagataaaggt

SEQ ID NO: 1777 - DNA, 47 bp, Artificial Sequence
  Synthetic
tgcgttgaggcgaaatagtaatagaagtattttagtcctaaagctgt

SEQ ID NO: 1778 - DNA, 38 bp, Artificial Sequence
  Synthetic
caaagctgctactacgctgcaaatgttggggatgcaca

SEQ ID NO: 1779 - DNA, 42 bp, Artificial Sequence
  Synthetic
cattgaaacggtcgctgagagggcaattagatctaagtgacc

SEQ ID NO: 1780 - DNA, 48 bp, Artificial Sequence
  Synthetic
gtgcgtcttgagcaaatctgatattatcatggtgcctattttatggat

SEQ ID NO: 1781 - DNA, 40 bp, Artificial Sequence
  Synthetic
tttggatccccctggaggcgtctaaaggaaggtacgggcg

SEQ ID NO: 1782 - DNA, 36 bp, Artificial Sequence
  Synthetic
tcccccgttcccttccgtcgggagcaggagaaggag

SEQ ID NO: 1783 - DNA, 49 bp, Artificial Sequence
  Synthetic
gaccatgtagtactgaagcaatcataatactcttaagtgttatcgctac

SEQ ID NO: 1784 - DNA, 38 bp, Artificial Sequence
  Synthetic
ggcaccaaagcaggcctaatggtgaagggacgagtgta

SEQ ID NO: 1785 - DNA, 45 bp, Artificial Sequence
  Synthetic
ccaagtctgctaacccttatatagcacaaaaacttggtaggccta

SEQ ID NO: 1786 - DNA, 50 bp, Artificial Sequence
  Synthetic
tcgtttcttccattttaagctaggagataataccccaacagtaataattc

SEQ ID NO: 1787 - DNA, 44 bp, Artificial Sequence
  Synthetic
tccctgacaccttaggcactaagttggacacccttattttgaag

SEQ ID NO: 1788 - DNA, 46 bp, Artificial Sequence
  Synthetic
agcatggtgtacatcctaaaacaaacaatactggaacaaaggatga

SEQ ID NO: 1789 - DNA, 48 bp, Artificial Sequence
  Synthetic
ccatagaaaaaacatgagttgccatttggatatagtagactccacatg

SEQ ID NO: 1790 - DNA, 49 bp, Artificial Sequence
  Synthetic
ggccgattaaataattgtgcatcagaaattgccagttctatctatttcc

SEQ ID NO: 1791 - DNA, 49 bp, Artificial Sequence
  Synthetic
caccactatgaaaaatctacgcccaaactttataaaaacatccactccc

SEQ ID NO: 1792 - DNA, 42 bp, Artificial Sequence
  Synthetic
gctagactgcacacaacactcaaaatcatgtgatggtggatt

SEQ ID NO: 1793 - DNA, 38 bp, Artificial Sequence
  Synthetic
atttccgggattgcacaggcgtgtctgtcttggtgcag

SEQ ID NO: 1794 - DNA, 44 bp, Artificial Sequence
  Synthetic
tgcaatctcataacataacgtggattcctacttggagtcaggaa

SEQ ID NO: 1795 - DNA, 45 bp, Artificial Sequence
  Synthetic
aatccaacctttaaaatcacacgagggttttgttatgcagtttgg

SEQ ID NO: 1796 - DNA, 45 bp, Artificial Sequence
  Synthetic
gccacacttgtgttgaacataatcagttttaggttgcaaggctat

SEQ ID NO: 1797 - DNA, 44 bp, Artificial Sequence
  Synthetic
ccaatcttaaaacaagaaaggccatgcacaagcatttcagagtg

SEQ ID NO: 1798 - DNA, 45 bp, Artificial Sequence
  Synthetic
ccagccttggccatataaacattaattctgaaccacctaaagttg

SEQ ID NO: 1799 - DNA, 48 bp, Artificial Sequence
  Synthetic
agtttcctcaccttctacatcatcttcctgaagatgatgactttcttg

SEQ ID NO: 1800 - DNA, 48 bp, Artificial Sequence
  Synthetic
ccaaggtatcaacaaacaactgactataaaaatttgcaggatctttgg

SEQ ID NO: 1801 - DNA, 44 bp, Artificial Sequence
  Synthetic
gccccctgtagagacataacaccgatatggttaagtctaaagga

SEQ ID NO: 1802 - DNA, 43 bp, Artificial Sequence
  Synthetic
tctgtttcgtaaacaatggaacgtcgggcactaagaaattggc

SEQ ID NO: 1803 - DNA, 48 bp, Artificial Sequence
  Synthetic
aacaggcacaaacctattagtgaaaaagccttgtttttggataaagtg

SEQ ID NO: 1804 - DNA, 44 bp, Artificial Sequence
  Synthetic
tctggagcattaagcaagaaacattgcaggttgttgttaatggt

SEQ ID NO: 1805 - DNA, 44 bp, Artificial Sequence
  Synthetic
tgtaccaaaatgcataacagcgtatgtaaatgtggtgtaaagca

SEQ ID NO: 1806 - DNA, 48 bp, Artificial Sequence
  Synthetic
acaccatctactttctcgaatgtttaatattattgtgacggaggtaag

SEQ ID NO: 1807 - DNA, 48 bp, Artificial Sequence
  Synthetic
ccatcgtcaacatcatccacttttataatagaccttcattggttgatg

SEQ ID NO: 1808 - DNA, 46 bp, Artificial Sequence
  Synthetic
ccagcaacctaaaactccaatgtaatgcccttatcagtattcagat

SEQ ID NO: 1809 - DNA, 47 bp, Artificial Sequence
  Synthetic
gcggcctcaacagtaataaaagtatactggcttttgttcaaaacatc

SEQ ID NO: 1810 - DNA, 44 bp, Artificial Sequence
  Synthetic
actgattaaaagcatccacagaccagcatgtgcagggtaatgtt

SEQ ID NO: 1811 - DNA, 48 bp, Artificial Sequence
  Synthetic
accatatcgtaacactttggtaggggctgtaatagatcaggattttgg

SEQ ID NO: 1812 - DNA, 41 bp, Artificial Sequence
  Synthetic
acgcacgatacgtacaagccatgctaaaggttttatccgtt

SEQ ID NO: 1813 - DNA, 43 bp, Artificial Sequence
  Synthetic
acaacaattacagcgagtatagcacgcctgtggattttttggc

SEQ ID NO: 1814 - DNA, 43 bp, Artificial Sequence
  Synthetic
gttggtaaagcacatcactaccatttgcatatagggaggctgc

SEQ ID NO: 1815 - DNA, 45 bp, Artificial Sequence
  Synthetic
cgcataaaaaggaacccttaatggttttagctgcttataacggca

SEQ ID NO: 1816 - DNA, 50 bp, Artificial Sequence
  Synthetic
acaaggtcagatttaacttggctaagtgttctgtagaagattttaatgtg

SEQ ID NO: 1817 - DNA, 46 bp, Artificial Sequence
  Synthetic
acagtgtaaaaagcacaggagttatttgtgttataagtttggccat

SEQ ID NO: 1818 - DNA, 47 bp, Artificial Sequence
  Synthetic
ccatgtgtaagtaccaaaaagggaaaagggttctaacttagaggaag

SEQ ID NO: 1819 - DNA, 43 bp, Artificial Sequence
  Synthetic
acctccaatacccaacagctccctcctaagaatagttttgaag

SEQ ID NO: 1820 - DNA, 44 bp, Artificial Sequence
  Synthetic
tcaacgaagctagccatattaacaacgatgattacgcaaaggac

SEQ ID NO: 1821 - DNA, 44 bp, Artificial Sequence
  Synthetic
acccgcataggtaacatagacattatggcagcaaatactctgaa

SEQ ID NO: 1822 - DNA, 48 bp, Artificial Sequence
  Synthetic
cagcttgcaatctaactgtagaagattttgtaaaaggttgtaacacac

SEQ ID NO: 1823 - DNA, 45 bp, Artificial Sequence
  Synthetic
cgtaatttgcacaacccatcaacatctgtttgtatatattgccgc

SEQ ID NO: 1824 - DNA, 48 bp, Artificial Sequence
  Synthetic
gctgaaaacggcaacaattaactttaagggcatttgatatttacaatg

SEQ ID NO: 1825 - DNA, 43 bp, Artificial Sequence
  Synthetic
agtgttaaaacgcctactaagcctaccctagttagcgctactg

SEQ ID NO: 1826 - DNA, 47 bp, Artificial Sequence
  Synthetic
cagcagcatataaaagcaagtctttattgtgatgaatatggatgtgg

SEQ ID NO: 1827 - DNA, 50 bp, Artificial Sequence
  Synthetic
aatggatagccagcactcttatcatagtattttgagatttatgatggtgg

SEQ ID NO: 1828 - DNA, 48 bp, Artificial Sequence
  Synthetic
ccaccataaaatttagtggtgcctaaaatgtttgaaaagtatagcagc

SEQ ID NO: 1829 - DNA, 45 bp, Artificial Sequence
  Synthetic
gcttctgaagagcacgtatactaaggccaatgtatgtgccttaat

SEQ ID NO: 1830 - DNA, 43 bp, Artificial Sequence
  Synthetic
caagcattgtgtgttgtgaacagttgggttgaacatgacataa

SEQ ID NO: 1831 - DNA, 45 bp, Artificial Sequence
  Synthetic
aaggactcatcagtgaacttttgtatcttggatagctacagtgtt

SEQ ID NO: 1832 - DNA, 50 bp, Artificial Sequence
  Synthetic
cgctctgtacattcattagctagtataatcgtatagctagttgtaaatgg

SEQ ID NO: 1833 - DNA, 47 bp, Artificial Sequence
  Synthetic
acgtctcaagcacactataaacactagctaatttaagtgctcctacg

SEQ ID NO: 1834 - DNA, 43 bp, Artificial Sequence
  Synthetic
acacatacttacgagtggtgtcatttattgttccggccaaggt

SEQ ID NO: 1835 - DNA, 49 bp, Artificial Sequence
  Synthetic
gcttagctgcaaagttctgactatttaataagtttttgaaggctaaccc

SEQ ID NO: 1836 - DNA, 46 bp, Artificial Sequence
  Synthetic
ccgctataactcttgctacaatcttccttagataaagtgccacagg

SEQ ID NO: 1837 - DNA, 43 bp, Artificial Sequence
  Synthetic
cacaacaaaatcaattcctgtggaagcgtgatagcattgggac

SEQ ID NO: 1838 - DNA, 40 bp, Artificial Sequence
  Synthetic
tcacgccctacttttgcaaagtagttacatgggcagccaa

SEQ ID NO: 1839 - DNA, 47 bp, Artificial Sequence
  Synthetic
tggttgggcatcatagaacttaaaactttgtgttatgatattggcaa

SEQ ID NO: 1840 - DNA, 43 bp, Artificial Sequence
  Synthetic
atccatatacacacaaggcgtatctggcagcctttgagcattt

SEQ ID NO: 1841 - DNA, 47 bp, Artificial Sequence
  Synthetic
tcgatcttagccacaactttatcattcaagactggtcattatacagg

SEQ ID NO: 1842 - DNA, 45 bp, Artificial Sequence
  Synthetic
tcgtggaaatgtaaacgccattaaattgaatgtcctttttgatgg

SEQ ID NO: 1843 - DNA, 48 bp, Artificial Sequence
  Synthetic
ccaccaataatcttctggttgaagttattcagaagtatggtttggagg

SEQ ID NO: 1844 - DNA, 43 bp, Artificial Sequence
  Synthetic
ggcttccagtcagatgcagcgtaacgatgagaaagttatgact

SEQ ID NO: 1845 - DNA, 50 bp, Artificial Sequence
  Synthetic
tctgcattccaagaaaactctgttaacatacatttgtcatatgattcgag

SEQ ID NO: 1846 - DNA, 43 bp, Artificial Sequence
  Synthetic
tgtgtggcgctgtttgtattaggtttacaatttcaaattctcg

SEQ ID NO: 1847 - DNA, 41 bp, Artificial Sequence
  Synthetic
tgatgaggggttgatggtgatttgatgcagcactgtccatt

SEQ ID NO: 1848 - DNA, 44 bp, Artificial Sequence
  Synthetic
aaggcgtaaaattaacaccctcataggagttttcactttaccga

SEQ ID NO: 1849 - DNA, 46 bp, Artificial Sequence
  Synthetic
acagattgctttcgtaggaacagttccctctggtaattatttagcc

SEQ ID NO: 1850 - DNA, 48 bp, Artificial Sequence
  Synthetic
tgattgtacgtggttgtactaccagtgagttccctgctataactatag

SEQ ID NO: 1851 - DNA, 49 bp, Artificial Sequence
  Synthetic
gcttactattacaagtcagaggcatgtttaatgtttatttaggcatggc

SEQ ID NO: 1852 - DNA, 45 bp, Artificial Sequence
  Synthetic
tcccaatttaatggagagggcaccgtaaacctaatcttcccaatt

SEQ ID NO: 1853 - DNA, 46 bp, Artificial Sequence
  Synthetic
tcgaggcttaaaaacagaatcttctctgctaatgtttctgttagca

SEQ ID NO: 1854 - DNA, 39 bp, Artificial Sequence
  Synthetic
caagacccgaacagtgctcaacttataagtgcccccaaa

SEQ ID NO: 1855 - DNA, 43 bp, Artificial Sequence
  Synthetic
agagttagcgtgaaaggccgcaaacagaacttttatgattcgt

SEQ ID NO: 1856 - DNA, 48 bp, Artificial Sequence
  Synthetic
gacaaatgcagcacaatcaatagtaccttcagagtttactataggtaa

SEQ ID NO: 1857 - DNA, 47 bp, Artificial Sequence
  Synthetic
actttgcacacaaatgaggtccgttgaggcttataataattgtacag

SEQ ID NO: 1858 - DNA, 50 bp, Artificial Sequence
  Synthetic
gcggtaagacgaccattaataagtccaagaaattctatctagacttgatg

SEQ ID NO: 1859 - DNA, 43 bp, Artificial Sequence
  Synthetic
ccactcttaggagctatacctctattatgtcacagcgagggtt

SEQ ID NO: 1860 - DNA, 46 bp, Artificial Sequence
  Synthetic
ccttgagattgatgtagctctgatttgttacattcttggacctaca

SEQ ID NO: 1861 - DNA, 47 bp, Artificial Sequence
  Synthetic
acaagcatcttctaattctgagacaagacctgagaagaaatatctcc

SEQ ID NO: 1862 - DNA, 47 bp, Artificial Sequence
  Synthetic
ggcctaacatacattgttcctttcaattagaactggaagtttttgga

SEQ ID NO: 1863 - DNA, 43 bp, Artificial Sequence
  Synthetic
gcttaccaggagtaaaagacatcctccaaaagggttctggcat

SEQ ID NO: 1864 - DNA, 40 bp, Artificial Sequence
  Synthetic
agcgacccagtagactccgtcgaacaggaccgcatgctaa

SEQ ID NO: 1865 - DNA, 39 bp, Artificial Sequence
  Synthetic
cagccatgtcaggtgttacaccgcgtagtagagccaatt

SEQ ID NO: 1866 - DNA, 41 bp, Artificial Sequence
  Synthetic
aacctaattgcgccgttatagctatctgggaatcctgacga

SEQ ID NO: 1867 - DNA, 41 bp, Artificial Sequence
  Synthetic
ggttaccaccagatgccgacatactgaagacacctcagaaa

SEQ ID NO: 1868 - DNA, 43 bp, Artificial Sequence
  Synthetic
actttctgcttgggcattagcaaactgacatgactattgagga

SEQ ID NO: 1869 - DNA, 45 bp, Artificial Sequence
  Synthetic
tccattcaagtcctccgatgagttttccaggacatactattgagg

SEQ ID NO: 1870 - DNA, 42 bp, Artificial Sequence
  Synthetic
ggtcaaggaatggggcatcaccctgctttctttggcatgtcc

SEQ ID NO: 1871 - DNA, 43 bp, Artificial Sequence
  Synthetic
gcttgggaatgagcattaaccagctacctaactgaaatgactc

SEQ ID NO: 1872 - DNA, 41 bp, Artificial Sequence
  Synthetic
tccattcaagtcctccgatgagcttccaggacatactgacg

SEQ ID NO: 1873 - DNA, 42 bp, Artificial Sequence
  Synthetic
tggaggctgcacgacactcgtagatcactcccctgtgaggaa

SEQ ID NO: 1874 - DNA, 40 bp, Artificial Sequence
  Synthetic
ccaacgatctgtccgccaccaaagaaacaccatccgtcgc

SEQ ID NO: 1875 - DNA, 39 bp, Artificial Sequence
  Synthetic
ccccatgaggtcggcgaatccggaggtcccgcaatttgg

SEQ ID NO: 1876 - DNA, 40 bp, Artificial Sequence
  Synthetic
tggggtccagcacgtagatgtacattctgcacacacccgg

SEQ ID NO: 1877 - DNA, 39 bp, Artificial Sequence
  Synthetic
ccaccaccatacccacagcgggacatcgaatggcttggg

SEQ ID NO: 1878 - DNA, 40 bp, Artificial Sequence
  Synthetic
ggtctgtcatcagaaggaccggagctgcaagcccatcact

SEQ ID NO: 1879 - DNA, 37 bp, Artificial Sequence
  Synthetic
gccgctgggacttcagcagggcgtgccaacctacacc

SEQ ID NO: 1880 - DNA, 41 bp, Artificial Sequence
  Synthetic
cgatcctcgatatcgcagcgctgaacatcgatttaccgccg

SEQ ID NO: 1881 - DNA, 40 bp, Artificial Sequence
  Synthetic
cagcgtgaccaggttctccaaccctttggctgatgctgat

SEQ ID NO: 1882 - DNA, 42 bp, Artificial Sequence
  Synthetic
gtggccactgctaggtctttgaacctatacgaccacctagcg

SEQ ID NO: 1883 - DNA, 40 bp, Artificial Sequence
  Synthetic
aggaaggtctgggtagccgtgagacaagaacgtggtgacc

SEQ ID NO: 1884 - DNA, 41 bp, Artificial Sequence
  Synthetic
gaagggcacataacgggacctcgctcagtcctaggcctctc

SEQ ID NO: 1885 - DNA, 39 bp, Artificial Sequence
  Synthetic
gtgcggatgttggggtcgatccacattaggcttcggctc

SEQ ID NO: 1886 - DNA, 40 bp, Artificial Sequence
  Synthetic
tctacctcgacccgttcggcaccttttccattgagacccg

SEQ ID NO: 1887 - DNA, 39 bp, Artificial Sequence
  Synthetic
gcgcacacagtggcttggtaagactaagcagcagggact

SEQ ID NO: 1888 - DNA, 39 bp, Artificial Sequence
  Synthetic
gtctggaacgagtgctggctttcggctgcgttgtgattg

SEQ ID NO: 1889 - DNA, 39 bp, Artificial Sequence
  Synthetic
tttggttggtcgtcaggggactttgcctggcaaccctgc

SEQ ID NO: 1890 - DNA, 38 bp, Artificial Sequence
  Synthetic
tgtcggcgcagtatggctggcccgccatactatctccg

SEQ ID NO: 1891 - DNA, 39 bp, Artificial Sequence
  Synthetic
ggaaatgaagggcagcccaggccgacttcaaggcatggc

SEQ ID NO: 1892 - DNA, 39 bp, Artificial Sequence
  Synthetic
cttggcacggacacttgagctgggtgggggacttccatt

SEQ ID NO: 1893 - DNA, 40 bp, Artificial Sequence
  Synthetic
gatgaggcctatgcgtctggcatccgccagccaactatca

SEQ ID NO: 1894 - DNA, 41 bp, Artificial Sequence
  Synthetic
gtccttttcctccgagggggatgtaccaccaactgtccatg

SEQ ID NO: 1895 - DNA, 41 bp, Artificial Sequence
  Synthetic
cgccggtccaagaatacgacataccgttagtgacagcgagg

SEQ ID NO: 1896 - DNA, 39 bp, Artificial Sequence
  Synthetic
ccctgctggacaaggagcgaatcactctgcccgatcgaa

SEQ ID NO: 1897 - DNA, 42 bp, Artificial Sequence
  Synthetic
gcctccggttcaaggttacagccactgaacaggacatcaggg

SEQ ID NO: 1898 - DNA, 40 bp, Artificial Sequence
  Synthetic
tcagccaccacgaccaaatcatcaaaggccgcaaacctcc

SEQ ID NO: 1899 - DNA, 48 bp, Artificial Sequence
  Synthetic
ccacggtggtttttgtgagtatcaaagaactaagaaatctaatgtcgc

SEQ ID NO: 1900 - DNA, 42 bp, Artificial Sequence
  Synthetic
gtcattggtccattcctattccacggatcagaccgagtgatg

SEQ ID NO: 1901 - DNA, 45 bp, Artificial Sequence
  Synthetic
ttggttatcgttagttgcgattccaagttgttttccctaacgaag

SEQ ID NO: 1902 - DNA, 43 bp, Artificial Sequence
  Synthetic
gtgggtctgctgatactgcagaatgatgatgttgatcaaagct

SEQ ID NO: 1903 - DNA, 43 bp, Artificial Sequence
  Synthetic
cctcatgcactcttatcttcaatgtacaagcggatcatcagtc

SEQ ID NO: 1904 - DNA, 47 bp, Artificial Sequence
  Synthetic
cgcatccttctgaaaatgtcttaaagatctgaatttcgtcaataggg

SEQ ID NO: 1905 - DNA, 39 bp, Artificial Sequence
  Synthetic
ttcactgacctcctcgggagattgaccggttcttgagag

SEQ ID NO: 1906 - DNA, 46 bp, Artificial Sequence
  Synthetic
cctcatttgttggaacagagttcttagtacctaaggccattagagg

SEQ ID NO: 1907 - DNA, 41 bp, Artificial Sequence
  Synthetic
tcccctcagaacagcggactcggcactttaaccgaagaccc

SEQ ID NO: 1908 - DNA, 41 bp, Artificial Sequence
  Synthetic
gccaacctctcaggacagcctatgaaagccttaacaccggc

SEQ ID NO: 1909 - DNA, 42 bp, Artificial Sequence; identical to SEQ ID NO: 94
  Synthetic

SEQ ID NO: 1910 - DNA, 36 bp, Artificial Sequence
  Synthetic
tgagctcggacctgtccctggcctgcaactggacgc

SEQ ID NO: 1911 - DNA, 42 bp, Artificial Sequence
  Synthetic
cgcaaagcagaagaacacgaggtactcaatgcagcatccctg

SEQ ID NO: 1912 - DNA, 41 bp, Artificial Sequence
  Synthetic
ggtccgaagatggccaggagttgtgttgtacacccgactct

SEQ ID NO: 1913 - DNA, 39 bp, Artificial Sequence
  Synthetic
cacgtgatgagcttggtctccactgcgagatctggccgt

SEQ ID NO: 1914 - DNA, 39 bp, Artificial Sequence
  Synthetic
gcgatggtcctcgttccggccaacgtgcatcaatggggt

SEQ ID NO: 1915 - DNA, 38 bp, Artificial Sequence
  Synthetic
acaccggggatctcatggttgtggtgtgcacccgtgga

SEQ ID NO: 1916 - DNA, 39 bp, Artificial Sequence
  Synthetic
taagcacctcctgagcacccggcagccccatcacgtact

SEQ ID NO: 1917 - DNA, 41 bp, Artificial Sequence
  Synthetic
agtaggccacggcattgatgctcaaagaagaagtgcgacga

SEQ ID NO: 1918 - DNA, 41 bp, Artificial Sequence
  Synthetic
acagaggacggacgagtcgaatctacagatttgtggcaccg

SEQ ID NO: 1919 - DNA, 38 bp, Artificial Sequence
  Synthetic
gggtgcgtcagggtgacttcggccaacacccctgctat

SEQ ID NO: 1920 - DNA, 41 bp, Artificial Sequence
  Synthetic
ggtgataacctctgcttggcggaagggatgatgctcgctga

SEQ ID NO: 1921 - DNA, 38 bp, Artificial Sequence
  Synthetic
ccctgcaagaatgtccacgaggtgggcgctggcttagc

SEQ ID NO: 1922 - DNA, 38 bp, Artificial Sequence
  Synthetic
tatggcagtgacgcgggcgggaaccatgtttcccccac

SEQ ID NO: 1923 - DNA, 42 bp, Artificial Sequence
  Synthetic
ctccacatgttcctgcaggtcctggacatgtcaaaaacggga

SEQ ID NO: 1924 - DNA, 37 bp, Artificial Sequence
  Synthetic
aggtaattgcgaccccaccggtgctgcgggaggaggt

SEQ ID NO: 1925 - DNA, 39 bp, Artificial Sequence
  Synthetic
cgaatctccgagacttccgcagtcgatccgcttgtggca

SEQ ID NO: 1926 - DNA, 37 bp, Artificial Sequence
  Synthetic
gactcaacgtcggagtcgggggcattacgggcgacaa

SEQ ID NO: 1927 - DNA, 42 bp, Artificial Sequence
  Synthetic
gctgcaagcttcctctacggatattaccaggacgtgctcaag

SEQ ID NO: 1928 - DNA, 38 bp, Artificial Sequence
  Synthetic
ggccatcttctcgcacacgccctgagaaggggggtcgt

SEQ ID NO: 1929 - DNA, 38 bp, Artificial Sequence
  Synthetic
ttgtcagtacgccgctcgcttatgttgggggccctctt

SEQ ID NO: 1930 - DNA, 38 bp, Artificial Sequence
  Synthetic
gtcttgctgtctcccacgcggcgctggaaagagggtct

SEQ ID NO: 1931 - DNA, 40 bp, Artificial Sequence
  Synthetic
tgtctccaagctcgcaagggtgaaatcaatagggtggccg

SEQ ID NO: 1932 - DNA, 44 bp, Artificial Sequence
  Synthetic
tgcacccatggacatagcttcgaatggggtacatataaaacaag

SEQ ID NO: 1933 - DNA, 49 bp, Artificial Sequence
  Synthetic
tgtagcatctgatcagctgtgtattattcatattatgtagaaggtgtgg

SEQ ID NO: 1934 - DNA, 41 bp, Artificial Sequence
  Synthetic
tggttccaccgcatctgtatggatatccctgtatgcaatgt

SEQ ID NO: 1935 - DNA, 40 bp, Artificial Sequence
  Synthetic
ccccagctttatggcgtctagcatttcagccccgtgtgtg

SEQ ID NO: 1936 - DNA, 45 bp, Artificial Sequence
  Synthetic
cattggcatggtagcacttgtatgcataaagaccctaatacaacc

SEQ ID NO: 1937 - DNA, 47 bp, Artificial Sequence
  Synthetic
gctcatacaaaagtatgatttgccaaggagtaccaaaaaaaagttgt

SEQ ID NO: 1938 - DNA, 44 bp, Artificial Sequence
  Synthetic
accttcgaaaaaagcatttccaatttgacaacacaaggagaacc

SEQ ID NO: 1939 - DNA, 45 bp, Artificial Sequence
  Synthetic
accctcgtatgagacttttcctgttatgtgcagaactatagtgac

SEQ ID NO: 1940 - DNA, 41 bp, Artificial Sequence
  Synthetic
tctttggacccttgtcgctgctaaagcgacagcgactcgag

SEQ ID NO: 1941 - DNA, 43 bp, Artificial Sequence
  Synthetic
ccaaaacaaacacagcagcagtggatttttacttgtgtcgact

SEQ ID NO: 1942 - DNA, 41 bp, Artificial Sequence
  Synthetic
ggtggtgccctctactttgggaataggacctgcaaggcctc

SEQ ID NO: 1943 - DNA, 40 bp, Artificial Sequence
  Synthetic
gttgtggcagaggatgtaacttagggtccaccatacctac

SEQ ID NO: 1944 - DNA, 43 bp, Artificial Sequence
  Synthetic
ggttccatttcaatgtcctcgatcccgggtacattactatcag

SEQ ID NO: 1945 - DNA, 40 bp, Artificial Sequence
  Synthetic
tccgtgctgagaactttagacagcgctctagtgacaactt

SEQ ID NO: 1946 - DNA, 47 bp, Artificial Sequence
  Synthetic
aggcacgtcagacttatttaattgtctattcaggatggtgatatggt

SEQ ID NO: 1947 - DNA, 45 bp, Artificial Sequence
  Synthetic
gccataatatccggggtcaatgtaggaatatgatttgcagttcat

SEQ ID NO: 1948 - DNA, 46 bp, Artificial Sequence
  Synthetic
cacaggaacagcaattacacaaatttgttatgagcatgtatgtgtg

SEQ ID NO: 1949 - DNA, 38 bp, Artificial Sequence
  Synthetic
atcgtacacctgtcccacagctgaggaggaggagcaat

SEQ ID NO: 1950 - DNA, 45 bp, Artificial Sequence
  Synthetic
atccatatcgtctatcaggttggaccactctggaggatttgtttg

SEQ ID NO: 1951 - DNA, 46 bp, Artificial Sequence
  Synthetic
gtcccagtttgtataaggaaacacatttcaaaaaacatggctacac

SEQ ID NO: 1952 - DNA, 40 bp, Artificial Sequence
  Synthetic
ggggtagaggggtatgcggttctagttctaccaggcagcc

SEQ ID NO: 1953 - DNA, 40 bp, Artificial Sequence
  Synthetic
gttcccactgcttcaggagctgacgaaccaccgagacaga

SEQ ID NO: 1954 - DNA, 43 bp, Artificial Sequence
  Synthetic
ctaacgatgaataacctgtagtcccatttgggcaacttgggta

SEQ ID NO: 1955 - DNA, 44 bp, Artificial Sequence
  Synthetic
tcctggatcagcagtgataactatgagctcttcaattgttcctt

SEQ ID NO: 1956 - DNA, 42 bp, Artificial Sequence
  Synthetic
tcatcatcaaaggcgggattttcattttgtaaggcaaccgtc

SEQ ID NO: 1957 - DNA, 46 bp, Artificial Sequence
  Synthetic
catcaggtactataggtctgtcagtacattggcctctaatattcct

SEQ ID NO: 1958 - DNA, 47 bp, Artificial Sequence
  Synthetic
cccttctacatattcatccgtactcaatcgtggaaagttatatctgc

SEQ ID NO: 1959 - DNA, 49 bp, Artificial Sequence
  Synthetic
gggatgacctgatgtactaatacctgttggtttggaaattgataggatt

SEQ ID NO: 1960 - DNA, 45 bp, Artificial Sequence
  Synthetic
acatgtcaccatcctgaatagtagtaaaggtttgcgaaaatgtcc

SEQ ID NO: 1961 - DNA, 44 bp, Artificial Sequence
  Synthetic
cctgctgagcaccataaataaagtttttacgcgaggcactttta

SEQ ID NO: 1962 - DNA, 38 bp, Artificial Sequence
  Synthetic
tggcgccaaaaacttaccgaatgctgccttttaagcca

SEQ ID NO: 1963 - DNA, 41 bp, Artificial Sequence
  Synthetic
ggtctaccgttgtctgtctcaactaaagcagctgttaaggg

SEQ ID NO: 1964 - DNA, 44 bp, Artificial Sequence
  Synthetic
ccttttcaaacccttcagtatcccttcaatagcagcagttacct

SEQ ID NO: 1965 - DNA, 48 bp, Artificial Sequence
  Synthetic
catcgttcccttcaatttttctcttaataccaagagaatctacttgga

SEQ ID NO: 1966 - DNA, 40 bp, Artificial Sequence
  Synthetic
agctctagtgggtttgatgcaatgattgtagcttgcagga

SEQ ID NO: 1967 - DNA, 42 bp, Artificial Sequence
  Synthetic
gctttttttcaatatccccctgcatatgggacggagaagagg

SEQ ID NO: 1968 - DNA, 43 bp, Artificial Sequence
  Synthetic
cattgatcaaaaaggtcattgctccgccaacttttatccccca

SEQ ID NO: 1969 - DNA, 45 bp, Artificial Sequence
  Synthetic
acgttatcattagctgtgcttgtgaagttataatgggagccaatg

SEQ ID NO: 1970 - DNA, 45 bp, Artificial Sequence
  Synthetic
ggtcagttttcataacctcttggtcggtcagtacagtggatttgc

SEQ ID NO: 1971 - DNA, 43 bp, Artificial Sequence
  Synthetic
ggttttgaaatctccaagatcagggatggggaatgcagtactg

SEQ ID NO: 1972 - DNA, 47 bp, Artificial Sequence
  Synthetic
gcatggataacagggaatcttgtttgtctatcagcttacgatctctt

SEQ ID NO: 1973 - DNA, 43 bp, Artificial Sequence
  Synthetic
agcgacaatctatcttcacatgattgttatgcccctctactgg

SEQ ID NO: 1974 - DNA, 49 bp, Artificial Sequence
  Synthetic
cacaatggacaagaaaaaccatccgataattgtgatttttatggttggg

SEQ ID NO: 1975 - DNA, 47 bp, Artificial Sequence
  Synthetic
caccaagaattattaacgccaagaattatgttcaatgtaagtgtggt

SEQ ID NO: 1976 - DNA, 45 bp, Artificial Sequence
  Synthetic
caccacacttacccatgtacatattgagtattgtcaaccacctaa

SEQ ID NO: 1977 - DNA, 46 bp, Artificial Sequence
  Synthetic
cagctttaacaagtctagcaacattacctcaattgtatggtttgtg

SEQ ID NO: 1978 - DNA, 48 bp, Artificial Sequence
  Synthetic
gcaacataagacaagctacattcaccggtccatttttttcttttgaac

SEQ ID NO: 1979 - DNA, 42 bp, Artificial Sequence
  Synthetic
acctgcacaattacagccaatttggtacattagcaaagactg

SEQ ID NO: 1980 - DNA, 48 bp, Artificial Sequence
  Synthetic
tgagcacaaatatcatgtccaactattaaaccatttgctaaagttgac

SEQ ID NO: 1981 - DNA, 48 bp, Artificial Sequence
  Synthetic
accagctttattacaaccatagacacggttttatatagttgttactgc

SEQ ID NO: 1982 - DNA, 45 bp, Artificial Sequence
  Synthetic
caacatctgaatcaatggaacaacagggtgtgcaattagaaaagg

SEQ ID NO: 1983 - DNA, 50 bp, Artificial Sequence
  Synthetic
agcattcttcataacaccatctgaactttgtgtactatgtttaaaagagg

SEQ ID NO: 1984 - DNA, 39 bp, Artificial Sequence
  Synthetic
acaagttgacagccctgcattaatgtctggtcggatgag

SEQ ID NO: 1985 - DNA, 47 bp, Artificial Sequence
  Synthetic
gcaataacattaacagtctggacgtttatggtccatatagagatgct

SEQ ID NO: 1986 - DNA, 45 bp, Artificial Sequence
  Synthetic
gttagtaagtgctaggtctgccattgtatgaacgtgataaagctg

SEQ ID NO: 1987 - DNA, 45 bp, Artificial Sequence
  Synthetic
gcaccaccataagaatcttggttaaatcatgctggtactggtatg

SEQ ID NO: 1988 - DNA, 46 bp, Artificial Sequence
  Synthetic
accattgaccatacaaatcttggtttactgtcatttttgcagacac

SEQ ID NO: 1989 - DNA, 46 bp, Artificial Sequence
  Synthetic
ggtgtgtgtcaacatctaagttcatccgtttgttgtttctattggt

SEQ ID NO: 1990 - DNA, 47 bp, Artificial Sequence
  Synthetic
gtgggcagaacattacgtttagtataagccagactttattatgaggc

SEQ ID NO: 1991 - DNA, 44 bp, Artificial Sequence
  Synthetic
cgggccaaaactaaactactaacaacctgttcttatgggttggg

SEQ ID NO: 1992 - DNA, 49 bp, Artificial Sequence
  Synthetic
gctctatcaaaagaacactgtcagttccagatccttctagaattttagg

SEQ ID NO: 1993 - DNA, 43 bp, Artificial Sequence
  Synthetic
tgccagaacataatcatcaacttctaatcttgcacgggttcac

SEQ ID NO: 1994 - DNA, 43 bp, Artificial Sequence
  Synthetic
acaccaatggaacactataaacactgtgcacctacacttgtcc

SEQ ID NO: 1995 - DNA, 41 bp, Artificial Sequence
  Synthetic
tgttccaatgttttcgcgagtagtgttagaggttgggttgg

SEQ ID NO: 1996 - DNA, 43 bp, Artificial Sequence
  Synthetic
aaacctttaggattgcctatgtcatggttattgcagcgtgtca

SEQ ID NO: 1997 - DNA, 50 bp, Artificial Sequence
  Synthetic
gcgcttcttaaaggaacgtaatcaaccttttttctattattcagatacgc

SEQ ID NO: 1998 - DNA, 50 bp, Artificial Sequence
  Synthetic
caactttatccacaatcacaccattagtaggttatcaatgattaaaggtc

SEQ ID NO: 1999 - DNA, 45 bp, Artificial Sequence
  Synthetic
cgcatattaacaggaacagctaatgacaggctgtatgatgaatgt

SEQ ID NO: 2000 - DNA, 41 bp, Artificial Sequence
  Synthetic
accaataggacaggaagcagaaaccttcttttgcttcaagt

SEQ ID NO: 2001 - DNA, 49 bp, Artificial Sequence
  Synthetic
cgaagaggaagaagaaggtgagttactgattattctgtttcttcttgtg

SEQ ID NO: 2002 - DNA, 50 bp, Artificial Sequence
  Synthetic
gcagttaaacgaccattaataagccttacaagaaattttatctcgtctcg

SEQ ID NO: 2003 - DNA, 47 bp, Artificial Sequence
  Synthetic
tgaccacgaataacagtagcagttaattgatatgaaaggcaagatgt

SEQ ID NO: 2004 - DNA, 40 bp, Artificial Sequence
  Synthetic
ggtcagcccaagaagttttctcggtcattatgctggaagt

SEQ ID NO: 2005 - DNA, 45 bp, Artificial Sequence
  Synthetic
gcttttggcgaggttttgttaaagtaaagattctaaacctcagca

SEQ ID NO: 2006 - DNA, 46 bp, Artificial Sequence
  Synthetic
agagtcaaactgttctggtaattgtcagaacactgattctgattcg

SEQ ID NO: 2007 - DNA, 44 bp, Artificial Sequence
  Synthetic
cctctccatactctttcattgctttagattttgtgcgacaatgc

SEQ ID NO: 2008 - DNA, 39 bp, Artificial Sequence
  Synthetic
cctctgttggccatttcttgtgaaagcagggctaggatt

SEQ ID NO: 2009 - DNA, 43 bp, Artificial Sequence
  Synthetic
gtttgattggtcttggtgttgtcatgtccaaagaagtgaatgc

SEQ ID NO: 2010 - DNA, 45 bp, Artificial Sequence
  Synthetic
tcatgtttttagtccttgggatctttggaagcaagtattgtcaga

SEQ ID NO: 2011 - DNA, 43 bp, Artificial Sequence
  Synthetic
ctcctcatgcttgcaatgtactgatagagctcgatgaaattgg

SEQ ID NO: 2012 - DNA, 41 bp, Artificial Sequence
  Synthetic
atgtggctcaagtctcgggtcacagatgtggtaaactttgt

SEQ ID NO: 2013 - DNA, 44 bp, Artificial Sequence
  Synthetic
ggccatgcttctgatttattctcaatcgagagcatgattgaagc

SEQ ID NO: 2014 - DNA, 41 bp, Artificial Sequence
  Synthetic
caccaaccattcttccaacagatgaaactggtggagaacgc

SEQ ID NO: 2015 - DNA, 42 bp, Artificial Sequence
  Synthetic
tctccagaagttccggtcattagggacaatggtaatggaact

SEQ ID NO: 2016 - DNA, 40 bp, Artificial Sequence
  Synthetic
tgagtgcagaccgtgccagaagcagaaatcctgggaatgc

SEQ ID NO: 2017 - DNA, 43 bp, Artificial Sequence
  Synthetic
gggatcactcttgttcctctaatgacatgccattctgcagcat

SEQ ID NO: 2018 - DNA, 43 bp, Artificial Sequence
  Synthetic
attccaaaggacgacgcgacgatacttattgctttgattgctc

SEQ ID NO: 2019 - DNA, 39 bp, Artificial Sequence
  Synthetic
tggatggggtgtccggggagtctcaaggtccgttccaga

SEQ ID NO: 2020 - DNA, 41 bp, Artificial Sequence
  Synthetic
gcctcttcttgaagtcgtctaaggggcaggaactagatcag

SEQ ID NO: 2021 - DNA, 45 bp, Artificial Sequence
  Synthetic
ctcgctttcttcttataggcatgttctttaccaaaaggcacatca

SEQ ID NO: 2022 - DNA, 43 bp, Artificial Sequence
  Synthetic
ttaccaaaaggacgcccagtctggtggttcattaggatatagg

SEQ ID NO: 2023 - DNA, 42 bp, Artificial Sequence
  Synthetic
catccaatacagcagaaacacccggtgattcaatagggggga

SEQ ID NO: 2024 - DNA, 44 bp, Artificial Sequence
  Synthetic
gtctccaatctttgtgtaggagtacggactcaggatttggtcag

SEQ ID NO: 2025 - DNA, 43 bp, Artificial Sequence
  Synthetic
ctggagcatactcagttaaccgccaatgaagattttgctgaca

SEQ ID NO: 2026 - DNA, 41 bp, Artificial Sequence
  Synthetic
gctggtgcacatcctacaataaacagaacagcggatggatt

SEQ ID NO: 2027 - DNA, 45 bp, Artificial Sequence
  Synthetic
tgtcatccgtaaataatctggccatgcaggaagacagatctagtg

SEQ ID NO: 2028 - DNA, 46 bp, Artificial Sequence
  Synthetic
aaaagctaattgccattgatcaagtatgtaaggtaaagcttgaacc

SEQ ID NO: 2029 - DNA, 48 bp, Artificial Sequence
  Synthetic
ccatttagcaggcctatctgatacaaacggttttcttcagatttaagc

SEQ ID NO: 2030 - DNA, 49 bp, Artificial Sequence
  Synthetic
caccaactgttactgaagaactgatgtcataatacactataaaaggctg

SEQ ID NO: 2031 - DNA, 47 bp, Artificial Sequence
  Synthetic
gaaacaaacttccaaatgtgtgcataaaggcaatgaaagaatatggg

SEQ ID NO: 2032 - DNA, 48 bp, Artificial Sequence
  Synthetic
accggttctctttgtaatcatacaatggtgaacagtatatgtaacaca

SEQ ID NO: 2033 - DNA, 46 bp, Artificial Sequence
  Synthetic
tcggactgacgaaaggaatcccttttcactataagacaagaaatgg

SEQ ID NO: 2034 - DNA, 41 bp, Artificial Sequence
  Synthetic
gccatattttcaccgagtgccagatcccaaggacaaagaac

SEQ ID NO: 2035 - DNA, 48 bp, Artificial Sequence
  Synthetic
gctgtaaaatagttcctcctcatgctgatgaaataggagaagatgttg

SEQ ID NO: 2036 - DNA, 43 bp, Artificial Sequence
  Synthetic
tcccatttgtgtggctccagtgaactttgtaagtatggagttc

SEQ ID NO: 2037 - DNA, 44 bp, Artificial Sequence
  Synthetic
gccatgtttccgatttgttttcaaattgagagcatgattgaggc

SEQ ID NO: 2038 - DNA, 44 bp, Artificial Sequence
  Synthetic
acatgtctctcatactgagtagcttcgataacctcgtttcaggt

SEQ ID NO: 2039 - DNA, 42 bp, Artificial Sequence
  Synthetic
cctaggcatcagcatgtaccaggtatatcaccgatatgagca

SEQ ID NO: 2040 - DNA, 47 bp, Artificial Sequence
  Synthetic
cgctcgaattgagttatcattccatttacagaggatgtcaaaaatgc

SEQ ID NO: 2041 - DNA, 49 bp, Artificial Sequence
  Synthetic
cactcttctctttctctggaaatgtgtaatggaatcaatggataaggaa

SEQ ID NO: 2042 - DNA, 42 bp, Artificial Sequence
  Synthetic
gtccagattgctcaagtttttcacaggattcgtgcactttgt

SEQ ID NO: 2043 - DNA, 45 bp, Artificial Sequence
  Synthetic
gcccatcccaccagtatgtgttaggagtctcaatcttaaatcttg

SEQ ID NO: 2044 - DNA, 43 bp, Artificial Sequence
  Synthetic
tcatgtcagccgattcattaattcctagccaacttcagcatgg

SEQ ID NO: 2045 - DNA, 44 bp, Artificial Sequence
  Synthetic
tggtacatttgttcatcctcaagaaattcccaagagaaatcgct

SEQ ID NO: 2046 - DNA, 47 bp, Artificial Sequence
  Synthetic
attgccaaattcagccatcctatgaaatcggtgcatatatataaccc

SEQ ID NO: 2047 - DNA, 43 bp, Artificial Sequence
  Synthetic
acacaatgtcatgtacagtaggtttccgcagagaaacacaagt

SEQ ID NO: 2048 - DNA, 47 bp, Artificial Sequence
  Synthetic
cctgtgcatgtaatagcgcttgctagtaatacaaattatatgcaggc

SEQ ID NO: 2049 - DNA, 45 bp, Artificial Sequence
  Synthetic
ctcaggtgtgtctcctgttactgcactatattggtataggacagg

SEQ ID NO: 2050 - DNA, 47 bp, Artificial Sequence
  Synthetic
acactggattgccattgctatcgtagggtaacagtatttacatttcc

SEQ ID NO: 2051 - DNA, 50 bp, Artificial Sequence
  Synthetic
aatttgaaatgttggtaccacgtgggtctggaaaatgcaatatattatgc

SEQ ID NO: 2052 - DNA, 46 bp, Artificial Sequence
  Synthetic
agcaattgcagtagcggatactacaatgttctgaatctatgtacag

SEQ ID NO: 2053 - DNA, 44 bp, Artificial Sequence
  Synthetic
ccacagattcaattacaacaggtgggtggcagacctaatactgt

SEQ ID NO: 2054 - DNA, 43 bp, Artificial Sequence
  Synthetic
tcccagatgtaggggtagtaataaatgcatttaccgacccttc

SEQ ID NO: 2055 - DNA, 50 bp, Artificial Sequence
  Synthetic
ggcctatgtaaacgaacaatatccaatagacactacattaaccttttcac

SEQ ID NO: 2056 - DNA, 42 bp, Artificial Sequence
  Synthetic
tcaggtaatgtaacccgaaacactcgcaagcaagacattcct

SEQ ID NO: 2057 - DNA, 44 bp, Artificial Sequence
  Synthetic
gggtttgtttataatccactgacaccccatgttgctacttctgt

SEQ ID NO: 2058 - DNA, 41 bp, Artificial Sequence
  Synthetic
ctgtccccatatgcatctgcaggttcccttagacatttgtc

SEQ ID NO: 2059 - DNA, 44 bp, Artificial Sequence
  Synthetic
tcttgtgactaaaacatccgagctggcacatatatgggaaagac

SEQ ID NO: 2060 - DNA, 44 bp, Artificial Sequence
  Synthetic
tgcattgttgtttggtcctgatatgtggtcaagtactagttgcc

SEQ ID NO: 2061 - DNA, 40 bp, Artificial Sequence
  Synthetic
ccaattgtccctgcatgtgcactggaactgctaagcatat

SEQ ID NO: 2062 - DNA, 44 bp, Artificial Sequence
  Synthetic
gctgtgcttattgtcctccctaggagtcaagggattctcatacc

SEQ ID NO: 2063 - DNA, 40 bp, Artificial Sequence
  Synthetic
gccatatggtccacagtggtcagatctaatgtcgcagtcc

SEQ ID NO: 2064 - DNA, 43 bp, Artificial Sequence
  Synthetic
agggtaatgaactgtacttgttgttgtatcacctctggccgta

SEQ ID NO: 2065 - DNA, 45 bp, Artificial Sequence
  Synthetic
gtacgccaccatcaagggagataacaaaagagaagaaagaagagc

SEQ ID NO: 2066 - DNA, 42 bp, Artificial Sequence
  Synthetic
tgctaatgggtctgctgacacagtttgattatcgctgctaga

SEQ ID NO: 2067 - DNA, 45 bp, Artificial Sequence
  Synthetic
tcccaaccattgtgaattcttcataagaagaagaagtgctaacgg

SEQ ID NO: 2068 - DNA, 45 bp, Artificial Sequence
  Synthetic
cccacatcattgatgacgaataagtgaacgtactattgtctcccg

SEQ ID NO: 2069 - DNA, 40 bp, Artificial Sequence
  Synthetic
gcagcaaaggggagaagttttaggacactgttccagcaaa

SEQ ID NO: 2070 - DNA, 43 bp, Artificial Sequence
  Synthetic
gtcttctttgcccaaaatgagaaatgatgaaggcacatctggg

SEQ ID NO: 2071 - DNA, 43 bp, Artificial Sequence
  Synthetic
tcttggtttggattccatcagaattatttgtgaccgggagaga

SEQ ID NO: 2072 - DNA, 47 bp, Artificial Sequence
  Synthetic
agcgtgtcaactctaaataattgctttaagcaatgaatctctgtcac

SEQ ID NO: 2073 - DNA, 43 bp, Artificial Sequence
  Synthetic
gacactctttgtggagaaatgtgaaggatcgctcatttgcaga

SEQ ID NO: 2074 - DNA, 41 bp, Artificial Sequence
  Synthetic
acttcttcaggagatgggacacacaacaaggagaacgttcc

SEQ ID NO: 2075 - DNA, 43 bp, Artificial Sequence
  Synthetic
cagcttcacctaatggtctgtaactttgggaattggatctggg

SEQ ID NO: 2076 - DNA, 48 bp, Artificial Sequence
  Synthetic
ggtagcagtagagtcagtgattgtatttagattttgtagctcctgatg

SEQ ID NO: 2077 - DNA, 39 bp, Artificial Sequence
  Synthetic
gctacttctgccaagtcccgaatttgaaaatgccgccta

SEQ ID NO: 2078 - DNA, 46 bp, Artificial Sequence
  Synthetic
cgttgtagctagtatgtcgtcaactagaattgcagactatagctgg

SEQ ID NO: 2079 - DNA, 48 bp, Artificial Sequence
  Synthetic
ctttgttaaagtaaggatggcctgttatcaggtgtagaaattaaacgt

SEQ ID NO: 2080 - DNA, 47 bp, Artificial Sequence
  Synthetic
ctgctttatcttcttgtaaacggcttaatagccctattcaggatggt

SEQ ID NO: 2081 - DNA, 46 bp, Artificial Sequence
  Synthetic
ggtgttaagaatgcacccccattcattaacctgctatgtatttgtc

SEQ ID NO: 2082 - DNA, 41 bp, Artificial Sequence
  Synthetic
gtttctaatgccctcctccgtggtggtgacagattgcaagt

SEQ ID NO: 2083 - DNA, 43 bp, Artificial Sequence
  Synthetic
gcattttcatccccattagtcaatgaggtggaaaaggtagcgt

SEQ ID NO: 2084 - DNA, 50 bp, Artificial Sequence
  Synthetic
cgcggaggatctgttattatttgatatgtagagatactgtacaaaaactg

SEQ ID NO: 2085 - DNA, 47 bp, Artificial Sequence
  Synthetic
aaagcacttctcatatacacatccaccactaacagatgctaaattgg

SEQ ID NO: 2086 - DNA, 41 bp, Artificial Sequence
  Synthetic
gtttgtatgccctgccttctgccaaatacaacactgggatc

SEQ ID NO: 2087 - DNA, 50 bp, Artificial Sequence
  Synthetic
atgtctataaagtacaggccatccgatatattatcaagatgcagatgagc

SEQ ID NO: 2088 - DNA, 46 bp, Artificial Sequence
  Synthetic
gctgtgctaatacactgaaataagccattgaaatgttggaggtaca

SEQ ID NO: 2089 - DNA, 40 bp, Artificial Sequence
  Synthetic
tgggaacatagccagaggcccactttgggggtctgggtat

SEQ ID NO: 2090 - DNA, 42 bp, Artificial Sequence
  Synthetic
aggatgcccatatacagagatgtaaaagggtctctgtaggca

SEQ ID NO: 2091 - DNA, 44 bp, Artificial Sequence
  Synthetic
aggccacttcttgtacgaatagtctgaaggccacattagactaa

SEQ ID NO: 2092 - DNA, 48 bp, Artificial Sequence
  Synthetic
agccacaaagacatctgcaaaatactacattttatttacatcctggac

SEQ ID NO: 2093 - DNA, 45 bp, Artificial Sequence
  Synthetic
caaacaaggagtacagcctactacgacaaagtgtctctatggacc

SEQ ID NO: 2094 - DNA, 45 bp, Artificial Sequence
  Synthetic
gccagcgtctgacttaacatttattacattggttgataacacaca

SEQ ID NO: 2095 - DNA, 45 bp, Artificial Sequence
  Synthetic
ccagtttgagataaaaatctgcgactacagaacgtttgtcctctg

SEQ ID NO: 2096 - DNA, 45 bp, Artificial Sequence
  Synthetic
aatattacaaaacatcgctgccggtcaacaacaagattactcagc

SEQ ID NO: 2097 - DNA, 42 bp, Artificial Sequence
  Synthetic
cctcctcctcaggatcaccattttacctgtcagtcttttagc

SEQ ID NO: 2098 - DNA, 43 bp, Artificial Sequence
  Synthetic
tgcccctcatttaattcaagagaatctgtttgaggtgctccag

SEQ ID NO: 2099 - DNA, 46 bp, Artificial Sequence
  Synthetic
tgtgacagcttccaaccttgggttaactaaaacacctttgaaaagc

SEQ ID NO: 2100 - DNA, 47 bp, Artificial Sequence
  Synthetic
taacccagttttcacaacatgatctaaagaatactttggtgtagcat

SEQ ID NO: 2101 - DNA, 49 bp, Artificial Sequence
  Synthetic
atgtcccagtttgtgaatatgtttgatggaaatagagcatattttctcc

SEQ ID NO: 2102 - DNA, 40 bp, Artificial Sequence
  Synthetic
tgctcgttggatcttcggcgtctctagctctaccacgtcg

SEQ ID NO: 2103 - DNA, 43 bp, Artificial Sequence
  Synthetic
gctggtgtaatgtctaatgtagcaacagatgtggtcggtgttg

SEQ ID NO: 2104 - DNA, 39 bp, Artificial Sequence
  Synthetic
aggtgtactggtacgtggagaggccctattaatcagcct

SEQ ID NO: 2105 - DNA, 42 bp, Artificial Sequence
  Synthetic
ctgcagatgtttctgaaaaccgaggccagaccaggattttgc

SEQ ID NO: 2106 - DNA, 49 bp, Artificial Sequence
  Synthetic
tgttgcaaatatcagctgtgcattaaatacctgacaatatactagagga

SEQ ID NO: 2107 - DNA, 45 bp, Artificial Sequence
  Synthetic
cgtttgcgtcgcctaagaagatatggcagtagatgtttatgatga

SEQ ID NO: 2108 - DNA, 48 bp, Artificial Sequence
  Synthetic
gctctgtctatcattgcaaatttgtgtagtggaaatcagtttagagtt

SEQ ID NO: 2109 - DNA, 45 bp, Artificial Sequence
  Synthetic
gcatttgttttggatccattgaaacccgcatatcctttaaagcag

SEQ ID NO: 2110 - DNA, 45 bp, Artificial Sequence
  Synthetic
agtgtgccaagtgattgtttcttaggggtctacatttttgtctac

SEQ ID NO: 2111 - DNA, 38 bp, Artificial Sequence
  Synthetic
ctgcccatctccacgcgaagccgcggaaatccagcaat

SEQ ID NO: 2112 - DNA, 41 bp, Artificial Sequence; identical to SEQ ID NO: 1458
  Synthetic

SEQ ID NO: 2113 - DNA, 42 bp, Artificial Sequence
  Synthetic
ctgaactaagactgggtgtccatccactaaccatccttttgc

SEQ ID NO: 2114 - DNA, 41 bp, Artificial Sequence
  Synthetic
cgaggcaggcttacatgggagggggggactttatgtgaccc

SEQ ID NO: 2115 - DNA, 35 bp, Artificial Sequence
  Synthetic
cgggctggtccagggacttgtcgctgactccgcca

SEQ ID NO: 2116 - DNA, 35 bp, Artificial Sequence
  Synthetic
cgcagggcaagacgagggatccaaggactcgggcc

SEQ ID NO: 2117 - DNA, 39 bp, Artificial Sequence
  Synthetic
cacgctggagggacattgtccgccacttcctgggtcatg

SEQ ID NO: 2118 - DNA, 43 bp, Artificial Sequence
  Synthetic
cccagctcattttggaaaataaacacaatccaacacgaggcaa

SEQ ID NO: 2119 - DNA, 35 bp, Artificial Sequence
  Synthetic
tgcgccgcctaatgcatcctatgcgccgaggcctt

SEQ ID NO: 2120 - DNA, 38 bp, Artificial Sequence
  Synthetic
tccttcttccacggcgccgcgagttacgctccttggag

SEQ ID NO: 2121 - DNA, 37 bp, Artificial Sequence
  Synthetic
tcgagctcgctggcgtgagaagctgtgtgacggtccc

SEQ ID NO: 2122 - DNA, 39 bp, Artificial Sequence
  Synthetic
acttgtaggcccggggaccccgatcgtaagccgcaatgt

SEQ ID NO: 2123 - DNA, 41 bp, Artificial Sequence
  Synthetic
cccacaccatcagcagcgtcttcctgagaggaggcttgtgt

SEQ ID NO: 2124 - DNA, 36 bp, Artificial Sequence
  Synthetic
cccccatcactctcccaggcctcgtttcggccccga

SEQ ID NO: 2125 - DNA, 39 bp, Artificial Sequence
  Synthetic
actcggcctggtctcggctgagtccgacaggaggtctcc

SEQ ID NO: 2126 - DNA, 38 bp, Artificial Sequence
  Synthetic
ccctgcgacccccttaaccctgtagttgagcggctcct

SEQ ID NO: 2127 - DNA, 36 bp, Artificial Sequence
  Synthetic
agcactcggcggggctttcttcgtcgcgtgacctgg

SEQ ID NO: 2128 - DNA, 40 bp, Artificial Sequence
  Synthetic
aattaggaaggcgctgggggcgggtgttccagtcatcggg

SEQ ID NO: 2129 - DNA, 39 bp, Artificial Sequence
  Synthetic
cgtccctggccacgaaggatttcagccagcatcttagca

SEQ ID NO: 2130 - DNA, 36 bp, Artificial Sequence
  Synthetic
gcaaccaggcccactgcaagacgcagttgctgacgc

SEQ ID NO: 2131 - DNA, 35 bp, Artificial Sequence
  Synthetic
agacccaccacctcgtgccgggcgtttgtcccacg

SEQ ID NO: 2132 - DNA, 38 bp, Artificial Sequence
  Synthetic
cggaagaggaggaggaggcggcggggggaggatgaaac

SEQ ID NO: 2133 - DNA, 38 bp, Artificial Sequence
  Synthetic
ggggtggtgaggatgcagctcctttatgcgctttgccg

SEQ ID NO: 2134 - DNA, 42 bp, Artificial Sequence
  Synthetic
cgttgcaggcctccttcaaaagttctctatcgtcaactgcgc

SEQ ID NO: 2135 - DNA, 37 bp, Artificial Sequence
  Synthetic
tcatccccctgcgtgtcggccaacatctgcctcccgc

SEQ ID NO: 2136 - DNA, 36 bp, Artificial Sequence
  Synthetic
tgtcaaccggccccgcaacgagtcccgctgagcaga

SEQ ID NO: 2137 - DNA, 35 bp, Artificial Sequence
  Synthetic
tgcggcagaggctaagcgcccgttgaggcccacgt

SEQ ID NO: 2138 - DNA, 38 bp, Artificial Sequence
  Synthetic
ctctccagtgcggtgttgctcaaggccagagacaccct

SEQ ID NO: 2139 - DNA, 35 bp, Artificial Sequence
  Synthetic
tctcgtcccacctggcggaacgtgtctgggaggcg

SEQ ID NO: 2140 - DNA, 38 bp, Artificial Sequence
  Synthetic
tcacgtccctggccgagctaaaagcctcggtctgctcc

SEQ ID NO: 2141 - DNA, 39 bp, Artificial Sequence
  Synthetic
accgcgttaacatctcggccagaactgggcctcgtggga

SEQ ID NO: 2142 - DNA, 39 bp, Artificial Sequence
  Synthetic
ggcttccgcctgttttgtttgtacgagagaacccgccac

SEQ ID NO: 2143 - DNA, 39 bp, Artificial Sequence
  Synthetic
cggagttgatgaaaggggccggatctcggccgttgtctc

SEQ ID NO: 2144 - DNA, 38 bp, Artificial Sequence
  Synthetic
aactccacgctgcgtccatcggggggtggcatatctga

SEQ ID NO: 2145 - DNA, 35 bp, Artificial Sequence
  Synthetic
agacgaggcacaggcacccctggctcgcctggagt

SEQ ID NO: 2146 - DNA, 38 bp, Artificial Sequence
  Synthetic
accggtgacaccaagtccatctgtcatgtcgggggcct

SEQ ID NO: 2147 - DNA, 41 bp, Artificial Sequence
  Synthetic
tgttcaggttttgctcaaggaaattggtttcagcaatcgga

SEQ ID NO: 2148 - DNA, 40 bp, Artificial Sequence
  Synthetic
cgccaaccaacacctccctctacaggcagcgtcttcagga

SEQ ID NO: 2149 - DNA, 38 bp, Artificial Sequence
  Synthetic
ggagtccggacagtttcatgctcgggcttcaggggcat

SEQ ID NO: 2150 - DNA, 41 bp, Artificial Sequence
  Synthetic
ggcagacatccgcgattacctttgtcgctgcagtactacga

SEQ ID NO: 2151 - DNA, 37 bp, Artificial Sequence
  Synthetic
tggccctgatcctgagccgggaagaggacgaggacga

SEQ ID NO: 2152 - DNA, 38 bp, Artificial Sequence
  Synthetic
tcacgtcctctaccccggcgcggggtcgaggaggtagt

SEQ ID NO: 2153 - DNA, 42 bp, Artificial Sequence
  Synthetic
cgtgtgctgcctggaacacaatgaggttcagggacttgtcct

SEQ ID NO: 2154 - DNA, 36 bp, Artificial Sequence
  Synthetic
actcgggagtctctggcccccatagctgcccctggt

SEQ ID NO: 2155 - DNA, 40 bp, Artificial Sequence
  Synthetic
accgtctatagcgcctttgggtccatgactgctgacccgc

SEQ ID NO: 2156 - DNA, 39 bp, Artificial Sequence
  Synthetic
cgcgcaggcttactttttgcatcatccggcaagcaccat

SEQ ID NO: 2157 - DNA, 42 bp, Artificial Sequence
  Synthetic
cagggggatctttacgtgggtgttcgtgccaaaccaaaaagg

SEQ ID NO: 2158 - DNA, 40 bp, Artificial Sequence
  Synthetic
acctgggcttatgcagacgagttcctctgaaggatgggcg

SEQ ID NO: 2159 - DNA, 39 bp, Artificial Sequence
  Synthetic
ggtggtctgccaaagctgctatcaacaggtgggggttgt

SEQ ID NO: 2160 - DNA, 40 bp, Artificial Sequence
  Synthetic
ctgcgaagagcgtcactgtgtgtagcagaatagggcccct

SEQ ID NO: 2161 - DNA, 36 bp, Artificial Sequence
  Synthetic
tgttcaacgcggtcaaggcctgcccatacctgcggg

SEQ ID NO: 2162 - DNA, 36 bp, Artificial Sequence
  Synthetic
tggttggggctgcttcccagtggccaggtggacgca

SEQ ID NO: 2163 - DNA, 37 bp, Artificial Sequence
  Synthetic
aactgcgagggggcctggtagaccctcgtgagacccg

SEQ ID NO: 2164 - DNA, 39 bp, Artificial Sequence
  Synthetic
acaggcaactacatggggccgtgtcggatctcggtccag

SEQ ID NO: 2165 - DNA, 36 bp, Artificial Sequence
  Synthetic
caacccggcagagctccaggtagcctgagccgcact

SEQ ID NO: 2166 - DNA, 42 bp, Artificial Sequence
  Synthetic
agcgtcccctgttaggtccttgcctaacagggtcatcgtcct

SEQ ID NO: 2167 - DNA, 39 bp, Artificial Sequence
  Synthetic
ggtcctaactggtcaggggcaagccggtcaacacgacat

SEQ ID NO: 2168 - DNA, 36 bp, Artificial Sequence
  Synthetic
agcagctggccccgaatcccaccagcccgttcacca

SEQ ID NO: 2169 - DNA, 37 bp, Artificial Sequence
  Synthetic
cctacacgaccgccaaggggcagaacgttgtcggtga

SEQ ID NO: 2170 - DNA, 38 bp, Artificial Sequence
  Synthetic
gttgagaccgtcctggcaggaagcggggtcttttggac

SEQ ID NO: 2171 - DNA, 39 bp, Artificial Sequence
  Synthetic
ttccccaggcagtcccagccgggacagattgtcttccac

SEQ ID NO: 2172 - DNA, 40 bp, Artificial Sequence
  Synthetic
cccggactcgttttacggactccccccttttccgcatcag

SEQ ID NO: 2173 - DNA, 40 bp, Artificial Sequence
  Synthetic
caacgggactgtcatggaaattattgccaaaacaacgtgt

SEQ ID NO: 2174 - DNA, 36 bp, Artificial Sequence
  Synthetic
gcggctgaacgtgactacccggcggtggacagcagt

SEQ ID NO: 2175 - DNA, 38 bp, Artificial Sequence
  Synthetic
atcctgccagcgggagaggcaaaagaccctccccacct

SEQ ID NO: 2176 - DNA, 36 bp, Artificial Sequence
  Synthetic
tggaggggggccaaagaggtaccacccccacccaca

SEQ ID NO: 2177 - DNA, 40 bp, Artificial Sequence
  Synthetic
caccagtttctttccgcggtggcgggaggacaccaaccct

SEQ ID NO: 2178 - DNA, 40 bp, Artificial Sequence
  Synthetic
ggcacaggagcgattaagtcctttctggagtgcctttcgc

SEQ ID NO: 2179 - DNA, 41 bp, Artificial Sequence
  Synthetic
tggccaacatgacttccgtcaaaggaaggcgctgtaggatt

SEQ ID NO: 2180 - DNA, 40 bp, Artificial Sequence
  Synthetic
cagatccacgaccgcatccagttttctcgcccccttcact

SEQ ID NO: 2181 - DNA, 36 bp, Artificial Sequence
  Synthetic
aggcgaccccatgatgcggggtgatgcggaccttgg

SEQ ID NO: 2182 - DNA, 37 bp, Artificial Sequence
  Synthetic
ggggtgacgaggatggaaaggccttgccgtgccctct

SEQ ID NO: 2183 - DNA, 39 bp, Artificial Sequence
  Synthetic
tggctcgctgctgtgacgcctggccatatcagggaagtc

SEQ ID NO: 2184 - DNA, 40 bp, Artificial Sequence
  Synthetic
cgagggtgccgcctttgagacagggtctgggtaaacaggt

SEQ ID NO: 2185 - DNA, 35 bp, Artificial Sequence
  Synthetic
tggcggtgccggtgaatccccagcctgccggactt

SEQ ID NO: 2186 - DNA, 35 bp, Artificial Sequence
  Synthetic
tggaggcctcgcacgagacgtcggcaaacaggggc

SEQ ID NO: 2187 - DNA, 40 bp, Artificial Sequence
  Synthetic
acaggaggtagcggtggggccacctccttgtcgtagagcg

SEQ ID NO: 2188 - DNA, 39 bp, Artificial Sequence
  Synthetic
cgctcctttgtggcatcaccgcctgtgcagagccttgac

SEQ ID NO: 2189 - DNA, 35 bp, Artificial Sequence
  Synthetic
tggtttgcgaggctgggccacgtcacggggaactg

SEQ ID NO: 2190 - DNA, 37 bp, Artificial Sequence
  Synthetic
gctcatcatcagcgtcctgcgctgagccgcgaccagt

SEQ ID NO: 2191 - DNA, 42 bp, Artificial Sequence
  Synthetic
gctacctcatgttcagggccatgcaaaggcaggtctttctca

SEQ ID NO: 2192 - DNA, 36 bp, Artificial Sequence
  Synthetic
cccttggtcacgcttggctgggctgaccccggcaaa

SEQ ID NO: 2193 - DNA, 43 bp, Artificial Sequence
  Synthetic
tgccaatatctaagttgccttagttgttttccgtttgctgcat

SEQ ID NO: 2194 - DNA, 42 bp, Artificial Sequence
  Synthetic
gctggcaaattgctcgtgacaaaaagacattgtcctgcagct

SEQ ID NO: 2195 - DNA, 47 bp, Artificial Sequence
  Synthetic
ttgccgtaccaattccatatatgattgttaaactccagtaatcgaag

SEQ ID NO: 2196 - DNA, 47 bp, Artificial Sequence
  Synthetic
tggtggttctattagcatgtttgttgtgtgctaaaaacagagatacc

SEQ ID NO: 2197 - DNA, 47 bp, Artificial Sequence
  Synthetic
gcatctttcacatatttggcttgactggctgatgtagatagtaatgc

SEQ ID NO: 2198 - DNA, 44 bp, Artificial Sequence
  Synthetic
aaccgtaataggctcatgcaaatgtttagtattttatgggcctg

SEQ ID NO: 2199 - DNA, 46 bp, Artificial Sequence
  Synthetic
gcacgtgttgccagtgtttaaagaactgtatgaaaaagatagtgac

SEQ ID NO: 2200 - DNA, 39 bp, Artificial Sequence
  Synthetic
attgcttaggcactgcgtcctatagcaacgaacgatgga

SEQ ID NO: 2201 - DNA, 42 bp, Artificial Sequence
  Synthetic
ggtgtcctgggtgctagacacagtacatgtgggttcaagggt

SEQ ID NO: 2202 - DNA, 41 bp, Artificial Sequence
  Synthetic
ggcctctatgcccttaggaataatgatagtgtggaacagcg

SEQ ID NO: 2203 - DNA, 44 bp, Artificial Sequence
  Synthetic
gctggttgtgtggtagtcacgtttctagcactatatatacaggc

SEQ ID NO: 2204 - DNA, 38 bp, Artificial Sequence
  Synthetic
tagtggcatgggaggtggaaggagcagatgttccagtg

SEQ ID NO: 2205 - DNA, 46 bp, Artificial Sequence
  Synthetic
acttgcctggcgaataggaaaatgctggtagttctagattacttac

SEQ ID NO: 2206 - DNA, 43 bp, Artificial Sequence
  Synthetic
gcattttcagtgtcattaagcttgtcggacagcctttaggaat

SEQ ID NO: 2207 - DNA, 39 bp, Artificial Sequence
  Synthetic
ccaagggaacgtcagacctatcacaggttttggggcaat

SEQ ID NO: 2208 - DNA, 43 bp, Artificial Sequence
  Synthetic
aaggcttgttaaacaactgtgacttctttatgcatccacacct

SEQ ID NO: 2209 - DNA, 43 bp, Artificial Sequence
  Synthetic
aagactagcagtaggaggtggtacatggatgctacattactgg

SEQ ID NO: 2210 - DNA, 40 bp, Artificial Sequence
  Synthetic
caccggacagggggggttattgcgtgtcatgtatgtgtgt

SEQ ID NO: 2211 - DNA, 43 bp, Artificial Sequence
  Synthetic
tgcacggtgagtaacacatgtattatgcctggcagttatttgg

SEQ ID NO: 2212 - DNA, 50 bp, Artificial Sequence
  Synthetic
ccaaactttgattcaccttttcctggtttctggtattgttagaaagatgg

SEQ ID NO: 2213 - DNA, 45 bp, Artificial Sequence
  Synthetic
cgacaaactctcttctgctaaaagagcctactgctgaaaatttgg

SEQ ID NO: 2214 - DNA, 43 bp, Artificial Sequence
  Synthetic
gctttattgcaatcctctgctaactacgatgcttcacagggaa

SEQ ID NO: 2215 - DNA, 50 bp, Artificial Sequence
  Synthetic
ggtaaccgtttctctactttttcctactgtaggattatatgctttaatgc

SEQ ID NO: 2216 - DNA, 50 bp, Artificial Sequence
  Synthetic
gtcatttggcgcatttcatatctttcaaagcaataatcaagctaaacatg

SEQ ID NO: 2217 - DNA, 43 bp, Artificial Sequence
  Synthetic
tgaaacagtttttgggttgggtattcgtatgcagcagaaacct

SEQ ID NO: 2218 - DNA, 40 bp, Artificial Sequence
  Synthetic
cttcgtcctccagctcgaagaccgccacaccttccacatc

SEQ ID NO: 2219 - DNA, 43 bp, Artificial Sequence
  Synthetic
gacgaaatccagtggcacccatttggcagtgttatttatttgg

SEQ ID NO: 2220 - DNA, 46 bp, Artificial Sequence
  Synthetic
gctatgtcttcttggccatgtagaaatgtatttgaggacttgtcca

SEQ ID NO: 2221 - DNA, 44 bp, Artificial Sequence
  Synthetic
tggtaatgcaccttttgtgtcaaagtttggtacgttttagcaga

SEQ ID NO: 2222 - DNA, 47 bp, Artificial Sequence
  Synthetic
tctacgtttcaataaagcaggatgtctaactctataccgtacacacc

SEQ ID NO: 2223 - DNA, 43 bp, Artificial Sequence
  Synthetic
acctgcttaggatccatactaagagccgatacagaaaatccca

SEQ ID NO: 2224 - DNA, 43 bp, Artificial Sequence
  Synthetic
cgctctgttaaatctacgttccaaaacgagatgtcctccagaa

SEQ ID NO: 2225 - DNA, 42 bp, Artificial Sequence
  Synthetic
aacacgcaggttatgttcaggatcttcctattgtgcaaagtc

SEQ ID NO: 2226 - DNA, 41 bp, Artificial Sequence
  Synthetic
cctcgccaaagcccagctattctgtgcagtgaggaaaagga

SEQ ID NO: 2227 - DNA, 41 bp, Artificial Sequence
  Synthetic
tctccaccaccagccttactgtcctacagaaccagcacagc

SEQ ID NO: 2228 - DNA, 42 bp, Artificial Sequence
  Synthetic
tccatccccgggatgcctactatagtgatgaggacgaggagg

SEQ ID NO: 2229 - DNA, 42 bp, Artificial Sequence
  Synthetic
gtcgcgtcaatatccacttgcgacgtagactgtttgagctgc

SEQ ID NO: 2230 - DNA, 41 bp, Artificial Sequence
  Synthetic
tgacaccctctgcaactgtgaaaagtaataggaccacgtgt

SEQ ID NO: 2231 - DNA, 45 bp, Artificial Sequence
  Synthetic
ccaattatttcactagcattgcccaccaaaataagacatccagcg

SEQ ID NO: 2232 - DNA, 42 bp, Artificial Sequence
  Synthetic
tgctctgcccgtttgtaatggccaagcaaaatatgtaaagga

SEQ ID NO: 2233 - DNA, 44 bp, Artificial Sequence
  Synthetic
gtggagttggcataggaaatcaatacttttgtatgagcctgttg

SEQ ID NO: 2234 - DNA, 44 bp, Artificial Sequence
  Synthetic
acaggaaatgcattaggaaaggtaatagaggaagacaggtggaa

SEQ ID NO: 2235 - DNA, 43 bp, Artificial Sequence
  Synthetic
tcatcatcaccgctttgtacatatacgttaagtttgatggcga

SEQ ID NO: 2236 - DNA, 36 bp, Artificial Sequence
  Synthetic
ccgagtcgctgacgcttatgcaacccgacgccacca

SEQ ID NO: 2237 - DNA, 43 bp, Artificial Sequence
  Synthetic
gccaggtggaggttactttgttaaggtatagattgcacaaaca

SEQ ID NO: 2238 - DNA, 46 bp, Artificial Sequence
  Synthetic
ggaaggatagacagccaaaagaagaagtgtggagacctttatttgc

SEQ ID NO: 2239 - DNA, 40 bp, Artificial Sequence
  Synthetic
cccccccatctctatcacgtacttgtgttgtagtgtgcaa

SEQ ID NO: 2240 - DNA, 39 bp, Artificial Sequence
  Synthetic
gggatgtatccagtgcgcccattctttgggggtttgggc

SEQ ID NO: 2241 - DNA, 45 bp, Artificial Sequence
  Synthetic
caggattgtcataggtaacaagtgtccaacaagtacatgtacagg

SEQ ID NO: 2242 - DNA, 44 bp, Artificial Sequence
  Synthetic
cactatagggttttttcctgattgcttcccgactgttaactgtt

SEQ ID NO: 2243 - DNA, 43 bp, Artificial Sequence
  Synthetic
ccatagtaagattgtcccgggtgtgacactgaaaacaccaatt

SEQ ID NO: 2244 - DNA, 44 bp, Artificial Sequence
  Synthetic
caccatatggctcagctgccgatgtgcctttagatattgtaacc

SEQ ID NO: 2245 - DNA, 41 bp, Artificial Sequence
  Synthetic
gcagataccattgttagggccatcccagttgtttaacaagc

SEQ ID NO: 2246 - DNA, 40 bp, Artificial Sequence
  Synthetic
aaggaacccgtgtacagacacccaaacgttcctaagcatg

SEQ ID NO: 2247 - DNA, 40 bp, Artificial Sequence
  Synthetic
ccgaaatcggtccgggggtagtggtgtcctgtatgtgacc

SEQ ID NO: 2248 - DNA, 40 bp, Artificial Sequence
  Synthetic
cgccatggctagacgctttctgccatgaatcactcccctg

SEQ ID NO: 2249 - DNA, 41 bp, Artificial Sequence
  Synthetic
cggcaacaagtatactccgccaaagaaacaccaaccgtcgc

SEQ ID NO: 2250 - DNA, 37 bp, Artificial Sequence
  Synthetic
gtaccccatgaggtcggcaaagtcgcgcaacgtgggt

SEQ ID NO: 2251 - DNA, 39 bp, Artificial Sequence
  Synthetic
ccggtatccagcactgagatgcgctgctgtcctccacgt

SEQ ID NO: 2252 - DNA, 42 bp, Artificial Sequence
  Synthetic
cccaatgagccccgctaatgatcacggctaccatgatcttgg

SEQ ID NO: 2253 - DNA, 40 bp, Artificial Sequence
  Synthetic
tcgggacatcctgacgagttgaccttgcacaccggcttta

SEQ ID NO: 2254 - DNA, 39 bp, Artificial Sequence
  Synthetic
gctctagtacggcagggtggtgtcatggttcggctgcac

SEQ ID NO: 2255 - DNA, 40 bp, Artificial Sequence
  Synthetic
cgtggtggagtgcaacaaaggattcactcgtggggatcgt

SEQ ID NO: 2256 - DNA, 40 bp, Artificial Sequence
  Synthetic
cccttgatgtaccaagcagccacagctagctgcaatggct

SEQ ID NO: 2257 - DNA, 39 bp, Artificial Sequence
  Synthetic
gtaagcaggcccaagcaccgccgtcgccatattctaccc

SEQ ID NO: 2258 - DNA, 40 bp, Artificial Sequence
  Synthetic
gaggacctcccgaccaagtcgagacagctgcttgtgggga

SEQ ID NO: 2259 - DNA, 38 bp, Artificial Sequence
  Synthetic
cgtgagccggccagagtctttctcgggggttttgtgga

SEQ ID NO: 2260 - DNA, 42 bp, Artificial Sequence
  Synthetic
caggtggtgtgctgttgtcacttttcatccccgttgagacac

SEQ ID NO: 2261 - DNA, 42 bp, Artificial Sequence
  Synthetic
ccacggcatggcattcatcacaatatggcaaattcctcgccg

SEQ ID NO: 2262 - DNA, 40 bp, Artificial Sequence
  Synthetic
cgaccactacgtctccctgagttcggggtatgggcttgaa

SEQ ID NO: 2263 - DNA, 42 bp, Artificial Sequence
  Synthetic
ggtctccgatggtgtgagctcagtgtagtgctctgtgagtgc

SEQ ID NO: 2264 - DNA, 38 bp, Artificial Sequence
  Synthetic
cacgggatgtgtgagggtgaccacactcgtgggcccca

SEQ ID NO: 2265 - DNA, 40 bp, Artificial Sequence
  Synthetic
gcctgcacagtgggttgtatgtgccgagatgctgaagtcc

SEQ ID NO: 2266 - DNA, 41 bp, Artificial Sequence
  Synthetic
cgacgagagcccccgaaatgcaggtaaggtgctagtggaca

SEQ ID NO: 2267 - DNA, 40 bp, Artificial Sequence
  Synthetic
cactggccctccgtgtaacaatcatgagaatcacggggcc

SEQ ID NO: 2268 - DNA, 39 bp, Artificial Sequence
  Synthetic
gcagtctccgccgtgatatgagcagcttccttgcgaccc

SEQ ID NO: 2269 - DNA, 41 bp, Artificial Sequence
  Synthetic
ccggtaaagctggtgggaacccgaccttgagccttcgatac

SEQ ID NO: 2270 - DNA, 39 bp, Artificial Sequence
  Synthetic
tccaagctccccctcgaggcctgatgagttggccctttc

SEQ ID NO: 2271 - DNA, 42 bp, Artificial Sequence
  Synthetic
ggaggccgctagcttaatgtcctgataggatgcaagtgctcg

SEQ ID NO: 2272 - DNA, 40 bp, Artificial Sequence
  Synthetic
ccatcaccgcctgaggaagttttttaccctgacctcggcg

SEQ ID NO: 2273 - DNA, 42 bp, Artificial Sequence
  Synthetic
ccctgcagctttacaagccgctggtgctcaccactagcatgg

SEQ ID NO: 2274 - DNA, 42 bp, Artificial Sequence
  Synthetic
gtggtagggtctctggtcaggttcctcaaatgtgtctgtggc

SEQ ID NO: 2275 - DNA, 42 bp, Artificial Sequence
  Synthetic
ccccaagttttctgagggctgactctgcacacatacactccc

SEQ ID NO: 2276 - DNA, 38 bp, Artificial Sequence
  Synthetic
caggctgcataggcaaggcggttgagggcagccagttg

SEQ ID NO: 2277 - DNA, 39 bp, Artificial Sequence
  Synthetic
gcacgggcaactaccaccaagcggtaatgaggccgaagt

SEQ ID NO: 2278 - DNA, 40 bp, Artificial Sequence
  Synthetic
acgtcaaaggctgccaccagtcttcgtcaacggtcaagtc

SEQ ID NO: 2279 - DNA, 41 bp, Artificial Sequence
  Synthetic
gctccgaccgaacaacaaccaagaggatgcggttttgttcg

SEQ ID NO: 2280 - DNA, 40 bp, Artificial Sequence
  Synthetic
aacagtaccgacaagcccggcgaaaagaaaatcgccctcc

SEQ ID NO: 2281 - DNA, 40 bp, Artificial Sequence
  Synthetic
ccttggctttgcagcttggctggacggcttggattttcag

SEQ ID NO: 2282 - DNA, 40 bp, Artificial Sequence
  Synthetic
gaccgcgccccagtatttcgatgtcgcccaagttttcaga

SEQ ID NO: 2283 - DNA, 38 bp, Artificial Sequence
  Synthetic
cgcgcagtttgccgttgacttgacgaagccgccctggt

SEQ ID NO: 2284 - DNA, 38 bp, Artificial Sequence
  Synthetic
ggcgttaaaaagccgagcggggcttcgatgcccttgtt

SEQ ID NO: 2285 - DNA, 37 bp, Artificial Sequence
  Synthetic
cccgaatggcagatacaggcacggctgccgtcttggt

SEQ ID NO: 2286 - DNA, 37 bp, Artificial Sequence
  Synthetic
attggcacgccgatccgcccgaacaggcggtatttgc

SEQ ID NO: 2287 - DNA, 39 bp, Artificial Sequence
  Synthetic
tcgggctgcccatgaccctttgttgcgatgtgatgacgc

SEQ ID NO: 2288 - DNA, 40 bp, Artificial Sequence
  Synthetic
cgcgcggcagttgatacaggcgggttctgccttttcaaac

SEQ ID NO: 2289 - DNA, 38 bp, Artificial Sequence
  Synthetic
gccgccaaaggcaaaggacgaggcggacaccttgttgc

SEQ ID NO: 2290 - DNA, 42 bp, Artificial Sequence
  Synthetic
gcccatttgtaaccggttctgcacaatttcagccacaactgc

SEQ ID NO: 2291 - DNA, 35 bp, Artificial Sequence
  Synthetic
aacggcggcctgattaccgcacaccagcgcaccga

SEQ ID NO: 2292 - DNA, 39 bp, Artificial Sequence
  Synthetic
agttgccgcacctgccctcgcaagataaaccacgtcgcc

SEQ ID NO: 2293 - DNA, 38 bp, Artificial Sequence
  Synthetic
gaatcggggcgaactcgggttccaatgcctgcgtttca

SEQ ID NO: 2294 - DNA, 37 bp, Artificial Sequence
  Synthetic
cgccagttgaccgaatcgggaactcttgccgcgttcc

SEQ ID NO: 2295 - DNA, 38 bp, Artificial Sequence
  Synthetic
cgcaaagactaccgcagcaacgtcagcggtgcaggcga

SEQ ID NO: 2296 - DNA, 36 bp, Artificial Sequence
  Synthetic
acttcctcgaccgcctcgcgtaacgcgcaaaccccg

SEQ ID NO: 2297 - DNA, 42 bp, Artificial Sequence
  Synthetic
gcatcctgctcgacaacatcctaggttttgtggacataggcg

SEQ ID NO: 2298 - DNA, 38 bp, Artificial Sequence
  Synthetic
cgaggctttgggcttgggtccttttgggcggcaggacg

SEQ ID NO: 2299 - DNA, 41 bp, Artificial Sequence
  Synthetic
gtccgcaacaaaatcgccctggttcatgttcgtgccttccg

SEQ ID NO: 2300 - DNA, 38 bp, Artificial Sequence
  Synthetic
agacattgccctccccgagggttttccagtgcgaacgc

SEQ ID NO: 2301 - DNA, 34 bp, Artificial Sequence
  Synthetic
acggcggcgaagagaaaggtttcttgggcgcggc

SEQ ID NO: 2302 - DNA, 35 bp, Artificial Sequence
  Synthetic
ttggcgttggctcaggcgggcatcggacggcaaag

SEQ ID NO: 2303 - DNA, 38 bp, Artificial Sequence
  Synthetic
ggcaatttgttcggcaatggcgcgaagctgcgttgggc

SEQ ID NO: 2304 - DNA, 35 bp, Artificial Sequence
  Synthetic
tcgaagatgcctgcgccgcataccgggttcgccga

SEQ ID NO: 2305 - DNA, 36 bp, Artificial Sequence
  Synthetic
ccgacaccatccgcctgatggcacgcctgccgctat

SEQ ID NO: 2306 - DNA, 34 bp, Artificial Sequence
  Synthetic
cgtgtgcatcggtcctgccttcggcggcggcaat

SEQ ID NO: 2307 - DNA, 38 bp, Artificial Sequence
  Synthetic
tgccgctcgccaaagtcggcgccttgttctttcaggga

SEQ ID NO: 2308 - DNA, 38 bp, Artificial Sequence
  Synthetic
ttggaaatcgtccgcaccgagggtttgaccgccgtaat

SEQ ID NO: 2309 - DNA, 38 bp, Artificial Sequence
  Synthetic
cgcctgaccatgctgttgcgccgcacctgtcagaatcg

SEQ ID NO: 2310 - DNA, 41 bp, Artificial Sequence
  Synthetic
cgccgatgccgtacaagaaaccatggacagatggatgtgcg

SEQ ID NO: 2311 - DNA, 38 bp, Artificial Sequence
  Synthetic
agtcgcgcccgtcgacaaagaaaatcaccgccatcagc

SEQ ID NO: 2312 - DNA, 37 bp, Artificial Sequence
  Synthetic
gcgcaggtggggcaggtaatcgccttaagccttgccg

SEQ ID NO: 2313 - DNA, 39 bp, Artificial Sequence
  Synthetic
gctgttttcgggcatctggctgaacacctgccccggtat

SEQ ID NO: 2314 - DNA, 37 bp, Artificial Sequence
  Synthetic
ccgatcataccggtcgcgccattgcgccgcttccaac

SEQ ID NO: 2315 - DNA, 38 bp, Artificial Sequence
  Synthetic
ccgatttccaaaaccgcgcctgctgcaaggctacgact

SEQ ID NO: 2316 - DNA, 39 bp, Artificial Sequence
  Synthetic
acggcagggcggggttttgtcgttttcgaaccccaaccc

SEQ ID NO: 2317 - DNA, 41 bp, Artificial Sequence
  Synthetic
cctgtcgctcggtaaatcagcgaatcgaacacagctacgcc

SEQ ID NO: 2318 - DNA, 37 bp, Artificial Sequence
  Synthetic
actgcttcgcgcgcttcgaaaaagccgaagccgaact

SEQ ID NO: 2319 - DNA, 38 bp, Artificial Sequence
  Synthetic
gcgttcttccctgcgtttgctgcctgcctcaacatcgg

SEQ ID NO: 2320 - DNA, 37 bp, Artificial Sequence
  Synthetic
tcgagcgggcaggctgaaatcaggcagtcggcgcagt

SEQ ID NO: 2321 - DNA, 37 bp, Artificial Sequence
  Synthetic
accgcgccatgctcttggcgcgttggcggctttttgg

SEQ ID NO: 2322 - DNA, 41 bp, Artificial Sequence
  Synthetic
cgcctcgcccgtatccatgtacgaacttcaccaaacccacg

SEQ ID NO: 2323 - DNA, 35 bp, Artificial Sequence
  Synthetic
ccgcagcattcccacgactccttttgggcgagccg

SEQ ID NO: 2324 - DNA, 40 bp, Artificial Sequence
  Synthetic
gcgcgtgaacacggcattcctaatgttggggaacggcatt

SEQ ID NO: 2325 - DNA, 36 bp, Artificial Sequence
  Synthetic
actctccgccctgctcgacctcgcggattgcctgct

SEQ ID NO: 2326 - DNA, 37 bp, Artificial Sequence
  Synthetic
ggctgaaaaacgccgtcgaacttcagcgtcgggtgca

SEQ ID NO: 2327 - DNA, 42 bp, Artificial Sequence
  Synthetic
ccatgctgaacaccgccctttcaaacggcatcggcttcttct

SEQ ID NO: 2328 - DNA, 42 bp, Artificial Sequence
  Synthetic
tcaagacagaaagctcctgccgtgtgcatataaagcggcagg

SEQ ID NO: 2329 - DNA, 40 bp, Artificial Sequence
  Synthetic
cgctgttttacacgctgaccgacgatcggacgcgttttgc

SEQ ID NO: 2330 - DNA, 36 bp, Artificial Sequence
  Synthetic
tgctgcactttccggcgaacaaggtttgccagcgcg

SEQ ID NO: 2331 - DNA, 41 bp, Artificial Sequence
  Synthetic
gggactgacggtgtcggtattgcggcatagtattcgcggac

SEQ ID NO: 2332 - DNA, 35 bp, Artificial Sequence
  Synthetic
aagctgcgcggtgctgaccgacgttgagccgggga

SEQ ID NO: 2333 - DNA, 39 bp, Artificial Sequence
  Synthetic
cctccgcaacgacctgacctcaatctgttcgggtgtcag

SEQ ID NO: 2334 - DNA, 36 bp, Artificial Sequence
  Synthetic
cgtgcgcgcctaccagattccttgcgaggctttgcg

SEQ ID NO: 2335 - DNA, 39 bp, Artificial Sequence
  Synthetic
tatggctgcacggcgaggcccagttgttcggacaaacgc

SEQ ID NO: 2336 - DNA, 42 bp, Artificial Sequence
  Synthetic
ggcacatttttcacgcttgccatgcttttgtcttcttcgccc

SEQ ID NO: 2337 - DNA, 41 bp, Artificial Sequence
  Synthetic
cccagcagtttcgccgttttgtctacgagcttttgggcgag

SEQ ID NO: 2338 - DNA, 36 bp, Artificial Sequence
  Synthetic
tgaccgccatgtacaagccgctgcccgcctgcatga

SEQ ID NO: 2339 - DNA, 38 bp, Artificial Sequence
  Synthetic
cgccgtttatgacgcccccaaggcgcgcaccataacca

SEQ ID NO: 2340 - DNA, 38 bp, Artificial Sequence
  Synthetic
gctcgcgcgaaaacttaaaccacgttttcaggcggccc

SEQ ID NO: 2341 - DNA, 37 bp, Artificial Sequence
  Synthetic
gcctgccggggctacatcactggagctgttcgtcggt

SEQ ID NO: 2342 - DNA, 37 bp, Artificial Sequence
  Synthetic
gtcccgaaagccgctgcacgaaatccgtgtcgatgca

SEQ ID NO: 2343 - DNA, 34 bp, Artificial Sequence
  Synthetic
ggcaaggtgcggcagcttcgctgcacgacacgct

SEQ ID NO: 2344 - DNA, 39 bp, Artificial Sequence
  Synthetic
cgatgacggtggtggcaaccaaaaggccgaagtcatggc

SEQ ID NO: 2345 - DNA, 39 bp, Artificial Sequence
  Synthetic
atcagcatcggggcggtttcgccaagctcgaagaagact

SEQ ID NO: 2346 - DNA, 35 bp, Artificial Sequence
  Synthetic
acacccgaaacccgcagcgcgcctgacggatgctg

SEQ ID NO: 2347 - DNA, 35 bp, Artificial Sequence
  Synthetic
gcttcaggacggcatcgccgcgtatcatcggcgcg

SEQ ID NO: 2348 - DNA, 35 bp, Artificial Sequence
  Synthetic
ccgccgacttccgcatacggcgtgggtcatgccgt

SEQ ID NO: 2349 - DNA, 37 bp, Artificial Sequence
  Synthetic
actttccaagtctgcgcggcaaacctgcctcgtcggg

SEQ ID NO: 2350 - DNA, 38 bp, Artificial Sequence
  Synthetic
ggagtagcgttgggattcgctctcggcaaagaacgtac

SEQ ID NO: 2351 - DNA, 38 bp, Artificial Sequence
  Synthetic
ttccgacccattctccggagatttcggcggcacagaag

SEQ ID NO: 2352 - DNA, 42 bp, Artificial Sequence
  Synthetic
ggtaggatgcggatttcctgcttttggaactgtggccaaaca

SEQ ID NO: 2353 - DNA, 42 bp, Artificial Sequence
  Synthetic
gcccacgtcgtttatccgcaagtgtttgagccagatttcgga

SEQ ID NO: 2354 - DNA, 41 bp, Artificial Sequence
  Synthetic
gcaactgccttatgccctgacgagacccaatgcgaggtagc

SEQ ID NO: 2355 - DNA, 40 bp, Artificial Sequence
  Synthetic
tatgctgccgattgccgccgatacacgggataatcagcgc

SEQ ID NO: 2356 - DNA, 38 bp, Artificial Sequence
  Synthetic
cgcccatgtgcgtgctgatcaagcgtggcgataatcga

SEQ ID NO: 2357 - DNA, 37 bp, Artificial Sequence
  Synthetic
cgtcgacggtctgacacacctaatcgccgtctgccca

SEQ ID NO: 2358 - DNA, 41 bp, Artificial Sequence
  Synthetic
gcaaatatacagccgcagcggttcatggcaacgtcaatcgg

SEQ ID NO: 2359 - DNA, 39 bp, Artificial Sequence
  Synthetic
tttccggttgccgatacgcctgtattccatcacgccgtc

SEQ ID NO: 2360 - DNA, 40 bp, Artificial Sequence
  Synthetic
gccattaccgccgaaccgagacctgtcgttttattggggc

SEQ ID NO: 2361 - DNA, 39 bp, Artificial Sequence
  Synthetic
cggtattcctgagcgtcggatccgtttggcgcaggttgg

SEQ ID NO: 2362 - DNA, 38 bp, Artificial Sequence
  Synthetic
cggcttggacgttgcacactttgggcgcaggtcatcga

SEQ ID NO: 2363 - DNA, 36 bp, Artificial Sequence
  Synthetic
cgcgccctatcatgatgccgccgcaaaaagccgccg

SEQ ID NO: 2364 - DNA, 38 bp, Artificial Sequence
  Synthetic
acggcggcatggcaatactgaaaaaccgaccgttgggc

SEQ ID NO: 2365 - DNA, 36 bp, Artificial Sequence
  Synthetic
gaccaaagccgccaatgccaatccggcatcgacgct

SEQ ID NO: 2366 - DNA, 35 bp, Artificial Sequence
  Synthetic
agcttgcccggaaagccgcgccgagggcgaatgtg

SEQ ID NO: 2367 - DNA, 36 bp, Artificial Sequence
  Synthetic
gcaggtcgtcgtcgctgtacctgctgcgcgggttca

SEQ ID NO: 2368 - DNA, 39 bp, Artificial Sequence
  Synthetic
tctgcctgtccctcagcgccctatcaggctcatacggcg

SEQ ID NO: 2369 - DNA, 41 bp, Artificial Sequence
  Synthetic
ccgtctgcaagcctacgaaggagttgctgttcaaaccacgg

SEQ ID NO: 2370 - DNA, 36 bp, Artificial Sequence
  Synthetic
ccacgttggcacgcctgtggcatcccttgccgtcca

SEQ ID NO: 2371 - DNA, 40 bp, Artificial Sequence
  Synthetic
cgcaagaacacaggcaaagcccggcactctgcatttttgc

SEQ ID NO: 2372 - DNA, 39 bp, Artificial Sequence
  Synthetic
cgctttgccgaactcgacggggatgacggtcagtgtgtg

SEQ ID NO: 2373 - DNA, 37 bp, Artificial Sequence
  Synthetic
aaatcccgccctgctcgccttggacggcgttatgggt

SEQ ID NO: 2374 - DNA, 35 bp, Artificial Sequence
  Synthetic
ctgaccggcacacccacacgcgggcaagctgacgt

SEQ ID NO: 2375 - DNA, 35 bp, Artificial Sequence
  Synthetic
acgccgacgacctcgaagctcgggacaggggtgga

SEQ ID NO: 2376 - DNA, 41 bp, Artificial Sequence
  Synthetic
ccaaaaccgccgtcctacaccaggattgcgctgaacagcct

SEQ ID NO: 2377 - DNA, 39 bp, Artificial Sequence
  Synthetic
caacagcatctccgtcagcgactttgacggatgcctggc

SEQ ID NO: 2378 - DNA, 42 bp, Artificial Sequence
  Synthetic
gccatattcgcaggattgctgccgggggaaaaggagttaacc

SEQ ID NO: 2379 - DNA, 37 bp, Artificial Sequence
  Synthetic
ccgacaaagaccgcgcatggtgtacgacaggtgcggc

SEQ ID NO: 2380 - DNA, 38 bp, Artificial Sequence
  Synthetic
catcacccgcatcggtttcaacctgcaaccggggatgc

SEQ ID NO: 2381 - DNA, 42 bp, Artificial Sequence
  Synthetic
gctatcggagttggaccaggtgcgggttttttgacggttcag

SEQ ID NO: 2382 - DNA, 37 bp, Artificial Sequence
  Synthetic
agccggcggattctgcctgtcggcaatggcatgcatg

SEQ ID NO: 2383 - DNA, 36 bp, Artificial Sequence
  Synthetic
accccggggcaaaccatccgcgcaatgcctgctcga

SEQ ID NO: 2384 - DNA, 43 bp, Artificial Sequence
  Synthetic
tccattatttaccaattcctcaccggacgttactttgcgccaa

SEQ ID NO: 2385 - DNA, 37 bp, Artificial Sequence
  Synthetic
cgccgctacgccatcaacgttgaccgatggcacgacc

SEQ ID NO: 2386 - DNA, 38 bp, Artificial Sequence
  Synthetic
ggcgaacccaaacccagcatcacgggtcggcgtggatt

SEQ ID NO: 2387 - DNA, 40 bp, Artificial Sequence
  Synthetic
gggaaatctttacccacggcggatttcgaccgcccattcc

SEQ ID NO: 2388 - DNA, 37 bp, Artificial Sequence
  Synthetic
acgcaccgttgccgacattgatgctgactttgtccgc

SEQ ID NO: 2389 - DNA, 34 bp, Artificial Sequence
  Synthetic
agcaggcgcgattaccggctgctgcgcttgggca

SEQ ID NO: 2390 - DNA, 35 bp, Artificial Sequence
  Synthetic
acgtcttgagcgtcggcccccgcgagacaggtcgt

SEQ ID NO: 2391 - DNA, 41 bp, Artificial Sequence
  Synthetic
ggcacaccaattgaaccttgccaaaccttccaatacgcccg

SEQ ID NO: 2392 - DNA, 40 bp, Artificial Sequence
  Synthetic
cgacgcactggtcggcaaaggatgccttcgatgacgaggt

SEQ ID NO: 2393 - DNA, 39 bp, Artificial Sequence
  Synthetic
cgacagcgcatcgaagccatgggatagcgtccggcaagt

SEQ ID NO: 2394 - DNA, 38 bp, Artificial Sequence
  Synthetic
gctgaccgccgacgatgtcgtccgatgtgtattcccaa

SEQ ID NO: 2395 - DNA, 37 bp, Artificial Sequence
  Synthetic
accggttgccgccaaaaaaggtaaacgacgacgcgcg

SEQ ID NO: 2396 - DNA, 39 bp, Artificial Sequence
  Synthetic
gcgtcaaccgtatgccgctccgctgaatcggataggtcg

SEQ ID NO: 2397 - DNA, 38 bp, Artificial Sequence
  Synthetic
aaacccaagcccgaagacgcggggtgaggatgtagcgt

SEQ ID NO: 2398 - DNA, 36 bp, Artificial Sequence
  Synthetic
tcctacggctggttcggcttgcctgttggacgggga

SEQ ID NO: 2399 - DNA, 36 bp, Artificial Sequence
  Synthetic
tcggcggcattgcccgatccggattcaaacgcgcca

SEQ ID NO: 2400 - DNA, 38 bp, Artificial Sequence
  Synthetic
gatgggttggttcgatgccgttggaaaacccgcccagc

SEQ ID NO: 2401 - DNA, 39 bp, Artificial Sequence
  Synthetic
ccttgccgtcgccatcctgtcggctttgaataactgcgt

SEQ ID NO: 2402 - DNA, 38 bp, Artificial Sequence
  Synthetic
tacgccttttcggacggcgccggaaagggtaacggtcg

SEQ ID NO: 2403 - DNA, 35 bp, Artificial Sequence
  Synthetic
aactgaccgcgctgctcggccgtcagccagagggt

SEQ ID NO: 2404 - DNA, 39 bp, Artificial Sequence
  Synthetic
accgactacgtcgtcgccgcaaggcattggctttttcca

SEQ ID NO: 2405 - DNA, 40 bp, Artificial Sequence
  Synthetic
gctccataagccctaccgcctgtcgcgttcgatttcgctg

SEQ ID NO: 2406 - DNA, 39 bp, Artificial Sequence
  Synthetic
cgatgccgaatacgaccgccctcgggatggtttcgttcc

SEQ ID NO: 2407 - DNA, 39 bp, Artificial Sequence
  Synthetic
ccgcactggacgcattctgcggtcggcgaaaccaaatgg

SEQ ID NO: 2408 - DNA, 35 bp, Artificial Sequence
  Synthetic
ccatcccgggcatccgctacgttgcggctgactgc

SEQ ID NO: 2409 - DNA, 41 bp, Artificial Sequence
  Synthetic
gcgttttccatcggcatcgaaccgaacggtattgcgcttcg

SEQ ID NO: 2410 - DNA, 42 bp, Artificial Sequence
  Synthetic
ggaaaagctgtttgccaaccggtgcaaagtgtgtatcaggct

SEQ ID NO: 2411 - DNA, 38 bp, Artificial Sequence
  Synthetic
ccgatacgcgccatcgatacttggtttgcgccccgatt

SEQ ID NO: 2412 - DNA, 41 bp, Artificial Sequence
  Synthetic
acggaacagcagcaaaggctcatgtattgaatgccgcgagc

SEQ ID NO: 2413 - DNA, 39 bp, Artificial Sequence
  Synthetic
cgcgcagttgttccagcgatcgctatgccgaaatgagcg

SEQ ID NO: 2414 - DNA, 41 bp, Artificial Sequence
  Synthetic
caccctgtacgaaacgctcgctgaattccgctttatcggcg

SEQ ID NO: 2415 - DNA, 40 bp, Artificial Sequence
  Synthetic
gccataatgcgcgctttgtaggccaacctcaaaccgccag

SEQ ID NO: 2416 - DNA, 37 bp, Artificial Sequence
  Synthetic
tcggcggtggtgatgtgttcaacccgttttggcgcaa

SEQ ID NO: 2417 - DNA, 37 bp, Artificial Sequence
  Synthetic
ggtaacggcggcgaccaatgtttctgcctgcccgtcc

SEQ ID NO: 2418 - DNA, 36 bp, Artificial Sequence
  Synthetic
tccatcgcgtccgccagtatgggcgggcgagttgaa

SEQ ID NO: 2419 - DNA, 36 bp, Artificial Sequence
  Synthetic
acatccacaccgccgagcgttcaaaccgaccaccgc

SEQ ID NO: 2420 - DNA, 38 bp, Artificial Sequence
  Synthetic
gcggaagcggtcgacgtatctggcggggtcttttttgc

SEQ ID NO: 2421 - DNA, 41 bp, Artificial Sequence
  Synthetic
ggcaggaaatcctatgccgtcgcaaatcgtaggcaagcgca

SEQ ID NO: 2422 - DNA, 34 bp, Artificial Sequence
  Synthetic
ggaaaccgccgccgacaacggcggcagaaggctt

SEQ ID NO: 2423 - DNA, 38 bp, Artificial Sequence
  Synthetic
tgccggtggacattggtgcagcgtccgggattttcaac

SEQ ID NO: 2424 - DNA, 39 bp, Artificial Sequence
  Synthetic
cctgcatcagatagctgcggaaccgcgccgattacttcg

SEQ ID NO: 2425 - DNA, 41 bp, Artificial Sequence
  Synthetic
cggcgcgaatttaaacggaaattggacgacctgataacaag

SEQ ID NO: 2426 - DNA, 43 bp, Artificial Sequence
  Synthetic
atccccaatatgccgtcagcattggccgtaataaaaagtatgg

SEQ ID NO: 2427 - DNA, 34 bp, Artificial Sequence
  Synthetic
tgggacagctcggggcaaggcaactggacgggga

SEQ ID NO: 2428 - DNA, 38 bp, Artificial Sequence
  Synthetic
ctcgcgcatatggacgcggtacatcgaatgctcgctcg

SEQ ID NO: 2429 - DNA, 38 bp, Artificial Sequence
  Synthetic
gcgtctgcctcgatacccaaacggcggctttgccccaa

SEQ ID NO: 2430 - DNA, 35 bp, Artificial Sequence
  Synthetic
tccacgcgcctgccagttgcgcaaaccgccgttgc

SEQ ID NO: 2431 - DNA, 36 bp, Artificial Sequence
  Synthetic
tgaggctgttgcggacggatattcggcttgccgctg

SEQ ID NO: 2432 - DNA, 36 bp, Artificial Sequence
  Synthetic
ttcaagacgacggcggactgtcggcagatacgccgt

SEQ ID NO: 2433 - DNA, 38 bp, Artificial Sequence
  Synthetic
tccatcgcgcgcggctatccttcctgaatcaggtcggc

SEQ ID NO: 2434 - DNA, 38 bp, Artificial Sequence
  Synthetic
gcctgcttccggccattctgatcggtttgttgggcggt

SEQ ID NO: 2435 - DNA, 35 bp, Artificial Sequence
  Synthetic
acgacgtttccggcctgccaaggtaggcgggcagc

SEQ ID NO: 2436 - DNA, 36 bp, Artificial Sequence
  Synthetic
ggtgtacggaatcgtcgccgggcgcatcagcagcat

SEQ ID NO: 2437 - DNA, 40 bp, Artificial Sequence
  Synthetic
ttcggttcgggcttgttgggaacgacgattcctgtgatgg

SEQ ID NO: 2438 - DNA, 37 bp, Artificial Sequence
  Synthetic
tggcgcacggcatcgatatgtccagccgttgcgtgca

SEQ ID NO: 2439 - DNA, 39 bp, Artificial Sequence
  Synthetic
tttccgtggcgatgtcgtaagcaaaaatggttatcggcc

SEQ ID NO: 2440 - DNA, 41 bp, Artificial Sequence
  Synthetic
ttgacggccttccattttggaaaagaagatttggctgaagt

SEQ ID NO: 2441 - DNA, 45 bp, Artificial Sequence
  Synthetic
ccctttggatattgcgctcaatttaaaaagcggtaataaagggaa

SEQ ID NO: 2442 - DNA, 39 bp, Artificial Sequence
  Synthetic
cacagcattcccggggtgtcccgaacaacgccttttcct

SEQ ID NO: 2443 - DNA, 42 bp, Artificial Sequence
  Synthetic
cctcaggcaaatacgcggacaaacgcagttgttcggaaaacg

SEQ ID NO: 2444 - DNA, 41 bp, Artificial Sequence
  Synthetic
tgccgtctgaagcaccgtttgaggttgatgctgtcgaactg

SEQ ID NO: 2445 - DNA, 37 bp, Artificial Sequence
  Synthetic
cgcgccacccatgcattggcatggcggcgacaaatgc

SEQ ID NO: 2446 - DNA, 45 bp, Artificial Sequence
  Synthetic
gttgatttgaaaaaaatgccgtctgaaacagtttctcgaacggta

SEQ ID NO: 2447 - DNA, 38 bp, Artificial Sequence
  Synthetic
acacccgaccaccaaaagctggcgattgcggcatgggc

SEQ ID NO: 2448 - DNA, 43 bp, Artificial Sequence
  Synthetic
gtctgaatgtttcgacaatccgattgctatctctctacgccac

SEQ ID NO: 2449 - DNA, 39 bp, Artificial Sequence
  Synthetic
cacaaccgccgacatcaagctttctttttcggcgagcgt

SEQ ID NO: 2450 - DNA, 42 bp, Artificial Sequence
  Synthetic
gtcaattcgcaccggactgcgtttcaaacccttgcccaaacc

SEQ ID NO: 2451 - DNA, 35 bp, Artificial Sequence
  Synthetic
tcctcaggctccgccacacccgctccttcgcatgg

SEQ ID NO: 2452 - DNA, 48 bp, Artificial Sequence
  Synthetic
cattggcaaaaatagcagcacaatattaaatcccaaaacagaaatgac

SEQ ID NO: 2453 - DNA, 35 bp, Artificial Sequence
  Synthetic
cgcaccttcgggcagactgggcaacgacagcgagg

SEQ ID NO: 2454 - DNA, 35 bp, Artificial Sequence
  Synthetic
ttgccggttcggaagccgcggtacgcgcatgacgg

SEQ ID NO: 2455 - DNA, 39 bp, Artificial Sequence
  Synthetic
cgcatgaagattggcttccgccttctgctggcggaatcg

SEQ ID NO: 2456 - DNA, 40 bp, Artificial Sequence
  Synthetic
cgcttcaaggtagccttttgccgatgtatctcggccggct

SEQ ID NO: 2457 - DNA, 35 bp, Artificial Sequence
  Synthetic
ggcgtgttggttgatgccgggctacggacacggca

SEQ ID NO: 2458 - DNA, 50 bp, Artificial Sequence
  Synthetic
gcgaaagtttccgtaaaaatatcggtcggattaatttgttcaatatcacc

SEQ ID NO: 2459 - DNA, 40 bp, Artificial Sequence
  Synthetic
ccgccgcccaagattggaatcttcaggaaagctttgccgc

SEQ ID NO: 2460 - DNA, 42 bp, Artificial Sequence
  Synthetic
acttcaaactgcgcggacaaccccaatccgtgcaaaaacagg

SEQ ID NO: 2461 - DNA, 38 bp, Artificial Sequence
  Synthetic
cgccgtacctatgcgtgtgaaagcattgtccgccacgc

SEQ ID NO: 2462 - DNA, 37 bp, Artificial Sequence
  Synthetic
acggtttcgtcgacggcacgtcggggatgatggcgac

SEQ ID NO: 2463 - DNA, 41 bp, Artificial Sequence
  Synthetic
gctctacttcgcagccgtcaacattgtggctgccggtaatc

SEQ ID NO: 2464 - DNA, 38 bp, Artificial Sequence
  Synthetic
tggtattcgtcatcggcatcgcgttaggcggcgtggca

SEQ ID NO: 2465 - DNA, 38 bp, Artificial Sequence
  Synthetic
gcatttccaatcccgacaccgtgccacgccgaagacga

SEQ ID NO: 2466 - DNA, 40 bp, Artificial Sequence
  Synthetic
catcgtcaggcgagcaaccggcttcccgattaccctgaaa

SEQ ID NO: 2467 - DNA, 38 bp, Artificial Sequence
  Synthetic
atcggacgaattggcacggattatgtcggtggcacggc

SEQ ID NO: 2468 - DNA, 37 bp, Artificial Sequence
  Synthetic
tgctcgacaacggcgttcccgttcggcgcaataaagc

SEQ ID NO: 2469 - DNA, 37 bp, Artificial Sequence
  Synthetic
cgtcgccgccataaaacgctcgaggtgtatgggcagg

SEQ ID NO: 2470 - DNA, 39 bp, Artificial Sequence
  Synthetic
atccgcagcccgacggttcctttcagacggcattggtcg

SEQ ID NO: 2471 - DNA, 38 bp, Artificial Sequence
  Synthetic
attgcgcgacatcgtccgaccgcccagccataaaacag

SEQ ID NO: 2472 - DNA, 40 bp, Artificial Sequence
  Synthetic
cgcccgataaagctgcgtaagtttgggcggatatttcggc

SEQ ID NO: 2473 - DNA, 41 bp, Artificial Sequence
  Synthetic
gcccgaaccgatgaagcaatccattttgcgcctgattccga

SEQ ID NO: 2474 - DNA, 37 bp, Artificial Sequence
  Synthetic
gccgattttgcctttgccgcgccttaccacatcgcgc

SEQ ID NO: 2475 - DNA, 40 bp, Artificial Sequence
  Synthetic
acgaagtggaagccgtgttggcgtcagcgtaaccatgtcg

SEQ ID NO: 2476 - DNA, 36 bp, Artificial Sequence
  Synthetic
agtcgaacccgccgccaagttgccggcaacaacgac

SEQ ID NO: 2477 - DNA, 42 bp, Artificial Sequence
  Synthetic
tcttcgcggaagatttcgccttcgcatccccttcctttatgc

SEQ ID NO: 2478 - DNA, 37 bp, Artificial Sequence
  Synthetic
agtccgctacacgcaaggccgctcgttgatgtagcgg

SEQ ID NO: 2479 - DNA, 38 bp, Artificial Sequence
  Synthetic
ggcttccaacgcgtcatccaggccaagcctttgcctgc

SEQ ID NO: 2480 - DNA, 40 bp, Artificial Sequence
  Synthetic
tgtcttcggcaaccacaccgacaattacccgcaaacacgt

SEQ ID NO: 2481 - DNA, 38 bp, Artificial Sequence
  Synthetic
gcgcattttgcccgaacgcaccacaacaaccgcatcct

SEQ ID NO: 2482 - DNA, 40 bp, Artificial Sequence
  Synthetic
aacggtctttgaggcggctgtatcgcgacgacttccatca

SEQ ID NO: 2483 - DNA, 34 bp, Artificial Sequence
  Synthetic
aagctcggcggcgcaaagcgttggaacaggcgca

SEQ ID NO: 2484 - DNA, 40 bp, Artificial Sequence
  Synthetic
cgaagccccggaatttgcctggcaaatgtggcgacatagc

SEQ ID NO: 2485 - DNA, 39 bp, Artificial Sequence
  Synthetic
gccaaaccgccgtggacatcaactcaaacaggttgcggg

SEQ ID NO: 2486 - DNA, 40 bp, Artificial Sequence
  Synthetic
cggaattccgcgcatttgcagaggtcaaactcgaaggcgg

SEQ ID NO: 2487 - DNA, 38 bp, Artificial Sequence
  Synthetic
ctgccctttctgcaaagccgttcagtgggcgaacgggt

SEQ ID NO: 2488 - DNA, 38 bp, Artificial Sequence
  Synthetic
gaacaggtattccggcgcggaccgcagggattacgcca

SEQ ID NO: 2489 - DNA, 39 bp, Artificial Sequence
  Synthetic
atcggcaggctgaaacactcggcaggattttatgtgctg

SEQ ID NO: 2490 - DNA, 37 bp, Artificial Sequence
  Synthetic
gcgcgctggatgccaaagttgtgatgaatgtcgcgca

SEQ ID NO: 2491 - DNA, 35 bp, Artificial Sequence
  Synthetic
gcgtgctgctgccggaaacgcgaacatcatgcccg

SEQ ID NO: 2492 - DNA, 41 bp, Artificial Sequence
  Synthetic
gctgaccactgaaaacacgcccgatgtagtaggcgtgttcc

SEQ ID NO: 2493 - DNA, 41 bp, Artificial Sequence
  Synthetic
accgtcatatgccttattgtcgtgggtaagaaggaacaggg

SEQ ID NO: 2494 - DNA, 40 bp, Artificial Sequence
  Synthetic
gcccggtcaaaagcgcaaaaagttccgatacctttgcgcc

SEQ ID NO: 2495 - DNA, 40 bp, Artificial Sequence
  Synthetic
agctacaccccgaaacatccgcaatcggggtctgacaggt

SEQ ID NO: 2496 - DNA, 38 bp, Artificial Sequence
  Synthetic
gcacggcgatgcggaagtgataagcggtttcgggatgg

SEQ ID NO: 2497 - DNA, 40 bp, Artificial Sequence
  Synthetic
gcggcggcggtttttgtagatgatggtacagaccgtgcgc

SEQ ID NO: 2498 - DNA, 35 bp, Artificial Sequence
  Synthetic
ccagcggtttgcaatcgcccggttgccaagcgtcc

SEQ ID NO: 2499 - DNA, 38 bp, Artificial Sequence
  Synthetic
taccgcgtctttgccgactgggacggtcgcagaaaagc

SEQ ID NO: 2500 - DNA, 38 bp, Artificial Sequence
  Synthetic
ccgatacggggtaaggcaggatgcctgtggacgcaacc

SEQ ID NO: 2501 - DNA, 35 bp, Artificial Sequence
  Synthetic
gtttgcgccgccgtctttgggcgcggttgccgtat

SEQ ID NO: 2502 - DNA, 37 bp, Artificial Sequence
  Synthetic
gttcctcgtaggctgcctgcgccgcaacaagaggccg

SEQ ID NO: 2503 - DNA, 37 bp, Artificial Sequence
  Synthetic
ggtcgtacagggcgttgccggtccttgaccgcgaacc

SEQ ID NO: 2504 - DNA, 46 bp, Artificial Sequence
  Synthetic
agtgccatttcattctaacttccttaaaacgctaatcataagaggg

SEQ ID NO: 2505 - DNA, 39 bp, Artificial Sequence
  Synthetic
gcttcatctgctttgtgcgggtcaggcatcgggagggat

SEQ ID NO: 2506 - DNA, 37 bp, Artificial Sequence
  Synthetic
cgaccacatcggacaatcccgcgcggcaggggttgtt

SEQ ID NO: 2507 - DNA, 41 bp, Artificial Sequence
  Synthetic
gtttccgttcgggcaatggttcccgcctgaaagaatcccat

SEQ ID NO: 2508 - DNA, 38 bp, Artificial Sequence
  Synthetic
gcccgtcgtcttccacgttgcgagatgcacggctcaaa

SEQ ID NO: 2509 - DNA, 41 bp, Artificial Sequence
  Synthetic
ggcggttacttttttgcctgccgttccgcccgaaaatctgc

SEQ ID NO: 2510 - DNA, 37 bp, Artificial Sequence
  Synthetic
gcagcttcggcttcggctgcaggacaatccgaacctg

SEQ ID NO: 2511 - DNA, 40 bp, Artificial Sequence
  Synthetic
cgcccgatataggcttccgcgacgatttcttcctcagcgt

SEQ ID NO: 2512 - DNA, 39 bp, Artificial Sequence
  Synthetic
cgttgacactgcccgcgaatcgatacgaacgtccgttac

SEQ ID NO: 2513 - DNA, 39 bp, Artificial Sequence
  Synthetic
ccctgcgtttcaagcccgatcggcaacatgaacgaagtg

SEQ ID NO: 2514 - DNA, 37 bp, Artificial Sequence
  Synthetic
tccaatacgccgcccagggcgcccgattacaggcttg

SEQ ID NO: 2515 - DNA, 41 bp, Artificial Sequence
  Synthetic
ccgcctgataaatgttgcgcgtgacgtgaaatccgacatcg

SEQ ID NO: 2516 - DNA, 36 bp, Artificial Sequence
  Synthetic
tcaaacccgcgttgcgcccctgacggctggttttcg

SEQ ID NO: 2517 - DNA, 36 bp, Artificial Sequence
  Synthetic
atcgcggctgtcctgctctgggcgtggaaatttcgg

SEQ ID NO: 2518 - DNA, 35 bp, Artificial Sequence
  Synthetic
cgggcgtgtgtctgaaccgcgtcgaggcagtccga

SEQ ID NO: 2519 - DNA, 41 bp, Artificial Sequence
  Synthetic
cgaacgggaacacatccgccttttatcgtgaatgccgaccg

SEQ ID NO: 2520 - DNA, 37 bp, Artificial Sequence
  Synthetic
cggcaagaagcggcggtatgttgccttgtgttgccgt

SEQ ID NO: 2521 - DNA, 41 bp, Artificial Sequence
  Synthetic
cggacaggagggcgtttgatgtggggtcgaaggcaagatgg

SEQ ID NO: 2522 - DNA, 36 bp, Artificial Sequence
  Synthetic
gcgggggcttcgagtttcgggactggtatcgcgcca

SEQ ID NO: 2523 - DNA, 35 bp, Artificial Sequence
  Synthetic
acaccgccgcaccgtatccccggcgcgtggcaata

SEQ ID NO: 2524 - DNA, 35 bp, Artificial Sequence
  Synthetic
ttcccaccgcttccccgacgatgtgattcgggcgg

SEQ ID NO: 2525 - DNA, 36 bp, Artificial Sequence
  Synthetic
tccgggcggttttggcgtgttcacgaagccgatgcc

SEQ ID NO: 2526 - DNA, 38 bp, Artificial Sequence
  Synthetic
gccttgagcttgtcgattgccgacgcatcgcacttgcc

SEQ ID NO: 2527 - DNA, 39 bp, Artificial Sequence
  Synthetic
cgcccatcaaccccatcactgcccgattcttgccgttgc

SEQ ID NO: 2528 - DNA, 40 bp, Artificial Sequence
  Synthetic
gcgaagtgggcgaactgatcgtgcggcaggcatattgagg

SEQ ID NO: 2529 - DNA, 34 bp, Artificial Sequence
  Synthetic
ttttggcgggcgcggtgtcggcgggaaaatgcgc

SEQ ID NO: 2530 - DNA, 38 bp, Artificial Sequence
  Synthetic
ggctggcaggcgagttttctcaagcactgccatcaccg

SEQ ID NO: 2531 - DNA, 41 bp, Artificial Sequence
  Synthetic
cgacaggggttctttttgctctagatcgtcaaagtttagca

SEQ ID NO: 2532 - DNA, 38 bp, Artificial Sequence
  Synthetic
ttttcgcaaatcttccgccccggcgagattctgaactt

SEQ ID NO: 2533 - DNA, 36 bp, Artificial Sequence
  Synthetic
caggaaatcatcgcgcgcgacaataccgccaagccg

SEQ ID NO: 2534 - DNA, 35 bp, Artificial Sequence
  Synthetic
gcacatcgcccccgaaacccgccacgcgttttcgg

SEQ ID NO: 2535 - DNA, 35 bp, Artificial Sequence
  Synthetic
actgccgacgtgcttgccctgccttgtccgagccg

SEQ ID NO: 2536 - DNA, 35 bp, Artificial Sequence
  Synthetic
cgccgacgcccgatttcacgcagcatcgcggtgga

SEQ ID NO: 2537 - DNA, 42 bp, Artificial Sequence
  Synthetic
cggaagacaaatccatgccgccatctgtggcgcatcaaaacc

SEQ ID NO: 2538 - DNA, 36 bp, Artificial Sequence
  Synthetic
atcagcgcgggcttgtgccgcacaaggtgcggcagt

SEQ ID NO: 2539 - DNA, 40 bp, Artificial Sequence
  Synthetic
cttgcattggaagccttgggcgcgttgacgtgatccatcg

SEQ ID NO: 2540 - DNA, 41 bp, Artificial Sequence
  Synthetic
gctggccggaaaccatatctcgaaaacgctgcaaaatgaac

SEQ ID NO: 2541 - DNA, 39 bp, Artificial Sequence
  Synthetic
tccacccgcacccgaccttatacacccaaagccacttcc

SEQ ID NO: 2542 - DNA, 35 bp, Artificial Sequence
  Synthetic
ccgtacgacgctgaacggctcggcctggatgtggc

SEQ ID NO: 2543 - DNA, 40 bp, Artificial Sequence
  Synthetic
ggcatcagcagctccacgctaaagtcgaaaacgtcgtgcg

SEQ ID NO: 2544 - DNA, 38 bp, Artificial Sequence
  Synthetic
ctccgatcggcaactggcaagaagaggtcagcgcgatg

SEQ ID NO: 2545 - DNA, 39 bp, Artificial Sequence
  Synthetic
aaggcgcatctgctcgatgtggccgcgatttgttcatcg

SEQ ID NO: 2546 - DNA, 37 bp, Artificial Sequence
  Synthetic
cgccgcgttcgtactgcatggacaccatcgagcagcg

SEQ ID NO: 2547 - DNA, 35 bp, Artificial Sequence
  Synthetic
atcaggctgcggtgggagcagtgtccctcgtcgcc

SEQ ID NO: 2548 - DNA, 37 bp, Artificial Sequence
  Synthetic
aaggcggtgcggacgttgttgaccgaatgctgcatca

SEQ ID NO: 2549 - DNA, 38 bp, Artificial Sequence
  Synthetic
cggtgaaacacggcatttggttgacggcatcgacgtgg

SEQ ID NO: 2550 - DNA, 34 bp, Artificial Sequence
  Synthetic
ggcgggcggcaaagtgttcgcggtacaccacgct

SEQ ID NO: 2551 - DNA, 38 bp, Artificial Sequence
  Synthetic
gcagcagcaatgtcggcattacagaaagccggtgtgga

SEQ ID NO: 2552 - DNA, 37 bp, Artificial Sequence
  Synthetic
cccgcccataaagccatcggcgccggagagtgcaatc

SEQ ID NO: 2553 - DNA, 40 bp, Artificial Sequence
  Synthetic
gctcgacagccttgccgacatttgtaggcaataagcgcgg

SEQ ID NO: 2554 - DNA, 35 bp, Artificial Sequence
  Synthetic
tgtttgccgcgctgatccgccggcggcagcagttt

SEQ ID NO: 2555 - DNA, 40 bp, Artificial Sequence
  Synthetic
cgacaggcagggagtcggcatacctgacggtcttcagccc

SEQ ID NO: 2556 - DNA, 39 bp, Artificial Sequence
  Synthetic
cggtgtcaacgataaggcacgggaacatctttgaccagt

SEQ ID NO: 2557 - DNA, 43 bp, Artificial Sequence
  Synthetic
accgtaaacgcaggtctgaaatttgagcgtttttgaattcagc

SEQ ID NO: 2558 - DNA, 38 bp, Artificial Sequence
  Synthetic
gcagcgcaacctcaaaccgaaacctgcgcgagtgttgc

SEQ ID NO: 2559 - DNA, 39 bp, Artificial Sequence
  Synthetic
cgacatctcgacggcaaccggttcaggttgttgaggcgt

SEQ ID NO: 2560 - DNA, 36 bp, Artificial Sequence
  Synthetic
cgcccttgcccaacgctatagcggtattgacggcgg

SEQ ID NO: 2561 - DNA, 38 bp, Artificial Sequence
  Synthetic
tggaaatccgcggcgcaggcgacctgcatcatttcgcc

SEQ ID NO: 2562 - DNA, 38 bp, Artificial Sequence
  Synthetic
cgaccacgcttctggtcgaggggaaatcggcgaaacgg

SEQ ID NO: 2563 - DNA, 33 bp, Artificial Sequence
  Synthetic
tcgccctgcacaagctcgttcggcggctttgcg

SEQ ID NO: 2564 - DNA, 37 bp, Artificial Sequence
  Synthetic
tgttgttcgtaccggttgccaccccgccaaaaacggc

SEQ ID NO: 2565 - DNA, 39 bp, Artificial Sequence
  Synthetic
tcctcgccgcctacatccattccgaagatgaagttgccg

SEQ ID NO: 2566 - DNA, 39 bp, Artificial Sequence
  Synthetic
tacagcacccgccacctgcttgttttcggtaatgctgcg

SEQ ID NO: 2567 - DNA, 38 bp, Artificial Sequence
  Synthetic
cgatctcatccgtatcgccccgcgttggagggcgacga

SEQ ID NO: 2568 - DNA, 39 bp, Artificial Sequence
  Synthetic
ggtatcgccgtcggtatggccgttgatggtgtcggtgag

SEQ ID NO: 2569 - DNA, 38 bp, Artificial Sequence
  Synthetic
gcaacgacgaactggcgcactcttcggtggtcatgcgg

SEQ ID NO: 2570 - DNA, 39 bp, Artificial Sequence
  Synthetic
ccaagttcgcccaatacctgctcgccgagtttcagcgtg

SEQ ID NO: 2571 - DNA, 42 bp, Artificial Sequence
  Synthetic
cgggcatcgttgcttttcattcatagtaacggatgtggaaag

SEQ ID NO: 2572 - DNA, 38 bp, Artificial Sequence
  Synthetic
tgcccctgcccgatgacataatgcaaactgcccacgcc

SEQ ID NO: 2573 - DNA, 42 bp, Artificial Sequence
  Synthetic
cgcagtcaggggcagaaacttcgaacaagcctgttttcctgc

SEQ ID NO: 2574 - DNA, 37 bp, Artificial Sequence
  Synthetic
atggtaggcagcacgcgcgacaaattcacacgggcgg

SEQ ID NO: 2575 - DNA, 40 bp, Artificial Sequence
  Synthetic
cggcgcattggcaaaaggtcgctttatcaggcgatggagg

SEQ ID NO: 2576 - DNA, 42 bp, Artificial Sequence
  Synthetic
cggcgtttcaaggtggttacgagtatcggcatcgttaccagt

SEQ ID NO: 2577 - DNA, 39 bp, Artificial Sequence
  Synthetic
cgcacgaccggttcttcgttaagattgtctgtcgcggcg

SEQ ID NO: 2578 - DNA, 37 bp, Artificial Sequence
  Synthetic
ggcgggaatggcggcaaatatcatcggcttctgcgtg

SEQ ID NO: 2579 - DNA, 39 bp, Artificial Sequence
  Synthetic
ccagaccgatatgccgtcgccgccatatccgacgcttac

SEQ ID NO: 2580 - DNA, 36 bp, Artificial Sequence
  Synthetic
ggtttgcgcccgcatgtgggcgtttaccggttcgac

SEQ ID NO: 2581 - DNA, 36 bp, Artificial Sequence
  Synthetic
aaccaccccgacccctgtgcgtttcaaacggcgcgg

SEQ ID NO: 2582 - DNA, 38 bp, Artificial Sequence
  Synthetic
gcagcgaacacgatacccgtatgagcagggcgcatcga

SEQ ID NO: 2583 - DNA, 38 bp, Artificial Sequence
  Synthetic
ggcaaagcaaccttagccgcgcacgatggaagcaggaa

SEQ ID NO: 2584 - DNA, 33 bp, Artificial Sequence
  Synthetic
atcaccgcgccgctgcaattggcggcctgcagt

SEQ ID NO: 2585 - DNA, 44 bp, Artificial Sequence
  Synthetic
accgcctttaaacaattgaaagaaatccgtatctggttaaacgg

SEQ ID NO: 2586 - DNA, 41 bp, Artificial Sequence
  Synthetic
tcgacattaccgaacaccgcaaagggtcagtccgatttcgt

SEQ ID NO: 2587 - DNA, 41 bp, Artificial Sequence
  Synthetic
ccagcttcgccgacatcttctttcttcggtcaacacgatgg

SEQ ID NO: 2588 - DNA, 41 bp, Artificial Sequence
  Synthetic
aatcccgccgaagaaaccgatatatattcgagtgcgcgctc

SEQ ID NO: 2589 - DNA, 36 bp, Artificial Sequence
  Synthetic
tccacccacggcgcattcgtcgccatcgtgtgttcg

SEQ ID NO: 2590 - DNA, 38 bp, Artificial Sequence
  Synthetic
agcgcgccaaatcgaccgtttggcaatccttttacgcg

SEQ ID NO: 2591 - DNA, 39 bp, Artificial Sequence
  Synthetic
cggatagacaagttcgcccgccggcaggcgttttctacc

SEQ ID NO: 2592 - DNA, 41 bp, Artificial Sequence
  Synthetic
gcgtgccattatgggtttccacgaccaaatccgcctgtacg

SEQ ID NO: 2593 - DNA, 38 bp, Artificial Sequence
  Synthetic
aaatgccggcgatgaaggtcaccgggtcggtatggaca

SEQ ID NO: 2594 - DNA, 35 bp, Artificial Sequence
  Synthetic
ttgtcttgcccacgcccggcggtggaaggcgggaa

SEQ ID NO: 2595 - DNA, 37 bp, Artificial Sequence
  Synthetic
ggatttgcgcgcccaagctcgcgccgtctgaaaatcc

SEQ ID NO: 2596 - DNA, 37 bp, Artificial Sequence
  Synthetic
tctttgacgaagcggcgcattgccgccgccaaatcca

SEQ ID NO: 2597 - DNA, 38 bp, Artificial Sequence
  Synthetic
ccaaagcccttgatcgcgtccggtgtggtgcaggagga

SEQ ID NO: 2598 - DNA, 34 bp, Artificial Sequence
  Synthetic
gattcccgccgccgtcatgcatacgcgccatcgt

SEQ ID NO: 2599 - DNA, 40 bp, Artificial Sequence
  Synthetic
tgcctgaaacggctaaatcctatcgattcaaaacactggc

SEQ ID NO: 2600 - DNA, 41 bp, Artificial Sequence
  Synthetic
cctgcactcatcaatcctgatttaacccaaactcaaagcca

SEQ ID NO: 2601 - DNA, 38 bp, Artificial Sequence
  Synthetic
gccatttgccgatgattggggcccccggcaggagcatt

SEQ ID NO: 2602 - DNA, 37 bp, Artificial Sequence
  Synthetic
tgttgtcgttgtgggcgggcggctttgtgcagattgc

SEQ ID NO: 2603 - DNA, 38 bp, Artificial Sequence
  Synthetic
ccgggtttcacatcgccgtatgagcgacgctttaccga

SEQ ID NO: 2604 - DNA, 41 bp, Artificial Sequence
  Synthetic
ggaacacggcatcgacacactcagagggctttgagcatcgc

SEQ ID NO: 2605 - DNA, 35 bp, Artificial Sequence
  Synthetic
gcgcatcgatttgggcgcggaagccggcgaagagt

SEQ ID NO: 2606 - DNA, 36 bp, Artificial Sequence
  Synthetic
cgtatgtccggcgcgtcaggtcagggcttcgggcgt

SEQ ID NO: 2607 - DNA, 38 bp, Artificial Sequence
  Synthetic
cagcgcgaagtgttggcggcgacgcagataaaatcgcg

SEQ ID NO: 2608 - DNA, 40 bp, Artificial Sequence
  Synthetic
cgtgccacttgttgccgtcgcactcttggggtcctgaagc

SEQ ID NO: 2609 - DNA, 38 bp, Artificial Sequence
  Synthetic
gagccgtccacgttggagacgcgctcaaacctttcggt

SEQ ID NO: 2610 - DNA, 38 bp, Artificial Sequence
  Synthetic
atttcgtggtgtccgggcagcacccccatcgacctgat

SEQ ID NO: 2611 - DNA, 41 bp, Artificial Sequence
  Synthetic
cactcttcgccattcccgcgatttccgatagattcctgccg

SEQ ID NO: 2612 - DNA, 37 bp, Artificial Sequence
  Synthetic
caacgtcggcgcactggaccggtcggctttttcctgc

SEQ ID NO: 2613 - DNA, 39 bp, Artificial Sequence
  Synthetic
acggacgcgggcaagacactgaacaggatgttgcggatg

SEQ ID NO: 2614 - DNA, 36 bp, Artificial Sequence
  Synthetic
acgagtgcggctacggaatccgacacgctcgtccgt

SEQ ID NO: 2615 - DNA, 38 bp, Artificial Sequence
  Synthetic
cgcgggaatccggtaaccgaaacggcgggggtttctgt

SEQ ID NO: 2616 - DNA, 36 bp, Artificial Sequence
  Synthetic
acgcctacctgctgaccggcaaggatgcgggcgatg

SEQ ID NO: 2617 - DNA, 40 bp, Artificial Sequence
  Synthetic
gttccacacgctcaacaaagccttgctgacgctttcggtc

SEQ ID NO: 2618 - DNA, 39 bp, Artificial Sequence
  Synthetic
aagtcatgctccatgccgtcaaggtgtcagtgcgttgtg

SEQ ID NO: 2619 - DNA, 39 bp, Artificial Sequence
  Synthetic
tggctgcggtacacaatgccgcagcccgcatgtttttcc

SEQ ID NO: 2620 - DNA, 39 bp, Artificial Sequence
  Synthetic
gcatcgccaaccgcctgttgacgccgttgtttttcacgt

SEQ ID NO: 2621 - DNA, 42 bp, Artificial Sequence
  Synthetic
gcgcaccttatcgccgaacaaacgaaacgttttttgcagcgg

SEQ ID NO: 2622 - DNA, 37 bp, Artificial Sequence
  Synthetic
agctgatgcggcagatggtgcagacgcgttcggcaac

SEQ ID NO: 2623 - DNA, 37 bp, Artificial Sequence
  Synthetic
ccttcatcgcccgatacggcgcttcggcgacaacagc

SEQ ID NO: 2624 - DNA, 45 bp, Artificial Sequence
  Synthetic
cgaatgctgcaaatttgtttgatgagccgtattgtttcatcatct

SEQ ID NO: 2625 - DNA, 40 bp, Artificial Sequence
  Synthetic
ccaagccaaaccggtaacctgtcgcttcgattacggcgtt

SEQ ID NO: 2626 - DNA, 39 bp, Artificial Sequence
  Synthetic
gcgtgggtcattttggcgttgttggacatcgcgcattgg

SEQ ID NO: 2627 - DNA, 41 bp, Artificial Sequence
  Synthetic
atgaccaaggacaaaatggacttgtaggggaggttgttctg

SEQ ID NO: 2628 - DNA, 43 bp, Artificial Sequence
  Synthetic
cgccaagcgtaaaccattcattatcggataacatctccttcaa

SEQ ID NO: 2629 - DNA, 47 bp, Artificial Sequence
  Synthetic
gctttggttccttcacatgtcagaagtaatcattaaattcggatccg

SEQ ID NO: 2630 - DNA, 42 bp, Artificial Sequence
  Synthetic
acacggtgcttgatacctttcaacaaatgtgggtgacaatcg

SEQ ID NO: 2631 - DNA, 40 bp, Artificial Sequence
  Synthetic
ggactactgtggctaccgtaaattgggtatctaggccact

SEQ ID NO: 2632 - DNA, 47 bp, Artificial Sequence
  Synthetic
ctgaatttttcagttgcctcacctttgaaaccacttctgatttacct

SEQ ID NO: 2633 - DNA, 45 bp, Artificial Sequence
  Synthetic
ttgtctgtttgggtgtatgaatcatcctgattcatttttctctgg

SEQ ID NO: 2634 - DNA, 44 bp, Artificial Sequence
  Synthetic
gccaaagtaaatggtactaaagctgctccaaagtaatcggttcg

SEQ ID NO: 2635 - DNA, 40 bp, Artificial Sequence
  Synthetic
accgcccggacagcttttgatacacgccaaatcgcaaggt

SEQ ID NO: 2636 - DNA, 38 bp, Artificial Sequence
  Synthetic
cgtggaagaaggcggcaaggtacctccgcgctgatgca

SEQ ID NO: 2637 - DNA, 39 bp, Artificial Sequence
  Synthetic
ctttggcagtggcgatgttgccgtgcgttgggtcaaaga

SEQ ID NO: 2638 - DNA, 39 bp, Artificial Sequence
  Synthetic
ccgtcggcaatcagcggaacctgaccgccattcacaacg

SEQ ID NO: 2639 - DNA, 38 bp, Artificial Sequence
  Synthetic
cttggctcatcgcgcccaagtaccaaggccgctcgtac

SEQ ID NO: 2640 - DNA, 35 bp, Artificial Sequence
  Synthetic
cgttcgatgcgcccctgatcgtccgccaagatgcc

SEQ ID NO: 2641 - DNA, 36 bp, Artificial Sequence
  Synthetic
acgggtttgacgatgcccgggacgcgataccgacga

SEQ ID NO: 2642 - DNA, 38 bp, Artificial Sequence
  Synthetic
ccgatgaccttgcccgcttcgcctgaacatccccacca

SEQ ID NO: 2643 - DNA, 36 bp, Artificial Sequence
  Synthetic
cgcttcggtcaggcagttcagacctgcggctcgtgt

SEQ ID NO: 2644 - DNA, 38 bp, Artificial Sequence
  Synthetic
tcgtccacgcctgcggttgtcttattcggcaacatcgc

SEQ ID NO: 2645 - DNA, 37 bp, Artificial Sequence
  Synthetic
atcctcgccgtcctcgagccgggcggacttcatcgtg

SEQ ID NO: 2646 - DNA, 39 bp, Artificial Sequence
  Synthetic
atatgccggactcgcgccgggaaacgccgaaattttccg

SEQ ID NO: 2647 - DNA, 40 bp, Artificial Sequence
  Synthetic
acacggtgagggacgaagcctccgaaccgtctttctgtgc

SEQ ID NO: 2648 - DNA, 39 bp, Artificial Sequence
  Synthetic
ttgtgcggacgcgtggtcgatgtccaacaagaaatgcgc

SEQ ID NO: 2649 - DNA, 41 bp, Artificial Sequence
  Synthetic
ccggacagatattgccggtgtacatcggatgctcttccaga

SEQ ID NO: 2650 - DNA, 35 bp, Artificial Sequence
  Synthetic
agccgtggtcgaagccgatgtccaactcgagggcg

SEQ ID NO: 2651 - DNA, 41 bp, Artificial Sequence
  Synthetic
gcaattccaccatccccaccgggtctgaccgtctttgaagg

SEQ ID NO: 2652 - DNA, 36 bp, Artificial Sequence
  Synthetic
acctaccgccgccgcaatcgacaaacgtgccttccg

SEQ ID NO: 2653 - DNA, 38 bp, Artificial Sequence
  Synthetic
tatcggcatcaggcagcagctccaaatcaaacgcgccc

SEQ ID NO: 2654 - DNA, 37 bp, Artificial Sequence
  Synthetic
ggcggcatcgaaggcttcgcgtctgaacaccctcccg

SEQ ID NO: 2655 - DNA, 37 bp, Artificial Sequence
  Synthetic
gctgcgtgaggactcggtcgcatcgcttttgccgccg

SEQ ID NO: 2656 - DNA, 37 bp, Artificial Sequence
  Synthetic
caaaccgcaaaccgtccgcagcacggacagggatcgt

SEQ ID NO: 2657 - DNA, 38 bp, Artificial Sequence
  Synthetic
aggacggggtgctgaaacaccgaccaaccgaccgattc

SEQ ID NO: 2658 - DNA, 36 bp, Artificial Sequence
  Synthetic
tctgttcattgtcccgcgccggcgcaacggccttac

SEQ ID NO: 2659 - DNA, 41 bp, Artificial Sequence
  Synthetic
gcgtgcggattgaaatgcatctgctttggcactgaaaagcg

SEQ ID NO: 2660 - DNA, 39 bp, Artificial Sequence
  Synthetic
ggtatccgaacacctgccgactcgcctcgggattgaaca

SEQ ID NO: 2661 - DNA, 41 bp, Artificial Sequence
  Synthetic
tggttttgtctgcctatgccgtctatctgaagtccgagcgc

SEQ ID NO: 2662 - DNA, 40 bp, Artificial Sequence
  Synthetic
tgcgagaattggcggaggaaaaaaactgtacagcaggcgc

SEQ ID NO: 2663 - DNA, 39 bp, Artificial Sequence
  Synthetic
gcgcatcgtcatccggcatttttcgtcatccgttaccgc

SEQ ID NO: 2664 - DNA, 40 bp, Artificial Sequence
  Synthetic
gcctcgctgccttcgagattcctactggtacatcgacacg

SEQ ID NO: 2665 - DNA, 38 bp, Artificial Sequence
  Synthetic
acgacggacagcaaaacgcccccgaacacctgcaacaa

SEQ ID NO: 2666 - DNA, 40 bp, Artificial Sequence
  Synthetic
aaagccgcgagtggtcatggaaaaccgttcgttacctccg

SEQ ID NO: 2667 - DNA, 41 bp, Artificial Sequence
  Synthetic
gttcagacggcattttgtatggagcgacaaataccccgttt

SEQ ID NO: 2668 - DNA, 39 bp, Artificial Sequence
  Synthetic
tcttcgaggcgttcgcgggtcgtttatgctgatccctcg

SEQ ID NO: 2669 - DNA, 42 bp, Artificial Sequence
  Synthetic
cgggtaatctttccgaaaccgtttcaatatagccaaggggat

SEQ ID NO: 2670 - DNA, 39 bp, Artificial Sequence
  Synthetic
agcctgctttgcgtatccacggcgactgcgtgtccattg

SEQ ID NO: 2671 - DNA, 40 bp, Artificial Sequence
  Synthetic
aggtattcgagataggcgcgggtcgtcaacagcgtcgtcg

SEQ ID NO: 2672 - DNA, 36 bp, Artificial Sequence
  Synthetic
acgaatcgccgtcttgcgccacgcgctgaaggaggt

SEQ ID NO: 2673 - DNA, 35 bp, Artificial Sequence
  Synthetic
acccccaagccgcattggattgccgggaaacacgc

SEQ ID NO: 2674 - DNA, 38 bp, Artificial Sequence
  Synthetic
tttgccgtcttcgatgcccaactgcccaaaagcgtacc

SEQ ID NO: 2675 - DNA, 38 bp, Artificial Sequence
  Synthetic
ttgccgaagccagatcgcacgttctttggcggcttcgt

SEQ ID NO: 2676 - DNA, 39 bp, Artificial Sequence
  Synthetic
tcgaccaaatcgccgatggggcggcgattatcatctgca

SEQ ID NO: 2677 - DNA, 37 bp, Artificial Sequence
  Synthetic
tcctttcgggcgcgagactaaaatcggtgcggacgtg

SEQ ID NO: 2678 - DNA, 37 bp, Artificial Sequence
  Synthetic
tccgcatcagccacatcggatgagtccgaggctgtgg

SEQ ID NO: 2679 - DNA, 38 bp, Artificial Sequence
  Synthetic
ccgataccacacccgaatacgcgccattgcaggcggtt

SEQ ID NO: 2680 - DNA, 34 bp, Artificial Sequence
  Synthetic
tgggcaagccattccgccttgccgatgttgccgc

SEQ ID NO: 2681 - DNA, 34 bp, Artificial Sequence
  Synthetic
cctcaaccgccgcatgcacgagtatggtggcgcg

SEQ ID NO: 2682 - DNA, 40 bp, Artificial Sequence
  Synthetic
ccgctgattgcaccgctcattggtgttccaaagcagtacc

SEQ ID NO: 2683 - DNA, 41 bp, Artificial Sequence
  Synthetic
caccgtaagcgagcgtcaacttgtattcctgatttccggcc

SEQ ID NO: 2684 - DNA, 43 bp, Artificial Sequence
  Synthetic
ggtactgcttcctttgccggctttgttatcgacttcaatttgg

SEQ ID NO: 2685 - DNA, 38 bp, Artificial Sequence
  Synthetic
ccttcggcgtgcatttggacagcgccgcataacctctt

SEQ ID NO: 2686 - DNA, 41 bp, Artificial Sequence
  Synthetic
cgatgtttgggcaaagtggctgagcagtagggtcatcaggc

SEQ ID NO: 2687 - DNA, 35 bp, Artificial Sequence
  Synthetic
tcaggtgcgcgctcatcgggacagccagcgcatcg

SEQ ID NO: 2688 - DNA, 37 bp, Artificial Sequence
  Synthetic
acatcaatgccaagccgggctcgccctgatagccgtc

SEQ ID NO: 2689 - DNA, 37 bp, Artificial Sequence
  Synthetic
tcacccacgccgtgctgtcgatatgggcggcgagtcc

SEQ ID NO: 2690 - DNA, 34 bp, Artificial Sequence
  Synthetic
tccgcgccggctttttcgggggcgaacaacaccg

SEQ ID NO: 2691 - DNA, 36 bp, Artificial Sequence
  Synthetic
gcaaagagtttcggggcggctgctctgcggcggaca

SEQ ID NO: 2692 - DNA, 39 bp, Artificial Sequence
  Synthetic
cggatatttctgcctgcccgttgaacccgtataccaacc

SEQ ID NO: 2693 - DNA, 39 bp, Artificial Sequence
  Synthetic
ccgtctggttgcgttggcgcggtagctaagacgacgtcc

SEQ ID NO: 2694 - DNA, 37 bp, Artificial Sequence
  Synthetic
cgggaactgggtgtgggaaatcatttcgcgcgcaccc

SEQ ID NO: 2695 - DNA, 38 bp, Artificial Sequence
  Synthetic
aaagtgcgtcaaggcagagtctacctcttcgcgacgct

SEQ ID NO: 2696 - DNA, 39 bp, Artificial Sequence
  Synthetic
aaatcccgtcccgcacgcgacgagcaaatgaaactggcg

SEQ ID NO: 2697 - DNA, 40 bp, Artificial Sequence
  Synthetic
tgcgccccctcatgattgagcggaatcgtacaggaagacg

SEQ ID NO: 2698 - DNA, 34 bp, Artificial Sequence
  Synthetic
tgccgcgcacgatgcttgcgcgtggcaggaacac

SEQ ID NO: 2699 - DNA, 34 bp, Artificial Sequence
  Synthetic
acgtcggtcagggcaacgcaaaaggccgcgctcg

SEQ ID NO: 2700 - DNA, 40 bp, Artificial Sequence
  Synthetic
atggttttgcccggcgagtcgaaactggtcgaatgcaacg

SEQ ID NO: 2701 - DNA, 40 bp, Artificial Sequence
  Synthetic
gggcgaggaatagtcgatgacggatgcgcgtttcggcata

SEQ ID NO: 2702 - DNA, 41 bp, Artificial Sequence
  Synthetic
cgtagaagcggctgaacagggtcgtatccgcactacctcgc

SEQ ID NO: 2703 - DNA, 38 bp, Artificial Sequence
  Synthetic
ggtcagcagtgccaaaacccaaggctgctgctgtccct

SEQ ID NO: 2704 - DNA, 38 bp, Artificial Sequence
  Synthetic
aaacggcatattcgcccgcgtttcgcaccctcttccgt

SEQ ID NO: 2705 - DNA, 41 bp, Artificial Sequence
  Synthetic
cgtacccgaaaacgaatacatcgccaaggcttcgatgaaga

SEQ ID NO: 2706 - DNA, 35 bp, Artificial Sequence
  Synthetic
ggtttggcggcggaaaccgtcagacggcaggcagc

SEQ ID NO: 2707 - DNA, 43 bp, Artificial Sequence
  Synthetic
gcatcgtattgactgcctttcaaccgatttgcacaaattaacc

SEQ ID NO: 2708 - DNA, 41 bp, Artificial Sequence
  Synthetic
ccaattcgtgcgtgtcttcaatttcggatttaattgacccg

SEQ ID NO: 2709 - DNA, 38 bp, Artificial Sequence
  Synthetic
aaccgaagtcaaaccgccgggcgatgaagcgtgggatt

SEQ ID NO: 2710 - DNA, 45 bp, Artificial Sequence
  Synthetic
cacagggtcaaaatacagttcagtctaccattgatattgtgtgct

SEQ ID NO: 2711 - DNA, 41 bp, Artificial Sequence
  Synthetic
ggacagtttggcagacggtgtgaatttgggcaaagaccccg

SEQ ID NO: 2712 - DNA, 45 bp, Artificial Sequence
  Synthetic
gtgccaccgtcttttttgtgatctttgattgataatggtgaaacg

SEQ ID NO: 2713 - DNA, 41 bp, Artificial Sequence
  Synthetic
tcgggcttttggtcattttcagaaacaattactggcgtgtc

SEQ ID NO: 2714 - DNA, 39 bp, Artificial Sequence
  Synthetic
ccgtcttggttttccagtgcaaaagggatacgcaaccat

SEQ ID NO: 2715 - DNA, 38 bp, Artificial Sequence
  Synthetic
tcgaattgcagcgtgaatgcgccgccgtactgctggct

SEQ ID NO: 2716 - DNA, 35 bp, Artificial Sequence
  Synthetic
tcggtggtccgctcggaagacaccgacgctgacct

SEQ ID NO: 2717 - DNA, 39 bp, Artificial Sequence
  Synthetic
atccattccctctcccgtggaatatttccgttgccgtcc

SEQ ID NO: 2718 - DNA, 43 bp, Artificial Sequence
  Synthetic
ctcaaaaaataccagcccgagagtatctgccagttttccttgt

SEQ ID NO: 2719 - DNA, 39 bp, Artificial Sequence
  Synthetic
gcgcgttgagatagacggcgagccgaaatgcgtaccggc

SEQ ID NO: 2720 - DNA, 37 bp, Artificial Sequence
  Synthetic
gcggagaactgtttgaccgcgggctcgcccgaatcca

SEQ ID NO: 2721 - DNA, 42 bp, Artificial Sequence
  Synthetic
acgccgtctgaaaaaacctttttgttttgcagtaaatcgaga

SEQ ID NO: 2722 - DNA, 39 bp, Artificial Sequence
  Synthetic
gccatgcgcccaaacagatgttgtcctttgtaagcggcg

SEQ ID NO: 2723 - DNA, 42 bp, Artificial Sequence
  Synthetic
gcgcctgctgcttaagatatgcaagcagtcgaaaatcaggcg

SEQ ID NO: 2724 - DNA, 39 bp, Artificial Sequence
  Synthetic
tttccagtcgccgccgtctaaggtcgaaatcgccaaacg

SEQ ID NO: 2725 - DNA, 40 bp, Artificial Sequence
  Synthetic
aaacacccgcttcaaaacccactcggggaatcagaagcgg

SEQ ID NO: 2726 - DNA, 37 bp, Artificial Sequence
  Synthetic
tttgaccgcgccgacacgtgacgaaagaggcggaaca

SEQ ID NO: 2727 - DNA, 38 bp, Artificial Sequence
  Synthetic
aaacggcggtcgattttgtcgccgtgtcaagatggaaa

SEQ ID NO: 2728 - DNA, 34 bp, Artificial Sequence
  Synthetic
tgccgcccgtgcaaactgtgcagacggcggaaca

SEQ ID NO: 2729 - DNA, 40 bp, Artificial Sequence
  Synthetic
acgaaccgttgggctacatcaagtcgagaccgcctgtttc

SEQ ID NO: 2730 - DNA, 42 bp, Artificial Sequence
  Synthetic
tcttcgccgtaaattaccgccaaatcggcgagatttccatcg

SEQ ID NO: 2731 - DNA, 38 bp, Artificial Sequence
  Synthetic
ccgaacttgctgtccactccgcgtaccacgctgctgac

SEQ ID NO: 2732 - DNA, 39 bp, Artificial Sequence
  Synthetic
ggaatgtgccgctgccgaaccgtcctattatgtccgtcg

SEQ ID NO: 2733 - DNA, 39 bp, Artificial Sequence
  Synthetic
cctgttgggtttgcgcgatgacgtatcggacgggttgga

SEQ ID NO: 2734 - DNA, 38 bp, Artificial Sequence
  Synthetic
tcttgatgggcgtcttgcgtatgtgctcctggcgcaga

SEQ ID NO: 2735 - DNA, 38 bp, Artificial Sequence
  Synthetic
atcagaagcggtagcgcacgacgcttggaaaacacccg

SEQ ID NO: 2736 - DNA, 42 bp, Artificial Sequence
  Synthetic
ccgataagtttccgtgcggacaatctcgaaacccgtcattcc

SEQ ID NO: 2737 - DNA, 37 bp, Artificial Sequence
  Synthetic
ctcttgtcgtgcggacggtttgcccgcctgagcaaca

SEQ ID NO: 2738 - DNA, 39 bp, Artificial Sequence
  Synthetic
aaacgatacggcaagcgcgacgaagaaaaccacctgcgt

SEQ ID NO: 2739 - DNA, 36 bp, Artificial Sequence
  Synthetic
cctgtcaagcccgtgtgcagggaagctgcccgaagc

SEQ ID NO: 2740 - DNA, 38 bp, Artificial Sequence
  Synthetic
ggcggatgatacggaggctttggccgccgtttcccgtt

SEQ ID NO: 2741 - DNA, 39 bp, Artificial Sequence
  Synthetic
gcgggggtgcgaaggaaataaggaaccaccgtatccaca

SEQ ID NO: 2742 - DNA, 36 bp, Artificial Sequence
  Synthetic
gcgcgtttccccgttgacggcgcgataatcggcagg

SEQ ID NO: 2743 - DNA, 36 bp, Artificial Sequence
  Synthetic
tcggggataaggcgggcgagacgtccagcggcgtca

SEQ ID NO: 2744 - DNA, 39 bp, Artificial Sequence
  Synthetic
gcgacgcggctttcgaacaggccgcatagtcaaaatgcc

SEQ ID NO: 2745 - DNA, 36 bp, Artificial Sequence
  Synthetic
ggcttatccggtgatggcggccgcagcaattcccgc

SEQ ID NO: 2746 - DNA, 41 bp, Artificial Sequence
  Synthetic
cccgtgatgaagtcccgggattccctcataaaaccgctgcc

SEQ ID NO: 2747 - DNA, 38 bp, Artificial Sequence
  Synthetic
acgagctgggcggtgtgtaaccaccaccagataatcgc

SEQ ID NO: 2748 - DNA, 39 bp, Artificial Sequence
  Synthetic
gcggttacggaggcggacaatcgcatcctcctccttcaa

SEQ ID NO: 2749 - DNA, 40 bp, Artificial Sequence
  Synthetic
ctgttgtcgcagcgtgtggaggccaccagcgtgattttgc

SEQ ID NO: 2750 - DNA, 34 bp, Artificial Sequence
  Synthetic
ttgcggaatcggcgggcagaatccgccgccgcat

SEQ ID NO: 2751 - DNA, 39 bp, Artificial Sequence
  Synthetic
gggctgtacgcgcttaccgtaagcctgtccaacacatcc

SEQ ID NO: 2752 - DNA, 38 bp, Artificial Sequence
  Synthetic
acgagaagggggcggctttcaaaccccaccgcagaatg

SEQ ID NO: 2753 - DNA, 37 bp, Artificial Sequence
  Synthetic
accaactcctaccgcagccagcggcagggatttgacc

SEQ ID NO: 2754 - DNA, 38 bp, Artificial Sequence
  Synthetic
gcggaagtatggtacaggcggtcaccgtgcgccctgtt

SEQ ID NO: 2755 - DNA, 39 bp, Artificial Sequence
  Synthetic
gggcaatgcacgccgaacacaacacggttgtttcagggt

SEQ ID NO: 2756 - DNA, 39 bp, Artificial Sequence
  Synthetic
gccgcctgcccgatattggggtatcacgcgcattcccct

SEQ ID NO: 2757 - DNA, 38 bp, Artificial Sequence
  Synthetic
atcgggcgttcgggcatcacggcgtagttttcaatccg

SEQ ID NO: 2758 - DNA, 39 bp, Artificial Sequence
  Synthetic
cggcctgtaaattccgcgtacgtcaacggcgcggattcg

SEQ ID NO: 2759 - DNA, 35 bp, Artificial Sequence
  Synthetic
ttacggcccggaccaacgccgccggccgatgatga

SEQ ID NO: 2760 - DNA, 39 bp, Artificial Sequence
  Synthetic
gcggtccgcagtcgcattttccactccgaatgtctgacg

SEQ ID NO: 2761 - DNA, 36 bp, Artificial Sequence
  Synthetic
cgaagtatcgcccgccgaaacgtgccggggttctca

SEQ ID NO: 2762 - DNA, 46 bp, Artificial Sequence
  Synthetic
aggttatccaaaaggtttacagcctatactggaatttctgcgtttg

SEQ ID NO: 2763 - DNA, 37 bp, Artificial Sequence
  Synthetic
aacagcctgctgtcgcccgtttggtggcggaggaaac

SEQ ID NO: 2764 - DNA, 39 bp, Artificial Sequence
  Synthetic
atacgcggcggcaaagaacatggtcaggaacaatgcctg

SEQ ID NO: 2765 - DNA, 41 bp, Artificial Sequence
  Synthetic
cggctgttgaccaaaatctgcgataaggcgtggcagaagga

SEQ ID NO: 2766 - DNA, 38 bp, Artificial Sequence
  Synthetic
cgcgcagggtgttgccttagagatggttaacgaaggcg

SEQ ID NO: 2767 - DNA, 38 bp, Artificial Sequence
  Synthetic
tggtggacaattccgcgccgccacatcgacatccaaga

SEQ ID NO: 2768 - DNA, 40 bp, Artificial Sequence
  Synthetic
acgtaaaacctgcaatgcgccagctcgttaccgaacagct

SEQ ID NO: 2769 - DNA, 40 bp, Artificial Sequence
  Synthetic
gtcgccttcgatgatgacggttgccgtttaccgcaacaac

SEQ ID NO: 2770 - DNA, 39 bp, Artificial Sequence
  Synthetic
cgatggttggcaaccgtgcggtatccatcccgattcggc

SEQ ID NO: 2771 - DNA, 40 bp, Artificial Sequence
  Synthetic
attaatacgccccagccgcccttacctctacacggacggc

SEQ ID NO: 2772 - DNA, 43 bp, Artificial Sequence
  Synthetic
ataggcagaatgaccgcagcgatgtttcaaatttcgaagatgt

SEQ ID NO: 2773 - DNA, 39 bp, Artificial Sequence
  Synthetic
accggagtggacgaacctcttagctacccggctatgcaa

SEQ ID NO: 2774 - DNA, 34 bp, Artificial Sequence
  Synthetic
cgcaagctgtttcggcggcttttcctgccgcgcc

SEQ ID NO: 2775 - DNA, 36 bp, Artificial Sequence
  Synthetic
cggtcgaggaggcaatccgtaacgctcaaaccgccg

SEQ ID NO: 2776 - DNA, 36 bp, Artificial Sequence
  Synthetic
gcaccttcgtcgcggatttcggccatcgcgccgttt

SEQ ID NO: 2777 - DNA, 37 bp, Artificial Sequence
  Synthetic
ttggtcgccgagctgccagccctgaaatcgaacgccg

SEQ ID NO: 2778 - DNA, 39 bp, Artificial Sequence
  Synthetic
accatttggtcgcggtgggcttcctgattaccatcggcg

SEQ ID NO: 2779 - DNA, 40 bp, Artificial Sequence
  Synthetic
cgatttgcccgtttacgccctgtcaacagtggcgcgaaac

SEQ ID NO: 2780 - DNA, 38 bp, Artificial Sequence
  Synthetic
acaggatggatttcgcccagccgcggcggcttcagcta

SEQ ID NO: 2781 - DNA, 35 bp, Artificial Sequence
  Synthetic
ggacgacttcgcgttccgcggcagcgttacgggca

SEQ ID NO: 2782 - DNA, 40 bp, Artificial Sequence
  Synthetic
acgagggcatgacgaccgtgggtctggtcggacagattgc

SEQ ID NO: 2783 - DNA, 39 bp, Artificial Sequence
  Synthetic
gctacggcaatcagtgtcaggttctacaccgcccaagca

SEQ ID NO: 2784 - DNA, 37 bp, Artificial Sequence
  Synthetic
atgccgtgcagggcttgggggcacgttctaccaaggc

SEQ ID NO: 2785 - DNA, 38 bp, Artificial Sequence
  Synthetic
cggcccattcgtcttggttgatcagctcgcccaagcca

SEQ ID NO: 2786 - DNA, 35 bp, Artificial Sequence
  Synthetic
cgttgcgcggcagcttgtcctcacccaagccgtct

SEQ ID NO: 2787 - DNA, 38 bp, Artificial Sequence
  Synthetic
ccgggtgcaagcagggtttcggcaaacacccattgacc

SEQ ID NO: 2788 - DNA, 43 bp, Artificial Sequence
  Synthetic
gaggcaaccggcaattattatgacgtaaacgctgtaatactgc

SEQ ID NO: 2789 - DNA, 42 bp, Artificial Sequence
  Synthetic
cgggcgttgtgtgttttgttgtcaatgactaccaccacgacg

SEQ ID NO: 2790 - DNA, 40 bp, Artificial Sequence
  Synthetic
gcaggttgtcggctttgacgtaaactaccgccgcaatacg

SEQ ID NO: 2791 - DNA, 36 bp, Artificial Sequence
  Synthetic
cgtacatcacgccggtcaggcgaagcccagcgcatc

SEQ ID NO: 2792 - DNA, 36 bp, Artificial Sequence
  Synthetic
cttggcaggcttcgcagcgacgcggctacaacgtcg

SEQ ID NO: 2793 - DNA, 35 bp, Artificial Sequence
  Synthetic
aaaggcagacgcggtcgccccgttgcgtttcggaa

SEQ ID NO: 2794 - DNA, 38 bp, Artificial Sequence
  Synthetic
tgggcgcgcaagaagtcggctgccgtagattttgacgg

SEQ ID NO: 2795 - DNA, 38 bp, Artificial Sequence
  Synthetic
acgtgcagcaggcggatttgttcgggtttttgacggcg

SEQ ID NO: 2796 - DNA, 38 bp, Artificial Sequence
  Synthetic
gcggtgtggcgcaggaattgtcgggagccagagtctct

SEQ ID NO: 2797 - DNA, 39 bp, Artificial Sequence
  Synthetic
acatcggcagcatcctcgaaagcgttgcgccataatggt

SEQ ID NO: 2798 - DNA, 35 bp, Artificial Sequence
  Synthetic
acggtttgcaggcagtcgcgcggcggctttgttca

SEQ ID NO: 2799 - DNA, 36 bp, Artificial Sequence
  Synthetic
ccgatgacccagaagccgaccagctgacgggcgtgt

SEQ ID NO: 2800 - DNA, 35 bp, Artificial Sequence
  Synthetic
aactcgccttcgcctgcggcgcagcaaaccgccga

SEQ ID NO: 2801 - DNA, 42 bp, Artificial Sequence
  Synthetic
cggggaaggaaataccgatgggtgcctgatacagtcggtaca

SEQ ID NO: 2802 - DNA, 38 bp, Artificial Sequence
  Synthetic
tccattttggtcggcggcgtttggaaggcaagagcgac

SEQ ID NO: 2803 - DNA, 39 bp, Artificial Sequence
  Synthetic
ggcgcggatgcacttgaagaagtgccgcctgcaaacctc

SEQ ID NO: 2804 - DNA, 37 bp, Artificial Sequence
  Synthetic
ccagtatttcagacggccccgcccaaacgccgcgtgt

SEQ ID NO: 2805 - DNA, 38 bp, Artificial Sequence
  Synthetic
tttggcaaaaccgggcggaacgcaacgacatcctcgcc

SEQ ID NO: 2806 - DNA, 38 bp, Artificial Sequence
  Synthetic
cgggcaggttgagggtgaaatcccgcgctgtacggcat

SEQ ID NO: 2807 - DNA, 38 bp, Artificial Sequence
  Synthetic
cctgccggattgcttgtccgatcgacgaccaccacacc

SEQ ID NO: 2808 - DNA, 38 bp, Artificial Sequence
  Synthetic
cgacttcgatgccgccgtcttagggcaaatgggtctgc

SEQ ID NO: 2809 - DNA, 38 bp, Artificial Sequence
  Synthetic
tgccttggaacatccccatcatcagtacgggaatgagc

SEQ ID NO: 2810 - DNA, 41 bp, Artificial Sequence
  Synthetic
ggaaaggtaaaacacgacgcgcttgaaagtgcgcgaactgt

SEQ ID NO: 2811 - DNA, 38 bp, Artificial Sequence
  Synthetic
cccaggtcttttgcgtcgtccgccaaagccgaactcgc

SEQ ID NO: 2812 - DNA, 42 bp, Artificial Sequence
  Synthetic
ggcgtattcgagataggcgcgtcccataccgattccaacacg

SEQ ID NO: 2813 - DNA, 41 bp, Artificial Sequence
  Synthetic
gcgggttgagggtggaaaagaagcgtgggcgttttacttgt

SEQ ID NO: 2814 - DNA, 42 bp, Artificial Sequence
  Synthetic
gcacggtcgatgtatctgaccgcgtagccggcttctatttcg

SEQ ID NO: 2815 - DNA, 39 bp, Artificial Sequence
  Synthetic
cggcaaggtgttcgccgaggccaaacggcaaaaaaacgc

SEQ ID NO: 2816 - DNA, 46 bp, Artificial Sequence
  Synthetic
cgggttcttgccatcaaatttaactaaacttttggtgctttttccg

SEQ ID NO: 2817 - DNA, 45 bp, Artificial Sequence
  Synthetic
agttcaaaggctacacgtcaaataaaagaaggttcaatatgtcgg

SEQ ID NO: 2818 - DNA, 36 bp, Artificial Sequence
  Synthetic
acaagtaatcccgcgtcccgcggctgtgcgtgaggt

SEQ ID NO: 2819 - DNA, 44 bp, Artificial Sequence
  Synthetic
ccgtccgttctaaaatttgaccaatcctgttttttgacgctgaa

SEQ ID NO: 2820 - DNA, 38 bp, Artificial Sequence
  Synthetic
ggttcgggctttcacaacggagcacatccgccacatcc

SEQ ID NO: 2821 - DNA, 38 bp, Artificial Sequence
  Synthetic
gacttggggcttctggctgccagcaggctgatggcaat

SEQ ID NO: 2822 - DNA, 35 bp, Artificial Sequence
  Synthetic
tatggcaatcggcgcctgccggcccagcaacacca

SEQ ID NO: 2823 - DNA, 39 bp, Artificial Sequence
  Synthetic
cggctcagggattcgacaatgtctcccgcaacaatgggc

SEQ ID NO: 2824 - DNA, 39 bp, Artificial Sequence
  Synthetic
ctcgccggacaattcattgctgggcacctgtatcggcgt

SEQ ID NO: 2825 - DNA, 36 bp, Artificial Sequence
  Synthetic
gctcgggcttttaccgcgtcaaacccaagccgcacc

SEQ ID NO: 2826 - DNA, 40 bp, Artificial Sequence
  Synthetic
acggctttttctttgggctcggaaaagccgaaaccgcacc

SEQ ID NO: 2827 - DNA, 38 bp, Artificial Sequence
  Synthetic
cggatatcgagctgcacagccgtgagttcgggcgggag

SEQ ID NO: 2828 - DNA, 40 bp, Artificial Sequence
  Synthetic
ccaccacacgccatgtcgaaaggaaaaccaacatgtccgc

SEQ ID NO: 2829 - DNA, 37 bp, Artificial Sequence
  Synthetic
tggttcgagggcaggctggacctgttcccgattggcg

SEQ ID NO: 2830 - DNA, 35 bp, Artificial Sequence
  Synthetic
tggcggcaaccttcggtaccagcgtgcagagccac

SEQ ID NO: 2831 - DNA, 39 bp, Artificial Sequence
  Synthetic
caatccctgcgtgcttcggggcgaagaaagccttgccaa

SEQ ID NO: 2832 - DNA, 40 bp, Artificial Sequence
  Synthetic
tccactgcttgccctcaacaagatggcggacggtataggc

SEQ ID NO: 2833 - DNA, 38 bp, Artificial Sequence
  Synthetic
tcgccagcttgcctgtccgcggagcatccaaatggcag

SEQ ID NO: 2834 - DNA, 38 bp, Artificial Sequence
  Synthetic
cccgttgcgtttcggaatgcccgtaaaggcagacgcgg

SEQ ID NO: 2835 - DNA, 40 bp, Artificial Sequence
  Synthetic
gttggaagtttgacgggggctcaccagaggttcgtccact

SEQ ID NO: 2836 - DNA, 43 bp, Artificial Sequence
  Synthetic
tccgttcaattgcttatttgttcaaaaagatgaagcggcaatg

SEQ ID NO: 2837 - DNA, 40 bp, Artificial Sequence
  Synthetic
ctgcctgcgggaatgtcgaaccaaacccaatgcttcaacc

SEQ ID NO: 2838 - DNA, 41 bp, Artificial Sequence
  Synthetic
acggacagatggatcggcatttgcggatccgggtttgatta

SEQ ID NO: 2839 - DNA, 39 bp, Artificial Sequence
  Synthetic
tatgcggcggcagggcttctttgccgaaaatatccccca

SEQ ID NO: 2840 - DNA, 36 bp, Artificial Sequence
  Synthetic
tacagttccgcgccgcactgcctgtatttccgcgac

SEQ ID NO: 2841 - DNA, 41 bp, Artificial Sequence
  Synthetic
cggcttgaccacccagaactgaactcaatgcggacgtatcc

SEQ ID NO: 2842 - DNA, 40 bp, Artificial Sequence
  Synthetic
attgctcaacgccgcttcgacgcacaaaaccatgtttggg

SEQ ID NO: 2843 - DNA, 37 bp, Artificial Sequence
  Synthetic
tgctcttctcgccgacagcgcgcgccatttgagtttc

SEQ ID NO: 2844 - DNA, 38 bp, Artificial Sequence
  Synthetic
ggcggtcgcttcgtccaactgcatcgatttgaccggtt

SEQ ID NO: 2845 - DNA, 37 bp, Artificial Sequence
  Synthetic
cgctgtgggtgtcggtcaggcttgaaagcccacctcg

SEQ ID NO: 2846 - DNA, 38 bp, Artificial Sequence
  Synthetic
ggttcgatcatcagcgtgccggactacggcttccacgc

SEQ ID NO: 2847 - DNA, 34 bp, Artificial Sequence
  Synthetic
cgcgagagtacggatgcgctcaacgcgccgcaca

SEQ ID NO: 2848 - DNA, 39 bp, Artificial Sequence
  Synthetic
agacaagggtgcggcagcccctgacaggttgcttcgaag

SEQ ID NO: 2849 - DNA, 35 bp, Artificial Sequence
  Synthetic
gcgcagggacgcatcgttacccgactttgagcgcg

SEQ ID NO: 2850 - DNA, 39 bp, Artificial Sequence
  Synthetic
ccacacaagccatcctgcccgtcggggtggacttcaaag

SEQ ID NO: 2851 - DNA, 39 bp, Artificial Sequence
  Synthetic
agcgcacacccaaacctggatcaggtcggtcagatagct

SEQ ID NO: 2852 - DNA, 40 bp, Artificial Sequence
  Synthetic
aagtcatcgacaacgcggcgttgcacgtcgatttcagtgg

SEQ ID NO: 2853 - DNA, 38 bp, Artificial Sequence
  Synthetic
tgggcttgaaagtcgtgcgcaccgtatgttccgcaacc

SEQ ID NO: 2854 - DNA, 39 bp, Artificial Sequence
  Synthetic
gcctgtaccgttgccgtcatggcggggttcagttcgatg

SEQ ID NO: 2855 - DNA, 39 bp, Artificial Sequence
  Synthetic
gcccaagcccttatcctgcaaagcggatgaagccttcgc

SEQ ID NO: 2856 - DNA, 37 bp, Artificial Sequence
  Synthetic
tgggacgaaacccggggcttgaaacatctgccgcgtc

SEQ ID NO: 2857 - DNA, 39 bp, Artificial Sequence
  Synthetic
ggcggacgcgttgaaggtggcaaaaaccaccgtttaccg

SEQ ID NO: 2858 - DNA, 38 bp, Artificial Sequence
  Synthetic
aaggcgtggctttcggcgccatactgacggttctgcag

SEQ ID NO: 2859 - DNA, 35 bp, Artificial Sequence
  Synthetic
agccgtgcgctatacccgccggcaagcgtcccgtt

SEQ ID NO: 2860 - DNA, 38 bp, Artificial Sequence
  Synthetic
tgaatggttgtggcagcccggttgacggtgcggacatt

SEQ ID NO: 2861 - DNA, 36 bp, Artificial Sequence
  Synthetic
cggcttgggacattgcctccccgtcgtgcgaggcat

SEQ ID NO: 2862 - DNA, 39 bp, Artificial Sequence
  Synthetic
gcggtcggacacgtcaaactggaagaaatccgcgctttg

SEQ ID NO: 2863 - DNA, 34 bp, Artificial Sequence
  Synthetic
cccggtgccgtgcagattcattgcagcacgccgg

SEQ ID NO: 2864 - DNA, 35 bp, Artificial Sequence
  Synthetic
agccggggcggaagtttcccgttcgcgtggggcat

SEQ ID NO: 2865 - DNA, 41 bp, Artificial Sequence
  Synthetic
gcgcagacgttttctgacggcttcggcaaaaaagaaaccgc

SEQ ID NO: 2866 - DNA, 36 bp, Artificial Sequence
  Synthetic
gccaatatcggtgcggcgcgtaccgacgcttccggt

SEQ ID NO: 2867 - DNA, 38 bp, Artificial Sequence
  Synthetic
agcagcagctacaatgtcggaccacgcgcccgaacaga

SEQ ID NO: 2868 - DNA, 40 bp, Artificial Sequence
  Synthetic
cctcgaatggggcggacagtcaaaatcagggtttgcgagc

SEQ ID NO: 2869 - DNA, 38 bp, Artificial Sequence
  Synthetic
cgacatccgcaccgcattgggttcgggaagtcgctgac

SEQ ID NO: 2870 - DNA, 40 bp, Artificial Sequence
  Synthetic
gaccgaagaccaaggcttcgttcatcggtgcgctctttgg

SEQ ID NO: 2871 - DNA, 37 bp, Artificial Sequence
  Synthetic
ccgaaacctatatcggggcgcgatacgggcggcggtt

SEQ ID NO: 2872 - DNA, 39 bp, Artificial Sequence
  Synthetic
ccaaacatcccgccaaaggcctgatgagggcttcgagga

SEQ ID NO: 2873 - DNA, 41 bp, Artificial Sequence
  Synthetic
ccgcttcctcgacagcgaaagtactgcaaaaggtgatgccg

SEQ ID NO: 2874 - DNA, 41 bp, Artificial Sequence
  Synthetic
cgacggtcggagaatgggtggtccggcttcgaacaatctgt

SEQ ID NO: 2875 - DNA, 38 bp, Artificial Sequence
  Synthetic
cctggaagcaggcggtagacctgccacatcgggttgcc

SEQ ID NO: 2876 - DNA, 38 bp, Artificial Sequence
  Synthetic
gggcaacgtcatcgaagcggcctgcgtcagatcgggat

SEQ ID NO: 2877 - DNA, 38 bp, Artificial Sequence
  Synthetic
tttggggcggcaagttcgtgcggttcgacaccccattt

SEQ ID NO: 2878 - DNA, 39 bp, Artificial Sequence
  Synthetic
gccgctattccgacgaatggcctcaggcacgacatcacg

SEQ ID NO: 2879 - DNA, 38 bp, Artificial Sequence
  Synthetic
atgcggcaggtttgatggatggacttttctcccacgaa

SEQ ID NO: 2880 - DNA, 39 bp, Artificial Sequence
  Synthetic
gcgttttgctggcggatgtagaggctgggtcaaatccgg

SEQ ID NO: 2881 - DNA, 34 bp, Artificial Sequence
  Synthetic
tcgcgcaaaagcccggaggggcaagtgttcgccg

SEQ ID NO: 2882 - DNA, 37 bp, Artificial Sequence
  Synthetic
ccgaatacgccgacaccgacgtacggctgcggacggt

SEQ ID NO: 2883 - DNA, 36 bp, Artificial Sequence
  Synthetic
gggcaacataagcggcggacgttgtggtagccgccg

SEQ ID NO: 2884 - DNA, 40 bp, Artificial Sequence
  Synthetic
cgccgtctttgcctacacccatatcacgaagacggctcgg

SEQ ID NO: 2885 - DNA, 39 bp, Artificial Sequence
  Synthetic
accacggcaggttacggattgatgtcgaaaccgccgttg

SEQ ID NO: 2886 - DNA, 42 bp, Artificial Sequence
  Synthetic
gttccgctgattaaggccttgcattttccaacacctgcttgc

SEQ ID NO: 2887 - DNA, 38 bp, Artificial Sequence
  Synthetic
ccgaaccgtgcctgctgtaaccaccacgtcgtaatcgt

SEQ ID NO: 2888 - DNA, 35 bp, Artificial Sequence
  Synthetic
cgccgaagaacagtccggtggcgcatacacgtcgg

SEQ ID NO: 2889 - DNA, 40 bp, Artificial Sequence
  Synthetic
tggcaatgctgtcttcgcggaactacaccaaccgttctcc

SEQ ID NO: 2890 - DNA, 35 bp, Artificial Sequence
  Synthetic
ttgtccgcacgaaccgccgcgcgcttgccagccaa

SEQ ID NO: 2891 - DNA, 38 bp, Artificial Sequence
  Synthetic
gcgcgctttggcaaacgatatcggcaatttcctgctgg

SEQ ID NO: 2892 - DNA, 38 bp, Artificial Sequence
  Synthetic
tgcccgcgccgattttgggcaaacgcctcgatattggg

SEQ ID NO: 2893 - DNA, 42 bp, Artificial Sequence
  Synthetic
acagataacctgcggcggcaaatacgcaaacactacgtctgc

SEQ ID NO: 2894 - DNA, 36 bp, Artificial Sequence
  Synthetic
gccttgccgaacgcgaacggcgcggtgcaaatcttg

SEQ ID NO: 2895 - DNA, 36 bp, Artificial Sequence
  Synthetic
cgtgttgcacagccggatggcccaacatcgcgcgca

SEQ ID NO: 2896 - DNA, 35 bp, Artificial Sequence
  Synthetic
agcagcgcgtctccatcgcggctcgtcggcgaaga

SEQ ID NO: 2897 - DNA, 41 bp, Artificial Sequence
  Synthetic
cgtcgtcgccgtagacatcaagatacgcctttcaaacggct

SEQ ID NO: 2898 - DNA, 40 bp, Artificial Sequence
  Synthetic
cccttctgccttctggacgaagagcttgcagaaacgcgag

SEQ ID NO: 2899 - DNA, 38 bp, Artificial Sequence
  Synthetic
ccctgatcaacgccaaacgctacttcgagcgcgtccag

SEQ ID NO: 2900 - DNA, 39 bp, Artificial Sequence
  Synthetic
tggcggaagagcagaccgttagcgatgtcgtctgaaagc

SEQ ID NO: 2901 - DNA, 40 bp, Artificial Sequence
  Synthetic
gcaggcggcatggctttcagacctgtacgggcagggattt

SEQ ID NO: 2902 - DNA, 36 bp, Artificial Sequence
  Synthetic
agcaggaagccgccgacttttgccacagttgcggcg

SEQ ID NO: 2903 - DNA, 35 bp, Artificial Sequence
  Synthetic
cgaggcaaaccgcatccgctcggcatgggcaagct

SEQ ID NO: 2904 - DNA, 40 bp, Artificial Sequence
  Synthetic
ggcaaaactgcccgccacataatgggggcggtgtttaagc

SEQ ID NO: 2905 - DNA, 40 bp, Artificial Sequence
  Synthetic
ggcgatttgctgctgaatcggatcggtgcgttcttctccg

SEQ ID NO: 2906 - DNA, 38 bp, Artificial Sequence
  Synthetic
gccttcttcgacttggctgtcgtgcctgtccgacgacc

SEQ ID NO: 2907 - DNA, 38 bp, Artificial Sequence
  Synthetic
tgctctacctggccgggttttatgccaaaagccccgtc

SEQ ID NO: 2908 - DNA, 38 bp, Artificial Sequence
  Synthetic
cacttgcccgcttttttgcagctgggaacaagccgcca

SEQ ID NO: 2909 - DNA, 40 bp, Artificial Sequence
  Synthetic
gatgttttcggggaacacggctcgacaacacgctcgttct

SEQ ID NO: 2910 - DNA, 39 bp, Artificial Sequence
  Synthetic
cggtcatcagggcggtgtcttgaaaccctgaccctctgc

SEQ ID NO: 2911 - DNA, 37 bp, Artificial Sequence
  Synthetic
gtaggtctcggtgtcatcgccgcgtccagggtcagct

SEQ ID NO: 2912 - DNA, 38 bp, Artificial Sequence
  Synthetic
acgtgattgccgaacagggcacttcctgatcgcgcatc

SEQ ID NO: 2913 - DNA, 40 bp, Artificial Sequence
  Synthetic
aaagcaggtgccaaccgcttgggtttgtaccaacagtccg

SEQ ID NO: 2914 - DNA, 38 bp, Artificial Sequence
  Synthetic
acgccaccgacaccaccagtctacttcgcggttgaagg

SEQ ID NO: 2915 - DNA, 38 bp, Artificial Sequence
  Synthetic
ccgccgcgaaaaactggaaacaatggcggggaagtcgg

SEQ ID NO: 2916 - DNA, 38 bp, Artificial Sequence
  Synthetic
cggcgtatcgctcaaaatgccgcgcgtaggtcagttcc

SEQ ID NO: 2917 - DNA, 34 bp, Artificial Sequence
  Synthetic
tgccgccgcattgctgaccgcctaagccgatgcg

SEQ ID NO: 2918 - DNA, 37 bp, Artificial Sequence
  Synthetic
caaaccgaaagcgcgggcccgtacacgctccaaaccg

SEQ ID NO: 2919 - DNA, 43 bp, Artificial Sequence
  Synthetic
ggcacaccaaaaatcatggcttaacacagagtatgcaacttac

SEQ ID NO: 2920 - DNA, 43 bp, Artificial Sequence
  Synthetic
gctgctgattatctgccgtaaacagtatgacaatttgctgaac

SEQ ID NO: 2921 - DNA, 39 bp, Artificial Sequence
  Synthetic
cggtgtgccattggtagattttgctgattaccaccaaca

SEQ ID NO: 2922 - DNA, 41 bp, Artificial Sequence
  Synthetic
gtcccacaattcaaaaccgtcttttgggtcaaaatgggtgc

SEQ ID NO: 2923 - DNA, 44 bp, Artificial Sequence
  Synthetic
ggctgtttttcaggttgcttaattttgaaatgttcaacggcatt

SEQ ID NO: 2924 - DNA, 40 bp, Artificial Sequence
  Synthetic
tttgagcttgtcagcagccgactgaaaatgcgcctgctca

SEQ ID NO: 2925 - DNA, 44 bp, Artificial Sequence
  Synthetic
tgccaaacaccgacataatcatcttcttgttttgatgttggcag

SEQ ID NO: 2926 - DNA, 43 bp, Artificial Sequence
  Synthetic
cgcttgtttacgagttttcaaacaaactttagcgcgaaaccat

SEQ ID NO: 2927 - DNA, 38 bp, Artificial Sequence
  Synthetic
gccctgccacaaacagatttcctgcatttcccaaaagc

SEQ ID NO: 2928 - DNA, 42 bp, Artificial Sequence
  Synthetic
gtggcaatgaatggaatattgtcccaaccgcttgaaacactt

SEQ ID NO: 2929 - DNA, 42 bp, Artificial Sequence
  Synthetic
agactgttcccgataactcgccatacaggacataatgcctac

SEQ ID NO: 2930 - DNA, 47 bp, Artificial Sequence
  Synthetic
gccttaatccaacaaaaaatgacgagcatatccggcaaataatcttg

SEQ ID NO: 2931 - DNA, 39 bp, Artificial Sequence
  Synthetic
agcgcgttattgttcaacagcgtcgtcaaagcaggcaaa

SEQ ID NO: 2932 - DNA, 41 bp, Artificial Sequence
  Synthetic
gtcggtgtgattgccgccattacggcaataatcgacagcgc

SEQ ID NO: 2933 - DNA, 36 bp, Artificial Sequence
  Synthetic
tatcgacctgcgccgccctgcccgtagcgacttggt

SEQ ID NO: 2934 - DNA, 49 bp, Artificial Sequence
  Synthetic
cagaaatcggttattgacgaagtgagatagggagagaaataaatatcgt

SEQ ID NO: 2935 - DNA, 35 bp, Artificial Sequence
  Synthetic
tgcggtgatgtcggcagggcctgatcgaatggccg

SEQ ID NO: 2936 - DNA, 35 bp, Artificial Sequence
  Synthetic
ggcgcgtaccgttttggcagccggcacactgttcg

SEQ ID NO: 2937 - DNA, 35 bp, Artificial Sequence
  Synthetic
gcgtcggcgtggatggagagcgtgtcgccaaaggg

SEQ ID NO: 2938 - DNA, 41 bp, Artificial Sequence
  Synthetic
gcttctcttcggcaggattggagcacccgatatgccgtcta

SEQ ID NO: 2939 - DNA, 39 bp, Artificial Sequence
  Synthetic
aggtcgaggcgggcgaaacgccgagttcttctccaaact

SEQ ID NO: 2940 - DNA, 39 bp, Artificial Sequence
  Synthetic
cgacgcattgggcaagcccgatgccttgttcttccagcc

SEQ ID NO: 2941 - DNA, 40 bp, Artificial Sequence
  Synthetic
acgccgaacaaatcaggcagttcgaccaagcccaaatcgc

SEQ ID NO: 2942 - DNA, 38 bp, Artificial Sequence
  Synthetic
atggatgggcggatggcggcaacaccagctcgttcaca

SEQ ID NO: 2943 - DNA, 42 bp, Artificial Sequence
  Synthetic
gcggcaatcaagcatttcggacgaagcagtcgtctatggtcg

SEQ ID NO: 2944 - DNA, 35 bp, Artificial Sequence
  Synthetic
tgcccccgttttggctgccgaccaggccctgcgta

SEQ ID NO: 2945 - DNA, 40 bp, Artificial Sequence
  Synthetic
cgcaccggcattcacatctgttaagcaagcgaaaacggca

SEQ ID NO: 2946 - DNA, 38 bp, Artificial Sequence; identical to SEQ ID NO: 2734
  Synthetic

SEQ ID NO: 2947 - DNA, 41 bp, Artificial Sequence
  Synthetic
cggggaatcagaagcggtagcaaacacccgcttcaaaaccc

SEQ ID NO: 2948 - DNA, 36 bp, Artificial Sequence
  Synthetic
acgcggggtttgggcaacgggaatccggacctgtcc

SEQ ID NO: 2949 - DNA, 37 bp, Artificial Sequence
  Synthetic
cccaaagccgttcccgttgccaaccatacggacggcg

SEQ ID NO: 2950 - DNA, 42 bp, Artificial Sequence
  Synthetic
acacgccgtcgatttggtgatttgtcgatgacggtagtcgga

SEQ ID NO: 2951 - DNA, 35 bp, Artificial Sequence
  Synthetic
tttcccggcctgcccaacgccgctccggcatggtt

SEQ ID NO: 2952 - DNA, 36 bp, Artificial Sequence
  Synthetic
gaagtgcgcttcgggcatcccctgacattcggcggc

SEQ ID NO: 2953 - DNA, 35 bp, Artificial Sequence
  Synthetic
ccgattacaccgcctccagcgcgcgtaccggcaaa

SEQ ID NO: 2954 - DNA, 38 bp, Artificial Sequence
  Synthetic
tgcgtccgccggcgatttcattggatggcgagatgtgg

SEQ ID NO: 2955 - DNA, 42 bp, Artificial Sequence
  Synthetic
ccaaatgcctgacggtgcagtgcgcgggttggaagtattggt

SEQ ID NO: 2956 - DNA, 38 bp, Artificial Sequence
  Synthetic
tcgaatttttcggcgagggcgccggcgtcatgttggaa

SEQ ID NO: 2957 - DNA, 36 bp, Artificial Sequence
  Synthetic
gcggtttggaagcggaaaccatatcgggcaggcgca

SEQ ID NO: 2958 - DNA, 38 bp, Artificial Sequence
  Synthetic
cccgatacggttgaggtcgtccggcatggtcgccccaa

SEQ ID NO: 2959 - DNA, 38 bp, Artificial Sequence
  Synthetic
gcgacatcaagttgccaaacggcggggtggtgtccgta

SEQ ID NO: 2960 - DNA, 36 bp, Artificial Sequence
  Synthetic
tcgggcgcggagagtggttcagaaagccgcgtttgc

SEQ ID NO: 2961 - DNA, 34 bp, Artificial Sequence
  Synthetic
gatgcgccgcaaatccgcacgcagtcggtcaggt

SEQ ID NO: 2962 - DNA, 33 bp, Artificial Sequence
  Synthetic
aaaacggcgggcgcgtgcggcggttcacaatgt

SEQ ID NO: 2963 - DNA, 40 bp, Artificial Sequence
  Synthetic
ccgcaaacccacctcgtcaaaaatggcggtcagaatcagc

SEQ ID NO: 2964 - DNA, 40 bp, Artificial Sequence
  Synthetic
tgagtttgaacgatgtggcggacgttcagacggcctttga

SEQ ID NO: 2965 - DNA, 41 bp, Artificial Sequence
  Synthetic
gggcgcggataaagtcgtcgtacgttgatgatgtcgtgcgg

SEQ ID NO: 2966 - DNA, 37 bp, Artificial Sequence
  Synthetic
ccgtcaacaaggcgcaacagcgactggtcaaggccgt

SEQ ID NO: 2967 - DNA, 38 bp, Artificial Sequence
  Synthetic
agcgaacagcggcgcaacgtttgattgccgaaccaggt

SEQ ID NO: 2968 - DNA, 39 bp, Artificial Sequence
  Synthetic
gcacacgtcatcggatttaccagcgaaagttccaaacct

SEQ ID NO: 2969 - DNA, 41 bp, Artificial Sequence
  Synthetic
gcgcacacgaattaagcatcgaatgtcgcggaatttggcag

SEQ ID NO: 2970 - DNA, 40 bp, Artificial Sequence
  Synthetic
tgaagaaaaggcgggcgagccgtgctttcttgcgcactgc

SEQ ID NO: 2971 - DNA, 41 bp, Artificial Sequence
  Synthetic
tgccgtctgaaacacattaaggacagaccttttccggattg

SEQ ID NO: 2972 - DNA, 39 bp, Artificial Sequence
  Synthetic
ccgttttggaacgcgtcatcgcggcgttgactttgccct

SEQ ID NO: 2973 - DNA, 37 bp, Artificial Sequence
  Synthetic
cggaaatgccgttgccttcgtcatccacgccatcggc

SEQ ID NO: 2974 - DNA, 35 bp, Artificial Sequence
  Synthetic
tcgcgcacttcggcaatgggatgcttgccgtgcgc

SEQ ID NO: 2975 - DNA, 37 bp, Artificial Sequence
  Synthetic
ggtttgttcggcaggtttggcggcgaagtcgtgtccg

SEQ ID NO: 2976 - DNA, 35 bp, Artificial Sequence
  Synthetic
gttgatcaggcgcgccactgatgccagcatcggcg

SEQ ID NO: 2977 - DNA, 36 bp, Artificial Sequence
  Synthetic
ccgagtaggaagccagcggggaccgaacttgccgcc

SEQ ID NO: 2978 - DNA, 39 bp, Artificial Sequence
  Synthetic
tccccagttgtggtagcggtatcggtttcgacatcacgc

SEQ ID NO: 2979 - DNA, 37 bp, Artificial Sequence
  Synthetic
tgccgctgtgggtcagtgcgccatgtacggtttgggt

SEQ ID NO: 2980 - DNA, 38 bp, Artificial Sequence
  Synthetic
gctgccggtggcgaaggtaaaacgccaaggcaaccaaa

SEQ ID NO: 2981 - DNA, 38 bp, Artificial Sequence
  Synthetic
cctcgcctttcagacgatggatggcttgcccgtcttgg

SEQ ID NO: 2982 - DNA, 39 bp, Artificial Sequence
  Synthetic
ggcggcttcgtcgcacaaaccatcggaaaacacgtcgcc

SEQ ID NO: 2983 - DNA, 39 bp, Artificial Sequence
  Synthetic
tgccgacggacgaacgctgacaaacgcaagacttcgtct

SEQ ID NO: 2984 - DNA, 39 bp, Artificial Sequence
  Synthetic
cgcacgcgaacagggcttgtcgatgcccgtaaacgttac

SEQ ID NO: 2985 - DNA, 34 bp, Artificial Sequence
  Synthetic
attgccgccgcccaacaatttccggcggcgaacg

SEQ ID NO: 2986 - DNA, 41 bp, Artificial Sequence
  Synthetic
tgtttgtgctggcgtttgtgcgacggaacagaacaaatgcc

SEQ ID NO: 2987 - DNA, 39 bp, Artificial Sequence
  Synthetic
gaacaaaagctgctccgtcccggggcaaacggcaacagc

SEQ ID NO: 2988 - DNA, 43 bp, Artificial Sequence
  Synthetic
tctcaatctgcaggtgctgaaatcgtacaggttaatcaaatgg

SEQ ID NO: 2989 - DNA, 38 bp, Artificial Sequence
  Synthetic
gtctgtgcctgtgtcctgcataccccctaccctgaccg

SEQ ID NO: 2990 - DNA, 36 bp, Artificial Sequence
  Synthetic
ggcaatcccgccgatgttcacgaagccctgttccgc

SEQ ID NO: 2991 - DNA, 37 bp, Artificial Sequence
  Synthetic
cggagagcgcgtcggatttcccgatacagctaccccg

SEQ ID NO: 2992 - DNA, 40 bp, Artificial Sequence
  Synthetic
cacagtttcggcaaggctttccgacagggcggttgtcatc

SEQ ID NO: 2993 - DNA, 40 bp, Artificial Sequence
  Synthetic
cgtattgaccgcaccggcagacaggaagcgtttcatctgg

SEQ ID NO: 2994 - DNA, 39 bp, Artificial Sequence
  Synthetic
ctgggtgtcggctacctgcttgttcgacggtcattttgc

SEQ ID NO: 2995 - DNA, 35 bp, Artificial Sequence
  Synthetic
gcaaccatggcctcgaccggtgtgccgcttccgca

SEQ ID NO: 2996 - DNA, 41 bp, Artificial Sequence
  Synthetic
ggcaggcactttaatcatggcgaggcacggtagaagaagcc

SEQ ID NO: 2997 - DNA, 37 bp, Artificial Sequence
  Synthetic
ggcgacaacttggatatgggcatacgcgcgcggcatt

SEQ ID NO: 2998 - DNA, 39 bp, Artificial Sequence
  Synthetic
aaaagctgcacgcggtttgcaatatttcaccgcccccga

SEQ ID NO: 2999 - DNA, 38 bp, Artificial Sequence
  Synthetic
cgggcgaggttttgggtgtaactccccgaccgcgacat

SEQ ID NO: 3000 - DNA, 36 bp, Artificial Sequence
  Synthetic
cgcccaaacactgctgcaaacgcggacaagacctgc

SEQ ID NO: 3001 - DNA, 38 bp, Artificial Sequence
  Synthetic
ttggtgcaacgcctctacacatcgcaggattgtgccgc

SEQ ID NO: 3002 - DNA, 39 bp, Artificial Sequence
  Synthetic
acggctacaacgaggtcaacctccgaacgcgcctttctg

SEQ ID NO: 3003 - DNA, 36 bp, Artificial Sequence
  Synthetic
ccgacggataagcgacgtgcgccgcctttgtccgca

SEQ ID NO: 3004 - DNA, 39 bp, Artificial Sequence
  Synthetic
tatgcgggctttttccacgccttaaggcggctttgtcgg

SEQ ID NO: 3005 - DNA, 39 bp, Artificial Sequence
  Synthetic
tggacgcttggcaaccggcgtaccgcttcaggaaatcgc

SEQ ID NO: 3006 - DNA, 39 bp, Artificial Sequence
  Synthetic
gcgaatgtctgccatgttcgggcccagttgaacagggga

SEQ ID NO: 3007 - DNA, 39 bp, Artificial Sequence
  Synthetic
cgctcctgaccgccctgttcttaccccgtatcggcaaac

SEQ ID NO: 3008 - DNA, 38 bp, Artificial Sequence
  Synthetic
gtacaagtaatcccgcgtcccgcggctgtgcgtgaggt

SEQ ID NO: 3009 - DNA, 35 bp, Artificial Sequence
  Synthetic
ccgacaaacaggccgcacccggcgcggcaaagtct

SEQ ID NO: 3010 - DNA, 35 bp, Artificial Sequence
  Synthetic
agggccgcaccaaatcggcgcgaactcaacgccgc

SEQ ID NO: 3011 - DNA, 44 bp, Artificial Sequence
  Synthetic
gccattaaaagaccagggcattcgaaaagtaattcttggttgcc

SEQ ID NO: 3012 - DNA, 42 bp, Artificial Sequence
  Synthetic
tgctgattgtcgtattcggcggttccacataatgaagcggct

SEQ ID NO: 3013 - DNA, 40 bp, Artificial Sequence
  Synthetic
agtcgcgcatgtgcctgaaaaaatcaaactgattgccgcc

SEQ ID NO: 3014 - DNA, 41 bp, Artificial Sequence
  Synthetic
ggaagaaacggcaatgacggcttccgaaaaaggcctgaccg

SEQ ID NO: 3015 - DNA, 38 bp, Artificial Sequence
  Synthetic
gtggacgatgcctacgaagcctcgcggacgacgtttcc

SEQ ID NO: 3016 - DNA, 39 bp, Artificial Sequence
  Synthetic
tgccgcaactgccacttcaaacatttgttgcaggcggga

SEQ ID NO: 3017 - DNA, 39 bp, Artificial Sequence
  Synthetic
caggttcggtcgtcgtgtccgacggcacagtaaaggctg

SEQ ID NO: 3018 - DNA, 41 bp, Artificial Sequence
  Synthetic
gccgcacccaccatcattgaaggccttcgacgatttcggaa

SEQ ID NO: 3019 - DNA, 35 bp, Artificial Sequence
  Synthetic
ggtgggcggacgctattcccgccaaccgcaaccat

SEQ ID NO: 3020 - DNA, 36 bp, Artificial Sequence
  Synthetic
cgctgcatacggctttgcgctccctgccgtccgcat

SEQ ID NO: 3021 - DNA, 36 bp, Artificial Sequence
  Synthetic
ccgattccgccggtcagtcactggtggctgacccat

SEQ ID NO: 3022 - DNA, 42 bp, Artificial Sequence
  Synthetic
ccgcgtacatactcaactccataacccaatttcgcacaatgg

SEQ ID NO: 3023 - DNA, 36 bp, Artificial Sequence
  Synthetic
cccgaggttgaagccgtgtggctgatcggcgatgcg

SEQ ID NO: 3024 - DNA, 35 bp, Artificial Sequence
  Synthetic
gcacacatggcggctgcacctgaccggcgttccct

SEQ ID NO: 3025 - DNA, 41 bp, Artificial Sequence
  Synthetic
cgaaaagcgtgccgccttgtgcgaattgaacggcttatggc

SEQ ID NO: 3026 - DNA, 37 bp, Artificial Sequence
  Synthetic
gcgttcttcccactgctgcaatgaccgccctgacagg

SEQ ID NO: 3027 - DNA, 43 bp, Artificial Sequence
  Synthetic
gcttgaaaaaacgtgttttaagggaaaccgaaaatgccgtctt

SEQ ID NO: 3028 - DNA, 40 bp, Artificial Sequence
  Synthetic
cggaaaaaatgtcggggatggctcctcctcaaacccgacc

SEQ ID NO: 3029 - DNA, 36 bp, Artificial Sequence
  Synthetic
cctgtccggcatccagacaggccgcatccgcctaca

SEQ ID NO: 3030 - DNA, 42 bp, Artificial Sequence
  Synthetic
cgcatcatcagcgtgttgtcggcggacggcaagaaataccgg

SEQ ID NO: 3031 - DNA, 41 bp, Artificial Sequence
  Synthetic
ggcagaaaaaatccgcgctcaagatgcgctgtttgcacaaa

SEQ ID NO: 3032 - DNA, 34 bp, Artificial Sequence
  Synthetic
cgaagtcagcaccgcgcctagcgcgtcccacctt

SEQ ID NO: 3033 - DNA, 38 bp, Artificial Sequence
  Synthetic
gccattcgatgacggcggccctccatatacgccagccc

SEQ ID NO: 3034 - DNA, 36 bp, Artificial Sequence
  Synthetic
ttgccgccgcgttgttctacatgcccgacaacccca

SEQ ID NO: 3035 - DNA, 41 bp, Artificial Sequence
  Synthetic
tttgagtgccgacgagaaccaggtaatactgttcctctacc

SEQ ID NO: 3036 - DNA, 40 bp, Artificial Sequence
  Synthetic
gccgccgatttggatgtcacttccgtaacggcgcattacg

SEQ ID NO: 3037 - DNA, 38 bp, Artificial Sequence
  Synthetic
cgtcatcctgcccaaacttgccgcaaggtcgtgcgcca

SEQ ID NO: 3038 - DNA, 41 bp, Artificial Sequence
  Synthetic
tcggtagggctgaacattgcccaaggcgatgtcctgatacg

SEQ ID NO: 3039 - DNA, 41 bp, Artificial Sequence
  Synthetic
gctcaaacccggacaggtcggatttgatgatgtgccagccg

SEQ ID NO: 3040 - DNA, 36 bp, Artificial Sequence
  Synthetic
cggcgcggaaagtaccatcctgcgaaatccgtgccg

SEQ ID NO: 3041 - DNA, 41 bp, Artificial Sequence
  Synthetic
cattgccgaaaaagtccgccagatttcagcttcgctcacgc

SEQ ID NO: 3042 - DNA, 36 bp, Artificial Sequence
  Synthetic
gtcaaagctgccgccacggggataccgccctgctgt

SEQ ID NO: 3043 - DNA, 35 bp, Artificial Sequence
  Synthetic
accgaacaaggcggacggtcgcccaacatttcggc

SEQ ID NO: 3044 - DNA, 36 bp, Artificial Sequence
  Synthetic
accctcggttcgacctgccttcggttctctcggggc

SEQ ID NO: 3045 - DNA, 40 bp, Artificial Sequence
  Synthetic
tttgcaccctgcggcaaatggcacactgatacccaaagca

SEQ ID NO: 3046 - DNA, 38 bp, Artificial Sequence
  Synthetic
cggtgtttgccgcgtatcgaatcgcacttgccgcagaa

SEQ ID NO: 3047 - DNA, 40 bp, Artificial Sequence
  Synthetic
gctttcgtcggagaggacggtactggcggtatgaacaggc

SEQ ID NO: 3048 - DNA, 37 bp, Artificial Sequence
  Synthetic
gctccctgcttagcggaacggagaatccgcccgaccg

SEQ ID NO: 3049 - DNA, 35 bp, Artificial Sequence
  Synthetic
gcgtttccggcccgaacagcgcgccccgatgaaac

SEQ ID NO: 3050 - DNA, 38 bp, Artificial Sequence
  Synthetic
gggcggcggtaaaggcgttttcacgggcgcaaaacttc

SEQ ID NO: 3051 - DNA, 39 bp, Artificial Sequence
  Synthetic
tcttctgcaaccgcccgcgacggctttgggcattttgtc

SEQ ID NO: 3052 - DNA, 35 bp, Artificial Sequence
  Synthetic
ccattgccgccagttcccatcggcaaatacgcgcc

SEQ ID NO: 3053 - DNA, 37 bp, Artificial Sequence
  Synthetic
tttgggcgcgcaccgtaacgaagccgtctatgccaag

SEQ ID NO: 3054 - DNA, 39 bp, Artificial Sequence
  Synthetic
ctgccactcgacgtgttcgctttacgccaaactctgggc

SEQ ID NO: 3055 - DNA, 38 bp, Artificial Sequence
  Synthetic
cgttttttgcgggtgctggcttgccgccgctacatcgt

SEQ ID NO: 3056 - DNA, 35 bp, Artificial Sequence
  Synthetic
agctggcggcaggtttcgcgcacgggattcgagga

SEQ ID NO: 3057 - DNA, 40 bp, Artificial Sequence
  Synthetic
cgccattacctacgcgctgatgccgtccgacaacaccatc

SEQ ID NO: 3058 - DNA, 35 bp, Artificial Sequence
  Synthetic
gcattacggcgcgttggcatcccacacggcaagct

SEQ ID NO: 3059 - DNA, 38 bp, Artificial Sequence
  Synthetic
atcggcacaattcccgctgccagaaatcggagtcgggc

SEQ ID NO: 3060 - DNA, 38 bp, Artificial Sequence
  Synthetic
gacggaaggggagggcaaagggagagcgcccaatacca

SEQ ID NO: 3061 - DNA, 41 bp, Artificial Sequence
  Synthetic
agcgcgatgatttggatgctgacgacgtaaaccaccaccag

SEQ ID NO: 3062 - DNA, 40 bp, Artificial Sequence
  Synthetic
aggggagggcgttcagacggatgataaataccgacgccgc

SEQ ID NO: 3063 - DNA, 35 bp, Artificial Sequence
  Synthetic
tttccgcacacgcccagccccgccgcctgtacgaa

SEQ ID NO: 3064 - DNA, 40 bp, Artificial Sequence
  Synthetic
ccgtgcgcgaaaaaagcaacccaatgcgccgtctatgtgt

SEQ ID NO: 3065 - DNA, 39 bp, Artificial Sequence
  Synthetic
agtccggatgccaagccgctcattatgggacaggtcgcc

SEQ ID NO: 3066 - DNA, 35 bp, Artificial Sequence
  Synthetic
gtgtgggcggcgttgttggccctgctgattctgcc

SEQ ID NO: 3067 - DNA, 41 bp, Artificial Sequence
  Synthetic
tgtgtaatcacgatgccgccgagtgatgctcacccaccaaa

SEQ ID NO: 3068 - DNA, 40 bp, Artificial Sequence
  Synthetic
gcgggattggtttcggtggggagcttcagatgtgtagggc

SEQ ID NO: 3069 - DNA, 37 bp, Artificial Sequence
  Synthetic
gcatattggtgcgcggatcgcgacccgcgcaaattcc

SEQ ID NO: 3070 - DNA, 36 bp, Artificial Sequence
  Synthetic
gcttcggtctcggaagcaggcatgcggcggtcagga

SEQ ID NO: 3071 - DNA, 36 bp, Artificial Sequence
  Synthetic
gtcccaaaactggctgcccacagttcggcggacgca

SEQ ID NO: 3072 - DNA, 37 bp, Artificial Sequence
  Synthetic
caagaaatcctcgccgtcggccgtccgcggaaggctt

SEQ ID NO: 3073 - DNA, 34 bp, Artificial Sequence
  Synthetic
tccacgaaaccggccacgccggacacgcccagtt

SEQ ID NO: 3074 - DNA, 38 bp, Artificial Sequence
  Synthetic
ggcatcaccgaacgcgtcgcgacgacggagttgagatg

SEQ ID NO: 3075 - DNA, 42 bp, Artificial Sequence
  Synthetic
ccgccggagattttgtagctgtcatcatgaccgtcttgcacg

SEQ ID NO: 3076 - DNA, 38 bp, Artificial Sequence
  Synthetic
cgttggtcggggcggtaacggatggtgtacgccatggc

SEQ ID NO: 3077 - DNA, 39 bp, Artificial Sequence
  Synthetic
acgccgacttcgccctgacctacaaaaccaacgcctcca

SEQ ID NO: 3078 - DNA, 34 bp, Artificial Sequence
  Synthetic
gggctttttcggcggcgacggcgggttggtgcaa

SEQ ID NO: 3079 - DNA, 39 bp, Artificial Sequence
  Synthetic
gcttccgatggcggcttacggttttcaatccggccggtg

SEQ ID NO: 3080 - DNA, 35 bp, Artificial Sequence
  Synthetic
agacggagttggggcagccgacggcgatgtcctgc

SEQ ID NO: 3081 - DNA, 38 bp, Artificial Sequence
  Synthetic
tgcgttcgttgcgtttgaggtcgacagccgttttgccg

SEQ ID NO: 3082 - DNA, 40 bp, Artificial Sequence
  Synthetic
cggaagttgtcgcgcattgtgcgcaatccaagtcccatcc

SEQ ID NO: 3083 - DNA, 37 bp, Artificial Sequence
  Synthetic
ggtcatccgatggcacagcttcgacatccgcgcccaa

SEQ ID NO: 3084 - DNA, 39 bp, Artificial Sequence
  Synthetic
cgcgtgcgtttgaggtggtcggaaggcttattgaccacc

SEQ ID NO: 3085 - DNA, 39 bp, Artificial Sequence
  Synthetic
ccaaagcgggtttcaggcgttgggcaaactctcccgttt

SEQ ID NO: 3086 - DNA, 41 bp, Artificial Sequence
  Synthetic
caggaaggtggcgacatcgacaagcgatgaaggacaacacc

SEQ ID NO: 3087 - DNA, 33 bp, Artificial Sequence
  Synthetic
tcgttgcggctgccgttcaccgcccgaaaccga

SEQ ID NO: 3088 - DNA, 36 bp, Artificial Sequence
  Synthetic
agcggatcggcaatgctgacccgcgcacgttttcgg

SEQ ID NO: 3089 - DNA, 37 bp, Artificial Sequence
  Synthetic
ttcccgtgcctgttccgccgcacaggaaatgccgtct

SEQ ID NO: 3090 - DNA, 38 bp, Artificial Sequence
  Synthetic
accgcgctcgatttggcggcacggcagttatcaggctg

SEQ ID NO: 3091 - DNA, 41 bp, Artificial Sequence
  Synthetic
ccgatgtggattttgccggacacgcggagtttaaagcacgc

SEQ ID NO: 3092 - DNA, 41 bp, Artificial Sequence
  Synthetic
cggcgtaacaaatcgtgcaggtgaacaaatccgcgtgttcg

SEQ ID NO: 3093 - DNA, 35 bp, Artificial Sequence
  Synthetic
acgctgtgctgggtgcgattcctgcaccagctcga

SEQ ID NO: 3094 - DNA, 38 bp, Artificial Sequence
  Synthetic
gacggtaaatttggcggcttcgtgccctgcggatccaa

SEQ ID NO: 3095 - DNA, 37 bp, Artificial Sequence
  Synthetic
gcgccgatgaggacgttcatacaacggcagcgaatgg

SEQ ID NO: 3096 - DNA, 40 bp, Artificial Sequence
  Synthetic
gaccatgcgtgcgttgatttggatgacgcgcgaacgtttg

SEQ ID NO: 3097 - DNA, 35 bp, Artificial Sequence
  Synthetic
gccggatttcgctgccgtttgctcctgaccaccgc

SEQ ID NO: 3098 - DNA, 38 bp, Artificial Sequence
  Synthetic
cgcatattggtgctgagccagatggaagccctcgccga

SEQ ID NO: 3099 - DNA, 39 bp, Artificial Sequence
  Synthetic
cgcggatggctttctcgacttcaccatcggcgtgaaacc

SEQ ID NO: 3100 - DNA, 35 bp, Artificial Sequence
  Synthetic
tgccgctgaaatacgcgcacgctgctcgccgtgat

SEQ ID NO: 3101 - DNA, 40 bp, Artificial Sequence
  Synthetic
cgactttgacgggcaggtagttcgtgtcgaaggcttgcag

SEQ ID NO: 3102 - DNA, 39 bp, Artificial Sequence
  Synthetic
cgatgtgtccgaccgtaccgagcgtaaccataggcagct

SEQ ID NO: 3103 - DNA, 36 bp, Artificial Sequence
  Synthetic
accactgcagtcgccacgctgatgaccgcgctgtcc

SEQ ID NO: 3104 - DNA, 40 bp, Artificial Sequence
  Synthetic
tcgtgaaatactcgcgcgtccgattacccagcaaatgcgc

SEQ ID NO: 3105 - DNA, 35 bp, Artificial Sequence
  Synthetic
gtttcggggaaacgggcgacgcccccatgtgcgat

SEQ ID NO: 3106 - DNA, 49 bp, Artificial Sequence
  Synthetic
gctactcgtgctaaattgatttgtgccaaatcttttgctttagtatcag

SEQ ID NO: 3107 - DNA, 43 bp, Artificial Sequence
  Synthetic
ggagttaaccatggctgaacaaatcaattgtaccaatcaggct

SEQ ID NO: 3108 - DNA, 42 bp, Artificial Sequence
  Synthetic
agctgctgttcggtgttcaattagttttgcctttagtggtaa

SEQ ID NO: 3109 - DNA, 44 bp, Artificial Sequence
  Synthetic
gcaaacagatttaaggcaaaacaacggcacaaaataagccgatt

SEQ ID NO: 3110 - DNA, 36 bp, Artificial Sequence
  Synthetic
aaagcctcgccctcctgccgacggcattgcatcgcg

SEQ ID NO: 3111 - DNA, 40 bp, Artificial Sequence
  Synthetic
cggttacctgacccgtcgtcatcgtcttcaacaacgacca

SEQ ID NO: 3112 - DNA, 40 bp, Artificial Sequence
  Synthetic
caacctctgggcggtaaagctgcccaaacctccatctcac

SEQ ID NO: 3113 - DNA, 38 bp, Artificial Sequence
  Synthetic
cgataccgatgccgtctgaacccccgcgcctgtaaacg

SEQ ID NO: 3114 - DNA, 37 bp, Artificial Sequence
  Synthetic
ggcagaaatggggcgcgaattgctgtgggggttgtct

SEQ ID NO: 3115 - DNA, 40 bp, Artificial Sequence
  Synthetic
cgtgcgggttcgactttaacctcgaaataacgccgctcca

SEQ ID NO: 3116 - DNA, 38 bp, Artificial Sequence
  Synthetic
gcaaaaagaagccgcgtggggcggattgcggatttcgt

SEQ ID NO: 3117 - DNA, 38 bp, Artificial Sequence
  Synthetic
ccagcggctgtatcgaacggtactacacccgcacccat

SEQ ID NO: 3118 - DNA, 38 bp, Artificial Sequence
  Synthetic
tgtgggagtgggcgaacgcccccgtattgaccacgtcc

SEQ ID NO: 3119 - DNA, 38 bp, Artificial Sequence
  Synthetic
ggcggtttcggcggaacacatgcgatgtggcaaacgcg

SEQ ID NO: 3120 - DNA, 37 bp, Artificial Sequence
  Synthetic
gtcgtggtcggtgctggttcgtatggcgatgtaccgg

SEQ ID NO: 3121 - DNA, 34 bp, Artificial Sequence
  Synthetic
gcgcgcggtcgttgatgtcagcgattggggcgtc

SEQ ID NO: 3122 - DNA, 43 bp, Artificial Sequence
  Synthetic
gctttctgttgaaatggagtctgataattgatgacgggggaag

SEQ ID NO: 3123 - DNA, 34 bp, Artificial Sequence
  Synthetic
acgtggtgaaagccggcggcgtgcggcatcgact

SEQ ID NO: 3124 - DNA, 36 bp, Artificial Sequence
  Synthetic
atccatcggcgtggggcagagcgatttggcgagccg

SEQ ID NO: 3125 - DNA, 38 bp, Artificial Sequence
  Synthetic
ggaatgcccgaaagcagcctaataaatcgacgcgccgg

SEQ ID NO: 3126 - DNA, 36 bp, Artificial Sequence
  Synthetic
ggctggacgatacgcagctgtccaactcgcgcaggt

SEQ ID NO: 3127 - DNA, 40 bp, Artificial Sequence
  Synthetic
tgcgatgaagctgtggaaggaaaccgccgcgatacctatg

SEQ ID NO: 3128 - DNA, 39 bp, Artificial Sequence
  Synthetic
cgaccttggacggcaaagtcacatcctcctgccggtttg

SEQ ID NO: 3129 - DNA, 38 bp, Artificial Sequence
  Synthetic
aaagcccttccttcgacagcgaggtatttggggcgaaa

SEQ ID NO: 3130 - DNA, 38 bp, Artificial Sequence
  Synthetic
cagccgttacctcgggggatttccgggtgtattcggca

SEQ ID NO: 3131 - DNA, 41 bp, Artificial Sequence
  Synthetic
tccacgatacggtcgacggtttccggacacttggttttcgg

SEQ ID NO: 3132 - DNA, 38 bp, Artificial Sequence
  Synthetic
ccatactttccctgctgcggacgctatgcgccaatccc

SEQ ID NO: 3133 - DNA, 37 bp, Artificial Sequence
  Synthetic
gggttcgcctagctgccagcttcccgttttcgccagt

SEQ ID NO: 3134 - DNA, 39 bp, Artificial Sequence
  Synthetic
aggatgatggcggtgctgtacctggctgaccaacccctt

SEQ ID NO: 3135 - DNA, 35 bp, Artificial Sequence
  Synthetic
ggtggcggatgtcgggactgctgccgccaatcgct

SEQ ID NO: 3136 - DNA, 41 bp, Artificial Sequence
  Synthetic
acgcctgattcgaggttcagcaccggcagcttcaaaaacac

SEQ ID NO: 3137 - DNA, 37 bp, Artificial Sequence
  Synthetic
agtacggtgccggcgatgcgccaacccaactacaccg

SEQ ID NO: 3138 - DNA, 37 bp, Artificial Sequence
  Synthetic
ggagatgtagccggtcagggccgacagcctgcaaccc

SEQ ID NO: 3139 - DNA, 36 bp, Artificial Sequence
  Synthetic
tgcggagggtgccgagttcacatgggacccgacgac

SEQ ID NO: 3140 - DNA, 38 bp, Artificial Sequence
  Synthetic
ttccctttgagccggggcgctaccctatagcccgcctt

SEQ ID NO: 3141 - DNA, 40 bp, Artificial Sequence
  Synthetic
cgcgctgttctttgaacgacgacgctgacgctgatttccg

SEQ ID NO: 3142 - DNA, 36 bp, Artificial Sequence
  Synthetic
atcaatacgccggcgcaggcgcgcccaagcttcgac

SEQ ID NO: 3143 - DNA, 40 bp, Artificial Sequence
  Synthetic
ggcaacgtcggcgatgtctttgtcgttgccaaagcctttg

SEQ ID NO: 3144 - DNA, 39 bp, Artificial Sequence
  Synthetic
cttcggcacactgcttaccctacataaacagcggcaggg

SEQ ID NO: 3145 - DNA, 40 bp, Artificial Sequence
  Synthetic
ggcttcgttggggatggagattctttggacggcgttacca

SEQ ID NO: 3146 - DNA, 38 bp, Artificial Sequence
  Synthetic
tttccccgaaaccctgccagggaaggttcgggcatcac

SEQ ID NO: 3147 - DNA, 36 bp, Artificial Sequence
  Synthetic
aagtcggcgcgggcaaaggtagcgtgccgggcgtta

SEQ ID NO: 3148 - DNA, 38 bp, Artificial Sequence
  Synthetic
tccacaggtttgttcaagccaactcgtccgtactttgg

SEQ ID NO: 3149 - DNA, 40 bp, Artificial Sequence
  Synthetic
tctgcaatctgttccgcacgaatgcaatgtttatctgcct

SEQ ID NO: 3150 - DNA, 41 bp, Artificial Sequence
  Synthetic
gcctgttttaatcggatcggtcaaatgccttggaaaaacct

SEQ ID NO: 3151 - DNA, 43 bp, Artificial Sequence
  Synthetic
cctttttttcaaatgcgccaacttattgttatggcttggggtg

SEQ ID NO: 3152 - DNA, 38 bp, Artificial Sequence
  Synthetic
ccgtcggcatcaccctcatcaggttgacaagcccggtt

SEQ ID NO: 3153 - DNA, 38 bp, Artificial Sequence
  Synthetic
gcgcggtgttcgacaaataccgttgccggaaaccgtca

SEQ ID NO: 3154 - DNA, 39 bp, Artificial Sequence
  Synthetic
agcctcccttcccgacttggctgccggtaatgttttgcg

SEQ ID NO: 3155 - DNA, 41 bp, Artificial Sequence
  Synthetic
cgggcaggctttgggtttgaacgatgcggtcgttttgaaag

SEQ ID NO: 3156 - DNA, 35 bp, Artificial Sequence
  Synthetic
tcaagggcggccgcctttcgtcaggccggcggtat

SEQ ID NO: 3157 - DNA, 38 bp, Artificial Sequence
  Synthetic
agctgtttaaagaccgcctgcttcgatgcgcgaagggt

SEQ ID NO: 3158 - DNA, 38 bp, Artificial Sequence
  Synthetic
aaatcccgtcctggttcggcgtcgagcagtgtgccttt

SEQ ID NO: 3159 - DNA, 42 bp, Artificial Sequence
  Synthetic
cgcgcaggttatttcttcacgcttgtccgcgtatgatgaacg

SEQ ID NO: 3160 - DNA, 39 bp, Artificial Sequence
  Synthetic
cccggctcggatgtcgatttgcgtttccaagaggcggtc

SEQ ID NO: 3161 - DNA, 35 bp, Artificial Sequence
  Synthetic
tttcggcagcaccccttccccgtcaaaaccggccg

SEQ ID NO: 3162 - DNA, 41 bp, Artificial Sequence
  Synthetic
tgatggagcacctactagtatggttttacccctgcttcacg

SEQ ID NO: 3163 - DNA, 35 bp, Artificial Sequence
  Synthetic
caaaccgcctcgcgcaaaccggcgtacggctcgaa

SEQ ID NO: 3164 - DNA, 37 bp, Artificial Sequence
  Synthetic
ccagcaggttgccgaaaatgccgatgccgtgtccgca

SEQ ID NO: 3165 - DNA, 37 bp, Artificial Sequence
  Synthetic
cccaacccgaacaccaccactcttctgtgccgtccgg

SEQ ID NO: 3166 - DNA, 39 bp, Artificial Sequence
  Synthetic
tgcgccaaaacaaccaaaccaacaggtggcggttgtagc

SEQ ID NO: 3167 - DNA, 38 bp, Artificial Sequence
  Synthetic
gcaccgcccgcattcaggacgatacagtcgcacatggc

SEQ ID NO: 3168 - DNA, 37 bp, Artificial Sequence
  Synthetic
ctttggcgaggcagacgcgcgacctcgacaccgacga

SEQ ID NO: 3169 - DNA, 38 bp, Artificial Sequence
  Synthetic
gggtggatttgccggcgttaactcaaagtcctcgccga

SEQ ID NO: 3170 - DNA, 40 bp, Artificial Sequence
  Synthetic
gtgtttgaggaagcggtggcctccccggtctgattgaagg

SEQ ID NO: 3171 - DNA, 39 bp, Artificial Sequence
  Synthetic
cgcggttgctccaccatgtatgggctggacggacatgtg

SEQ ID NO: 3172 - DNA, 35 bp, Artificial Sequence
  Synthetic
gcggcgaatacatcagcgcgttcggctgcacccca

SEQ ID NO: 3173 - DNA, 38 bp, Artificial Sequence
  Synthetic
gcgggcgcgaaaaatatgcgccacttgggcgtgaatcg

SEQ ID NO: 3174 - DNA, 38 bp, Artificial Sequence
  Synthetic
aagttgccgccgccgatatcgcctttgacaaagttcgg

SEQ ID NO: 3175 - DNA, 38 bp, Artificial Sequence
  Synthetic
cgttgagctgctgcggcttcttgccgcaacacgtatcg

SEQ ID NO: 3176 - DNA, 41 bp, Artificial Sequence
  Synthetic
agcgaacccaactcatactgcgcgagtgcctgatgttcagt

SEQ ID NO: 3177 - DNA, 37 bp, Artificial Sequence
  Synthetic
cacggaaaccgacctgtcgtcagggcgaacagacggt

SEQ ID NO: 3178 - DNA, 36 bp, Artificial Sequence
  Synthetic
tatgcgccccgccgaatccgggaaaacgcccaagcc

SEQ ID NO: 3179 - DNA, 38 bp, Artificial Sequence
  Synthetic
caaacacggcaggcttctttccaatcggggtcggcagg

SEQ ID NO: 3180 - DNA, 36 bp, Artificial Sequence
  Synthetic
acaccgccgtctcacgcagattcgacggccagtgcg

SEQ ID NO: 3181 - DNA, 38 bp, Artificial Sequence
  Synthetic
accccggctacatcgccagggcggtgggcatttgtttg

SEQ ID NO: 3182 - DNA, 36 bp, Artificial Sequence
  Synthetic
atcccccgagcacaccagcgtgtaaacccgcgccac

SEQ ID NO: 3183 - DNA, 39 bp, Artificial Sequence
  Synthetic
tgcaggaaaacggcagcctactcgctggataatggcttg

SEQ ID NO: 3184 - DNA, 35 bp, Artificial Sequence
  Synthetic
tttcctggctgccgctggcagcgttgccgtcaggg

SEQ ID NO: 3185 - DNA, 33 bp, Artificial Sequence
  Synthetic
cagcacgggtacgctgctaaagcagggccgcca

SEQ ID NO: 3186 - DNA, 38 bp, Artificial Sequence
  Synthetic
ccagacgggcgaggtaaaccatccgatccgcgcatcgt

SEQ ID NO: 3187 - DNA, 36 bp, Artificial Sequence
  Synthetic
cgcggataggcgtttttgcgcgcaagccggcaaact

SEQ ID NO: 3188 - DNA, 40 bp, Artificial Sequence
  Synthetic
ctgccgagcaggtctttggcggcaaaaaccaaggctttga

SEQ ID NO: 3189 - DNA, 40 bp, Artificial Sequence
  Synthetic
gccatacctttgctgttgccgacgaccgggcatattcagc

SEQ ID NO: 3190 - DNA, 34 bp, Artificial Sequence
  Synthetic
aaccggcatcgcccaacggcttttcgccgcttgc

SEQ ID NO: 3191 - DNA, 35 bp, Artificial Sequence
  Synthetic
ggcaggctggcggtttaccgcgcggcaggtcgaaa

SEQ ID NO: 3192 - DNA, 42 bp, Artificial Sequence
  Synthetic
tgccattacgtcgtcgttgactaaactttaccgcgaactgcc

SEQ ID NO: 3193 - DNA, 39 bp, Artificial Sequence
  Synthetic
ttccaagttgcgttgggcgtgcaaggcgaagtcatcacc

SEQ ID NO: 3194 - DNA, 37 bp, Artificial Sequence
  Synthetic
ggtcaggtgcaccatcagcagtgctcaaacgcctgcg

SEQ ID NO: 3195 - DNA, 40 bp, Artificial Sequence
  Synthetic
tccgcacacacttccaaggttcgtgaaaacaaacgcggac

SEQ ID NO: 3196 - DNA, 39 bp, Artificial Sequence
  Synthetic
gccccatcatggttttgggctactggccgaaatcacccg

SEQ ID NO: 3197 - DNA, 38 bp, Artificial Sequence
  Synthetic
gccgctgttcgaacgcaaatcccgcagcagcctttcgc

SEQ ID NO: 3198 - DNA, 36 bp, Artificial Sequence
  Synthetic
agtctgcgcccaaatcggcccatttgggctgctcgc

SEQ ID NO: 3199 - DNA, 40 bp, Artificial Sequence
  Synthetic
ttgccgcatcgaagttcggcttgttctttgcccctgaagg

SEQ ID NO: 3200 - DNA, 43 bp, Artificial Sequence
  Synthetic
tgacatttttagaatgatgccgtcttgaaaagcctgaatccgt

SEQ ID NO: 3201 - DNA, 39 bp, Artificial Sequence
  Synthetic
gcggacgtgatggcgaaaatggccgcctttaccgaatgc

SEQ ID NO: 3202 - DNA, 39 bp, Artificial Sequence
  Synthetic
gccctcgccgaagtagtcgttgttggacgaagccgcagc

SEQ ID NO: 3203 - DNA, 35 bp, Artificial Sequence
  Synthetic
cggacgcttgcagcacctgccatccgtgaagcagc

SEQ ID NO: 3204 - DNA, 38 bp, Artificial Sequence
  Synthetic
aattgcgcgtccggccagtcatcacctacaaactcgcc

SEQ ID NO: 3205 - DNA, 36 bp, Artificial Sequence
  Synthetic
cgtcaacgccgccaacgaccaggttgacggcaggtg

SEQ ID NO: 3206 - DNA, 38 bp, Artificial Sequence
  Synthetic
ccccgtgttgccgcaaactaatcgcgtccagattgagg

SEQ ID NO: 3207 - DNA, 38 bp, Artificial Sequence
  Synthetic
gcaaaatcaaacgcgtgcgcccctttttcgcgtgccgc

SEQ ID NO: 3208 - DNA, 38 bp, Artificial Sequence
  Synthetic
acgcataccgccgacctttctgcccttgattgccgttg

SEQ ID NO: 3209 - DNA, 35 bp, Artificial Sequence
  Synthetic
cctcggctgcgccaatttgaaggcttgggcgcaca

SEQ ID NO: 3210 - DNA, 41 bp, Artificial Sequence
  Synthetic
cggcaagcaggaaaaaaacgctatggccttggtcggtatgg

SEQ ID NO: 3211 - DNA, 35 bp, Artificial Sequence
  Synthetic
ctgccgcatctgtgcccacgaacatcggcggtctg

SEQ ID NO: 3212 - DNA, 39 bp, Artificial Sequence
  Synthetic
gtacgttccacgccgtttctgaaccggtatcgaaatcgt

SEQ ID NO: 3213 - DNA, 39 bp, Artificial Sequence
  Synthetic
acaagccccgattccccggttcctttctttgcgatgcct

SEQ ID NO: 3214 - DNA, 37 bp, Artificial Sequence
  Synthetic
catcgttgccgggtattgccccgccggcagaagcgtt

SEQ ID NO: 3215 - DNA, 42 bp, Artificial Sequence
  Synthetic
ccaaatccgccaactctaccgagacaaaaccaaattcccgcc

SEQ ID NO: 3216 - DNA, 35 bp, Artificial Sequence
  Synthetic
tcgccttgggctgacgcagcgtgcctgttccggca

SEQ ID NO: 3217 - DNA, 37 bp, Artificial Sequence
  Synthetic
gcgcccgaaaaacagcttgcggtaactgtgcgcctgc

SEQ ID NO: 3218 - DNA, 35 bp, Artificial Sequence
  Synthetic
acattccggaccgcccctcgcgagcgtttcccagc

SEQ ID NO: 3219 - DNA, 39 bp, Artificial Sequence
  Synthetic
gcataccgcccgccaaaaagagcactaccgctggacgta

SEQ ID NO: 3220 - DNA, 37 bp, Artificial Sequence
  Synthetic
gtccagccacgtctttaccgccggcgttcgtgtcggt

SEQ ID NO: 3221 - DNA, 39 bp, Artificial Sequence
  Synthetic
ggcttccaaaccagccgccgatttcctcgaccttgcctt

SEQ ID NO: 3222 - DNA, 41 bp, Artificial Sequence
  Synthetic
tgcaccgatatgcccgaactctagggttcgtacagggatgc

SEQ ID NO: 3223 - DNA, 38 bp, Artificial Sequence
  Synthetic
gcaaccgcagcaactacgcccgccgcatcatatgggaa

SEQ ID NO: 3224 - DNA, 38 bp, Artificial Sequence
  Synthetic
ccgtcggacaactcgtcttcttccaagcgtgcggatgc

SEQ ID NO: 3225 - DNA, 34 bp, Artificial Sequence
  Synthetic
aaccaggcaggccggcttgccggttgcgcgcaaa

SEQ ID NO: 3226 - DNA, 39 bp, Artificial Sequence
  Synthetic
ttgcgacaggacgggcagcttggaaatggaaaacccgcg

SEQ ID NO: 3227 - DNA, 37 bp, Artificial Sequence
  Synthetic
cgcgacattctgcgcggagaggttgatgtcttgcggc

SEQ ID NO: 3228 - DNA, 40 bp, Artificial Sequence
  Synthetic
cgagttccacacccaagccaacttcatcggtcagcggaat

SEQ ID NO: 3229 - DNA, 36 bp, Artificial Sequence
  Synthetic
cggtatgttcggcggcgttatgctgtcggcgagtgc

SEQ ID NO: 3230 - DNA, 35 bp, Artificial Sequence
  Synthetic
ggcgcgccatccatgttccggtcgctgtctcgcgt

SEQ ID NO: 3231 - DNA, 34 bp, Artificial Sequence
  Synthetic
gcctccgtcggcgcatttaatcgggcccggatgg

SEQ ID NO: 3232 - DNA, 37 bp, Artificial Sequence
  Synthetic
gccgtctgaaagccgtttgcggcactgccgccggatt

SEQ ID NO: 3233 - DNA, 36 bp, Artificial Sequence
  Synthetic
cgtccgaagcgtttggcgtagcaccaaaatgccgcg

SEQ ID NO: 3234 - DNA, 45 bp, Artificial Sequence
  Synthetic
tccggctacaagtgataaggtgggctttaattgacgattatcttg

SEQ ID NO: 3235 - DNA, 38 bp, Artificial Sequence
  Synthetic
ccggctgacgattttggggctccgtccggttcaaaccc

SEQ ID NO: 3236 - DNA, 37 bp, Artificial Sequence
  Synthetic
tcgccgcaaaattccgacccattgtgcggcggaaacc

SEQ ID NO: 3237 - DNA, 37 bp, Artificial Sequence
  Synthetic
cgctgcaaacccacggcaaacgttcggctttggtgcc

SEQ ID NO: 3238 - DNA, 39 bp, Artificial Sequence
  Synthetic
cgggttactttggcagggtcgaaggctccggcgaatacg

SEQ ID NO: 3239 - DNA, 40 bp, Artificial Sequence
  Synthetic
tggcataatcgagcagcagcacctgccctatctggtagcg

SEQ ID NO: 3240 - DNA, 40 bp, Artificial Sequence
  Synthetic
gcctgcgtaattccggcaaccgccggctttgtttatgttg

SEQ ID NO: 3241 - DNA, 36 bp, Artificial Sequence
  Synthetic
ccatacagccggccgccttccgtttgaggcgcgggt

SEQ ID NO: 3242 - DNA, 40 bp, Artificial Sequence
  Synthetic
gagggttttgtcaccggagaggttccgccgactattccca

SEQ ID NO: 3243 - DNA, 37 bp, Artificial Sequence
  Synthetic
acatcggcatcagcgcggggcggcggattttgcctct

SEQ ID NO: 3244 - DNA, 37 bp, Artificial Sequence
  Synthetic
cgacctgcgccaaatcggtaaaacaggatgccgacgc

SEQ ID NO: 3245 - DNA, 39 bp, Artificial Sequence
  Synthetic
acgcgggcttcagctacggaacaagtgcagatgcttggt

SEQ ID NO: 3246 - DNA, 38 bp, Artificial Sequence
  Synthetic
gtcatcgacagcgaccccgttcgttgaggaatcgggct

SEQ ID NO: 3247 - DNA, 40 bp, Artificial Sequence
  Synthetic
cgttcaacgtcgtcatccgcactgcctgaaacaatgccgt

SEQ ID NO: 3248 - DNA, 35 bp, Artificial Sequence
  Synthetic
cagacccgaaaaaccgcgccgaggtcgttgcgcag

SEQ ID NO: 3249 - DNA, 38 bp, Artificial Sequence
  Synthetic
cggcatttccacgccgcaatctttggcggatgcggtcg

SEQ ID NO: 3250 - DNA, 39 bp, Artificial Sequence
  Synthetic
ccgtcaaagccgttgccgaaacgccgcaaaccaatttcg

SEQ ID NO: 3251 - DNA, 41 bp, Artificial Sequence
  Synthetic
ggggttttcaggcggcatgaaacatccgatacagccgtccc

SEQ ID NO: 3252 - DNA, 36 bp, Artificial Sequence
  Synthetic
cagccaggcaaacgccatcacccgcctgccaaaacc

SEQ ID NO: 3253 - DNA, 39 bp, Artificial Sequence
  Synthetic
tcagggtaacgcctgccgctacccggaaaaacatacgcg

SEQ ID NO: 3254 - DNA, 34 bp, Artificial Sequence
  Synthetic
ccgcgttcgaccacggtttttgcggtcggtgcgt

SEQ ID NO: 3255 - DNA, 36 bp, Artificial Sequence
  Synthetic
ttgccgccgcattgggcaaacagggcatattcgcgc

SEQ ID NO: 3256 - DNA, 38 bp, Artificial Sequence
  Synthetic
gcggtagtagccgtagcggatcggcaggcatgataggc

SEQ ID NO: 3257 - DNA, 38 bp, Artificial Sequence
  Synthetic
gctgatggtgcgcgaaacgccatttccgttacccgctt

SEQ ID NO: 3258 - DNA, 37 bp, Artificial Sequence
  Synthetic
tgcctgcccttccaatgccgtcgtcgcttcgtttgcc

SEQ ID NO: 3259 - DNA, 37 bp, Artificial Sequence
  Synthetic
ccccaaatgccgaccagggtgcaaaattgccgccgcc

SEQ ID NO: 3260 - DNA, 37 bp, Artificial Sequence
  Synthetic
acgcgtttgttggcggcggccgtcgccgtattcaaac

SEQ ID NO: 3261 - DNA, 38 bp, Artificial Sequence
  Synthetic
gggcatcgccgtattggtacgatggcgaacgggtttgc

SEQ ID NO: 3262 - DNA, 37 bp, Artificial Sequence
  Synthetic
ggcaaatgccgtctgcgcgcgcaaggaagacggttcg

SEQ ID NO: 3263 - DNA, 40 bp, Artificial Sequence
  Synthetic
ggcgcgtatgtgctgcaccttagaatgtttgttgcgccgg

SEQ ID NO: 3264 - DNA, 35 bp, Artificial Sequence
  Synthetic
gcccgaagaaacccgccaagcgtcgccgaatctgc

SEQ ID NO: 3265 - DNA, 39 bp, Artificial Sequence
  Synthetic
cgcgccattttgaaagacgcgttgtccaatgcgctggtg

SEQ ID NO: 3266 - DNA, 34 bp, Artificial Sequence
  Synthetic
gccgacggcgtatgtgcatcgcgagcgtgccttt

SEQ ID NO: 3267 - DNA, 39 bp, Artificial Sequence
  Synthetic
cccctgatcaaccacggctttggtggaaaggatgtcggc

SEQ ID NO: 3268 - DNA, 40 bp, Artificial Sequence
  Synthetic
gccaaagaagccggagccaaactgcaatgggaaggaacgg

SEQ ID NO: 3269 - DNA, 37 bp, Artificial Sequence
  Synthetic
ttcggcaaccccgcaaccgcttgcgtgcagagtaccg

SEQ ID NO: 3270 - DNA, 47 bp, Artificial Sequence
  Synthetic
gtgctaaatctaccaagttgcaaatttgtagctactttgatattccg

SEQ ID NO: 3271 - DNA, 40 bp, Artificial Sequence
  Synthetic
tggtaaggtgtcacttgctccttatgcaacgaaagcttgt

SEQ ID NO: 3272 - DNA, 43 bp, Artificial Sequence
  Synthetic
tgcttagtctttctttttctggagaaaaaggaccgtctgttgc

SEQ ID NO: 3273 - DNA, 43 bp, Artificial Sequence
  Synthetic
gtaacccagctaggcaatttgttatagaagtgttcctgcagct

SEQ ID NO: 3274 - DNA, 43 bp, Artificial Sequence
  Synthetic
cgatgcccatttgtattgcaacatcatataccagcaacaaggg

SEQ ID NO: 3275 - DNA, 46 bp, Artificial Sequence
  Synthetic
tcctggcatcttcaaaaaacaatagtgggaaagttgattatgatgg

SEQ ID NO: 3276 - DNA, 42 bp, Artificial Sequence
  Synthetic
tccatctatacctccagcactttactagggatccggccatag

SEQ ID NO: 3277 - DNA, 45 bp, Artificial Sequence
  Synthetic
gaacaatagatgaagcaccaggctattccactagaacctataggc

SEQ ID NO: 3278 - DNA, 45 bp, Artificial Sequence
  Synthetic
tggaacctgtgttgtgtatctagtagccacctgtacaaagtactc

SEQ ID NO: 3279 - DNA, 46 bp, Artificial Sequence
  Synthetic
ccctgtgtgtctgtagtggtaacttttctgacgaatctttattgga

SEQ ID NO: 3280 - DNA, 46 bp, Artificial Sequence
  Synthetic
caaactaaccgttctctttgaggatgttttgcgtttacagttacct

SEQ ID NO: 3281 - DNA, 43 bp, Artificial Sequence
  Synthetic
tgacgagcataaagttgttctcttttggccagattttgtgcag

SEQ ID NO: 3282 - DNA, 48 bp, Artificial Sequence
  Synthetic
gggatccattgcattaatatgagctttggaagtagaaatagtaatgca

SEQ ID NO: 3283 - DNA, 47 bp, Artificial Sequence
  Synthetic
aagcagtcaggatattcaagtacaacaatgttaagctgtgaaacttg

SEQ ID NO: 3284 - DNA, 42 bp, Artificial Sequence
  Synthetic
tcttctccatactctttcattgcccgacaatgcttcaatccg

SEQ ID NO: 3285 - DNA, 45 bp, Artificial Sequence
  Synthetic
tccttgtaatcatacaaatctggcagcctggacagtagtaaacag

SEQ ID NO: 3286 - DNA, 44 bp, Artificial Sequence
  Synthetic
ctgaaaacaaggaggcccatcattgaaccttttctgaaaacaac

SEQ ID NO: 3287 - DNA, 42 bp, Artificial Sequence
  Synthetic
agctgactcgttttcttcatgtttaagcaagtactggcggaa

SEQ ID NO: 3288 - DNA, 42 bp, Artificial Sequence
  Synthetic
tctcatgcttgcaatgtgttcaactggatagagctcgatgag

SEQ ID NO: 3289 - DNA, 44 bp, Artificial Sequence
  Synthetic
tcacaaagtttaccacgtcggatggtttcatcataaaaggaaga

SEQ ID NO: 3290 - DNA, 45 bp, Artificial Sequence
  Synthetic
gtctttctctttgacagaggactcgctccttcagtcactacaaca

SEQ ID NO: 3291 - DNA, 38 bp, Artificial Sequence
  Synthetic
tctgttcgctgaaggggtcctggaggaagccacacgga

SEQ ID NO: 3292 - DNA, 39 bp, Artificial Sequence
  Synthetic
tggctccactggtccccaatcggaccccctttcaaagtg

SEQ ID NO: 3293 - DNA, 40 bp, Artificial Sequence
  Synthetic
gacgcacgtccactcggatgtagcttcccagagagaagcg

SEQ ID NO: 3294 - DNA, 41 bp, Artificial Sequence
  Synthetic
catgcaaggagtcccggagtcttccccttatgtccagtccc

SEQ ID NO: 3295 - DNA, 40 bp, Artificial Sequence
  Synthetic
ccaggggaggattcaccgacagttctcgagggccttcctt

SEQ ID NO: 3296 - DNA, 45 bp, Artificial Sequence
  Synthetic
aggatcctcgaacatagctgtttcgaaaccggtacatataaaagt

SEQ ID NO: 3297 - DNA, 45 bp, Artificial Sequence
  Synthetic
ggcatttgacatctatgacaccttatatggtgcaacattagaagc

SEQ ID NO: 3298 - DNA, 45 bp, Artificial Sequence
  Synthetic
gttcgtagcagcgtaggtcaattgaagatgtaatactagatctgg

SEQ ID NO: 3299 - DNA, 42 bp, Artificial Sequence
  Synthetic
ctcctcatttgtaccttcacagtccttggtgtgccatcagtg

SEQ ID NO: 3300 - DNA, 41 bp, Artificial Sequence
  Synthetic
ttaaattgcgcactgcctttgttaacccaggcattgtttca

SEQ ID NO: 3301 - DNA, 45 bp, Artificial Sequence
  Synthetic
ccaaatctaatctggaccaggtggcaatgggaatcctgtatatgc

SEQ ID NO: 3302 - DNA, 43 bp, Artificial Sequence
  Synthetic
cgtgtttattaacgactgcaatgctgtggtgccctctactgtt

SEQ ID NO: 3303 - DNA, 46 bp, Artificial Sequence
  Synthetic
cgtaatactgcttatatgccccttgtaaaggtactggagatgttga

SEQ ID NO: 3304 - DNA, 39 bp, Artificial Sequence
  Synthetic
cggtggtgtcaggtccactgaggcaccaaggaaaccgag

SEQ ID NO: 3305 - DNA, 42 bp, Artificial Sequence
  Synthetic
aggggctccagattgtataatactctgtgggtcctacagaac

SEQ ID NO: 3306 - DNA, 40 bp, Artificial Sequence
  Synthetic
agatgtaagggccggacgatcagtagtactgtagcacctg

SEQ ID NO: 3307 - DNA, 45 bp, Artificial Sequence
  Synthetic
atgttgtaggggaatatgacatgcatatgcagaccctgatacagt

SEQ ID NO: 3308 - DNA, 48 bp, Artificial Sequence
  Synthetic
gcatacgtttacggcgtttatggcatggggataattattatttatggc

SEQ ID NO: 3309 - DNA, 41 bp, Artificial Sequence
  Synthetic
aggatcaggtaggtgcactccgaaattcctaaggtatctgc

SEQ ID NO: 3310 - DNA, 50 bp, Artificial Sequence
  Synthetic
cacgttgtgtctgtgtatttttacacagttatgtattataggttgtacac

SEQ ID NO: 3311 - DNA, 47 bp, Artificial Sequence
  Synthetic
cccccgccttattataaaaatgtctacagcatgtttttttttcttcg

SEQ ID NO: 3312 - DNA, 47 bp, Artificial Sequence
  Synthetic
acacaccttacataacataccacaaaacgcaaaaaacgtaaacttac

SEQ ID NO: 3313 - DNA, 36 bp, Artificial Sequence
  Synthetic
ctccacccttctgcagacggtggagcacccccccta

SEQ ID NO: 3314 - DNA, 42 bp, Artificial Sequence
  Synthetic
ggaccctatcaggcagtacggtgcaagcccacctatatgtgt

SEQ ID NO: 3315 - DNA, 40 bp, Artificial Sequence
  Synthetic
ccagcaagcgtactatctggcatctagtaggcccgctggt

SEQ ID NO: 3316 - DNA, 40 bp, Artificial Sequence
  Synthetic
tgtacggattggcgggaaccttgttctccttccacttgcc

SEQ ID NO: 3317 - DNA, 43 bp, Artificial Sequence
  Synthetic
caccagggattgtataggggtactttgttacagtccaaagtgg

SEQ ID NO: 3318 - DNA, 46 bp, Artificial Sequence
  Synthetic
gtggaattcacagggtcataaaagttcaggccatttgtattttgag

SEQ ID NO: 3319 - DNA, 40 bp, Artificial Sequence
  Synthetic
agctgaagcaggcgtaaccaaagtcaccgcatagctctgc

SEQ ID NO: 3320 - DNA, 39 bp, Artificial Sequence
  Synthetic
cgatgctgcactggatgttaacgctggtgactttctgtg

SEQ ID NO: 3321 - DNA, 41 bp, Artificial Sequence
  Synthetic
gcatagccaaccctgcgaaaaccacggttgatggtttgccc

SEQ ID NO: 3322 - DNA, 42 bp, Artificial Sequence
  Synthetic
ccagctccacatggtggttgatacacccaataaccgttgacg

SEQ ID NO: 3323 - DNA, 43 bp, Artificial Sequence
  Synthetic
tgggggcaattaaaatttgcactgccactcttgatacaaaacc

SEQ ID NO: 3324 - DNA, 39 bp, Artificial Sequence
  Synthetic
ggtgtagggattactccaggggtcctaaccgaagctcca

SEQ ID NO: 3325 - DNA, 43 bp, Artificial Sequence
  Synthetic
agtttgagcttctgttgatgacaaacattgttgaagccttcga

SEQ ID NO: 3326 - DNA, 46 bp, Artificial Sequence
  Synthetic
cccaagaaaggtgttaagtttttcagagtacaatcaccacaactag

SEQ ID NO: 3327 - DNA, 40 bp, Artificial Sequence
  Synthetic
ggccactcacccatcaagcattttgacatgctaggcggct

SEQ ID NO: 3328 - DNA, 42 bp, Artificial Sequence
  Synthetic
tcagttgggtccggtctagcacttgttcaaattactggagag

SEQ ID NO: 3329 - DNA, 41 bp, Artificial Sequence
  Synthetic
ggtggtgaaggagggaggtttgtcatgtcctgaaagcctgc

SEQ ID NO: 3330 - DNA, 44 bp, Artificial Sequence
  Synthetic
cagttttgaagctaatcacgtcggtgggaaagagtgagttttcg

SEQ ID NO: 3331 - DNA, 40 bp, Artificial Sequence
  Synthetic
gtccagaacagccttgcggggctaagtcccacatcactgg

SEQ ID NO: 3332 - DNA, 41 bp, Artificial Sequence
  Synthetic
cctcgggtgtgatggtactgtctgttgtcgatgtggtcacc

SEQ ID NO: 3333 - DNA, 40 bp, Artificial Sequence
  Synthetic
gcgctcttccaaattacggtgccgaacaggctggcatgaa

SEQ ID NO: 3334 - DNA, 42 bp, Artificial Sequence
  Synthetic
gcagatcttctacaggcaccgtttgaggacaaacttcccgag

SEQ ID NO: 3335 - DNA, 38 bp, Artificial Sequence
  Synthetic
aaagtggtgtaccgagccaccttctctggcatgctaca

SEQ ID NO: 3336 - DNA, 40 bp, Artificial Sequence
  Synthetic
ggcttcacccgaaacggttctggggagaccccgggcttaa

SEQ ID NO: 3337 - DNA, 44 bp, Artificial Sequence
  Synthetic
cagtggttatcaggatggcaatttctgtttctctcaccatttcc

SEQ ID NO: 3338 - DNA, 45 bp, Artificial Sequence
  Synthetic
ggaaagcctaatcgaattgtccttatacagaaattggtcaaagcc

SEQ ID NO: 3339 - DNA, 38 bp, Artificial Sequence
  Synthetic
acacaaacatgcagccatgccaagtgtgcatagcatgg

SEQ ID NO: 3340 - DNA, 43 bp, Artificial Sequence
  Synthetic
gaggatagcaggagcactccggaaaatcattcatactagcaca

SEQ ID NO: 3341 - DNA, 42 bp, Artificial Sequence
  Synthetic
tccatcatcaaaggcccagccattgcttggatcctaacaatg

SEQ ID NO: 3342 - DNA, 48 bp, Artificial Sequence
  Synthetic
atcgtacttttcagcagtatccaatttgaattgtcttattgttcgttg

SEQ ID NO: 3343 - DNA, 47 bp, Artificial Sequence
  Synthetic
tgaagtagcaaaaacacacactcttattatattgggttgacacctgt

SEQ ID NO: 3344 - DNA, 50 bp, Artificial Sequence
  Synthetic
tgtgaagcattatccacatcatcaaatatatttgaagagagtacagatgg

SEQ ID NO: 3345 - DNA, 46 bp, Artificial Sequence
  Synthetic
tgtacctgagaaacatttgcagttaaaagacgattatttcaggaca

SEQ ID NO: 3346 - DNA, 50 bp, Artificial Sequence
  Synthetic
tcgtctaacaagccaattttaccataggtaaagtcatttctttcatgaac

SEQ ID NO: 3347 - DNA, 39 bp, Artificial Sequence
  Synthetic
gcgatggggtcttggagtacctcgcagactccagccaag

SEQ ID NO: 3348 - DNA, 38 bp, Artificial Sequence
  Synthetic
cttgtcgcgcaagtagtcgagaatctgctgtcccgtct

SEQ ID NO: 3349 - DNA, 43 bp, Artificial Sequence
  Synthetic
ggaagtgcttcaggaattggttttatggattgggaattggcac

SEQ ID NO: 3350 - DNA, 41 bp, Artificial Sequence
  Synthetic
gaaagtaggatccggtgcagccttttccgatgatgtcactt

SEQ ID NO: 3351 - DNA, 43 bp, Artificial Sequence
  Synthetic
gcattaggattttctgtgtcaagcaaccgttaggggttggaac

SEQ ID NO: 3352 - DNA, 48 bp, Artificial Sequence
  Synthetic
cctgatttgtcctgttgtaatcgtcaatacaagatggtgatatgtgtg

SEQ ID NO: 3353 - DNA, 39 bp, Artificial Sequence
  Synthetic
cagaaccggtatgcaatagcccagagctgtcaaccgttt

SEQ ID NO: 3354 - DNA, 42 bp, Artificial Sequence
  Synthetic
ctgatgatctttcgacgatgtaggcaacccttcttgtgacct

SEQ ID NO: 3355 - DNA, 43 bp, Artificial Sequence
  Synthetic
cgaaaagaatgctctttcccctgcaaaagagcggtttttaccc

SEQ ID NO: 3356 - DNA, 42 bp, Artificial Sequence
  Synthetic
tgaaagaacgtgtccataccatggggccaaacattgcgagta

SEQ ID NO: 3357 - DNA, 39 bp, Artificial Sequence
  Synthetic
taccagccagcgactagtccagaggactatttggagcca

SEQ ID NO: 3358 - DNA, 48 bp, Artificial Sequence
  Synthetic
atgctcatcgagtgttttttgatttagattgatgaccaaatacaagac

SEQ ID NO: 3359 - DNA, 42 bp, Artificial Sequence
  Synthetic
cggttccgcagaccactatggcatgagtgtcgaacagcctcc

SEQ ID NO: 3360 - DNA, 39 bp, Artificial Sequence
  Synthetic
gcggcaacaagtaaactccaccgcccacaggacgtcaag

SEQ ID NO: 3361 - DNA, 38 bp, Artificial Sequence
  Synthetic
tgacagcgtgggggtgatttgtgccctgtgtcctggaa

SEQ ID NO: 3362 - DNA, 41 bp, Artificial Sequence
  Synthetic
acagtatgggtgcggccatcactgggccaaggttatactgg

SEQ ID NO: 3363 - DNA, 40 bp, Artificial Sequence
  Synthetic
ttggtcgaatgcggcaagggtcaactcttctgggtgtcca

SEQ ID NO: 3364 - DNA, 40 bp, Artificial Sequence
  Synthetic
acaaaccccgtggagttcatcctaacattaggccccccgc

SEQ ID NO: 3365 - DNA, 40 bp, Artificial Sequence
  Synthetic
gtgtggtggtgtgcaggagcaattggacctatggtgagcg

SEQ ID NO: 3366 - DNA, 39 bp, Artificial Sequence
  Synthetic
cccatgattccctgcggccgaagcaacctgcaagaacgt

SEQ ID NO: 3367 - DNA, 41 bp, Artificial Sequence
  Synthetic
ccacccttaacctgcaacgggtttcatagcccgagtggagg

SEQ ID NO: 3368 - DNA, 40 bp, Artificial Sequence
  Synthetic
cgcggagaatacgatgggttcttgaaggattgggcagcgt

SEQ ID NO: 3369 - DNA, 41 bp, Artificial Sequence
  Synthetic
gccccatggaagagtgtccacaggtgcagttcttatccacg

SEQ ID NO: 3370 - DNA, 40 bp, Artificial Sequence
  Synthetic
aacacctaccacatgcccggttacctcaagggttcctcgg

SEQ ID NO: 3371 - DNA, 37 bp, Artificial Sequence
  Synthetic
ctccggtcctgatgttggggtgttcgggttcggggca

SEQ ID NO: 3372 - DNA, 41 bp, Artificial Sequence
  Synthetic
acgcccagactggtcaattgtttaaagggcggtaggcatct

SEQ ID NO: 3373 - DNA, 40 bp, Artificial Sequence
  Synthetic
tctccctgtacggcccctacgagactactacagtgcccca

SEQ ID NO: 3374 - DNA, 42 bp, Artificial Sequence
  Synthetic
gagtggggccagttaaagtcggccagctgggatacaatgtgg

SEQ ID NO: 3375 - DNA, 38 bp, Artificial Sequence
  Synthetic
aagaggggaggtcaccgcggaccttgccgggtaatccc

SEQ ID NO: 3376 - DNA, 38 bp, Artificial Sequence
  Synthetic
atgtggcgccgcagaacgtcaatactctgccctggagc

SEQ ID NO: 3377 - DNA, 39 bp, Artificial Sequence
  Synthetic
aagggcactccggggagttgcggcactgacagacttcaa

SEQ ID NO: 3378 - DNA, 40 bp, Artificial Sequence
  Synthetic
acgccatccagctccgtgaaacaatctgaagtgtccctgc

SEQ ID NO: 3379 - DNA, 38 bp, Artificial Sequence
  Synthetic
gcaggtggccttgagagaggtctccaccctctctggca

SEQ ID NO: 3380 - DNA, 36 bp, Artificial Sequence
  Synthetic
gcaggtggtatcgggcagcgacttggaagcgaccgg

SEQ ID NO: 3381 - DNA, 40 bp, Artificial Sequence
  Synthetic
gccccagtccaggtgtatgacacagggtcatggtcaaccg

SEQ ID NO: 3382 - DNA, 41 bp, Artificial Sequence
  Synthetic
cgccgtatccgtacttggaacgccctagaggaagcctgtgg

SEQ ID NO: 3383 - DNA, 42 bp, Artificial Sequence
  Synthetic
gtcgtcaccacataccaggagcgctttagcctcctgtagagc

SEQ ID NO: 3384 - DNA, 41 bp, Artificial Sequence
  Synthetic
gcactatccgagcccacaaggcggttaattcctggctaggg

SEQ ID NO: 3385 - DNA, 38 bp, Artificial Sequence
  Synthetic
atggcggccctacctccctgttggagacatcgggctcg

SEQ ID NO: 3386 - DNA, 43 bp, Artificial Sequence
  Synthetic
tactgcgtaggtgcactaggcttgtagatctgttctctaaacg

SEQ ID NO: 3387 - DNA, 42 bp, Artificial Sequence
  Synthetic
ggtgttcacgtgcctccgatagggttagagacgtgctagtgc

SEQ ID NO: 3388 - DNA, 45 bp, Artificial Sequence
  Synthetic
gtggttgaatgactttgacttttgagagtgccaagaaatttgaca

SEQ ID NO: 3389 - DNA, 43 bp, Artificial Sequence
  Synthetic
cgcttattatagcagccaacatagggcaagggaggtaggacta

SEQ ID NO: 3390 - DNA, 38 bp, Artificial Sequence
  Synthetic
tccaagcaccttttacgggcattgttgagtcctgcggt

SEQ ID NO: 3391 - DNA, 46 bp, Artificial Sequence
  Synthetic
gaccaccagttacatatgccataatgacgccatggtttatacttca

SEQ ID NO: 3392 - DNA, 41 bp, Artificial Sequence
  Synthetic
acctaagttgagtgatcgcaacttgttaacaaggcactcga

SEQ ID NO: 3393 - DNA, 40 bp, Artificial Sequence
  Synthetic
caggagacaatgcgcagtattaccagtctgtgtaaatggc

SEQ ID NO: 3394 - DNA, 46 bp, Artificial Sequence
  Synthetic
tgcatcgtcctcttcttcctcacttttcatcacgtatgtattgttc

SEQ ID NO: 3395 - DNA, 46 bp, Artificial Sequence
  Synthetic
aggtgtatgttagcagcatttacaatgtgttgacatcgttaaggag

SEQ ID NO: 3396 - DNA, 42 bp, Artificial Sequence
  Synthetic
aagactgaagtggtttagcacctcacaggacatcttacttgc

SEQ ID NO: 3397 - DNA, 42 bp, Artificial Sequence
  Synthetic
tcacctaccatgtaaggtgcatgaacatgcttagaggtgaag

SEQ ID NO: 3398 - DNA, 47 bp, Artificial Sequence
  Synthetic
gctctaacatccatgcatataggcaaactgtatcctggaatttgaga

SEQ ID NO: 3399 - DNA, 44 bp, Artificial Sequence
  Synthetic
tgatgacgaagtgaggtatccattccgtagtgtcagtatcatca

SEQ ID NO: 3400 - DNA, 47 bp, Artificial Sequence
  Synthetic
agcttcactacgtagtgtgtcatcatgtaaatcatgagggtaagact

SEQ ID NO: 3401 - DNA, 46 bp, Artificial Sequence
  Synthetic
ggtagtagttttctgaccacaatgtcatgctaatttggaatctgca

SEQ ID NO: 3402 - DNA, 44 bp, Artificial Sequence
  Synthetic
tggtcctttgtactctgacatcttaaggagaccctctatcgtat

SEQ ID NO: 3403 - DNA, 40 bp, Artificial Sequence
  Synthetic
ccactacatcgccattcaagtccaaagccagcttcacgag

SEQ ID NO: 3404 - DNA, 47 bp, Artificial Sequence
  Synthetic
tggtttaagtatgacattgcctacaaccatacagaaggaagtcatag

SEQ ID NO: 3405 - DNA, 46 bp, Artificial Sequence
  Synthetic
ggaaaagaaccttcacagaaatccagctccttcttattgtaatggc

SEQ ID NO: 3406 - DNA, 39 bp, Artificial Sequence
  Synthetic
ctaaccattgcagaaacgggttcttggctcatgtggttt

SEQ ID NO: 3407 - DNA, 44 bp, Artificial Sequence
  Synthetic
gtcagtagggttgattggtcttttcattagtgatgaagttgctc

SEQ ID NO: 3408 - DNA, 47 bp, Artificial Sequence
  Synthetic
gcaacaagtgccttaagtttttccagtttccgttaagatgtttgatg

SEQ ID NO: 3409 - DNA, 45 bp, Artificial Sequence
  Synthetic
gcagctgttcagataaagacatgtacatatcaatgcccaagtagc

SEQ ID NO: 3410 - DNA, 46 bp, Artificial Sequence
  Synthetic
accagcatgtttatttgcaaaacaaaaatcattggttacaaagcca

SEQ ID NO: 3411 - DNA, 43 bp, Artificial Sequence
  Synthetic
tctggacgaagctcactataagaaagctatgggcaaacctgtg

SEQ ID NO: 3412 - DNA, 39 bp, Artificial Sequence
  Synthetic
ccaccagccactactgaagcttactcctcttgtgcaacc

SEQ ID NO: 3413 - DNA, 47 bp, Artificial Sequence
  Synthetic
cgctacgcaattttaggtacatttcgttacatttagtaccttcgagg

SEQ ID NO: 3414 - DNA, 40 bp, Artificial Sequence
  Synthetic
aaccactctgcagaacagcagctgatgttctctaccaacc

SEQ ID NO: 3415 - DNA, 46 bp, Artificial Sequence
  Synthetic
cggacaaatttatacttgggtgtctaaaattgtctgcttaggctta

SEQ ID NO: 3416 - DNA, 47 bp, Artificial Sequence
  Synthetic
acatgatcttgtgtcaaaggttcatagattcaccactactttgaatg

SEQ ID NO: 3417 - DNA, 48 bp, Artificial Sequence
  Synthetic
gaccactgtgtactttgaacaagacatcattggatgcttttaactttc

SEQ ID NO: 3418 - DNA, 50 bp, Artificial Sequence
  Synthetic
cgacaccagaatagttagaggttactctactatggtaatgctttagatca

SEQ ID NO: 3419 - DNA, 43 bp, Artificial Sequence
  Synthetic
cctccaatacccaacaacttaatgtatatgaactcccaggggc

SEQ ID NO: 3420 - DNA, 47 bp, Artificial Sequence
  Synthetic
acaacctattaatgtctacagcaccagaagatggtttctcttttgtc

SEQ ID NO: 3421 - DNA, 43 bp, Artificial Sequence
  Synthetic
gcactagttacttttgccctcttgcaggctatgacccaaatgt

SEQ ID NO: 3422 - DNA, 43 bp, Artificial Sequence
  Synthetic
gtcgtagtgctactggactcagttggcctcttattgttacagc

SEQ ID NO: 3423 - DNA, 42 bp, Artificial Sequence
  Synthetic
gcaggtacttctgtagcatttccatatggtgctgggcagttt

SEQ ID NO: 3424 - DNA, 45 bp, Artificial Sequence
  Synthetic
gggtcattagcacaagtggtagtaaaggattctgtgacttgaaag

SEQ ID NO: 3425 - DNA, 48 bp, Artificial Sequence
  Synthetic
ccatgtcaccatctactctaaacttataacttggttaaagattgtcca

SEQ ID NO: 3426 - DNA, 44 bp, Artificial Sequence
  Synthetic
cctacaatgcctgcatcacgtgtacgccaatcattattaaagac

SEQ ID NO: 3427 - DNA, 48 bp, Artificial Sequence
  Synthetic
ggatacacctatcatccaaacagtttctcttcgaccgttattttaaat

SEQ ID NO: 3428 - DNA, 47 bp, Artificial Sequence
  Synthetic
tgacagtttgaaaagcaacattgtttattgctagataaacgcactac

SEQ ID NO: 3429 - DNA, 48 bp, Artificial Sequence
  Synthetic
acagatagagacaccagctacggaactcaaatgaatcttaagtatgcc

SEQ ID NO: 3430 - DNA, 43 bp, Artificial Sequence
  Synthetic
cgttagctaacctgtagaaacgggttcttgctcgcaaacataa

SEQ ID NO: 3431 - DNA, 46 bp, Artificial Sequence
  Synthetic
cggcatcatcagaaagaatcatcatatcatgaattcgtggatgagt

SEQ ID NO: 3432 - DNA, 47 bp, Artificial Sequence
  Synthetic
agacatcagcatactcctgattaggacttatgattgaaaggttcgtg

SEQ ID NO: 3433 - DNA, 45 bp, Artificial Sequence
  Synthetic
gcaaacatagggattaacagacaacgaccattcctatgttgcaag

SEQ ID NO: 3434 - DNA, 40 bp, Artificial Sequence
  Synthetic
ttcctcagtggctttgagcgccaacacttgtactgagaga

SEQ ID NO: 3435 - DNA, 43 bp, Artificial Sequence
  Synthetic
gtgttgggtacaagccagtaatcttagtgcacctactctagtg

SEQ ID NO: 3436 - DNA, 44 bp, Artificial Sequence
  Synthetic
agcattgacaacactcaagtcataaatgcattgccagaaacaac

SEQ ID NO: 3437 - DNA, 47 bp, Artificial Sequence
  Synthetic
tgattgcagatgaaacatcatgtgtaaaagcacacaaggataagtca

SEQ ID NO: 3438 - DNA, 47 bp, Artificial Sequence
  Synthetic
cgacgtggtatttctagacttgtaacattttgtgcataatgtctgat

SEQ ID NO: 3439 - DNA, 44 bp, Artificial Sequence
  Synthetic
aaagccaatccacgcacgaaggttaccctaatatgtttatcacc

SEQ ID NO: 3440 - DNA, 42 bp, Artificial Sequence
  Synthetic
gtaagctcaaagccatgcgcagtgatacactgaaaggattgt

SEQ ID NO: 3441 - DNA, 45 bp, Artificial Sequence
  Synthetic
caatgcagacttcacaaccatgtattataggagatgaactgaggg

SEQ ID NO: 3442 - DNA, 44 bp, Artificial Sequence
  Synthetic
catcacagcctggtaagttcaagaatgcaattgtgtgtaggttt

SEQ ID NO: 3443 - DNA, 45 bp, Artificial Sequence
  Synthetic
cctggtaaatgtattccacaggttaatttctgctggatttagcct

SEQ ID NO: 3444 - DNA, 43 bp, Artificial Sequence
  Synthetic
acaagacagtaagtgaagaacaagctctgcacaatgactgaca

SEQ ID NO: 3445 - DNA, 45 bp, Artificial Sequence
  Synthetic
cctcgagcttatatcgctgtatgaataagcccagatcacaaatgg

SEQ ID NO: 3446 - DNA, 50 bp, Artificial Sequence
  Synthetic
ccaaagcatgaatgaaatttcagcaaataaagtcacaagatttgtcagtg

SEQ ID NO: 3447 - DNA, 44 bp, Artificial Sequence
  Synthetic
ccaattaaagtagaatctgcgtcggctcagacaatggttgccaa

SEQ ID NO: 3448 - DNA, 45 bp, Artificial Sequence
  Synthetic
tgccaagatagttagccccaattggacagcttttgttacaaatgt

SEQ ID NO: 3449 - DNA, 43 bp, Artificial Sequence
  Synthetic
tgtctgtgtacccatgggtttgtaactttgaattgtgtgacaa

SEQ ID NO: 3450 - DNA, 44 bp, Artificial Sequence
  Synthetic
acttgagcataaatgtagttggcttttttcacctgctcaagaca

SEQ ID NO: 3451 - DNA, 50 bp, Artificial Sequence
  Synthetic
gcaaagatcattcaacttagtggcactacaactcaacatttttttcaacc

SEQ ID NO: 3452 - DNA, 43 bp, Artificial Sequence
  Synthetic
gccaataacaattaagagcaggtggtaggccctttgagagaga

SEQ ID NO: 3453 - DNA, 50 bp, Artificial Sequence
  Synthetic
agcatttgttccaggtgtaattacacatctgaaatattagacatttcacc

SEQ ID NO: 3454 - DNA, 47 bp, Artificial Sequence
  Synthetic
agcaatggtgttattagagtaagcaactagccaaaaatctattgtgg

SEQ ID NO: 3455 - DNA, 46 bp, Artificial Sequence
  Synthetic
gcattcgccatattgcttcatgaaaggtcttttattgaggacttgc

SEQ ID NO: 3456 - DNA, 49 bp, Artificial Sequence
  Synthetic
tgcagttgatgttgttgtaagtgattctatgagaaccaaaaacaaatcg

SEQ ID NO: 3457 - DNA, 42 bp, Artificial Sequence
  Synthetic
ggacataaggtggtagccctttctgagtgtgttcttggacaa

SEQ ID NO: 3458 - DNA, 48 bp, Artificial Sequence
  Synthetic
gctcttctttgaatgagtcaagctctcgttattggcatcattaacaac

SEQ ID NO: 3459 - DNA, 42 bp, Artificial Sequence
  Synthetic
aagagcatgcacccttgaggcatcgtcatggttacaatcttg

SEQ ID NO: 3460 - DNA, 42 bp, Artificial Sequence
  Synthetic
gcaaatgaactggaagcccttatgctgtttttcagagcgcta

SEQ ID NO: 3461 - DNA, 46 bp, Artificial Sequence
  Synthetic
gtgaaatagccatgtacaacgacataattggtggttattctgagga

SEQ ID NO: 3462 - DNA, 43 bp, Artificial Sequence
  Synthetic
gcaagaataccacgaaagcaagaaatcggaagaaacaggtacg

SEQ ID NO: 3463 - DNA, 43 bp, Artificial Sequence
  Synthetic
cctgttccgattagaataggcaaattcctggaacaatggaacc

SEQ ID NO: 3464 - DNA, 40 bp, Artificial Sequence
  Synthetic
acagcgccctagggagtgtcacttgtcattggtgctgtga

SEQ ID NO: 3465 - DNA, 48 bp, Artificial Sequence
  Synthetic
cctgatagtgatatagctcgcaagcatgaaaattattctcttcctgac

SEQ ID NO: 3466 - DNA, 47 bp, Artificial Sequence
  Synthetic
acatgaggtttattagatgcacagcttgtatttctctatgcagttgc

SEQ ID NO: 3467 - DNA, 41 bp, Artificial Sequence
  Synthetic
ccattgcgtcctccattctggtccccccgcattacatttgg

SEQ ID NO: 3468 - DNA, 40 bp, Artificial Sequence
  Synthetic
tgccaatgtggtctttgggtgtacttccctacggcgctaa

SEQ ID NO: 3469 - DNA, 45 bp, Artificial Sequence
  Synthetic
agcagatttcttagtgacagtttggcttgagagcaaagtttctgg

SEQ ID NO: 3470 - DNA, 43 bp, Artificial Sequence
  Synthetic
gttcagcagtatgacgttgtctttcatggagccattaaattgg

SEQ ID NO: 3471 - DNA, 49 bp, Artificial Sequence
  Synthetic
cctacttgtgctgtttagttacgagttccgtttacgatacatagtctac

SEQ ID NO: 3472 - DNA, 39 bp, Artificial Sequence
  Synthetic
gggaagggtgggaaaaactggccatgcggtgttgtactc

SEQ ID NO: 3473 - DNA, 41 bp, Artificial Sequence
  Synthetic
caagaagggtgagcaggcagcagtagacctggcagatgagg

SEQ ID NO: 3474 - DNA, 43 bp, Artificial Sequence
  Synthetic
gcacccatgatgacaatctatacacgtgtccgtgtttcctgtt

SEQ ID NO: 3475 - DNA, 46 bp, Artificial Sequence
  Synthetic
cacaagcttcaactgttggtgactgttaaagatgtgttagaaaagg

SEQ ID NO: 3476 - DNA, 38 bp, Artificial Sequence
  Synthetic
agggcatcaggcaatttccatggacagtcgttcttgga

SEQ ID NO: 3477 - DNA, 44 bp, Artificial Sequence
  Synthetic
ccaactgtcatcactaggtcttttaaggtgagcaaggtagagaa

SEQ ID NO: 3478 - DNA, 47 bp, Artificial Sequence
  Synthetic
ctgagtggtactaaacacaaccttatcaattagccctatgttttcag

SEQ ID NO: 3479 - DNA, 50 bp, Artificial Sequence
  Synthetic
ggttgtgaggcaatatctactggtatgaatatgtacactgttgatttacg

SEQ ID NO: 3480 - DNA, 40 bp, Artificial Sequence
  Synthetic
ccccacatcccacactaaatgttcctggtgttggaaaacc

SEQ ID NO: 3481 - DNA, 48 bp, Artificial Sequence
  Synthetic
tgtgagtactccttcttgtgtgtcaaagatttttgcttaagattagcc

SEQ ID NO: 3482 - DNA, 45 bp, Artificial Sequence
  Synthetic
ttcctgattgccatgtgtaatcatcttatgtatgtacccccagga

SEQ ID NO: 3483 - DNA, 45 bp, Artificial Sequence
  Synthetic
cgaggacaccatgcttttatatgtcacgattcaaatattgtgtgc

SEQ ID NO: 3484 - DNA, 50 bp, Artificial Sequence
  Synthetic
tcacatcattaccttcagtgtttgttgattctattcttgtatcatactcc

SEQ ID NO: 3485 - DNA, 49 bp, Artificial Sequence
  Synthetic
cacactggaattttctcaggtcaattggtgttataggtatgattacagc

SEQ ID NO: 3486 - DNA, 45 bp, Artificial Sequence
  Synthetic
acgcacagagtttctctttaagaaacacaaactgtaattgccact

SEQ ID NO: 3487 - DNA, 43 bp, Artificial Sequence
  Synthetic
tttaggatctgggggcaaagaatactggaaaatctcttgccac

SEQ ID NO: 3488 - DNA, 46 bp, Artificial Sequence
  Synthetic
tgaagatactgttggtggtgttagtaccatttacatccaagtttgt

SEQ ID NO: 3489 - DNA, 49 bp, Artificial Sequence
  Synthetic
accctgaagtgtacagaacaatttctataggtataatagctaatgtggt

SEQ ID NO: 3490 - DNA, 45 bp, Artificial Sequence
  Synthetic
gcaaatcataggaatcagagacctttggtacttccaacacattct

SEQ ID NO: 3491 - DNA, 42 bp, Artificial Sequence
  Synthetic
ccttgtacaaaacacccccacatactgcacgaatgatcaagt

SEQ ID NO: 3492 - DNA, 49 bp, Artificial Sequence
  Synthetic
gtgactatacctgggtttttgtggatgtgttattcagaagtgtatttgg

SEQ ID NO: 3493 - DNA, 43 bp, Artificial Sequence
  Synthetic
ctcatcagctctgaatcctcttttaacccctgctgataagtct

SEQ ID NO: 3494 - DNA, 43 bp, Artificial Sequence
  Synthetic
ggtagaagcactaacacacagtctaaagaggtggagttgtcac

SEQ ID NO: 3495 - DNA, 49 bp, Artificial Sequence
  Synthetic
cttcacaagctacctgtacattagatctaaaaggagattgtttacagac

SEQ ID NO: 3496 - DNA, 47 bp, Artificial Sequence
  Synthetic
ccatcaaatgcatttctcatatgcagggtaaagtaggctttctagat

SEQ ID NO: 3497 - DNA, 43 bp, Artificial Sequence
  Synthetic
tgtgatgtgatctctaaggtctgtactgagcgtacgttttgct

SEQ ID NO: 3498 - DNA, 48 bp, Artificial Sequence
  Synthetic
tgacaggagcaagaatagttttgttcaacctgatgtgttaaagtatgg

SEQ ID NO: 3499 - DNA, 44 bp, Artificial Sequence
  Synthetic
ttcacagtcatgccccaacccagaaatatgggcatttatacctg

SEQ ID NO: 3500 - DNA, 41 bp, Artificial Sequence
  Synthetic
ggaagatgctccaggttctactggcccattacaaggcctaa

SEQ ID NO: 3501 - DNA, 42 bp, Artificial Sequence
  Synthetic
ctctgtgattggtacctgctctatcacacctgtcactgcatt

SEQ ID NO: 3502 - DNA, 50 bp, Artificial Sequence
  Synthetic
tcggggacaaatacctttaaaactgagaaggggaaacattaaatattcct

SEQ ID NO: 3503 - DNA, 46 bp, Artificial Sequence
  Synthetic
gacgttccctgtctgaattgtatgtattcagatgtaagttaccaga

SEQ ID NO: 3504 - DNA, 43 bp, Artificial Sequence
  Synthetic
gctgttctcgctttccaaaaaagaacaattgctttgtggcctg

SEQ ID NO: 3505 - DNA, 48 bp, Artificial Sequence
  Synthetic
gccattcttccaatattctgggattatgtaaaataactttggatgctg

SEQ ID NO: 3506 - DNA, 48 bp, Artificial Sequence
  Synthetic
tgaccccatgagtcagataaaacagcttgaataaattgtttactgtgc

SEQ ID NO: 3507 - DNA, 47 bp, Artificial Sequence
  Synthetic
gaaggtaacaccaactcttccaaataaagtatgaaggggactattgc

SEQ ID NO: 3508 - DNA, 43 bp, Artificial Sequence
  Synthetic
ccaatctgcagtttgtaattcaagaccaggacctgctttcaag

SEQ ID NO: 3509 - DNA, 43 bp, Artificial Sequence
  Synthetic
agtctcggactcaaatctacaagatccgagctttagtggacct

SEQ ID NO: 3510 - DNA, 42 bp, Artificial Sequence
  Synthetic
tgatcctgcagtacatcgaaaccagtgtgacgaagaagatga

SEQ ID NO: 3511 - DNA, 48 bp, Artificial Sequence
  Synthetic
tggaactagtaacgacagaggaaattattcaaatactggacaatggac

SEQ ID NO: 3512 - DNA, 41 bp, Artificial Sequence
  Synthetic
ggctcttggttctctggtggttcgacaagagaacgacgacg

SEQ ID NO: 3513 - DNA, 45 bp, Artificial Sequence
  Synthetic
cctctggatttatcacatccaaaggtacaaaaccaagcataccac

SEQ ID NO: 3514 - DNA, 49 bp, Artificial Sequence
  Synthetic
ggtttgaacctgttgtacaaaacgcttttaatagggttatcaatcaagg

SEQ ID NO: 3515 - DNA, 43 bp, Artificial Sequence
  Synthetic
gttgaaaaaggtccagttggctatcgcgcaggtgttaagacaa

SEQ ID NO: 3516 - DNA, 41 bp, Artificial Sequence
  Synthetic
tgctttgccttctccatcttctaatgtcgctgtttggagac

SEQ ID NO: 3517 - DNA, 43 bp, Artificial Sequence
  Synthetic
acatcttctcatttttctctcagctcctgtcaggaatgggaac

SEQ ID NO: 3518 - DNA, 41 bp, Artificial Sequence
  Synthetic
tgtctttgctgtgttcatagctggtcttcggtacctggagt

SEQ ID NO: 3519 - DNA, 45 bp, Artificial Sequence
  Synthetic
agtttccatctgttcataagatcgtactcactgagtgacatcaac

SEQ ID NO: 3520 - DNA, 44 bp, Artificial Sequence
  Synthetic
tcctctttgtcatacagaatcagctaggtccaatctaccgaaga

SEQ ID NO: 3521 - DNA, 40 bp, Artificial Sequence; identical to SEQ ID NO: 2016
  Synthetic

SEQ ID NO: 3522 - DNA, 43 bp, Artificial Sequence
  Synthetic
ctgatgaagcttgagactctcagacaattggtgtggatggcat

SEQ ID NO: 3523 - DNA, 44 bp, Artificial Sequence
  Synthetic
cccaaaagagctctttcatttgatctttttgttcatgatgcccg

SEQ ID NO: 3524 - DNA, 43 bp, Artificial Sequence
  Synthetic
gccaccccaaataaacaaaggattaggctgttgctgcttcaat

SEQ ID NO: 3525 - DNA, 42 bp, Artificial Sequence
  Synthetic
tccatcttgctttctggcgcaaattgacacgattactgttga

SEQ ID NO: 3526 - DNA, 46 bp, Artificial Sequence
  Synthetic
gaggcgtgtataaaaagaaatgtgtccgttgaggtatttttctcac

SEQ ID NO: 3527 - DNA, 48 bp, Artificial Sequence
  Synthetic
cagtaccttccattgattagcctttgttgaaatgaaaaaacctcatgc

SEQ ID NO: 3528 - DNA, 50 bp, Artificial Sequence
  Synthetic
gcaaaaggataattagcagcttctggttggtaaatcaaccttatttaacg

SEQ ID NO: 3529 - DNA, 43 bp, Artificial Sequence
  Synthetic
tgcaaaacattaaactctgctactgtaaacgttatgcgcgtgt

SEQ ID NO: 3530 - DNA, 47 bp, Artificial Sequence
  Synthetic
ttcagtaagaccgatagcttccaaacgtgcagaagaagaaatttcag

SEQ ID NO: 3531 - DNA, 48 bp, Artificial Sequence
  Synthetic
agccataaaaccaatattgtgctttatggtaaaaatgattgttggtct

SEQ ID NO: 3532 - DNA, 45 bp, Artificial Sequence
  Synthetic
ccaactttgattcggttaaattcctaggaggacataatggcatta

SEQ ID NO: 3533 - DNA, 42 bp, Artificial Sequence
  Synthetic
caaagaagcaagcctaagcctaaagtgggcttgtctggtcta

SEQ ID NO: 3534 - DNA, 45 bp, Artificial Sequence
  Synthetic
gcctgcaaaatcttacctaagtcatggaggctcaaaatttgtgat

SEQ ID NO: 3535 - DNA, 40 bp, Artificial Sequence
  Synthetic
agcacaacaaaacaagccatttcagcaattagaagcgctg

SEQ ID NO: 3536 - DNA, 48 bp, Artificial Sequence
  Synthetic
cacaaaacctttcaagagacgtttgaagttactaagttttgacgatgt

SEQ ID NO: 3537 - DNA, 46 bp, Artificial Sequence
  Synthetic
gcaattaatggctgatttgcggagaataccgattgaaatttctcct

SEQ ID NO: 3538 - DNA, 44 bp, Artificial Sequence
  Synthetic
cccaaatctacggctgataaagattgtggtgatcacatctgctt

SEQ ID NO: 3539 - DNA, 39 bp, Artificial Sequence
  Synthetic
tacgagatccccaacgttggtggtaccgaaaacatgagt

SEQ ID NO: 3540 - DNA, 45 bp, Artificial Sequence
  Synthetic
gcagggcgtaactttgctaaatcaagatgaataccctaaatttgg

SEQ ID NO: 3541 - DNA, 42 bp, Artificial Sequence
  Synthetic
gcaatagctcctccattgacattacttttgctgctcaggctt

SEQ ID NO: 3542 - DNA, 40 bp, Artificial Sequence
  Synthetic
accagtgcatcaattaacgcttcacgattatggtcggtgg

SEQ ID NO: 3543 - DNA, 47 bp, Artificial Sequence
  Synthetic
tgaggttaatcgaccaaaatcttcttcttgccaaagaatatctgaac

SEQ ID NO: 3544 - DNA, 50 bp, Artificial Sequence
  Synthetic
gagcaacccttcaagataaacatcttttgaaggataagattgatagaagg

SEQ ID NO: 3545 - DNA, 50 bp, Artificial Sequence
  Synthetic
gcttcttttgtagctactagtgtcgctttgatcagcatttaaaactactg

SEQ ID NO: 3546 - DNA, 44 bp, Artificial Sequence
  Synthetic
acaatggggcatttccgatgctaaaaaatggttagttaagccag

SEQ ID NO: 3547 - DNA, 44 bp, Artificial Sequence
  Synthetic
gaccttgaaagtggcaaagttttagttgtcaagagcttactgac

SEQ ID NO: 3548 - DNA, 44 bp, Artificial Sequence
  Synthetic
gcatttttattaccacaagctgccaaaagtaaatggttggcagc

SEQ ID NO: 3549 - DNA, 44 bp, Artificial Sequence
  Synthetic
ccagtcacaaaatcttctgctgttatgtctcttggtatacggct

SEQ ID NO: 3550 - DNA, 44 bp, Artificial Sequence
  Synthetic
caacattcttagcatcccagtagtttggtgcttacttcttgagc

SEQ ID NO: 3551 - DNA, 50 bp, Artificial Sequence
  Synthetic
acgaaaatccttgttgttaagagcttctttcaaaaacactaagaaagacc

SEQ ID NO: 3552 - DNA, 45 bp, Artificial Sequence
  Synthetic
ctaattgaactgggaaggttacaccaaagctgagtttgcaaaagc

SEQ ID NO: 3553 - DNA, 44 bp, Artificial Sequence
  Synthetic
tgtgtcatcagccagctgtacatcagtttttagaggagaattgg

SEQ ID NO: 3554 - DNA, 45 bp, Artificial Sequence
  Synthetic
ggtgtccactcttgtgcctgctaaaaagagcttatttgtgacaag

SEQ ID NO: 3555 - DNA, 41 bp, Artificial Sequence
  Synthetic
tgcttggggtaatggctcactggcacctgcttctagtccag

SEQ ID NO: 3556 - DNA, 41 bp, Artificial Sequence
  Synthetic
cattggattgtaggcatggtttgcaccacaagtgttgcaac

SEQ ID NO: 3557 - DNA, 42 bp, Artificial Sequence
  Synthetic
tctgtaatactgccgcgatctggccatttgcaagtatttacg

SEQ ID NO: 3558 - DNA, 45 bp, Artificial Sequence
  Synthetic
caggttttcgaggtgttgcaggtcttgaaatgtattatactagtg

SEQ ID NO: 3559 - DNA, 43 bp, Artificial Sequence
  Synthetic
cagttggatgagttaggatcatccttccctcactggaaattcc

SEQ ID NO: 3560 - DNA, 47 bp, Artificial Sequence
  Synthetic
ggtttgaccatagagtcatattggtaggtttatccaccatattgatg

SEQ ID NO: 3561 - DNA, 43 bp, Artificial Sequence
  Synthetic
ccaaaatcatctgattgagcagctactaagccaaccaaagcgt

SEQ ID NO: 3562 - DNA, 44 bp, Artificial Sequence
  Synthetic
ggacgtaattgccctcactattgaaagaaaatgagaccactgtc

SEQ ID NO: 3563 - DNA, 43 bp, Artificial Sequence
  Synthetic
gctgctggtgttttagcaatgataaccaaacagctccgttgag

SEQ ID NO: 3564 - DNA, 47 bp, Artificial Sequence
  Synthetic
cttctgtgccatacataccatagtttatcatttacgatgcccttacc

SEQ ID NO: 3565 - DNA, 45 bp, Artificial Sequence
  Synthetic
aggaatagctcgctctttagggtaagcagagttgaatttgacctt

SEQ ID NO: 3566 - DNA, 46 bp, Artificial Sequence
  Synthetic
tgaaactgattggggctaacgcacatgtctaagttattattggttg

SEQ ID NO: 3567 - DNA, 41 bp, Artificial Sequence
  Synthetic
tgccttcaaaaatggcagctaaatgtggctctagcttttcg

SEQ ID NO: 3568 - DNA, 47 bp, Artificial Sequence
  Synthetic
gctccgtatggtaaatagcttgtaaagatactacgacgattagagaa

SEQ ID NO: 3569 - DNA, 47 bp, Artificial Sequence
  Synthetic
gccgattagccttaagtttggttaagaagcagtcttagctaatcaac

SEQ ID NO: 3570 - DNA, 49 bp, Artificial Sequence
  Synthetic
cgtcatacaacctggtaaataaggttattgttggtcctaatttcaatcg

SEQ ID NO: 3571 - DNA, 45 bp, Artificial Sequence
  Synthetic
ggcttatgcgcttgtttgtaagtaaaaatagggatgatgctatcg

SEQ ID NO: 3572 - DNA, 43 bp, Artificial Sequence
  Synthetic
ccgatttttacacacagttgtcctagccattaccgactaccga

SEQ ID NO: 3573 - DNA, 44 bp, Artificial Sequence
  Synthetic
agctaattgaacatctgctccaacataagccctgattatgctcc

SEQ ID NO: 3574 - DNA, 46 bp, Artificial Sequence
  Synthetic
aatcagattggcctttggtaattgttaaacggtaagaaagtagccg

SEQ ID NO: 3575 - DNA, 44 bp, Artificial Sequence
  Synthetic
gtgattcttgaagagtaccagctttctcttgacgatgctcttcg

SEQ ID NO: 3576 - DNA, 43 bp, Artificial Sequence
  Synthetic
cggtaccagtcttttctttgttgtagctgcagcttctttttcc

SEQ ID NO: 3577 - DNA, 45 bp, Artificial Sequence
  Synthetic
cacctccccataaaaatcccattttacaaaaaagagtttcggtgg

SEQ ID NO: 3578 - DNA, 46 bp, Artificial Sequence
  Synthetic
cggtatattaagcgacataccagtccaagtccccttcttagaaagt

SEQ ID NO: 3579 - DNA, 44 bp, Artificial Sequence
  Synthetic
gcgtcgtaaatggtattggattgataggaaggtcaattggttgc

SEQ ID NO: 3580 - DNA, 44 bp, Artificial Sequence
  Synthetic
ggtgattgacatgttcttgagtcaagttccggctatgaaaatgc

SEQ ID NO: 3581 - DNA, 45 bp, Artificial Sequence
  Synthetic
ggcaacaaatcagcaatcttgttaaaaaatggcaccattgattgc

SEQ ID NO: 3582 - DNA, 44 bp, Artificial Sequence
  Synthetic
gatcgcctttgttactagattctctttatccaaacgtgccaaac

SEQ ID NO: 3583 - DNA, 45 bp, Artificial Sequence
  Synthetic
ccacatatttgctttcttctagggtggctttattcaagacttgcc

SEQ ID NO: 3584 - DNA, 50 bp, Artificial Sequence
  Synthetic
ggtctaaaagagcaactcgattcaacagtttgttccttttagaatcaaag

SEQ ID NO: 3585 - DNA, 43 bp, Artificial Sequence
  Synthetic
gccccaaagccttagaaagattcctactttgctgaaatctacc

SEQ ID NO: 3586 - DNA, 43 bp, Artificial Sequence
  Synthetic
cccttaagcatggtgataccgttttacacctgatgacacactc

SEQ ID NO: 3587 - DNA, 44 bp, Artificial Sequence
  Synthetic
ggtctccatgcaaatgagtaatgaagaaggaacgcaaagacaaa

SEQ ID NO: 3588 - DNA, 43 bp, Artificial Sequence
  Synthetic
cgtctagggttccttctaagtctttgtctggcgcataccattt

SEQ ID NO: 3589 - DNA, 39 bp, Artificial Sequence
  Synthetic
gcttcatgagcgatttgtgctcggattgcgagaaatcac

SEQ ID NO: 3590 - DNA, 41 bp, Artificial Sequence
  Synthetic
tccaactcgaggcattctttgaacaaagaacgcctagaaca

SEQ ID NO: 3591 - DNA, 39 bp, Artificial Sequence
  Synthetic
tccgataagggcaaacttggtcaggcttgattgcgtcag

SEQ ID NO: 3592 - DNA, 46 bp, Artificial Sequence
  Synthetic
ccgctgttaaaaactcatctaaggcccgctcagttgatttatgatc

SEQ ID NO: 3593 - DNA, 47 bp, Artificial Sequence
  Synthetic
ttaggcgtgtcaagaagaccttttatcagtttttagaggctattggt

SEQ ID NO: 3594 - DNA, 41 bp, Artificial Sequence
  Synthetic
tgagggcttcaactaaagcatccaaacgacctcaactccaa

SEQ ID NO: 3595 - DNA, 40 bp, Artificial Sequence
  Synthetic
agccccatcagcaatcatttgtctttttcagatggggggt

SEQ ID NO: 3596 - DNA, 43 bp, Artificial Sequence
  Synthetic
caaacgtcttgtgttacctcttgatcttagcagccgagtacga

SEQ ID NO: 3597 - DNA, 39 bp, Artificial Sequence
  Synthetic
tgacatcgtgtacgcgtacaaagcagccttgtctgctta

SEQ ID NO: 3598 - DNA, 41 bp, Artificial Sequence
  Synthetic
gttcacaaatcgcacctgctaaacgtcagttagtggaaggg

SEQ ID NO: 3599 - DNA, 48 bp, Artificial Sequence
  Synthetic
aagagattgctcaatagcttgtgtttatggcctgtcaattagatacac

SEQ ID NO: 3600 - DNA, 46 bp, Artificial Sequence
  Synthetic
ggaaaagccaagaaatctgctggatgaacccctaaaacattacact

SEQ ID NO: 3601 - DNA, 42 bp, Artificial Sequence
  Synthetic
agcacccgcattcataaaaacaggtttgaatttgcatgtggc

SEQ ID NO: 3602 - DNA, 45 bp, Artificial Sequence
  Synthetic
gccctttaagatttgcttccatgatttgtggatctgtgtttaagc

SEQ ID NO: 3603 - DNA, 42 bp, Artificial Sequence
  Synthetic
ggttacttgattttcgttgtgcagaaagcaagagcccctgaa

SEQ ID NO: 3604 - DNA, 44 bp, Artificial Sequence
  Synthetic
ggccttcaattcccttgtcaaattccagttgctactttatcgac

SEQ ID NO: 3605 - DNA, 42 bp, Artificial Sequence
  Synthetic
agcaacacgttggcaaaccattgcggtaaaaattcctggacg

SEQ ID NO: 3606 - DNA, 43 bp, Artificial Sequence
  Synthetic
tattgccaccccatttgccattcaggctgtaataatttagcgc

SEQ ID NO: 3607 - DNA, 44 bp, Artificial Sequence
  Synthetic
tggaggaattatggaaaatcaggaaccaaaggtttcaagccttg

SEQ ID NO: 3608 - DNA, 45 bp, Artificial Sequence
  Synthetic
ttacctttcctttgcctacgttgtgccttaaacccatttaattgc

SEQ ID NO: 3609 - DNA, 43 bp, Artificial Sequence
  Synthetic
cggaagaaaaagatggtattgatgccaagtcctgcaacagcta

SEQ ID NO: 3610 - DNA, 48 bp, Artificial Sequence
  Synthetic
acaggctggtaccaattactcattatatttttgatggtcttgtcaacg

SEQ ID NO: 3611 - DNA, 47 bp, Artificial Sequence
  Synthetic
ccagttacgtctttggaaaatgtttgtaatcaccaaaggtttgtagt

SEQ ID NO: 3612 - DNA, 47 bp, Artificial Sequence
  Synthetic
gaatgtgccaagttgcaaaaatctcaggtggagtatatcaattctcc

SEQ ID NO: 3613 - DNA, 45 bp, Artificial Sequence
  Synthetic
cttagtgactacacgcccaaaagagcttcaacgattttttcaatg

SEQ ID NO: 3614 - DNA, 39 bp, Artificial Sequence
  Synthetic
tgacgtgacagtcgaaagcaagccttatttcggtaagct

SEQ ID NO: 3615 - DNA, 47 bp, Artificial Sequence
  Synthetic
aggtctgcgctaagatatggtatataaccattgctcaaaaaagaaga

SEQ ID NO: 3616 - DNA, 41 bp, Artificial Sequence
  Synthetic
gaaggagatttcggacgaaccttgatttgggacataacagc

SEQ ID NO: 3617 - DNA, 43 bp, Artificial Sequence
  Synthetic
tgcatttaatcttggagagcaagaaatgttttaaggcccgtcg

SEQ ID NO: 3618 - DNA, 48 bp, Artificial Sequence
  Synthetic
tgctcttcctagatctcaaaaaaggtaagccaagaatgttaaaaaacc

SEQ ID NO: 3619 - DNA, 43 bp, Artificial Sequence
  Synthetic
ggtggcggtgtagtggttttattatgctggtgattttttctca

SEQ ID NO: 3620 - DNA, 45 bp, Artificial Sequence
  Synthetic
tgcagccttgcttgttaaacaatttgaaaaacgttggataagacg

SEQ ID NO: 3621 - DNA, 44 bp, Artificial Sequence
  Synthetic
aggaactatcatatcaggaggtcttcaagaagtgcaatgatggg

SEQ ID NO: 3622 - DNA, 43 bp, Artificial Sequence
  Synthetic
actcgaaaccatacagaagaaatgatcccaccaaagtaatgcg

SEQ ID NO: 3623 - DNA, 45 bp, Artificial Sequence
  Synthetic
cgcgaaatgctaagattatcggtaatttcacttcttcactagcgt

SEQ ID NO: 3624 - DNA, 43 bp, Artificial Sequence
  Synthetic
tcagccttctatcttgattttgctacgacgacgttctaagcta

SEQ ID NO: 3625 - DNA, 43 bp, Artificial Sequence
  Synthetic
gcagatattcttcgactttgggtccatagaaacacggacatca

SEQ ID NO: 3626 - DNA, 45 bp, Artificial Sequence
  Synthetic
ccaaatggcgagtttacaaaagaacaagaagaaccagagtcaaac

SEQ ID NO: 3627 - DNA, 43 bp, Artificial Sequence
  Synthetic
tctgtttctgatttccgtcaagatcccatgatggatgaaaggt

SEQ ID NO: 3628 - DNA, 41 bp, Artificial Sequence
  Synthetic
gttacccttgagtcagggacatagtcatcctcaccaaaacc

SEQ ID NO: 3629 - DNA, 50 bp, Artificial Sequence
  Synthetic
cgattcaacctctttatactacgcccgatatacgtattagtatcaaggat

SEQ ID NO: 3630 - DNA, 46 bp, Artificial Sequence
  Synthetic
cgtaaggagatggatttagcagaattatcaacctgacttaaagcgt

SEQ ID NO: 3631 - DNA, 38 bp, Artificial Sequence
  Synthetic
aaacagcctttccaatgcgcttgttcccaagctgcttg

SEQ ID NO: 3632 - DNA, 50 bp, Artificial Sequence
  Synthetic
agaggtaaatctcagtgaaacacaactgtgattataagcaaatcatcttg

SEQ ID NO: 3633 - DNA, 48 bp, Artificial Sequence
  Synthetic
aggattaaaccgagtataagcgtagaaacgattaatgtctattctcgt

SEQ ID NO: 3634 - DNA, 45 bp, Artificial Sequence
  Synthetic
ccttttcacggcggtaacacaaagttactaaatagctatagtccg

SEQ ID NO: 3635 - DNA, 41 bp, Artificial Sequence
  Synthetic
gccccctgtgagataaggtagtagctgagctaaactcccat

SEQ ID NO: 3636 - DNA, 42 bp, Artificial Sequence
  Synthetic
tggacttaccgctggtgtaccaatgctttcagcgcttatccc

SEQ ID NO: 3637 - DNA, 42 bp, Artificial Sequence
  Synthetic
gggcttagtgatccggtggtactgttatccccagggtagctt

SEQ ID NO: 3638 - DNA, 41 bp, Artificial Sequence
  Synthetic
cgcagtgaataggcccaagcaaggcgtcaccccctatacat

SEQ ID NO: 3639 - DNA, 45 bp, Artificial Sequence
  Synthetic
gagtccggctaagcagtgagcagctcaatgttataaagataagca

SEQ ID NO: 3640 - DNA, 42 bp, Artificial Sequence
  Synthetic
tgtaccggggctaaaacagtttctctcctaccatgacacttt

SEQ ID NO: 3641 - DNA, 41 bp, Artificial Sequence
  Synthetic
cctacaacaagttcgagcccgtatcgtaactcgccggttca

SEQ ID NO: 3642 - DNA, 38 bp, Artificial Sequence
  Synthetic
tgagaggtcttgtggggcctgacctcctgcgtgcaaag

SEQ ID NO: 3643 - DNA, 48 bp, Artificial Sequence
  Synthetic
cgaaacgtaaagaagaagttgaccttctttgattgttttttcagtagc

SEQ ID NO: 3644 - DNA, 40 bp, Artificial Sequence
  Synthetic
gcagacaaccaaccagctgtcttgttatctgctgccattg

SEQ ID NO: 3645 - DNA, 43 bp, Artificial Sequence
  Synthetic
tgcaggattgtcattgtcagaaatctgggatacgagttgatcc

SEQ ID NO: 3646 - DNA, 45 bp, Artificial Sequence
  Synthetic
tccttgaattaggtgatggtgtctaccaccaagtttgttatcacc

SEQ ID NO: 3647 - DNA, 43 bp, Artificial Sequence
  Synthetic
tcgtacaactccttcagtagtatcacactgcttgacgttttgc

SEQ ID NO: 3648 - DNA, 50 bp, Artificial Sequence
  Synthetic
ccagcgatggtagttgtttataactgcttctaacttgctatctagtttac

SEQ ID NO: 3649 - DNA, 39 bp, Artificial Sequence
  Synthetic
tcgttctcaggatctggcaaaccaaggcacgttctagat

SEQ ID NO: 3650 - DNA, 50 bp, Artificial Sequence
  Synthetic
cgtaggtctgttagtttggtaaacacgataataatcacctaatttagcag

SEQ ID NO: 3651 - DNA, 43 bp, Artificial Sequence
  Synthetic
gcagtttgctattccaagaaactttagcgctcctctacgatag

SEQ ID NO: 3652 - DNA, 41 bp, Artificial Sequence
  Synthetic
tggcaaaactagagaagttgggacttggcatccgtccacta

SEQ ID NO: 3653 - DNA, 41 bp, Artificial Sequence
  Synthetic
gtcacatcacctcgtctatcacggctggtggaacttctgtt

SEQ ID NO: 3654 - DNA, 42 bp, Artificial Sequence
  Synthetic
atttggtgagcacgagggatcacaaaaagatctctttgcctt

SEQ ID NO: 3655 - DNA, 48 bp, Artificial Sequence
  Synthetic
acgatcgctggattctaaatttttgctatgcgcaaaatgatatctttg

SEQ ID NO: 3656 - DNA, 39 bp, Artificial Sequence
  Synthetic
ttgccgtattgctgttccgttggaaaataagcgtgctca

SEQ ID NO: 3657 - DNA, 49 bp, Artificial Sequence
  Synthetic
tctggtagtttttctttgaccttctaagcctattatgatctgatgaaga

SEQ ID NO: 3658 - DNA, 43 bp, Artificial Sequence
  Synthetic
cataggctggcgatcaataaagatctcgtgattgtggttgacc

SEQ ID NO: 3659 - DNA, 43 bp, Artificial Sequence
  Synthetic
gagtttatcaaacgcttgaaaggctctattgagagcgcacaga

SEQ ID NO: 3660 - DNA, 44 bp, Artificial Sequence
  Synthetic
agggtttgattttgccaaatcttgcgatcaagaacaagaagctc

SEQ ID NO: 3661 - DNA, 49 bp, Artificial Sequence
  Synthetic
cccgttcaaattggctcttgtatttaccaagcctataaagaaaaacaag

SEQ ID NO: 3662 - DNA, 44 bp, Artificial Sequence
  Synthetic
ggcttcttgttcagggagggtagctctagtgatatcaaatatgc

SEQ ID NO: 3663 - DNA, 39 bp, Artificial Sequence
  Synthetic
acatgatgcgctcagaagggggtcagaatcaccacttcc

SEQ ID NO: 3664 - DNA, 43 bp, Artificial Sequence
  Synthetic
cagaaaaagcagctgaattggtacacaaaagggcacaggttga

SEQ ID NO: 3665 - DNA, 48 bp, Artificial Sequence
  Synthetic
aggaccgtcatgaatactaaaatgtgaaaggaattcacacttatgact

SEQ ID NO: 3666 - DNA, 40 bp, Artificial Sequence
  Synthetic
attgcggtgtgaagacctgcctcagtttgactttgcctta

SEQ ID NO: 3667 - DNA, 49 bp, Artificial Sequence
  Synthetic
tccctacctagaagtttgtacttgtctctttaatcagcttgagattgac

SEQ ID NO: 3668 - DNA, 47 bp, Artificial Sequence
  Synthetic
gccaaatcgtaaacaacgttggaaatcaaagatgtagataatcaccg

SEQ ID NO: 3669 - DNA, 42 bp, Artificial Sequence
  Synthetic
agaagcttcgcaatcactatcaaagattgggctttatcacgt

SEQ ID NO: 3670 - DNA, 48 bp, Artificial Sequence
  Synthetic
cgatcagtgggttattggttatacggtctgattaaatcctacccattg

SEQ ID NO: 3671 - DNA, 44 bp, Artificial Sequence
  Synthetic
agcgtgacaaccaatccattggattactccattattggcaaagg

SEQ ID NO: 3672 - DNA, 44 bp, Artificial Sequence
  Synthetic
agtgaaaatccgactttcagaagttccacgagtggtttgattgt

SEQ ID NO: 3673 - DNA, 40 bp, Artificial Sequence
  Synthetic
gcattagcaaaggcggtagccgcatcagtatgtcgccgcc

SEQ ID NO: 3674 - DNA, 38 bp, Artificial Sequence
  Synthetic
atgcaacggcggatgttgttggatatgcagcgctggcg

SEQ ID NO: 3675 - DNA, 40 bp, Artificial Sequence
  Synthetic
gtccggcaacaacgcctcagcaatgcgtgctcatggtatg

SEQ ID NO: 3676 - DNA, 40 bp, Artificial Sequence
  Synthetic
gggcatggggcaaggatttgcgcgcgttagggctattggg

SEQ ID NO: 3677 - DNA, 40 bp, Artificial Sequence
  Synthetic
gtgagggcgtactcatcggtgaaagtcaccgttggcacag

SEQ ID NO: 3678 - DNA, 42 bp, Artificial Sequence
  Synthetic
tgacacccaatcccgacactgtaaagagacatttgtccccgg

SEQ ID NO: 3679 - DNA, 42 bp, Artificial Sequence
  Synthetic
gcgcggatggtccaattatccactgacagccgacttttaccc

SEQ ID NO: 3680 - DNA, 38 bp, Artificial Sequence
  Synthetic
ccaagatgcaggcgggggaggccaccgtctacaccgga

SEQ ID NO: 3681 - DNA, 38 bp, Artificial Sequence
  Synthetic
cctcataaactgccgccccatcgagtccagccggtcca

SEQ ID NO: 3682 - DNA, 40 bp, Artificial Sequence
  Synthetic
actcctgataggccacctgcatgtggcgcctgactatagg

SEQ ID NO: 3683 - DNA, 38 bp, Artificial Sequence
  Synthetic
gccctccattgcgccttaagttggggaagtccgtcggt

SEQ ID NO: 3684 - DNA, 42 bp, Artificial Sequence
  Synthetic
actgtagccgccattctgttggtgattttgagagcaagggcc

SEQ ID NO: 3685 - DNA, 40 bp, Artificial Sequence
  Synthetic
gcctgtggccgaatgcttcgtgcaggacatagacgcagtg

SEQ ID NO: 3686 - DNA, 39 bp, Artificial Sequence
  Synthetic
aacagacggagcgactcccgcaggtacggcaaggagaca

SEQ ID NO: 3687 - DNA, 41 bp, Artificial Sequence
  Synthetic
cgaacggagcaggtggtacaatattgatgaaggaggccggg

SEQ ID NO: 3688 - DNA, 38 bp, Artificial Sequence
  Synthetic
ctgcgtacgagccaacatcactgccctcatcaccggct

SEQ ID NO: 3689 - DNA, 36 bp, Artificial Sequence
  Synthetic
ttgagggccagaccaggctctgctctgtcgtgcctg

SEQ ID NO: 3690 - DNA, 35 bp, Artificial Sequence
  Synthetic
attggtccgttggggcgggcgacgcggcacacgat

SEQ ID NO: 3691 - DNA, 38 bp, Artificial Sequence
  Synthetic
ccaccgacgtggggactgttggtgggtatgcggtgtca

SEQ ID NO: 3692 - DNA, 41 bp, Artificial Sequence
  Synthetic
gcgatattcaacctggagggcgaccaattcagcctacaccg

SEQ ID NO: 3693 - DNA, 38 bp, Artificial Sequence
  Synthetic
ctctgcagagggcaaggtcaccgctcgccccatcacca

SEQ ID NO: 3694 - DNA, 44 bp, Artificial Sequence
  Synthetic
ctatcagagtcagtggtgttgtaatgggcaagatcagtttttgg

SEQ ID NO: 3695 - DNA, 48 bp, Artificial Sequence
  Synthetic
cctaaccagtttacaaacttgacgaactaaacgaaatttttctagtgc

SEQ ID NO: 3696 - DNA, 39 bp, Artificial Sequence
  Synthetic
ccaaaagcaacaaaacggcatgttcgcacctatagcgaa

SEQ ID NO: 3697 - DNA, 48 bp, Artificial Sequence
  Synthetic
ccacaattgcatttaacaaaagcatattacaaatggtatgtcattgct

SEQ ID NO: 3698 - DNA, 50 bp, Artificial Sequence
  Synthetic
gctagcagcaaatttaacatcttcttactttctaatcaattacgtctagc

SEQ ID NO: 3699 - DNA, 47 bp, Artificial Sequence
  Synthetic
caacaatcttacctttagggcaaactgaacttgccactgttaatttg

SEQ ID NO: 3700 - DNA, 44 bp, Artificial Sequence
  Synthetic
gctcccaaacattataacagtccttggttgatggctgtagtgtc

SEQ ID NO: 3701 - DNA, 50 bp, Artificial Sequence
  Synthetic
caagcaattttaccaaaacacgtctcacttacttctaatggtcttttagg

SEQ ID NO: 3702 - DNA, 49 bp, Artificial Sequence
  Synthetic
gcaacttaatatgttgcccaatgacgtccattatttatacaggtgattg

SEQ ID NO: 3703 - DNA, 47 bp, Artificial Sequence
  Synthetic
acaacactcacctttttgaaaaagtggtaaaaagtttgatgatcagg

SEQ ID NO: 3704 - DNA, 45 bp, Artificial Sequence
  Synthetic
agaaacacagtttacaaggtgtgaaaagctggtgaagttaaacct

SEQ ID NO: 3705 - DNA, 46 bp, Artificial Sequence
  Synthetic
cacacaacgaccaagatttttatcatttttgttgagagttgtacca

SEQ ID NO: 3706 - DNA, 44 bp, Artificial Sequence
  Synthetic
tggagctacagataagacagtatcaaacaattgggtgttgtgag

SEQ ID NO: 3707 - DNA, 46 bp, Artificial Sequence
  Synthetic
aaccatctttaagcacactagcatgtaaaagtactgtagttgaagt

SEQ ID NO: 3708 - DNA, 46 bp, Artificial Sequence
  Synthetic
caaacttagcctcatgccattgatttgtttgaagcacctttacact

SEQ ID NO: 3709 - DNA, 46 bp, Artificial Sequence
  Synthetic
acacgtccatcattaacataccatttattgtagagttggtgaatgc

SEQ ID NO: 3710 - DNA, 45 bp, Artificial Sequence
  Synthetic
gcataatctaacatagccttggctatagtggtagtgctagtgagg

SEQ ID NO: 3711 - DNA, 49 bp, Artificial Sequence
  Synthetic
gacactgaaaaattatgcaaacgcaccactgttcttattgattatgatc

SEQ ID NO: 3712 - DNA, 48 bp, Artificial Sequence
  Synthetic
actaggttggtcatcaaaattaccatacaccaaattgagttaggtagt

SEQ ID NO: 3713 - DNA, 50 bp, Artificial Sequence
  Synthetic
tgaagtccattagcaaccatgtattaggttttttaaatgtactatgggtg

SEQ ID NO: 3714 - DNA, 48 bp, Artificial Sequence
  Synthetic
ggcacgcttcaattgtttaataagtttgcttatgaaaatgctagacaa

SEQ ID NO: 3715 - DNA, 45 bp, Artificial Sequence
  Synthetic
gaacaggtctaccatcattgtcttttctgttcattatgctggagt

SEQ ID NO: 3716 - DNA, 46 bp, Artificial Sequence
  Synthetic
tccagaattaacagccaattcagttcgttcttggttttataggtgc

SEQ ID NO: 3717 - DNA, 45 bp, Artificial Sequence
  Synthetic
caacaaccacaaacattacacacatggtaaatgtgttcaggttcc

SEQ ID NO: 3718 - DNA, 49 bp, Artificial Sequence
  Synthetic
gccaaagcaccagaaaagttaagttgttataaagaggtgtactaagtcg

SEQ ID NO: 3719 - DNA, 48 bp, Artificial Sequence
  Synthetic
acgcatttaagcatagctctagccccagttgaaaatgaagatatacat

SEQ ID NO: 3720 - DNA, 45 bp, Artificial Sequence
  Synthetic
cctaactgagtgtgtgttaacatctgtgttccacttgttacaact

SEQ ID NO: 3721 - DNA, 46 bp, Artificial Sequence
  Synthetic
gcacgttctttaccactaatagcatctttgacaaagcgtaatgtcc

SEQ ID NO: 3722 - DNA, 47 bp, Artificial Sequence
  Synthetic
gcctataaaacctatctgttgcagtgcctaacatgatacgtatgatt

SEQ ID NO: 3723 - DNA, 48 bp, Artificial Sequence
  Synthetic
ggtaccatctttgtcaactatttgcgttgggttgaagaagatttaact

SEQ ID NO: 3724 - DNA, 49 bp, Artificial Sequence
  Synthetic
ccagcagcttgcaatattgtagaaaatcaagaagataagttttggtgtg

SEQ ID NO: 3725 - DNA, 48 bp, Artificial Sequence
  Synthetic
gctagaatacttctcttggtttgcattttgtcttaacatctcacaatg

SEQ ID NO: 3726 - DNA, 42 bp, Artificial Sequence
  Synthetic
gccacaaacatgagcactttcatttgctattcgtaatgtgcg

SEQ ID NO: 3727 - DNA, 44 bp, Artificial Sequence
  Synthetic
ggaaccaacataaccccactggttgtgattatgtttacaatccg

SEQ ID NO: 3728 - DNA, 44 bp, Artificial Sequence
  Synthetic
tgggttgcataatcataatccaacagctgttactgatgccaaat

SEQ ID NO: 3729 - DNA, 46 bp, Artificial Sequence
  Synthetic
gcaacattagtaggcaatgttgtttcaaagtttttgttcgctatgg

SEQ ID NO: 3730 - DNA, 47 bp, Artificial Sequence
  Synthetic
caccacaacatccacctataaggactaaagagtttagatcttggtgt

SEQ ID NO: 3731 - DNA, 39 bp, Artificial Sequence
  Synthetic
acacctttgtcagaaccagcaacaatgtgcgtacctcat

SEQ ID NO: 3732 - DNA, 44 bp, Artificial Sequence
  Synthetic
gttgaagaattgtcaggaacacctatggcctcttgctttttcac

SEQ ID NO: 3733 - DNA, 47 bp, Artificial Sequence
  Synthetic
tggcacataaaaagtacgagttacaggcataactatatctggtgaaa

SEQ ID NO: 3734 - DNA, 38 bp, Artificial Sequence
  Synthetic
agaccccgtccactagtgtggccgcattcctaatggtt

SEQ ID NO: 3735 - DNA, 46 bp, Artificial Sequence
  Synthetic
atgagtagtgttgatagtgctgtttttcttgacaccacaatacctt

SEQ ID NO: 3736 - DNA, 43 bp, Artificial Sequence
  Synthetic
agtctcaggcaaaacattatcatcagtgtgagcacttgcagtt

SEQ ID NO: 3737 - DNA, 45 bp, Artificial Sequence
  Synthetic
gtctggttggttacatggtgtccttggttttaaaaatgtttccac

SEQ ID NO: 3738 - DNA, 46 bp, Artificial Sequence
  Synthetic
gctaaacaacaaatcttccaaagcattacctcagagaaacattcgt

SEQ ID NO: 3739 - DNA, 46 bp, Artificial Sequence
  Synthetic
gcctgaattgaattagaaatggccttgttaatcaacagggtagtgc

SEQ ID NO: 3740 - DNA, 38 bp, Artificial Sequence
  Synthetic
ggttgacgcagaacatagccatgtaaaggcgtggtctg

SEQ ID NO: 3741 - DNA, 49 bp, Artificial Sequence
  Synthetic
caacaaaacacaagaagactcaacagaaaattatatcaaatggccttgg

SEQ ID NO: 3742 - DNA, 47 bp, Artificial Sequence
  Synthetic
ggcacactactattagacatcgttttgcttaccaagattatatgcaa

SEQ ID NO: 3743 - DNA, 47 bp, Artificial Sequence
  Synthetic
gcagccatcaccggtaagtaataagcttttaatcctgaaactaatgc

SEQ ID NO: 3744 - DNA, 49 bp, Artificial Sequence
  Synthetic
ggaaatttcttcctagcagctctgtctaaactaaacaaaatggctagtg

SEQ ID NO: 3745 - DNA, 41 bp, Artificial Sequence
  Synthetic
cgtttgcgattaccaagactggcaacgttctgatggtgttg

SEQ ID NO: 3746 - DNA, 47 bp, Artificial Sequence
  Synthetic
ggtgacttcgactggttatcaaaacgattctaaccagtcttcttcag

SEQ ID NO: 3747 - DNA, 43 bp, Artificial Sequence
  Synthetic
cagtgctaacctcactatcaaagaaaggttttccacagcttgc

SEQ ID NO: 3748 - DNA, 44 bp, Artificial Sequence
  Synthetic
cggtacctcataagactcctgataatcaagggtgtgctagaact

SEQ ID NO: 3749 - DNA, 43 bp, Artificial Sequence
  Synthetic
tcaccaagtgaggtttcctctaacaacgattggtttttggtgg

SEQ ID NO: 3750 - DNA, 41 bp, Artificial Sequence
  Synthetic
acaggttttgttgctcttgtacgtaaagatacggctggcgt

SEQ ID NO: 3751 - DNA, 45 bp, Artificial Sequence
  Synthetic
ccccatgtaaaaacagttgaagacactgagcctccaaaatcaaga

SEQ ID NO: 3752 - DNA, 50 bp, Artificial Sequence
  Synthetic
gcgaaatggaaaagaacttgttcttaacaggacagtaaattgatagaaga

SEQ ID NO: 3753 - DNA, 38 bp, Artificial Sequence
  Synthetic
aacctcaagtgtgctgccacgagagctgtttttggcac

SEQ ID NO: 3754 - DNA, 36 bp, Artificial Sequence
  Synthetic
tgctgggcggtgtcactctcctggggctcctgcagt

SEQ ID NO: 3755 - DNA, 44 bp, Artificial Sequence
  Synthetic
caagaaacttctctcgttgagccaggataggtagtgctagaatg

SEQ ID NO: 3756 - DNA, 47 bp, Artificial Sequence
  Synthetic
tcagcaattgttgtatgctcaatttctcatgcaaaatatcaaacacc

SEQ ID NO: 3757 - DNA, 47 bp, Artificial Sequence
  Synthetic
gttggtattgggaagtctctacctagaaattttccccatagatgttg

SEQ ID NO: 3758 - DNA, 41 bp, Artificial Sequence
  Synthetic
ctaccaaggggatatcctcgcggagaagcatcaacatcaga

SEQ ID NO: 3759 - DNA, 42 bp, Artificial Sequence
  Synthetic
cactggtgtctgagcaagagcaaatccagcatttgagccaga

SEQ ID NO: 3760 - DNA, 45 bp, Artificial Sequence
  Synthetic
tggaactaatgactgttgtttgacttattgctccagaagactcaa

SEQ ID NO: 3761 - DNA, 43 bp, Artificial Sequence
  Synthetic
gttgcatggtagaagagattggtccatcactagaatcctgtcc

SEQ ID NO: 3762 - DNA, 44 bp, Artificial Sequence
  Synthetic
ttgtctagaatctccatttgcatgagggccaccctcttttaaat

SEQ ID NO: 3763 - DNA, 44 bp, Artificial Sequence
  Synthetic
gcttgaacaacatctaaagggacatttggggctatggattttgc

SEQ ID NO: 3764 - DNA, 43 bp, Artificial Sequence
  Synthetic
tcgctgaagccagtaagatctacaacaaattatgtaggcacac

SEQ ID NO: 3765 - DNA, 49 bp, Artificial Sequence
  Synthetic
gggattaacaaaaagaaaggacagcctgattgattgtgtgttattttcc

SEQ ID NO: 3766 - DNA, 43 bp, Artificial Sequence
  Synthetic
gttggcaaaccgtctttgggtcttcattgtttatggtttaccg

SEQ ID NO: 3767 - DNA, 40 bp, Artificial Sequence
  Synthetic
cagttctctgatggagagcagagcgcagtgtttgaatgtg

SEQ ID NO: 3768 - DNA, 47 bp, Artificial Sequence
  Synthetic
ggaatttccctgactttgtggtttggaaactaacagtgatatatcag

SEQ ID NO: 3769 - DNA, 44 bp, Artificial Sequence
  Synthetic
tgtcaacttcatttggcaacgatcgaaggcgattatttaatgtg

SEQ ID NO: 3770 - DNA, 43 bp, Artificial Sequence
  Synthetic
gcaatatccattcaggtgtttttcccctgctgcaatgttttgg

SEQ ID NO: 3771 - DNA, 44 bp, Artificial Sequence
  Synthetic
gctgcaaccaaaaatgacttttacttttgtatgagcctgttgca

SEQ ID NO: 3772 - DNA, 47 bp, Artificial Sequence
  Synthetic
gcacttgctcttgttttattaaggtctgttgagtctttatgaacagg

SEQ ID NO: 3773 - DNA, 49 bp, Artificial Sequence
  Synthetic
cctctaccagttccaataccaagaaagattcttcaatatggaagtttgg

SEQ ID NO: 3774 - DNA, 46 bp, Artificial Sequence
  Synthetic
ggaagatcagaagcagggtgaatttctatctaacattcccactaca

SEQ ID NO: 3775 - DNA, 41 bp, Artificial Sequence
  Synthetic
gtgtcaaagctggatgcacggtcaatctgtaggtgaagaca

SEQ ID NO: 3776 - DNA, 43 bp, Artificial Sequence
  Synthetic
ctcctgctttgtcatgatcactatttgttaccgggcatcctag

SEQ ID NO: 3777 - DNA, 47 bp, Artificial Sequence
  Synthetic
gggcacatcagataaatttccttgttagaagatggtgatatgatgga

SEQ ID NO: 3778 - DNA, 47 bp, Artificial Sequence
  Synthetic
tgggaacagcaaaataattgtctgtaatacatttgtagccaatggag

SEQ ID NO: 3779 - DNA, 48 bp, Artificial Sequence
  Synthetic
cataccgtacttaaggagtcacatcgacaccaaatcctaataaaatgc

SEQ ID NO: 3780 - DNA, 41 bp, Artificial Sequence
  Synthetic
gacccacctcaatttgtgttgttttagtcactggcaaacgg

SEQ ID NO: 3781 - DNA, 44 bp, Artificial Sequence
  Synthetic
gctcaaacccttcaattccagcggggtaaaaatgatgaaagtgc

SEQ ID NO: 3782 - DNA, 43 bp, Artificial Sequence
  Synthetic
gggtgcttgaggaaggttccaaaaagggatatacgtaatgtgt

SEQ ID NO: 3783 - DNA, 39 bp, Artificial Sequence
  Synthetic
gactcccaccgcagtttcagtcttcgagcgttttgatga

SEQ ID NO: 3784 - DNA, 43 bp, Artificial Sequence
  Synthetic
gggaaaatttagcctatagcctaggtggaagtccatggtgagg

SEQ ID NO: 3785 - DNA, 38 bp, Artificial Sequence
  Synthetic
acactgcaaggtgacgttccgcatggagctgtaggagt

SEQ ID NO: 3786 - DNA, 43 bp, Artificial Sequence
  Synthetic
gcagtcctatcaactgattgaatcatggtcttgaccacatcct

SEQ ID NO: 3787 - DNA, 50 bp, Artificial Sequence
  Synthetic
atgccaaatcttgcatatgtatggtgtggtgaaattattatacaatgagc

SEQ ID NO: 3788 - DNA, 50 bp, Artificial Sequence
  Synthetic
accaaactctaattgtcaattcccaaaggttccatttatttacacaagag

SEQ ID NO: 3789 - DNA, 45 bp, Artificial Sequence
  Synthetic
atgagtaattttgatcccaccacccagcaaagatgtcttttgctt

SEQ ID NO: 3790 - DNA, 49 bp, Artificial Sequence
  Synthetic
gccaggaacaaaacaaaacagtaatgagatcttgtctttgattttcaag

SEQ ID NO: 3791 - DNA, 45 bp, Artificial Sequence
  Synthetic
cgttagaaggagaggtcaatctgttaagtcagcacatcagaaagg

SEQ ID NO: 3792 - DNA, 42 bp, Artificial Sequence
  Synthetic
tgttgtgatagctcccacaggaagctaacagagggaaaatgg

SEQ ID NO: 3793 - DNA, 46 bp, Artificial Sequence
  Synthetic
tgaaacaagttgaaaaaccacctcagtcttcaacctctaatcctcc

SEQ ID NO: 3794 - DNA, 43 bp, Artificial Sequence
  Synthetic
gcttcctgcattctatatgactctccagctggagacttggagt

SEQ ID NO: 3795 - DNA, 48 bp, Artificial Sequence
  Synthetic
aatccaaacctccttaaagctctagtgaaataatgaagttttcctgga

SEQ ID NO: 3796 - DNA, 47 bp, Artificial Sequence
  Synthetic
cctcatctgttgtgttttggccatggatatagtggacaattagtttg

SEQ ID NO: 3797 - DNA, 47 bp, Artificial Sequence
  Synthetic
caacccacttgtgattagtaacagagtttttccagtcttttccatct

SEQ ID NO: 3798 - DNA, 45 bp, Artificial Sequence
  Synthetic
caactccaaactgaaccaagttctagaatctcagtcaactttgga

SEQ ID NO: 3799 - DNA, 41 bp, Artificial Sequence
  Synthetic
tgcccaagattgcattctgtatcgaaggtcttcctggaatg

SEQ ID NO: 3800 - DNA, 48 bp, Artificial Sequence
  Synthetic
gccattggatcaatttcagctttagatcatcacattgataaaaccatg

SEQ ID NO: 3801 - DNA, 46 bp, Artificial Sequence
  Synthetic
gcaataaaccattttcatccaaccactcctggatttccttatgtcc

SEQ ID NO: 3802 - DNA, 45 bp, Artificial Sequence
  Synthetic
cctgtatggaaacctggattcaaattactcaattttgtgccgaat

SEQ ID NO: 3803 - DNA, 41 bp, Artificial Sequence
  Synthetic
ttgccgtgctgttgtcatttagctacattctatgtctggtt

SEQ ID NO: 3804 - DNA, 40 bp, Artificial Sequence
  Synthetic
tttgctgcgttcaacaaaaaggggagaccctcagtgtgat

SEQ ID NO: 3805 - DNA, 49 bp, Artificial Sequence
  Synthetic
cccccaaatgtacagtttgtcaaatgacccacttaaaattcaaataccc

SEQ ID NO: 3806 - DNA, 48 bp, Artificial Sequence
  Synthetic
cgtattttgaagtaaccccgaggaggagacatacttttgattaacagc

SEQ ID NO: 3807 - DNA, 43 bp, Artificial Sequence
  Synthetic
ccattttctatgaaacccgcgattggcaacagggatgcgaaat

SEQ ID NO: 3808 - DNA, 45 bp, Artificial Sequence
  Synthetic
cgcgttgtatgaccagagatctagaagtagaagggagaattcagg

SEQ ID NO: 3809 - DNA, 50 bp, Artificial Sequence
  Synthetic
aggatccaatctttgtatcctgactatacagagatgaagcattaaacaac

SEQ ID NO: 3810 - DNA, 44 bp, Artificial Sequence
  Synthetic
tccatctcaacaatgaacagagatccctgccactcataaacaag

SEQ ID NO: 3811 - DNA, 46 bp, Artificial Sequence
  Synthetic
tcgtcccttgactgttttttcataatgttgtttcaattgtgctaga

SEQ ID NO: 3812 - DNA, 41 bp, Artificial Sequence
  Synthetic
caggtcaatgggcaggacaaagaagcaactataccagacat

SEQ ID NO: 3813 - DNA, 43 bp, Artificial Sequence
  Synthetic
acacccttctttaggatcaatacctaccttctttgctgtgtcc

SEQ ID NO: 3814 - DNA, 41 bp, Artificial Sequence
  Synthetic
gctaagctgctgcaactctttcgagcagcaaatacaggact

SEQ ID NO: 3815 - DNA, 48 bp, Artificial Sequence
  Synthetic
cccgacaacaagtcttattgctattatgctcagcaaatttaaaaacag

SEQ ID NO: 3816 - DNA, 41 bp, Artificial Sequence
  Synthetic
tgaagccacccatgaccatggaaagacaaacttagaggctc

SEQ ID NO: 3817 - DNA, 38 bp, Artificial Sequence
  Synthetic
atgtgccagctgccttacaggcgcacgtagagtaaagc

SEQ ID NO: 3818 - DNA, 44 bp, Artificial Sequence
  Synthetic
actgaaggtgcaacagggtcgtcctactgatataatacctttgg

SEQ ID NO: 3819 - DNA, 43 bp, Artificial Sequence
  Synthetic
ttgagtgccaacctgtgctcaggttacattagagtcagtagac

SEQ ID NO: 3820 - DNA, 44 bp, Artificial Sequence
  Synthetic
accacaatgatgacatctgcaaatttacatccaagtttgagacg

SEQ ID NO: 3821 - DNA, 43 bp, Artificial Sequence
  Synthetic
cggtaagtgtaccctaaaggcccatgaagtgttagttcccaag

SEQ ID NO: 3822 - DNA, 41 bp, Artificial Sequence
  Synthetic
ccaatgttcccccaagcaggggtgaatacatcctttgatcc

SEQ ID NO: 3823 - DNA, 46 bp, Artificial Sequence
  Synthetic
cctctacaaaacatatgtctggcattaatgatgtgtatggcaatgc

SEQ ID NO: 3824 - DNA, 43 bp, Artificial Sequence
  Synthetic
caatgtcacagtagttaccaggatgtctctcaccattgcaaca

SEQ ID NO: 3825 - DNA, 43 bp, Artificial Sequence
  Synthetic
cagcagaaagccggattgaatgcaatgtcaaattacaggattt

SEQ ID NO: 3826 - DNA, 40 bp, Artificial Sequence
  Synthetic
tgacacaaacatgcaaccatgcgtgtgtgtagcatggtcc

SEQ ID NO: 3827 - DNA, 44 bp, Artificial Sequence
  Synthetic
tcgaggataacaggaacactccggaaaattgtccatattagccc

SEQ ID NO: 3828 - DNA, 38 bp, Artificial Sequence
  Synthetic
tcccatccacacgtcatctcgagagggaatccaggagt

SEQ ID NO: 3829 - DNA, 37 bp, Artificial Sequence
  Synthetic
gctgctccagcgtgtcgtgcctaattacgctgtccgc

SEQ ID NO: 3830 - DNA, 40 bp, Artificial Sequence
  Synthetic
gctctcccactccaacacgggccctgtggagactgcatct

SEQ ID NO: 3831 - DNA, 39 bp, Artificial Sequence
  Synthetic
tgcggagatgtggagagaaacggctggacgaactgtgcg

SEQ ID NO: 3832 - DNA, 38 bp, Artificial Sequence
  Synthetic
acgtatacgaagggtggctcgtgggcggtctcccttgt

SEQ ID NO: 3833 - DNA, 38 bp, Artificial Sequence
  Synthetic
tccgttgtgctcgacgccgtgtacgtccaccacatgag

SEQ ID NO: 3834 - DNA, 40 bp, Artificial Sequence
  Synthetic
gcgtatcctcgtctgccctctggccggcgagagaaagaga

SEQ ID NO: 3835 - DNA, 38 bp, Artificial Sequence
  Synthetic
gcggggctttctttgagttcgccgggtatgagccgcca

SEQ ID NO: 3836 - DNA, 37 bp, Artificial Sequence
  Synthetic
tctcgccgaggacgcgttccgtagacgggctcgaagc

SEQ ID NO: 3837 - DNA, 40 bp, Artificial Sequence
  Synthetic
ataccattcccaaccatccctaacatcaagttccctggaa

SEQ ID NO: 3838 - DNA, 39 bp, Artificial Sequence
  Synthetic
tggttaagctgggcgattgtgcaaaaagtctggcaaacc

SEQ ID NO: 3839 - DNA, 39 bp, Artificial Sequence
  Synthetic
tgtgagtcaaaacggaggcttgcaaaaaaacagagtggt

SEQ ID NO: 3840 - DNA, 43 bp, Artificial Sequence
  Synthetic
ccatttcccacaaagtctgccgacacgaaacactgatacttac

SEQ ID NO: 3841 - DNA, 40 bp, Artificial Sequence
  Synthetic
tgcaagtttgtaaggcgtgtttctcccgaagaactgacag

SEQ ID NO: 3842 - DNA, 46 bp, Artificial Sequence
  Synthetic
cctctatgttgcgaaagtatgctttcctttgccatagtaaacatga

SEQ ID NO: 3843 - DNA, 44 bp, Artificial Sequence
  Synthetic
tctgcggtaaacctgtactagatgtttgttgttgtacttcaagc

SEQ ID NO: 3844 - DNA, 40 bp, Artificial Sequence
  Synthetic
cagtgcgacacaactaacgaattgtttgatttcggttgga

SEQ ID NO: 3845 - DNA, 42 bp, Artificial Sequence
  Synthetic
cgccccggctttataacatttagggacttgatatatccgagt

SEQ ID NO: 3846 - DNA, 43 bp, Artificial Sequence
  Synthetic
gttgctgtccggttgtaacatttgtgtttttttaccgaaagac

SEQ ID NO: 3847 - DNA, 42 bp, Artificial Sequence
  Synthetic
ttttccccccctgatcggagtctgcgcagattttaaaatacg

SEQ ID NO: 3848 - DNA, 39 bp, Artificial Sequence
  Synthetic
accctcgggaaggttctcttttacgtcgtttcctgtagc

SEQ ID NO: 3849 - DNA, 38 bp, Artificial Sequence
  Synthetic
atcgcgcaatcgaaccattctctgacggctaaggtgaa

SEQ ID NO: 3850 - DNA, 44 bp, Artificial Sequence
  Synthetic
gcaatgtgatcaacgacgttttatgtatcggaaaaactcgaatt

SEQ ID NO: 3851 - DNA, 48 bp, Artificial Sequence
  Synthetic
caaagcaattcctctatcgcagaagaaagtttcggaaaatgtaaacac

SEQ ID NO: 3852 - DNA, 45 bp, Artificial Sequence
  Synthetic
cctgtaaactggtctgcttgcatgtgttataacagacatatgcaa

SEQ ID NO: 3853 - DNA, 44 bp, Artificial Sequence
  Synthetic
aatctctaacccgtcatctccaaggacactttcaaaatttttcg

SEQ ID NO: 3854 - DNA, 43 bp, Artificial Sequence
  Synthetic
cacaaatcatcgtcgaacaataaggcggtgagcaagttctctt

SEQ ID NO: 3855 - DNA, 40 bp, Artificial Sequence
  Synthetic
gattccgccgtactgaaaaaacaacgctgtttaaaagggc

SEQ ID NO: 3856 - DNA, 40 bp, Artificial Sequence
  Synthetic
ggcagaacagagaccccccctgctgacaggatcgtcccct

SEQ ID NO: 3857 - DNA, 35 bp, Artificial Sequence
  Synthetic
cgcgaagtgttccgcgacgtggagacgcgggcgaa

SEQ ID NO: 3858 - DNA, 40 bp, Artificial Sequence
  Synthetic
gggcgttcgttccgcacatagccgtgacgtatgaagaaga

SEQ ID NO: 3859 - DNA, 38 bp, Artificial Sequence
  Synthetic
gcgatctccacctcgcgtggcctccgatacgtacgact

SEQ ID NO: 3860 - DNA, 41 bp, Artificial Sequence
  Synthetic
aggaaaacgagtacgcgcaccaatcatgcattgtgtggggt

SEQ ID NO: 3861 - DNA, 42 bp, Artificial Sequence
  Synthetic
ccgacttcgataaacctcttggttccttagcccaagagcatg

SEQ ID NO: 3862 - DNA, 43 bp, Artificial Sequence
  Synthetic
tcctttttcaatttcttcttcccctctcacagaacttcaggct

SEQ ID NO: 3863 - DNA, 40 bp, Artificial Sequence
  Synthetic
tggaacttctggtagctcatggaaatgggaggacctgaga

SEQ ID NO: 3864 - DNA, 43 bp, Artificial Sequence
  Synthetic
catctcctgtggcccacttgaatacaataagcaatgaggaaac

SEQ ID NO: 3865 - DNA, 48 bp, Artificial Sequence
  Synthetic
agggagccaattttaaagacagtatgactttcgagtttagtagtacag

SEQ ID NO: 3866 - DNA, 48 bp, Artificial Sequence
  Synthetic
tgagtcccaatactgaaagttttggcgatacaagggtatgatatgacc

SEQ ID NO: 3867 - DNA, 47 bp, Artificial Sequence
  Synthetic
gaaggttaacagagtgtgttactgtgttatcatgcgaacaattcaac

SEQ ID NO: 3868 - DNA, 40 bp, Artificial Sequence
  Synthetic
tcctgggtaacacgttccataagctcatggtcctacattg

SEQ ID NO: 3869 - DNA, 42 bp, Artificial Sequence
  Synthetic
agagactttgttggtcagcactaaaagaagtcctcgtgctat

SEQ ID NO: 3870 - DNA, 44 bp, Artificial Sequence
  Synthetic
cgtggactggtgtatctgaaatgattggaaatctagtggtaccg

SEQ ID NO: 3871 - DNA, 43 bp, Artificial Sequence
  Synthetic
tctaccatccctgtccacccattcaatctagaggcctatttgg

SEQ ID NO: 3872 - DNA, 36 bp, Artificial Sequence
  Synthetic
agcacgagccaaggggacgcttccacgcggcagatc

SEQ ID NO: 3873 - DNA, 39 bp, Artificial Sequence
  Synthetic
aggtgcgtacacggccaccttggagtgggagagaacaga

SEQ ID NO: 3874 - DNA, 38 bp, Artificial Sequence
  Synthetic
tcgttcaggtcaagcgccagctccgcacgtctgtctga

SEQ ID NO: 3875 - DNA, 37 bp, Artificial Sequence
  Synthetic
gcaggagtcggtcgatcgtctagtctatgcgcgcgcc

SEQ ID NO: 3876 - DNA, 39 bp, Artificial Sequence
  Synthetic
gccggcgagcgtttgcttgttcacacagatgcaaccgat

SEQ ID NO: 3877 - DNA, 36 bp, Artificial Sequence
  Synthetic
ctcatacgccacggggtcccccgtctggcgtcgaac

SEQ ID NO: 3878 - DNA, 37 bp, Artificial Sequence
  Synthetic
gcctccgctgcctatcggacgccgttctgtctcgaga

SEQ ID NO: 3879 - DNA, 40 bp, Artificial Sequence
  Synthetic
ggagaagaggtggcggctcagaagaatctgccgatcacca

SEQ ID NO: 3880 - DNA, 35 bp, Artificial Sequence
  Synthetic
ttgcgtcgcttcgagcccgagaaagaggcgccggt

SEQ ID NO: 3881 - DNA, 41 bp, Artificial Sequence
  Synthetic
gccaagctgtctcgcggatacctgcgaagatagtgaccccg

SEQ ID NO: 3882 - DNA, 44 bp, Artificial Sequence
  Synthetic
gtatgacggccccagattcgactccttaacacatcattattcct

SEQ ID NO: 3883 - DNA, 40 bp, Artificial Sequence
  Synthetic
atgagaacagctgctctctgttagcgattttgtgctcatg

SEQ ID NO: 3884 - DNA, 44 bp, Artificial Sequence
  Synthetic
cgtctgactgtttgcgattctggtttccaatgtccattttttcc

SEQ ID NO: 3885 - DNA, 44 bp, Artificial Sequence
  Synthetic
cgtgcctgctttttagcgtgtagctctgttttctttgttttgtc

SEQ ID NO: 3886 - DNA, 44 bp, Artificial Sequence
  Synthetic
tctcggattgcgtcgttatgatttttgttaaaaagcgaatgtcc

SEQ ID NO: 3887 - DNA, 41 bp, Artificial Sequence
  Synthetic
gcccagagagattgcaactacttcacacatcacgagtctcc

SEQ ID NO: 3888 - DNA, 43 bp, Artificial Sequence
  Synthetic
cggcccattggaacgaacattatgatcatctgaaactgtttgg

SEQ ID NO: 3889 - DNA, 45 bp, Artificial Sequence
  Synthetic
cggtatacgcgtttagtagaatgctgatgacgcatacgatctact

SEQ ID NO: 3890 - DNA, 38 bp, Artificial Sequence
  Synthetic
gcgtgtttagtgggtgcagtccgtcattacatctcccg

SEQ ID NO: 3891 - DNA, 42 bp, Artificial Sequence
  Synthetic
tcagacctctcatcgttcacataatttcgacgcaaactttgg

SEQ ID NO: 3892 - DNA, 42 bp, Artificial Sequence
  Synthetic
tggaagtccgacagatgcaatagttcgttgagagaattaggc

SEQ ID NO: 3893 - DNA, 49 bp, Artificial Sequence
  Synthetic
agtcttagtgaggactgactttgaagaaacatactgatttgtacagaag

SEQ ID NO: 3894 - DNA, 42 bp, Artificial Sequence
  Synthetic
tcagacatgggaagcaagatacaagtgttggtaaacgcgtgt

SEQ ID NO: 3895 - DNA, 39 bp, Artificial Sequence
  Synthetic
acacaaggcaattttagcccttttttcaaacgtctgggc

SEQ ID NO: 3896 - DNA, 39 bp, Artificial Sequence
  Synthetic
cgcccatatgctaaacgaacggtttgtggagtcggtagc

SEQ ID NO: 3897 - DNA, 45 bp, Artificial Sequence
  Synthetic
ggactagtgttcgcattagagaatcgagcctagcgattagtttgt

SEQ ID NO: 3898 - DNA, 39 bp, Artificial Sequence
  Synthetic
cggcctggaatacaagaccattgatgccaatgaagcctt

SEQ ID NO: 3899 - DNA, 41 bp, Artificial Sequence
  Synthetic
accatgacctcgagaatctctctgaatgggagcctttgaac

SEQ ID NO: 3900 - DNA, 43 bp, Artificial Sequence
  Synthetic
agacgttcgagacctgttcaaaatctgtgtttgtatctgctcc

SEQ ID NO: 3901 - DNA, 46 bp, Artificial Sequence
  Synthetic
acaaccattgagtgagaatacgctgaattttttctggaatcttgag

SEQ ID NO: 3902 - DNA, 35 bp, Artificial Sequence
  Synthetic
cgagccaaggggacgatccgccgacacactgcagc

SEQ ID NO: 3903 - DNA, 39 bp, Artificial Sequence
  Synthetic
cgtctccgatccgtcaggaccgagctctctcaccccgtg

SEQ ID NO: 3904 - DNA, 38 bp, Artificial Sequence
  Synthetic
tctcgctccgcttggttttccggccgccgagattaacg

SEQ ID NO: 3905 - DNA, 38 bp, Artificial Sequence
  Synthetic
gtctgcggaccccgatgtaaaccggtgattcccggaga

SEQ ID NO: 3906 - DNA, 36 bp, Artificial Sequence
  Synthetic
cctcgccttgcaaactccgtacatgagggcggccag

SEQ ID NO: 3907 - DNA, 43 bp, Artificial Sequence
  Synthetic
ccctcttgagcttcctatacagtttccttaatgggaacgggga

SEQ ID NO: 3908 - DNA, 44 bp, Artificial Sequence
  Synthetic
agcgacggtaaatgcatttgaaactattgccgcaaatatcattg

SEQ ID NO: 3909 - DNA, 42 bp, Artificial Sequence
  Synthetic
ccgatcaaggaatggggcatcagtttcctttggcatatccgc

SEQ ID NO: 3910 - DNA, 43 bp, Artificial Sequence
  Synthetic
ggcctattatcttttgcctaggcattttctgacatgaccctcg

SEQ ID NO: 3911 - DNA, 45 bp, Artificial Sequence
  Synthetic
agtttctccaagcgaatctctgtatctcatcggaggacttgaatg

SEQ ID NO: 3912 - DNA, 41 bp, Artificial Sequence
  Synthetic
ccagatcaggttttttgggttgggtaaccgaaaacggtccg

SEQ ID NO: 3913 - DNA, 49 bp, Artificial Sequence
  Synthetic
tcttcttccactgttggtgcatatttatggaaaagtgaatcagtatagg

SEQ ID NO: 3914 - DNA, 41 bp, Artificial Sequence
  Synthetic
ggttgctcacgctgtctattgtcagaagatgaccatgaaca

SEQ ID NO: 3915 - DNA, 40 bp, Artificial Sequence
  Synthetic
tctgtacctgaatcgtctgcctatagtgtgccccaactgt

SEQ ID NO: 3916 - DNA, 43 bp, Artificial Sequence
  Synthetic
cggactaagttgctgtataacatcagcgacagttgaaacggaa

SEQ ID NO: 3917 - DNA, 40 bp, Artificial Sequence
  Synthetic
tgccgcactactgtttctctattggacaacgtgtagatgg

SEQ ID NO: 3918 - DNA, 43 bp, Artificial Sequence
  Synthetic
cccattatcatatgcccactgcgttggaacatagttttgctga

SEQ ID NO: 3919 - DNA, 39 bp, Artificial Sequence
  Synthetic
tcctggcacaaatctaggcgcagtttagagctgcagaca

SEQ ID NO: 3920 - DNA, 44 bp, Artificial Sequence
  Synthetic
cgtccatggctctaagttatattcacatgcagcaattgaaatgc

SEQ ID NO: 3921 - DNA, 42 bp, Artificial Sequence
  Synthetic
tgtttccagtgtccacgtattttccggagacttgtccatcag

SEQ ID NO: 3922 - DNA, 45 bp, Artificial Sequence
  Synthetic
ggtgtgtggtagatgtaacatgtaccatcaggtacagatgtccct

SEQ ID NO: 3923 - DNA, 42 bp, Artificial Sequence
  Synthetic
cacaggcaaatatggtgtacctttaacatctggtcctgacat

SEQ ID NO: 3924 - DNA, 48 bp, Artificial Sequence
  Synthetic
ctctgtattgatgtccagacactttccatattttgaattgaaaaagcc

SEQ ID NO: 3925 - DNA, 50 bp, Artificial Sequence
  Synthetic
acccataccccaatattctccaatagttgctatggattataaacaaactc

SEQ ID NO: 3926 - DNA, 43 bp, Artificial Sequence
  Synthetic
cacacatacacaatcatcgttttgtgcccctacctcttcttcc

SEQ ID NO: 3927 - DNA, 43 bp, Artificial Sequence
  Synthetic
agtgtaattaaaggtgtggcaacctgttccctgccaaaaatgc

SEQ ID NO: 3928 - DNA, 48 bp, Artificial Sequence
  Synthetic
tggtcgctcttctgtattttcaaatacatataaaagcactgtgtacaa

SEQ ID NO: 3929 - DNA, 46 bp, Artificial Sequence
  Synthetic
gccccgtacactgaacaattgctgtttgctattttatagtaaggtc

SEQ ID NO: 3930 - DNA, 46 bp, Artificial Sequence
  Synthetic
caggtcaatctcagtttgtggtataatcagcagtataatcatgcac

SEQ ID NO: 3931 - DNA, 42 bp, Artificial Sequence
  Synthetic
cgttttaatttctgcagcgtctgtgacagctcagcagttgtt

SEQ ID NO: 3932 - DNA, 42 bp, Artificial Sequence
  Synthetic
cacatccatatcacttcctgaccaggctcacaacatagtgtg

SEQ ID NO: 3933 - DNA, 47 bp, Artificial Sequence
  Synthetic
ccactgcaccattttagatagttcaacaccagaatggatagaaagac

SEQ ID NO: 3934 - DNA, 45 bp, Artificial Sequence
  Synthetic
tgtactattggcttccagtccctatgaaacaatggataaagcatg

SEQ ID NO: 3935 - DNA, 48 bp, Artificial Sequence
  Synthetic
ggaccatgtcctttcaaaaaaacataatggaaatcctgtataccaatt

SEQ ID NO: 3936 - DNA, 41 bp, Artificial Sequence
  Synthetic
acgttttatggccgtcatgtatggatgggtggtgtaaagtg

SEQ ID NO: 3937 - DNA, 38 bp, Artificial Sequence
  Synthetic
cgggctctgtggttctgggaggcacctacgaagcctca

SEQ ID NO: 3938 - DNA, 48 bp, Artificial Sequence
  Synthetic
gcacagtttacatttgtccaatgataggtatcggtttcaaaaacataa

SEQ ID NO: 3939 - DNA, 44 bp, Artificial Sequence
  Synthetic
gcaaaaacacaaaactaacacacaacgccatatatgctgctagg

SEQ ID NO: 3940 - DNA, 45 bp, Artificial Sequence
  Synthetic
tacctcaccagtttgggggaagttctactacatatactaatccca

SEQ ID NO: 3941 - DNA, 45 bp, Artificial Sequence
  Synthetic
atcaggatcaggtgccacacgataatcccatatttcaaaatgctg

SEQ ID NO: 3942 - DNA, 43 bp, Artificial Sequence
  Synthetic
gccataacgcaaatgtggagctcaatctccttttgataccacc

SEQ ID NO: 3943 - DNA, 47 bp, Artificial Sequence
  Synthetic
tgtcctctaagctagtggcaaccatactatgaattctaccttactgg

SEQ ID NO: 3944 - DNA, 48 bp, Artificial Sequence
  Synthetic
gtaaaagcatagttggcagcctatttgttttatacactatgccttacc

SEQ ID NO: 3945 - DNA, 38 bp, Artificial Sequence
  Synthetic
gaggggagggaaaaactggccccaatgggtgttgtact

SEQ ID NO: 3946 - DNA, 42 bp, Artificial Sequence
  Synthetic
aggctggaccactgttaccagttgcatacccagcagtagacc

SEQ ID NO: 3947 - DNA, 42 bp, Artificial Sequence
  Synthetic
gcctcaacagatggtgattgtatgacccagttaaagatgtct

SEQ ID NO: 3948 - DNA, 47 bp, Artificial Sequence
  Synthetic
caccagaaaattcagcacacatgacatcttctaatatagtgccaatc

SEQ ID NO: 3949 - DNA, 46 bp, Artificial Sequence
  Synthetic
caaaggctgtgatgtaatgtctacttgtacactgtacaactaggga

SEQ ID NO: 3950 - DNA, 42 bp, Artificial Sequence
  Synthetic
tccaacatcccacacaacatgctggtattgatgaaccaacaa

SEQ ID NO: 3951 - DNA, 48 bp, Artificial Sequence
  Synthetic
tgtcctgtccattatagtcagtgttagaaagtttccttggtagatctg

SEQ ID NO: 3952 - DNA, 43 bp, Artificial Sequence
  Synthetic
ccagaatattgacatattggtgcctcaggagctccaattcctt

SEQ ID NO: 3953 - DNA, 43 bp, Artificial Sequence
  Synthetic
cagcacagtgaaattgtctaagatcacatggtgtcattggcat

SEQ ID NO: 3954 - DNA, 40 bp, Artificial Sequence
  Synthetic
tggtgaaccattgcaaccaattaaactcctctgaccctca

SEQ ID NO: 3955 - DNA, 46 bp, Artificial Sequence
  Synthetic
tgtctccttcttttgtcttcttccattgctcaacatacaccttagc

SEQ ID NO: 3956 - DNA, 45 bp, Artificial Sequence
  Synthetic
cctcagcttgtacttacctggataaccaaaggctgttttagtacc

SEQ ID NO: 3957 - DNA, 48 bp, Artificial Sequence
  Synthetic
agcaacgaatagtaatgctctgtaatgaaaattattgtgtgtgtgttg

SEQ ID NO: 3958 - DNA, 45 bp, Artificial Sequence
  Synthetic
tgaaccatctgtactttcatcgaaaaaagttggtttgttgtggat

SEQ ID NO: 3959 - DNA, 49 bp, Artificial Sequence
  Synthetic
tgcctcaattacttcttctaaagcaagaagctacaaaagtaataagtcc

SEQ ID NO: 3960 - DNA, 46 bp, Artificial Sequence
  Synthetic
accatttgactgcaatctctaacattatacgcagatgaagatagca

SEQ ID NO: 3961 - DNA, 47 bp, Artificial Sequence
  Synthetic
ggtagtttaatttgttgtgggactctatgaggaatgcattagatggt

SEQ ID NO: 3962 - DNA, 47 bp, Artificial Sequence
  Synthetic
ctcagaggcatactgtgatttacttttcaagtttcagaagctaaagc

SEQ ID NO: 3963 - DNA, 40 bp, Artificial Sequence
  Synthetic
ggcctcctctcaggggaattgaggcctcctccaactccat

SEQ ID NO: 3964 - DNA, 45 bp, Artificial Sequence
  Synthetic
cacgtttatttctacctgctctgtaactgtaaacctcccaaaagg

SEQ ID NO: 3965 - DNA, 44 bp, Artificial Sequence
  Synthetic
tggattaccccctacaccaccaggggaaatcgatattgtatcag

SEQ ID NO: 3966 - DNA, 45 bp, Artificial Sequence
  Synthetic
agtctgcatcaggagcagctgatgtttcatttacatttgaaaggg

SEQ ID NO: 3967 - DNA, 47 bp, Artificial Sequence
  Synthetic
gctctgtttgtgatggtataatggttggattggtagtgtttaatccc

SEQ ID NO: 3968 - DNA, 46 bp, Artificial Sequence
  Synthetic
tgggtatgtgttaggattttcaacagaagaggaaatccattaggtg

SEQ ID NO: 3969 - DNA, 43 bp, Artificial Sequence
  Synthetic
gggaagcaagtttattatcctgcttggctggaaaggttggaga

SEQ ID NO: 3970 - DNA, 49 bp, Artificial Sequence
  Synthetic
gcgtaagggtcagttttttccttattacaagtatattacttcatgggcc

SEQ ID NO: 3971 - DNA, 37 bp, Artificial Sequence
  Synthetic
actgtcgccagtggggtgcgctcagccactaacccgt

SEQ ID NO: 3972 - DNA, 43 bp, Artificial Sequence
  Synthetic
acactatttgtcaccataagcaagtctgtgggatggaaccaac

SEQ ID NO: 3973 - DNA, 43 bp, Artificial Sequence
  Synthetic
tgcttcaacagttggtgacattaaaattcacacaacctctagc

SEQ ID NO: 3974 - DNA, 40 bp, Artificial Sequence
  Synthetic
acagattttgcccgaagatgctaaaggttggtggtggaag

SEQ ID NO: 3975 - DNA, 50 bp, Artificial Sequence
  Synthetic
agggtcccattacaattaaagaaggttcaaatgttaggagagataacaag

SEQ ID NO: 3976 - DNA, 41 bp, Artificial Sequence
  Synthetic
cttggcagccgtgttggtaagataagtcagagttctcaggg

SEQ ID NO: 3977 - DNA, 45 bp, Artificial Sequence
  Synthetic
gtggtagaaaagagagtgttgctaacaagaaaacagcagacaagc

SEQ ID NO: 3978 - DNA, 44 bp, Artificial Sequence
  Synthetic
accttgtctatgtagtcctcaactacaccaatgatgaaacagga

SEQ ID NO: 3979 - DNA, 43 bp, Artificial Sequence
  Synthetic
catgctcttggaagtttatatcccactctttgggccaagatcc

SEQ ID NO: 3980 - DNA, 49 bp, Artificial Sequence
  Synthetic
tctggggacatcataaccatcataaggttttcctaggtttactattcca

SEQ ID NO: 3981 - DNA, 45 bp, Artificial Sequence
  Synthetic
tcagtcctgtggttaataaagtgttattcagcacaaactaccatg

SEQ ID NO: 3982 - DNA, 45 bp, Artificial Sequence
  Synthetic
gtcgtgtgcttctaatttaactggtttggagggctgctactatag

SEQ ID NO: 3983 - DNA, 43 bp, Artificial Sequence
  Synthetic
gctaccaaaggcactccctaattgtttagacactcaccaaggt

SEQ ID NO: 3984 - DNA, 44 bp, Artificial Sequence
  Synthetic
ggtctagtgatgtttaaccactgacctgtcacaagtcaccatgg

SEQ ID NO: 3985 - DNA, 45 bp, Artificial Sequence
  Synthetic
acttcttgttgatcatacccatcaagtttaaccaaaccaggtgac

SEQ ID NO: 3986 - DNA, 43 bp, Artificial Sequence
  Synthetic
ggtacccttgcaagatcttaagatcacccacagtaacagtccc

SEQ ID NO: 3987 - DNA, 43 bp, Artificial Sequence
  Synthetic
ccaagccctgaaatatagctgttatagaggagagcaaatccag

SEQ ID NO: 3988 - DNA, 43 bp, Artificial Sequence
  Synthetic
actcaggtttcttcttgggtgtattgatgtgtattgcccaagg

SEQ ID NO: 3989 - DNA, 45 bp, Artificial Sequence
  Synthetic
cctatgatattacctgtgttggccatatgactatccaacccaacc

SEQ ID NO: 3990 - DNA, 41 bp, Artificial Sequence
  Synthetic
gtgaggtctacttccaatcgtgtcctggtgttaaggaacca

SEQ ID NO: 3991 - DNA, 45 bp, Artificial Sequence
  Synthetic
ccttgtgtctttagtagcgttgtttttcccttatgtgtctttggg

SEQ ID NO: 3992 - DNA, 43 bp, Artificial Sequence
  Synthetic
gcatgcatttgtgaccaaaacaccaggtatcttaacaggctca

SEQ ID NO: 3993 - DNA, 45 bp, Artificial Sequence
  Synthetic
tgcattgagtaaacaggatgtatcaaatgtgaccttccttaaacg

SEQ ID NO: 3994 - DNA, 46 bp, Artificial Sequence
  Synthetic
cttctcttgtcttcctgatgtgtatcgcgagatactaacaaaaacc

SEQ ID NO: 3995 - DNA, 38 bp, Artificial Sequence
  Synthetic
ttgtcggcccattcctgttcgtcggacagagtgatggt

SEQ ID NO: 3996 - DNA, 45 bp, Artificial Sequence
  Synthetic
ggagctcttctttcttctcttttgtgtcgttttcccaaatgaagt

SEQ ID NO: 3997 - DNA, 44 bp, Artificial Sequence
  Synthetic
tgtgaattcttcatacccctcatgtcatccgtcaagaaggaaga

SEQ ID NO: 3998 - DNA, 39 bp, Artificial Sequence
  Synthetic
cctcaggagttgatgcatgggggcgatctgaatttcgtg

SEQ ID NO: 3999 - DNA, 44 bp, Artificial Sequence
  Synthetic
tgtttcactaacctcttcaggagatattgaccgtttcttgaggg

SEQ ID NO: 4000 - DNA, 40 bp, Artificial Sequence
  Synthetic
gacttgcttccgggctaggcacaagcggtaatgcagttga

SEQ ID NO: 4001 - DNA, 39 bp, Artificial Sequence
  Synthetic
ggatttaacacggacgcggaaaccgattacgtggggttt

SEQ ID NO: 4002 - DNA, 38 bp, Artificial Sequence
  Synthetic
cttcgtttgggtcgttctcccccacacttcaggaccta

SEQ ID NO: 4003 - DNA, 40 bp, Artificial Sequence
  Synthetic
ggtctgttcccggtgatattgattggacaatcctgaggtg

SEQ ID NO: 4004 - DNA, 40 bp, Artificial Sequence
  Synthetic
cccacgtcctgcaacaaatcctggttagaccgagtggcga

SEQ ID NO: 4005 - DNA, 40 bp, Artificial Sequence
  Synthetic
gtctccaaaacccggagcacgggaatttaacaagacacgc

SEQ ID NO: 4006 - DNA, 39 bp, Artificial Sequence
  Synthetic
tctgtccccgctgcctcatcgcaggggctacattctgga

SEQ ID NO: 4007 - DNA, 38 bp, Artificial Sequence
  Synthetic
cttgcaatctgggcgcagggacgaggattgggaggagg

SEQ ID NO: 4008 - DNA, 40 bp, Artificial Sequence
  Synthetic
cggtacagactcccaggtagcatggaagacccaagagcga

SEQ ID NO: 4009 - DNA, 41 bp, Artificial Sequence
  Synthetic
gatgccgttcaggttcaccctgtgcaactttagccagacca

SEQ ID NO: 4010 - DNA, 35 bp, Artificial Sequence
  Synthetic
tgctggaagcactgggcgcgggatgggccggagtt

SEQ ID NO: 4011 - DNA, 38 bp, Artificial Sequence
  Synthetic
cacctctaccgggtcctggatggtccacctctcccgat

SEQ ID NO: 4012 - DNA, 40 bp, Artificial Sequence
  Synthetic
tgcacaacatgaacccccggggcctggatcttaaggttgg

SEQ ID NO: 4013 - DNA, 36 bp, Artificial Sequence
  Synthetic
aaccgggtgcggcaagtccggggtgatgagctgcga

SEQ ID NO: 4014 - DNA, 38 bp, Artificial Sequence
  Synthetic
ccccgaaacgaggaagtctgcttccaggcggtcccaga

SEQ ID NO: 4015 - DNA, 38 bp, Artificial Sequence
  Synthetic
ctgtacgccctgcaatccctccggagcttgcccttgga

SEQ ID NO: 4016 - DNA, 38 bp, Artificial Sequence
  Synthetic
gccttcgtctcagagtggtccgtgtcctgcaggggcgt

SEQ ID NO: 4017 - DNA, 39 bp, Artificial Sequence
  Synthetic
tgacaacctgagtgccgaggtccagctgttggggtaggt

SEQ ID NO: 4018 - DNA, 37 bp, Artificial Sequence
  Synthetic
cgcgtcaggattgtgcccgcgcaacgcacttccattc

SEQ ID NO: 4019 - DNA, 39 bp, Artificial Sequence
  Synthetic
tacgtgcgcgccagcatcctacacatagatgggctccga

SEQ ID NO: 4020 - DNA, 40 bp, Artificial Sequence
  Synthetic
cgctcaagcttacgccctccatggttaacggccttgtagg

SEQ ID NO: 4021 - DNA, 40 bp, Artificial Sequence
  Synthetic
cgcccgcgattcatggaactatctgggcggctaggacaat

SEQ ID NO: 4022 - DNA, 35 bp, Artificial Sequence
  Synthetic
ccccaagctggtcgccctttcccagcgatcccagc

SEQ ID NO: 4023 - DNA, 38 bp, Artificial Sequence
  Synthetic
cgccactcctgaagttcctcctcgctgcacgggctgta

SEQ ID NO: 4024 - DNA, 36 bp, Artificial Sequence
  Synthetic
gttcaaagtcacggggcccggacgcggcggttgaca

SEQ ID NO: 4025 - DNA, 35 bp, Artificial Sequence
  Synthetic
cgccgtctttacgcggcactccccgtcaacgtcgc

SEQ ID NO: 4026 - DNA, 38 bp, Artificial Sequence
  Synthetic
ccaccgcccccagaggaaattcgcgctcaaaatccccg

SEQ ID NO: 4027 - DNA, 39 bp, Artificial Sequence
  Synthetic
cggtcgatcttgacgcgcttaggcgctaacgatgcatct

SEQ ID NO: 4028 - DNA, 38 bp, Artificial Sequence
  Synthetic
gctcaggggcgttggggttatgtcatcatttgcggcgg

SEQ ID NO: 4029 - DNA, 36 bp, Artificial Sequence
  Synthetic
atgctcgaggacctggcccactaggaagtgcggcgg

SEQ ID NO: 4030 - DNA, 37 bp, Artificial Sequence
  Synthetic
ctcgaaccggggtacacgccttcctccgtagcctggc

SEQ ID NO: 4031 - DNA, 37 bp, Artificial Sequence
  Synthetic
aaaagggggctcgctcgccagcattgccagggttacg

SEQ ID NO: 4032 - DNA, 40 bp, Artificial Sequence
  Synthetic
ggtgcgcacgtggttgttgaaaggcctacgagcagacggt

SEQ ID NO: 4033 - DNA, 42 bp, Artificial Sequence
  Synthetic
gggcacgtacggcgtcttgtaagcgatcaactactcagtgct

SEQ ID NO: 4034 - DNA, 38 bp, Artificial Sequence
  Synthetic
gggcttgctgctgggacatctaaggatgcacccgctgc

SEQ ID NO: 4035 - DNA, 35 bp, Artificial Sequence
  Synthetic
gctgttgtagcggcccacgaggccatccgtcccga

SEQ ID NO: 4036 - DNA, 42 bp, Artificial Sequence
  Synthetic
cccgcgtaggttcttgaaagcctttttccagacaagccggca

SEQ ID NO: 4037 - DNA, 41 bp, Artificial Sequence
  Synthetic
cgtactgcggcggaattttctgacgacaccgacagtttgag

SEQ ID NO: 4038 - DNA, 37 bp, Artificial Sequence
  Synthetic
cgggagccaatgcgggttcaagcgcggcgtccatgaa

SEQ ID NO: 4039 - DNA, 42 bp, Artificial Sequence
  Synthetic
agcgtaggtcttccagcggtttgaacgccatggccaataacg

SEQ ID NO: 4040 - DNA, 41 bp, Artificial Sequence
  Synthetic
catcacgctctcgtacgagggccttgttagagatgaggcgc

SEQ ID NO: 4041 - DNA, 41 bp, Artificial Sequence
  Synthetic
ggtcccagcccagcttgaaattaagtggggcgtcaaaatgg

SEQ ID NO: 4042 - DNA, 45 bp, Artificial Sequence
  Synthetic
aggagcattaactttagcagcatttcaagtacttggaaagcaaga

SEQ ID NO: 4043 - DNA, 41 bp, Artificial Sequence
  Synthetic
gctgggtggagcgaaaggtgagcaagtttactggtcgctgc

SEQ ID NO: 4044 - DNA, 40 bp, Artificial Sequence
  Synthetic
tgcccagggccttgtagacgcgagtgaccgttactgacgc

SEQ ID NO: 4045 - DNA, 38 bp, Artificial Sequence
  Synthetic
gcgtcagcgactacggagtcaagcttacaagcgcgggc

SEQ ID NO: 4046 - DNA, 35 bp, Artificial Sequence
  Synthetic
tttccgcgcctgggtctggcagacgagcggccgtt

SEQ ID NO: 4047 - DNA, 36 bp, Artificial Sequence
  Synthetic
caacacgcgctgcaccctgtgtgcgcgagtttgctc

SEQ ID NO: 4048 - DNA, 38 bp, Artificial Sequence
  Synthetic
ggtgtccagcacgtcctcctacccgaccatgcagatca

SEQ ID NO: 4049 - DNA, 35 bp, Artificial Sequence
  Synthetic
aggctcggtggccgtggatgtgcagaccgacccct

SEQ ID NO: 4050 - DNA, 41 bp, Artificial Sequence
  Synthetic
cggcgggatcttcctcggtaatactgttgcagagagatggc

SEQ ID NO: 4051 - DNA, 41 bp, Artificial Sequence
  Synthetic
cgttccaggtgcccatgaacgcatcaattttgcgtccctgg

SEQ ID NO: 4052 - DNA, 38 bp, Artificial Sequence
  Synthetic
gcatcttccatctccaccaccgccgtgcagcgcgagat

SEQ ID NO: 4053 - DNA, 35 bp, Artificial Sequence
  Synthetic
tgccagttctgggcctggccagctccggtcgtgca

SEQ ID NO: 4054 - DNA, 38 bp, Artificial Sequence
  Synthetic
ggagccaccgtggggtttctaaccgggtctggtgcagt

SEQ ID NO: 4055 - DNA, 44 bp, Artificial Sequence
  Synthetic
aattgttatgtcagcgcctccccaaaacaaactaatgctggaaa

SEQ ID NO: 4056 - DNA, 43 bp, Artificial Sequence
  Synthetic
acccagagaatctagcaaaagcttgtggttgacttacaagaca

SEQ ID NO: 4057 - DNA, 38 bp, Artificial Sequence
  Synthetic
tggtgttggtgggcagtgtgttgtacctgcccgactcc

SEQ ID NO: 4058 - DNA, 40 bp, Artificial Sequence
  Synthetic
gttgcccagggaactctgcacacctacgagtggaacttcc

SEQ ID NO: 4059 - DNA, 41 bp, Artificial Sequence
  Synthetic
acgctgcgcttaatctcgaactgttcgactcctcggttagc

SEQ ID NO: 4060 - DNA, 35 bp, Artificial Sequence
  Synthetic
cctggcgcatggtaggtgcccctgcccttccagca

SEQ ID NO: 4061 - DNA, 40 bp, Artificial Sequence
  Synthetic
gtagacggcctcgatgacgctgaagttttcgacgtggtca

SEQ ID NO: 4062 - DNA, 35 bp, Artificial Sequence
  Synthetic
tctgcttaagccggcggtcgctcgcgcacctgcta

SEQ ID NO: 4063 - DNA, 40 bp, Artificial Sequence
  Synthetic
gcacctgtggcgattgtagcatgggaaccccaccatgaac

SEQ ID NO: 4064 - DNA, 41 bp, Artificial Sequence
  Synthetic
ccccgagattgctgttcccaaatgcggtactggtacttggg

SEQ ID NO: 4065 - DNA, 39 bp, Artificial Sequence
  Synthetic
tacccgaatatgcagcgcggctgtggggcttgtggttac

SEQ ID NO: 4066 - DNA, 37 bp, Artificial Sequence
  Synthetic
gctcaagtgtctgcacgggacgcgctgaccgttctcg

SEQ ID NO: 4067 - DNA, 40 bp, Artificial Sequence
  Synthetic
tgctgatggaacgctaccgctttggaagatctcggtctgc

SEQ ID NO: 4068 - DNA, 42 bp, Artificial Sequence
  Synthetic
cgaggaggacgtggttccactgtgtttggtctttctgggctg

SEQ ID NO: 4069 - DNA, 42 bp, Artificial Sequence
  Synthetic
tcctgtgggggttctagacgaggcaacccaaaatcaagcagg

SEQ ID NO: 4070 - DNA, 39 bp, Artificial Sequence
  Synthetic
tcgacgctgcgcttaagcacgttacactagcgccctggt

SEQ ID NO: 4071 - DNA, 40 bp, Artificial Sequence
  Synthetic
tgtagtgcagggtctcctcgacttggaatgtatgcgccgc

SEQ ID NO: 4072 - DNA, 41 bp, Artificial Sequence
  Synthetic
gcccgtccacaacgttttaagggacgagaacctgaaggagc

SEQ ID NO: 4073 - DNA, 38 bp, Artificial Sequence
  Synthetic
actcaagcagcccctcgccagctggccaactacattgc

SEQ ID NO: 4074 - DNA, 41 bp, Artificial Sequence
  Synthetic
gatcgtgccctgggtgatgactctttgaggaccaattgcgc

SEQ ID NO: 4075 - DNA, 37 bp, Artificial Sequence
  Synthetic
acgaggaggcttgaccggaggcaggcaacagagcagc

SEQ ID NO: 4076 - DNA, 40 bp, Artificial Sequence
  Synthetic
gctgacctcgactctgctgaaacttgaccaccagggagct

SEQ ID NO: 4077 - DNA, 42 bp, Artificial Sequence
  Synthetic
gccagctggacacctgagttagactaccgtactacttccgcg

SEQ ID NO: 4078 - DNA, 40 bp, Artificial Sequence
  Synthetic
ggcctggggagcctgaaaagcagttcgtggaggagtttgt

SEQ ID NO: 4079 - DNA, 43 bp, Artificial Sequence
  Synthetic
tccagagtagagtcttatttcagctcccgaagttgcatgagaa

SEQ ID NO: 4080 - DNA, 47 bp, Artificial Sequence
  Synthetic
caccagggaaaggataattagcaaatatctgctgggttagatattgc

SEQ ID NO: 4081 - DNA, 43 bp, Artificial Sequence
  Synthetic
acctgacataaagcaggccataatctaccaaggagaacatggt

SEQ ID NO: 4082 - DNA, 44 bp, Artificial Sequence
  Synthetic
agctatgcttgatttgtgggtttccagttacatggtatgatgga

SEQ ID NO: 4083 - DNA, 45 bp, Artificial Sequence
  Synthetic
ctttgagcagtattaccttgtccaagtgtcagtcaaaaccttgtt

SEQ ID NO: 4084 - DNA, 47 bp, Artificial Sequence
  Synthetic
gaggttctttggtatgtggcttaatgataaggcaaatcgttacagaa

SEQ ID NO: 4085 - DNA, 49 bp, Artificial Sequence
  Synthetic
acaaagtacaaaagaaccacgagaactcaggtttgcatattcaaattac

SEQ ID NO: 4086 - DNA, 39 bp, Artificial Sequence
  Synthetic
gcagacaatgctgcagacgcagccattccccacctacct

SEQ ID NO: 4087 - DNA, 48 bp, Artificial Sequence
  Synthetic
cgagatcaaaacaggggtagatcatttcctattacttggtaattgtgg

SEQ ID NO: 4088 - DNA, 41 bp, Artificial Sequence
  Synthetic
cccgtctgctgggtgatgactaccccagcagaagcaaaagt

SEQ ID NO: 4089 - DNA, 38 bp, Artificial Sequence
  Synthetic
tgagtgacagaaccccagggcttccttactcccccctt

SEQ ID NO: 4090 - DNA, 49 bp, Artificial Sequence
  Synthetic
aaatgctaccaagtctccattatcaggtggaaatatatgtgttagagtt

SEQ ID NO: 4091 - DNA, 46 bp, Artificial Sequence
  Synthetic
gccaaggtagatgtttccataaacttttggtagcctatccaaaacc

SEQ ID NO: 4092 - DNA, 40 bp, Artificial Sequence
  Synthetic
aaggccacccgtactgagagacacattctcccaccaccag

SEQ ID NO: 4093 - DNA, 44 bp, Artificial Sequence
  Synthetic
tgggctgctgaataacataatgattgcaccgcattctaatttcg

SEQ ID NO: 4094 - DNA, 43 bp, Artificial Sequence
  Synthetic
cctgggatatgatcctgaccacaaggcacactgacatacatct

SEQ ID NO: 4095 - DNA, 41 bp, Artificial Sequence
  Synthetic
ggcagcattaactggatggggatgcgaattcccctcaacac

SEQ ID NO: 4096 - DNA, 45 bp, Artificial Sequence
  Synthetic
tggacttacaccaacaatttgtagacatcatgttacattcctgca

SEQ ID NO: 4097 - DNA, 44 bp, Artificial Sequence
  Synthetic
cctggctttatcacttacattttggctgcatgctggaataagct

SEQ ID NO: 4098 - DNA, 40 bp, Artificial Sequence
  Synthetic
ccgatgtgatttttgccggaagtccgtgtgattaaagagc

SEQ ID NO: 4099 - DNA, 42 bp, Artificial Sequence
  Synthetic
cgtcagtgtaagttgcctttaagtcagtacaagcgccaacag

SEQ ID NO: 4100 - DNA, 39 bp, Artificial Sequence
  Synthetic
gatgctctcacttctcctggattataatggccgggctac

SEQ ID NO: 4101 - DNA, 43 bp, Artificial Sequence
  Synthetic
caggatatccatatgtctgaagcaaccattgttccaagggcaa

SEQ ID NO: 4102 - DNA, 40 bp, Artificial Sequence
  Synthetic
agctccacagtgctggatagatactcagagacccagttca

SEQ ID NO: 4103 - DNA, 46 bp, Artificial Sequence
  Synthetic
ccagttcttgttgtcccgatcttgatcatacagacataacatttgg

SEQ ID NO: 4104 - DNA, 42 bp, Artificial Sequence
  Synthetic
cattctcatagtcagcatcactgcggccgacagaaaacagag

SEQ ID NO: 4105 - DNA, 41 bp, Artificial Sequence
  Synthetic
cttctccaatttctgtgggctttctcagatgtcatcggact

SEQ ID NO: 4106 - DNA, 45 bp, Artificial Sequence
  Synthetic
gttgatcaaggattctagcatgtgtggagtggaatctctaggaga

SEQ ID NO: 4107 - DNA, 49 bp, Artificial Sequence
  Synthetic
cttgggttggtaatgacatcagttagagggtagaacaaataataatgga

SEQ ID NO: 4108 - DNA, 41 bp, Artificial Sequence
  Synthetic
gctgctgactcttcgttctttgatcgaagaccacaacacca

SEQ ID NO: 4109 - DNA, 42 bp, Artificial Sequence
  Synthetic
tgtctttcccttttgtgaagactgcgggaaaacgggaaatcc

SEQ ID NO: 4110 - DNA, 44 bp, Artificial Sequence
  Synthetic
gagaggttctactgtcccattttcaaatggctgaaacatacagg

SEQ ID NO: 4111 - DNA, 45 bp, Artificial Sequence
  Synthetic
ggagcatggatcgaatctaccatgcattgacctcaaaataactgt

SEQ ID NO: 4112 - DNA, 48 bp, Artificial Sequence
  Synthetic
ttgagttcggtaatgcaagatctgtggaacatcactaggtacaattac

SEQ ID NO: 4113 - DNA, 46 bp, Artificial Sequence
  Synthetic
tccattaaaggatagcaaactgcttcaggcacattatccaaaactc

SEQ ID NO: 4114 - DNA, 49 bp, Artificial Sequence
  Synthetic
gctgagctttttgagactcttgtctcagttcaaataagaaaaacgtagg

SEQ ID NO: 4115 - DNA, 50 bp, Artificial Sequence
  Synthetic
gcaccaaagaatctagtttgtggatatccctgataacaataactaatgac

SEQ ID NO: 4116 - DNA, 50 bp, Artificial Sequence
  Synthetic
acctgttcagtgtaaatgatgtcatctctactctgctaatataacagaaa

SEQ ID NO: 4117 - DNA, 43 bp, Artificial Sequence
  Synthetic
gaatgtaactcctcttgagcgatctcatccacatgtacatgcg

SEQ ID NO: 4118 - DNA, 49 bp, Artificial Sequence
  Synthetic
gactggattgtctttaaccctaagtcatacaacaatcaaatctatccac

SEQ ID NO: 4119 - DNA, 42 bp, Artificial Sequence
  Synthetic
cagaaatcgtgtgggtccagagaaaacaccattgctattcac

SEQ ID NO: 4120 - DNA, 46 bp, Artificial Sequence
  Synthetic
tcctgcagctattacagaacatgggtaatttctcatacctatgaca

SEQ ID NO: 4121 - DNA, 47 bp, Artificial Sequence
  Synthetic
cgtaccctaggaaaatgagtgtattacttttgaccatcctttttctg

SEQ ID NO: 4122 - DNA, 46 bp, Artificial Sequence
  Synthetic
agtgccaacctgaagatctagtagaaggtaggctacttaaactagg

SEQ ID NO: 4123 - DNA, 41 bp, Artificial Sequence
  Synthetic
tggtgggattaacacgtgatgtccactatctcctgatgcag

SEQ ID NO: 4124 - DNA, 44 bp, Artificial Sequence
  Synthetic
cggataaggttcaaaagtgtaacgacccggcagatcaaaatcag

SEQ ID NO: 4125 - DNA, 45 bp, Artificial Sequence
  Synthetic
cgagtcgtccagctgaagacgtattaatgtattgtgatgttgtcg

SEQ ID NO: 4126 - DNA, 44 bp, Artificial Sequence
  Synthetic
cccattttcactgaataactcacctaagatgagagcagtccagg

SEQ ID NO: 4127 - DNA, 45 bp, Artificial Sequence
  Synthetic
tgctatagcttgattgtctccttgttcttgcagctgttaaagttg

SEQ ID NO: 4128 - DNA, 48 bp, Artificial Sequence
  Synthetic
gctgtagacatatagttgaaccctcaagggaaaaattggttaagatgt

SEQ ID NO: 4129 - DNA, 50 bp, Artificial Sequence
  Synthetic
gtggattggtcttccataagttagagagtatatgtgttcagtagaattgg

SEQ ID NO: 4130 - DNA, 44 bp, Artificial Sequence
  Synthetic
ttctctaaacttaagttagccctgggggcttatggaactgatga

SEQ ID NO: 4131 - DNA, 41 bp, Artificial Sequence
  Synthetic
tccctctgacgtttaacccgttcgggggtattctaatcaat

SEQ ID NO: 4132 - DNA, 44 bp, Artificial Sequence
  Synthetic
agcatactatcggcatcaggatctgagagtaagaggtataggga

SEQ ID NO: 4133 - DNA, 47 bp, Artificial Sequence
  Synthetic
ggtaagttccaatgctttcaaacaattatcacaccaattgagacttt

SEQ ID NO: 4134 - DNA, 42 bp, Artificial Sequence
  Synthetic
aggatctccagtataagggaatgtggatgtcaatccgacctt

SEQ ID NO: 4135 - DNA, 45 bp, Artificial Sequence
  Synthetic
gtttgtccactcttgtttgttgaatatcacacccaggaatctttg

SEQ ID NO: 4136 - DNA, 47 bp, Artificial Sequence
  Synthetic
tggtcatgttgtctcttactcttctggatgtgatagaatcaatggat

SEQ ID NO: 4137 - DNA, 46 bp, Artificial Sequence
  Synthetic
ccttcttttcattacctccaaccgacactagcgagaaatatttgtg

SEQ ID NO: 4138 - DNA, 42 bp, Artificial Sequence
  Synthetic
tcgaacatgtaacctttccctagtctgagcattgcacccata

SEQ ID NO: 4139 - DNA, 41 bp, Artificial Sequence
  Synthetic
agtccgtcccaccagtatgttcttaggagtctcaatcctga

SEQ ID NO: 4140 - DNA, 46 bp, Artificial Sequence
  Synthetic
agccgattcattaattccagacacgatttgtagccaattttagcat

SEQ ID NO: 4141 - DNA, 40 bp, Artificial Sequence
  Synthetic
gcctcccctgatagtcttcattctccacattccagaagtc

SEQ ID NO: 4142 - DNA, 46 bp, Artificial Sequence
  Synthetic
actgctagggaagaatttctcaaatgggaattcttgaagatgaaca

SEQ ID NO: 4143 - DNA, 43 bp, Artificial Sequence
  Synthetic
tgcagagcaggaaaatattagttgggtagggtcagcaaagcac

SEQ ID NO: 4144 - DNA, 40 bp, Artificial Sequence
  Synthetic
ccgtcctgttgtctgttccacaaaaagtgagggagctgcg

SEQ ID NO: 4145 - DNA, 42 bp, Artificial Sequence
  Synthetic
acgcacactatcctcctcctctggtggttgacctacattgca

SEQ ID NO: 4146 - DNA, 49 bp, Artificial Sequence
  Synthetic
gctagtccaaataggtccttgaattagacatattagaggtgtttaaggt

SEQ ID NO: 4147 - DNA, 44 bp, Artificial Sequence
  Synthetic
ggtatgtttaacagttttcccatgctgtgcgatacaaatgtggg

SEQ ID NO: 4148 - DNA, 42 bp, Artificial Sequence
  Synthetic
cctcatttcccagcaatgcatattgggcatatgacaatgaca

SEQ ID NO: 4149 - DNA, 42 bp, Artificial Sequence
  Synthetic
gcaaaatagcgacttccctgtgggtaccaaaaaaaagctgca

SEQ ID NO: 4150 - DNA, 42 bp, Artificial Sequence
  Synthetic
ggtctagtaatttctcctggcacgaggaggaggaggatgagg

SEQ ID NO: 4151 - DNA, 40 bp, Artificial Sequence
  Synthetic
tttccaaagaggtggtttgcaaagggttacaaacaagtgc

SEQ ID NO: 4152 - DNA, 46 bp, Artificial Sequence
  Synthetic
gcacaacaatcctacatatatggcagctttcctatctttcctcact

SEQ ID NO: 4153 - DNA, 39 bp, Artificial Sequence
  Synthetic
tacagtaggaggccgggtgcgggggattgggtataggca

SEQ ID NO: 4154 - DNA, 40 bp, Artificial Sequence
  Synthetic
cccctgcctgaggaggttcaatgggtctgtgcaggttagc

SEQ ID NO: 4155 - DNA, 41 bp, Artificial Sequence
  Synthetic
ggcaccaaaggctgtaactccagcgctcgggtacactttta

SEQ ID NO: 4156 - DNA, 45 bp, Artificial Sequence
  Synthetic
gcaacaaataaaaatcagagccctggtaccagctgtaccatatgt

SEQ ID NO: 4157 - DNA, 39 bp, Artificial Sequence
  Synthetic
gtgtttttcttgccctgcagccagttcccgtctgcttac

SEQ ID NO: 4158 - DNA, 47 bp, Artificial Sequence
  Synthetic
agcagccatttgtaaataatcaggaaataaatctgaagtgccattgg

SEQ ID NO: 4159 - DNA, 46 bp, Artificial Sequence
  Synthetic
ataccattgttgtggccctggctgattcccaattatttaataagcc

SEQ ID NO: 4160 - DNA, 44 bp, Artificial Sequence
  Synthetic
ggactgcaaaaacctatatgtgtctttgttggatgactggaact

SEQ ID NO: 4161 - DNA, 43 bp, Artificial Sequence
  Synthetic
acatgcacaacaacagcatacagtgctacaaaacgcaaaaagc

SEQ ID NO: 4162 - DNA, 42 bp, Artificial Sequence
  Synthetic
acagaaatggggaagctgcacatgcaccctgtgagtaagtgt

SEQ ID NO: 4163 - DNA, 43 bp, Artificial Sequence
  Synthetic
cacagtaattgcacaacatgtcaaagggtgtgtttgacaggtt

SEQ ID NO: 4164 - DNA, 44 bp, Artificial Sequence
  Synthetic
gctgttatattgcgggcataagtttggagaaacagtggaattac

SEQ ID NO: 4165 - DNA, 43 bp, Artificial Sequence
  Synthetic
tctgtatagtttgagcgttgaaagagacgtttgcatccaacac

SEQ ID NO: 4166 - DNA, 38 bp, Artificial Sequence
  Synthetic
ggacatgggctgccagaccgggacggtccagtacttcc

SEQ ID NO: 4167 - DNA, 37 bp, Artificial Sequence
  Synthetic
acgggattggtcggccgaaccggcccgtcaatcaaag

SEQ ID NO: 4168 - DNA, 41 bp, Artificial Sequence
  Synthetic
taagcaaaggggggatgggttttaccgagtaaaaggttcca

SEQ ID NO: 4169 - DNA, 39 bp, Artificial Sequence
  Synthetic
tatcccgcatgtaagctggctgattctggtctcacctgt

SEQ ID NO: 4170 - DNA, 36 bp, Artificial Sequence
  Synthetic
tacaccatgcgcggcggtcgcggttcgatgtagggt

SEQ ID NO: 4171 - DNA, 39 bp, Artificial Sequence
  Synthetic
tacgtgcaggcgccacacgcatgtggctgagcaaaaagg

SEQ ID NO: 4172 - DNA, 38 bp, Artificial Sequence
  Synthetic
gctggacacgcccatctcctcaggttcctgcggaggtg

SEQ ID NO: 4173 - DNA, 38 bp, Artificial Sequence
  Synthetic
gcagcacgcaaaagagcaggttacttgaggagccggcg

SEQ ID NO: 4174 - DNA, 35 bp, Artificial Sequence
  Synthetic
ccccattgacgcgtctgccccccttccgcctccaa

SEQ ID NO: 4175 - DNA, 39 bp, Artificial Sequence
  Synthetic
ccgaacagaagatgggacgccgtcgtcacgctccacaac

SEQ ID NO: 4176 - DNA, 40 bp, Artificial Sequence
  Synthetic
accgcatctcttggcgtttaccgtcctcgaattcgtggcc

SEQ ID NO: 4177 - DNA, 40 bp, Artificial Sequence
  Synthetic
acaggcaaaacacgccgtggcggtgcgaaatgaagagtgt

SEQ ID NO: 4178 - DNA, 38 bp, Artificial Sequence
  Synthetic
cgcgcttcagtgcaccgttgagaagcagtttcaggacg

SEQ ID NO: 4179 - DNA, 42 bp, Artificial Sequence
  Synthetic
cactgataacatgtaactccgccttatcaggtacgtgctgtt

SEQ ID NO: 4180 - DNA, 38 bp, Artificial Sequence
  Synthetic
ggtcacgggcgtgttcagtaatcgatggagcgcatgcc

SEQ ID NO: 4181 - DNA, 38 bp, Artificial Sequence
  Synthetic
cctgccgttgttctttgcggcccgttgcagtgattcgg

SEQ ID NO: 4182 - DNA, 36 bp, Artificial Sequence
  Synthetic
tttgtgggagcgtccggccgtcccgttgtgcgttgt

SEQ ID NO: 4183 - DNA, 38 bp, Artificial Sequence
  Synthetic
cggcaccgttgtcgcagtacagacggtgtcagtcaagg

SEQ ID NO: 4184 - DNA, 39 bp, Artificial Sequence
  Synthetic
ggcttctggttgggcgagcccaacagtagtccctctgcc

SEQ ID NO: 4185 - DNA, 41 bp, Artificial Sequence
  Synthetic
ccccgtgttgttctgccgtattcgtcctccccctgaaaagc

SEQ ID NO: 4186 - DNA, 37 bp, Artificial Sequence
  Synthetic
gcccgggtatgcgaaaccatcgtagctggcggttctg

SEQ ID NO: 4187 - DNA, 35 bp, Artificial Sequence
  Synthetic
tgcacctctggcgccacagagccacgcgctagcac

SEQ ID NO: 4188 - DNA, 39 bp, Artificial Sequence
  Synthetic
tcagggcgcgtctggtctcaaaggggatcaaattggccc

SEQ ID NO: 4189 - DNA, 40 bp, Artificial Sequence
  Synthetic
gtgaatgagggcgcatctacctcgaggcctgcgtaacttg

SEQ ID NO: 4190 - DNA, 38 bp, Artificial Sequence
  Synthetic
acgcctctgaggacgctgcctgtccttagttggcgccg

SEQ ID NO: 4191 - DNA, 39 bp, Artificial Sequence
  Synthetic
ggccaccgcgtccttcatttccggcggtaacaaaggacg

SEQ ID NO: 4192 - DNA, 40 bp, Artificial Sequence
  Synthetic
cctgttggacgatctcgcacatgacgcaaagacgctcctg

SEQ ID NO: 4193 - DNA, 41 bp, Artificial Sequence
  Synthetic
ggcgatgtgctgggggtgatacagagagcctagaatcacgc

SEQ ID NO: 4194 - DNA, 40 bp, Artificial Sequence
  Synthetic
cgcgtgaggtgaggtggacatccccacacgccatagacat

SEQ ID NO: 4195 - DNA, 39 bp, Artificial Sequence
  Synthetic
ttggggtaacggcgggcacctttccacacgcaatgaagc

SEQ ID NO: 4196 - DNA, 38 bp, Artificial Sequence
  Synthetic
tgcgagcaggagggacctttgtatgccagaagcctcct

SEQ ID NO: 4197 - DNA, 36 bp, Artificial Sequence
  Synthetic
tccctgggcaggcggaatagcgctgtgcgccctcaa

SEQ ID NO: 4198 - DNA, 38 bp, Artificial Sequence
  Synthetic
gcagcagcaggatgagcagcatgctgctcctgctcctc

SEQ ID NO: 4199 - DNA, 40 bp, Artificial Sequence
  Synthetic
gcactcttaccccccgtaaccacggagacacaggatggga

SEQ ID NO: 4200 - DNA, 35 bp, Artificial Sequence
  Synthetic
tgtcagaggtgctgcgggcacggtgcccagtgggt

SEQ ID NO: 4201 - DNA, 41 bp, Artificial Sequence
  Synthetic
ccccggacgtaaaggtcgaaggagacagctctgattcacgg

SEQ ID NO: 4202 - DNA, 36 bp, Artificial Sequence
  Synthetic
ttctgccgggagctgggagaagcgtcggagagctgg

SEQ ID NO: 4203 - DNA, 37 bp, Artificial Sequence
  Synthetic
catgctggccgagagggtggggacggagtgatggcct

SEQ ID NO: 4204 - DNA, 41 bp, Artificial Sequence
  Synthetic
gcgcatcttggagaccctgaagagtccggagaagatagggc

SEQ ID NO: 4205 - DNA, 43 bp, Artificial Sequence
  Synthetic
ccaaaccatactctttgcaaagcaagcagggatgtctgaggag

SEQ ID NO: 4206 - DNA, 38 bp, Artificial Sequence
  Synthetic
ccgcactcaaccaccagcccggggtggtaactacctgc

SEQ ID NO: 4207 - DNA, 40 bp, Artificial Sequence
  Synthetic
tcccccgttacctcctctggcagacagtgggtatggcaat

SEQ ID NO: 4208 - DNA, 41 bp, Artificial Sequence
  Synthetic
catggccgtcttgtaccagtcatagaaccaccaaaactgag

SEQ ID NO: 4209 - DNA, 47 bp, Artificial Sequence
  Synthetic
cgccttttaggaacaatttaaaggctcaggtttctaagacatcaagg

SEQ ID NO: 4210 - DNA, 45 bp, Artificial Sequence
  Synthetic
gttgttatcattaggggtggacactagtgagcatagacagaaagc

SEQ ID NO: 4211 - DNA, 39 bp, Artificial Sequence
  Synthetic
gagggcaggcacagctgtactgctgtttaaggcccgaga

SEQ ID NO: 4212 - DNA, 39 bp, Artificial Sequence
  Synthetic
ttcgtcgtccgaggcgctgtggctgggactgttattcac

SEQ ID NO: 4213 - DNA, 43 bp, Artificial Sequence
  Synthetic
cccttaggtatactgactcttgtcagcctttgtaacactgtgg

SEQ ID NO: 4214 - DNA, 44 bp, Artificial Sequence
  Synthetic
acaaacggacataaaacatcaacaatggggtcatgatgatgttc

SEQ ID NO: 4215 - DNA, 40 bp, Artificial Sequence
  Synthetic
gggtctgtaacggtggaggttgcaggagcgtcacatccca

SEQ ID NO: 4216 - DNA, 41 bp, Artificial Sequence
  Synthetic
gcaatggctgaaggacatccgagttgcccccagcttctact

SEQ ID NO: 4217 - DNA, 42 bp, Artificial Sequence
  Synthetic
ccgtactgatcacctttgaaacaggtggcggcctaatgaaag

SEQ ID NO: 4218 - DNA, 41 bp, Artificial Sequence
  Synthetic
gacttatttgactgcagagtggcgaggacggggatatggtt

SEQ ID NO: 4219 - DNA, 45 bp, Artificial Sequence
  Synthetic
gggttatcttgcacagttggaagggaatatctcaggcatatggag

SEQ ID NO: 4220 - DNA, 47 bp, Artificial Sequence
  Synthetic
acagttacagaacacacaacacatgacatgtatggtatgtatcccct

SEQ ID NO: 4221 - DNA, 43 bp, Artificial Sequence
  Synthetic
ttgctttcttgcagcagctgaaacttactagatgatagcgatg

SEQ ID NO: 4222 - DNA, 44 bp, Artificial Sequence
  Synthetic
ggcaatctggagagacagactcacagtggaatagaaaatgaagc

SEQ ID NO: 4223 - DNA, 50 bp, Artificial Sequence
  Synthetic
tctgtagcatcatctataagcccaaggtttctcatatgaattcaaaaagc

SEQ ID NO: 4224 - DNA, 44 bp, Artificial Sequence
  Synthetic
ggaacatgctgcaggcctagtcatgagaaaagaaggaatactgt

SEQ ID NO: 4225 - DNA, 42 bp, Artificial Sequence
  Synthetic
ggtttctccggtttgtgcaaccatcagctcttcctaccccac

SEQ ID NO: 4226 - DNA, 48 bp, Artificial Sequence
  Synthetic
ggccaccaaagtatactaaactactaataaagtagaggaaacaacact

SEQ ID NO: 4227 - DNA, 44 bp, Artificial Sequence
  Synthetic
gttctgtagttatgtcaaagcctgtggtcactcctgaagtagtg

SEQ ID NO: 4228 - DNA, 39 bp, Artificial Sequence
  Synthetic
aggatctggagcagcagttggaaaatcccgcctttacca

SEQ ID NO: 4229 - DNA, 41 bp, Artificial Sequence
  Synthetic
tgagggtgagacacaaagagtctggtgtggctcttagagtg

SEQ ID NO: 4230 - DNA, 44 bp, Artificial Sequence
  Synthetic
gccgtggaagtatatttctgtttctatcttccaccttccagacc

SEQ ID NO: 4231 - DNA, 46 bp, Artificial Sequence
  Synthetic
cgtttaacttatttagcaaggggtggaaactgaaaggtattgaggt

SEQ ID NO: 4232 - DNA, 44 bp, Artificial Sequence
  Synthetic
cccaaatccaatatcacacatgtctctgcccacctcttgaatta

SEQ ID NO: 4233 - DNA, 43 bp, Artificial Sequence
  Synthetic
gcctgagtaccttgaccagggggttgtaggtgaaaatattcct

SEQ ID NO: 4234 - DNA, 43 bp, Artificial Sequence
  Synthetic
tctgatagatccacatcccaaaagtccacacgttgtcctgatc

SEQ ID NO: 4235 - DNA, 44 bp, Artificial Sequence
  Synthetic
cgtgttgagacagcaccatttactgtgaatttaatgtgaaatgc

SEQ ID NO: 4236 - DNA, 48 bp, Artificial Sequence
  Synthetic
gcttcccttgagcaatcaaatcaaattgcaagaaattgatattcgttg

SEQ ID NO: 4237 - DNA, 47 bp, Artificial Sequence
  Synthetic
ctgaaatgttggacccatcagtacgtgagaatgagcatgatactttg

SEQ ID NO: 4238 - DNA, 48 bp, Artificial Sequence
  Synthetic
cctgttcagaagaatttgcagtttcattgaaaagacgattgttgtttc

SEQ ID NO: 4239 - DNA, 48 bp, Artificial Sequence
  Synthetic
gatgttgcactttggtgattcactaacaaatgcctcttatatgtatgg

SEQ ID NO: 4240 - DNA, 39 bp, Artificial Sequence
  Synthetic
gcgtcacctcctcgctttctcgacgacgacgacgaagag

SEQ ID NO: 4241 - DNA, 50 bp, Artificial Sequence
  Synthetic
ggcaatgtggtagtgactaaaaacagaacataaagaatctagtagcaagc

SEQ ID NO: 4242 - DNA, 50 bp, Artificial Sequence
  Synthetic
ccaaaatagaccacacttccaaacaaataaagtagaaggtaatacatggg

SEQ ID NO: 4243 - DNA, 44 bp, Artificial Sequence
  Synthetic
gggggtctagcactgttactatattgttatagacacaggcacat

SEQ ID NO: 4244 - DNA, 43 bp, Artificial Sequence
  Synthetic
accaaaagactgtgcatctacaaatactgctgtgcaaactcat

SEQ ID NO: 4245 - DNA, 45 bp, Artificial Sequence
  Synthetic
ccatagtgacgtcctcctcaaattgcactttatacatctaggttt

SEQ ID NO: 4246 - DNA, 47 bp, Artificial Sequence
  Synthetic
aggttgcacaggaatataaggtgtaattaatacattaccctgtgcag

SEQ ID NO: 4247 - DNA, 50 bp, Artificial Sequence
  Synthetic
tcaaagaaaggatgtccaactgttaattgttggaactgatttatacttcc

SEQ ID NO: 4248 - DNA, 48 bp, Artificial Sequence
  Synthetic
ggattttctgtatcctgcaatttgtggtattgaaattgatagaggtgg

SEQ ID NO: 4249 - DNA, 47 bp, Artificial Sequence
  Synthetic
cgaaccactcggaattgtaaagtaatattttaatcctaatggccagg

SEQ ID NO: 4250 - DNA, 48 bp, Artificial Sequence
  Synthetic
ccacatgagtcaagtcaacatcatttattttgcatgtgaaatggaaca

SEQ ID NO: 4251 - DNA, 45 bp, Artificial Sequence
  Synthetic
cccctgatgtgagtaatagggttaatgaacaggccaaaaatgaac

SEQ ID NO: 4252 - DNA, 40 bp, Artificial Sequence
  Synthetic
ttcctttgatctctccgaacctagggctcaacctttcaga

SEQ ID NO: 4253 - DNA, 40 bp, Artificial Sequence
  Synthetic
accatcatggcatgcggatccaactgtggaaaactccatt

SEQ ID NO: 4254 - DNA, 46 bp, Artificial Sequence
  Synthetic
gctccactcttcctgttggaatgcagatttcttaaaattagagagg

SEQ ID NO: 4255 - DNA, 39 bp, Artificial Sequence
  Synthetic
tccaagccacttgtctccattccagaccggatgatggaa

SEQ ID NO: 4256 - DNA, 48 bp, Artificial Sequence
  Synthetic
caagtatcttttccaccatcgtgtataaaggacaagaaatgtgatgtc

SEQ ID NO: 4257 - DNA, 39 bp, Artificial Sequence
  Synthetic
cgcccgattgaaacttaccgtcattttggcgccaactct

SEQ ID NO: 4258 - DNA, 43 bp, Artificial Sequence
  Synthetic
ctggccaaactcttcttgtagtattggggtgtgtagacattgc

SEQ ID NO: 4259 - DNA, 43 bp, Artificial Sequence
  Synthetic
tgaggacacaagaattgcagttcctgacgctgctattagaagt

SEQ ID NO: 4260 - DNA, 46 bp, Artificial Sequence
  Synthetic
ctcaaattcctgctggcgaagtcaaatttgttaaatgatgaggagg

SEQ ID NO: 4261 - DNA, 45 bp, Artificial Sequence
  Synthetic
aggtcaaattgcatagcatctgctgattggattgtaaatcagacc

SEQ ID NO: 4262 - DNA, 46 bp, Artificial Sequence
  Synthetic
gtgtccaaagcctttcaaaaaaagaatggtacccctgtatttcaac

SEQ ID NO: 4263 - DNA, 43 bp, Artificial Sequence
  Synthetic
cggaggtacgggttgatacccaagctttattattttttgcacg

SEQ ID NO: 4264 - DNA, 49 bp, Artificial Sequence
  Synthetic
ttccatccttataatatgcacctgctttgtagactcagatgatatgtgg

SEQ ID NO: 4265 - DNA, 37 bp, Artificial Sequence
  Synthetic
ggtgtctcgtcgacggtgtcccacggggctacgagaa

SEQ ID NO: 4266 - DNA, 39 bp, Artificial Sequence
  Synthetic
ggaccctctggatcctctggaagggaagcgagcacctca

SEQ ID NO: 4267 - DNA, 43 bp, Artificial Sequence
  Synthetic
gctagcctcctccagtaaccttagagtacaaacagttagtgga

SEQ ID NO: 4268 - DNA, 44 bp, Artificial Sequence
  Synthetic
tccacctattggttgaccaccgaatctgcattaactgatcatgt

SEQ ID NO: 4269 - DNA, 43 bp, Artificial Sequence
  Synthetic
tgctacgtccctttcaaatatttgtgccctcacgtttagttcg

SEQ ID NO: 4270 - DNA, 50 bp, Artificial Sequence
  Synthetic
accagaatgttcccctaatagtgatagtgcatttttatacagatcttagc

SEQ ID NO: 4271 - DNA, 46 bp, Artificial Sequence
  Synthetic
cacagcataaccttccaaatcttgtgcgttctaccacatttactgt

SEQ ID NO: 4272 - DNA, 39 bp, Artificial Sequence
  Synthetic
tccgtgctttgtacccttgccctgcaactggtaaggtat

SEQ ID NO: 4273 - DNA, 44 bp, Artificial Sequence
  Synthetic
aacacctaaaggctggccacccagaaaaggaaagattagtatgg

SEQ ID NO: 4274 - DNA, 40 bp, Artificial Sequence
  Synthetic
gcagtattgggtatcgcatcccaatgttatgccaggcact

SEQ ID NO: 4275 - DNA, 44 bp, Artificial Sequence
  Synthetic
gctcatatggatctttcctttctggtcttacatcacaggcaaca

SEQ ID NO: 4276 - DNA, 45 bp, Artificial Sequence
  Synthetic
gctttcaatgtgatgtttttgtccaacagaaaataacagggtccc

SEQ ID NO: 4277 - DNA, 42 bp, Artificial Sequence
  Synthetic
gccccaacagtaagaatgcatttcgaaggggtcttgcaagga

SEQ ID NO: 4278 - DNA, 48 bp, Artificial Sequence
  Synthetic
agcttctcttaaaggttgagcaattagacattaaacgaaaaacagatg

SEQ ID NO: 4279 - DNA, 48 bp, Artificial Sequence
  Synthetic
cctctggagtgtcatcaatggataatacaagaaaatgtagaagacctt

SEQ ID NO: 4280 - DNA, 44 bp, Artificial Sequence
  Synthetic
gcaactgtaggttccgtagaactttgcaggtaaacgaggaatgt

SEQ ID NO: 4281 - DNA, 43 bp, Artificial Sequence
  Synthetic
gcatacttggatttagccaaactttaaaaccacgctaaaaccg

SEQ ID NO: 4282 - DNA, 44 bp, Artificial Sequence
  Synthetic
cagtccatgtaccagtttttccatattttaccgaactggatggg

SEQ ID NO: 4283 - DNA, 46 bp, Artificial Sequence
  Synthetic
agtgacgctagtgtcaagcaataagtgttattgatattcaaacgcc

SEQ ID NO: 4284 - DNA, 41 bp, Artificial Sequence
  Synthetic
agggcggagagatagaccaacagggcgcgagatttgtacaa

SEQ ID NO: 4285 - DNA, 43 bp, Artificial Sequence
  Synthetic
tgtgcttagtactttgtcagtgttacagtgacggaagacctag

SEQ ID NO: 4286 - DNA, 38 bp, Artificial Sequence
  Synthetic
cacgtacccttttgacctggccttagggcaacattggg

SEQ ID NO: 4287 - DNA, 41 bp, Artificial Sequence
  Synthetic
cagggatactgtcgccaacaaaaacgtgaacaagtctatgc

SEQ ID NO: 4288 - DNA, 42 bp, Artificial Sequence
  Synthetic
gcgtctttaggacagatagtagcttagcctttgtaccagcac

SEQ ID NO: 4289 - DNA, 41 bp, Artificial Sequence
  Synthetic
ggttacaatggtcacagcatgtggatgagctggaggaggag

SEQ ID NO: 4290 - DNA, 47 bp, Artificial Sequence
  Synthetic
tgaagagtgccagggaatttccgggtcagttatttcaaatctaatag

SEQ ID NO: 4291 - DNA, 48 bp, Artificial Sequence
  Synthetic
gcactcttctacctgtgatagttcatccaaaaaaacgtttatttgagg

SEQ ID NO: 4292 - DNA, 45 bp, Artificial Sequence
  Synthetic
gcactagccatttgatgattaacaaatttgtgtttggtcaaatgc

SEQ ID NO: 4293 - DNA, 40 bp, Artificial Sequence
  Synthetic
ccttcccacttcttcagcagacagcaagaaaacgaagagt

SEQ ID NO: 4294 - DNA, 42 bp, Artificial Sequence
  Synthetic
ccaaatggtctgtagccagtagctattttgggggtttgggaa

SEQ ID NO: 4295 - DNA, 42 bp, Artificial Sequence
  Synthetic
tcttcagcagttattgtaggccccagaaggtgttccagagac

SEQ ID NO: 4296 - DNA, 48 bp, Artificial Sequence
  Synthetic
ggcctactcaggtaattgatatctcttgttattcaatcaagaacttgc

SEQ ID NO: 4297 - DNA, 46 bp, Artificial Sequence
  Synthetic
acaaagggttttctgaatctccataagaattaggtagaggaggtcc

SEQ ID NO: 4298 - DNA, 46 bp, Artificial Sequence
  Synthetic
tgctgatctgtcttgagaaaatgttgcacacaagaattcaagatgg

SEQ ID NO: 4299 - DNA, 46 bp, Artificial Sequence
  Synthetic
tggtactttacaaagacgaaagactaagcgattttaaccagtacac

SEQ ID NO: 4300 - DNA, 45 bp, Artificial Sequence
  Synthetic
acatgagtcagtattttgcaaacacttttgccaaatgtactgtga

SEQ ID NO: 4301 - DNA, 44 bp, Artificial Sequence
  Synthetic
ccgccaaattttgagtcagtcaaacagaggcgattgttataccg

SEQ ID NO: 4302 - DNA, 46 bp, Artificial Sequence
  Synthetic
gcttttctgctgcatccaacaactttacctgaggtgattattaggt

SEQ ID NO: 4303 - DNA, 39 bp, Artificial Sequence
  Synthetic
atcgacgagctccagagtcgacttcttgtgcaaactgtg

SEQ ID NO: 4304 - DNA, 43 bp, Artificial Sequence
  Synthetic
tgagttagtgtctacctgtgtaagaggcaaaacggagactgtt

SEQ ID NO: 4305 - DNA, 49 bp, Artificial Sequence
  Synthetic
gcagctgattgatgttctaccaatataatttcatgatgggagaatttcc

SEQ ID NO: 4306 - DNA, 40 bp, Artificial Sequence
  Synthetic
tcggtgtcggtggtcccaccctagctctacaaggccaacc

SEQ ID NO: 4307 - DNA, 40 bp, Artificial Sequence
  Synthetic
ggatcccgagcttcttcttgtatagaacggttgcgagaac

SEQ ID NO: 4308 - DNA, 43 bp, Artificial Sequence
  Synthetic
ggtgtagatggtgtcaatggtctatgggcataggtactggcaa

SEQ ID NO: 4309 - DNA, 46 bp, Artificial Sequence
  Synthetic
actacagtaggtgtactttctggtaccatcagttgttagtacctct

SEQ ID NO: 4310 - DNA, 46 bp, Artificial Sequence
  Synthetic
cttgtttttggtgggttaatagagctatagggggacaatatgagga

SEQ ID NO: 4311 - DNA, 48 bp, Artificial Sequence
  Synthetic
gtttgtttgggatcaaaagacacattaacaaatacatgagcaaacagt

SEQ ID NO: 4312 - DNA, 47 bp, Artificial Sequence
  Synthetic
ggccatttgcaagtactgtgaatatgtcaattttgtaaagtttcagg

SEQ ID NO: 4313 - DNA, 50 bp, Artificial Sequence
  Synthetic
agcgtttacctaaagaaaactgtgatccttatgccagatataatttttgg

SEQ ID NO: 4314 - DNA, 46 bp, Artificial Sequence
  Synthetic
tcataggtaaacaggggtgcgcaactatatctactgactcatttgg

SEQ ID NO: 4315 - DNA, 45 bp, Artificial Sequence
  Synthetic
cctcttgttaaaacttgacctacctcgccaaaaggaagtaaagac

SEQ ID NO: 4316 - DNA, 46 bp, Artificial Sequence
  Synthetic
cccatcagtttccatctgttcataacgagtgacatcaaaatcatgg

SEQ ID NO: 4317 - DNA, 43 bp, Artificial Sequence
  Synthetic
ccctctcaatatcaatgcagatcttgagagaaagtcggaaccc

SEQ ID NO: 4318 - DNA, 43 bp, Artificial Sequence
  Synthetic
ccctctgatgaagcttaacaatcttgagtcagctggtgtggat

SEQ ID NO: 4319 - DNA, 42 bp, Artificial Sequence
  Synthetic
ccagtgaatgctgccatgatcgttttctgtacaaagaaacct

SEQ ID NO: 4320 - DNA, 39 bp, Artificial Sequence
  Synthetic
aagccatgggtacactgtcctttcaaccgaaaacggtac

SEQ ID NO: 4321 - DNA, 46 bp, Artificial Sequence
  Synthetic
aggtcaatttcagtttgcggtacacggtaaagtaacaactattcca

SEQ ID NO: 4322 - DNA, 41 bp, Artificial Sequence
  Synthetic
gcagcgtctgtgtatctgcatatgacagggagacagctcag

SEQ ID NO: 4323 - DNA, 43 bp, Artificial Sequence
  Synthetic
gcctatatccatatcactgtctgctgatggaggctcacagact

SEQ ID NO: 4324 - DNA, 43 bp, Artificial Sequence
  Synthetic
cgtcattatcaaatgcccattgcaatacagcacagttttcagg

SEQ ID NO: 4325 - DNA, 50 bp, Artificial Sequence
  Synthetic
gaagtcgaccccttgatatcttaaacacacatatgtagtaaagtagatga

SEQ ID NO: 4326 - DNA, 45 bp, Artificial Sequence
  Synthetic
cccatatgcacttcccatgtgattatacagactttaatgacgagg

SEQ ID NO: 4327 - DNA, 43 bp, Artificial Sequence
  Synthetic
gcaaagcaaaaacacaaaactaacatattttgctgctacgcct

SEQ ID NO: 4328 - DNA, 47 bp, Artificial Sequence
  Synthetic
gccctacacaaagcaaaagtgtaatatgctgtgtggttaataaacac

SEQ ID NO: 4329 - DNA, 42 bp, Artificial Sequence
  Synthetic
cctcaataactgggggttcaacaaggctctgtccatgttagt

SEQ ID NO: 4330 - DNA, 42 bp, Artificial Sequence
  Synthetic
gtcaggatcaggtgccacactggataatccagtctttgagga

SEQ ID NO: 4331 - DNA, 47 bp, Artificial Sequence
  Synthetic
gcctacgccttaaaaagtatacaggcacatgatgtggttatacatgg

SEQ ID NO: 4332 - DNA, 43 bp, Artificial Sequence
  Synthetic
catctgttttggaattaccagccttctcacgtttgcttgctgt

SEQ ID NO: 4333 - DNA, 41 bp, Artificial Sequence
  Synthetic
tttgtgttcctagtggtgtccaacagggacacaataatggc

SEQ ID NO: 4334 - DNA, 45 bp, Artificial Sequence
  Synthetic
ctaagcttgtggcagctgggcatactatgaactccactttacttg

SEQ ID NO: 4335 - DNA, 41 bp, Artificial Sequence
  Synthetic
tgcgtttggctgatggtgtaactactactaaaaaacgctcg

SEQ ID NO: 4336 - DNA, 39 bp, Artificial Sequence
  Synthetic
aaaagggtggaggacatagggggttgtgtccctaggcat

SEQ ID NO: 4337 - DNA, 42 bp, Artificial Sequence
  Synthetic
ccaacagcagtaaagtatgctgatgtaagacgcctcgcctta

SEQ ID NO: 4338 - DNA, 47 bp, Artificial Sequence
  Synthetic
cctcaggattgggaaaaaacatttcatatcggtgcatatataagtgc

SEQ ID NO: 4339 - DNA, 42 bp, Artificial Sequence
  Synthetic
actcgtaacatgtaaggtcagtctaagtgtgcaggacattgt

SEQ ID NO: 4340 - DNA, 41 bp, Artificial Sequence
  Synthetic
cccaattacctgaatcagccatcaaaattgtgtgccccaac

SEQ ID NO: 4341 - DNA, 47 bp, Artificial Sequence
  Synthetic
tgagataggtcaaattgacagtcctgtacccgaatggattaaaagac

SEQ ID NO: 4342 - DNA, 40 bp, Artificial Sequence
  Synthetic
tgtccagcatgcaggtgttgagtcatttttggttatcgcc

SEQ ID NO: 4343 - DNA, 48 bp, Artificial Sequence
  Synthetic
tgccttccagttttcattagtaagtaaagtgtttacgttttcaaatcc

SEQ ID NO: 4344 - DNA, 41 bp, Artificial Sequence
  Synthetic
tcgtgatactgcaaggcttggacataaggcacgtgaaatgg

SEQ ID NO: 4345 - DNA, 44 bp, Artificial Sequence
  Synthetic
attgccctcaacctttggaatttacaaaacatgtaagcaaagtg

SEQ ID NO: 4346 - DNA, 45 bp, Artificial Sequence
  Synthetic
ggcactatggaggtaggaccgattcttctatagtttcattagtgg

SEQ ID NO: 4347 - DNA, 45 bp, Artificial Sequence
  Synthetic
aagcaggcctatgtaactttacaatagaatttcagcacagtgact

SEQ ID NO: 4348 - DNA, 47 bp, Artificial Sequence
  Synthetic
gccacatctgcaaaaaaatatgacatatgggtccgattttatattgc

SEQ ID NO: 4349 - DNA, 47 bp, Artificial Sequence
  Synthetic
gtaccccaatgttcccctaagggtcagtagattataaacaaacacag

SEQ ID NO: 4350 - DNA, 43 bp, Artificial Sequence
  Synthetic
gccctgttaaataggtgtctaacaagcagatccctatggcgat

SEQ ID NO: 4351 - DNA, 41 bp, Artificial Sequence
  Synthetic
aagcggtcgcagaataactttataatagccactgtgtctcc

SEQ ID NO: 4352 - DNA, 46 bp, Artificial Sequence
  Synthetic
tccattattgtgtcaacctgctctaaaagtgatcagatttgcattg

SEQ ID NO: 4353 - DNA, 39 bp, Artificial Sequence
  Synthetic
gaggtcattggctggactggacgaattcatcaatgtgcc

SEQ ID NO: 4354 - DNA, 45 bp, Artificial Sequence
  Synthetic
gtgaatcccccacagtactaaaagaacccaacaataaagaggagc

SEQ ID NO: 4355 - DNA, 46 bp, Artificial Sequence
  Synthetic
ccctttcttgacaattttgtatgcagaatgatgccatcaatttcga

SEQ ID NO: 4356 - DNA, 50 bp, Artificial Sequence
  Synthetic
catcctccctctataaaacctgctagagagagagaagaagaaaaaagaga

SEQ ID NO: 4357 - DNA, 50 bp, Artificial Sequence
  Synthetic
aagttcagcattataagtccagacaaaggaggatagagaatttaaacaag

SEQ ID NO: 4358 - DNA, 43 bp, Artificial Sequence
  Synthetic
cccattgattccaattttactccacaacgtatgactacccgca

SEQ ID NO: 4359 - DNA, 47 bp, Artificial Sequence
  Synthetic
catcagtctccatctgttcgtaagactgagtgacatcaaaatcatgg

SEQ ID NO: 4360 - DNA, 48 bp, Artificial Sequence
  Synthetic
ctcttctgtatataggtcctccagtaataaatacctggaagaacatcc

SEQ ID NO: 4361 - DNA, 42 bp, Artificial Sequence
  Synthetic
aattccatcaccattgttccaactctccctaggaggtctgga

SEQ ID NO: 4362 - DNA, 43 bp, Artificial Sequence
  Synthetic
ccctttgatgaagctcaatactcttgagtcaactggtgtggat

SEQ ID NO: 4363 - DNA, 50 bp, Artificial Sequence
  Synthetic
ctcctcggttactaattcatcacatctattggagatgtaaagttagaact

SEQ ID NO: 4364 - DNA, 42 bp, Artificial Sequence
  Synthetic
gttgcagtcttgggctcaaataaagtactttagtcctagccc

SEQ ID NO: 4365 - DNA, 43 bp, Artificial Sequence
  Synthetic
acatcattactgtaacgcccgtcaacattactgcaaccacatt

SEQ ID NO: 4366 - DNA, 48 bp, Artificial Sequence
  Synthetic
cccatctactagtggttgcaaccaataaaatatacccaaggtaaggtg

SEQ ID NO: 4367 - DNA, 44 bp, Artificial Sequence
  Synthetic
ccatctgagctgtcgtctggctttttttagtaaactgtggaagc

SEQ ID NO: 4368 - DNA, 48 bp, Artificial Sequence
  Synthetic
actgcattgtcctcattatttccattcgcatacatttaaaaaacaagg

SEQ ID NO: 4369 - DNA, 42 bp, Artificial Sequence
  Synthetic
gtgtctattaggcagtcgatgtccggggatccgagtctccta

SEQ ID NO: 4370 - DNA, 47 bp, Artificial Sequence
  Synthetic
ggccatataccgatatgtaagaaggacctcctacatctactcctaag

SEQ ID NO: 4371 - DNA, 39 bp, Artificial Sequence
  Synthetic
agccatcaacaatagaggccatggctcagttgaattgca

SEQ ID NO: 4372 - DNA, 42 bp, Artificial Sequence
  Synthetic
accatccacaacaataggaggttacatcctgttattcctggc

SEQ ID NO: 4373 - DNA, 41 bp, Artificial Sequence
  Synthetic
caaccaacaacaaacaactgtgtggtgctaaggacgctaga

SEQ ID NO: 4374 - DNA, 47 bp, Artificial Sequence
  Synthetic
gcaaaatataaagagggagccagcgtttgagggtaatggtaaaaagt

SEQ ID NO: 4375 - DNA, 47 bp, Artificial Sequence
  Synthetic
ccttttccttaggaggctctgccttacagatatattgattctcttgc

SEQ ID NO: 4376 - DNA, 43 bp, Artificial Sequence
  Synthetic
gaacatacctgctggcaaaattggtattgcttttggaggcacc

SEQ ID NO: 4377 - DNA, 41 bp, Artificial Sequence
  Synthetic
gtccgtctctctgttttggcccttgaagcagtagtccttct

SEQ ID NO: 4378 - DNA, 49 bp, Artificial Sequence
  Synthetic
ttagcagaaatggttcaatggtgtcatatctataagcaataattggctc

SEQ ID NO: 4379 - DNA, 41 bp, Artificial Sequence
  Synthetic
cttgttggctgttcatggatacttccaaacatacaggggtg

SEQ ID NO: 4380 - DNA, 43 bp, Artificial Sequence
  Synthetic
ggtttgcaaccccttcctagaaatgtatagcttctttggactt

SEQ ID NO: 4381 - DNA, 37 bp, Artificial Sequence
  Synthetic
ctcccacccaggcggcataccggtggtgctactagcg

SEQ ID NO: 4382 - DNA, 41 bp, Artificial Sequence
  Synthetic
ctgctggagaagtgggaagcggcttcagcttcaagtcttgc

SEQ ID NO: 4383 - DNA, 48 bp, Artificial Sequence
  Synthetic
aaagcagtttctaagtagtgtgtctttataatgagtccaaatgtccat

SEQ ID NO: 4384 - DNA, 42 bp, Artificial Sequence
  Synthetic
aagaatcaggtcctagcactagcataaaattggcgggctctg

SEQ ID NO: 4385 - DNA, 47 bp, Artificial Sequence
  Synthetic
cggacattaagtagaccaacattcatcctagcctacttaatcgaatt

SEQ ID NO: 4386 - DNA, 47 bp, Artificial Sequence
  Synthetic
agatgcattagctgagtctgctgtcaaaagactcattatatggatct

SEQ ID NO: 4387 - DNA, 46 bp, Artificial Sequence
  Synthetic
ttgttcaataaatatgctgacgtggtgtaatcctcatcctgttgag

SEQ ID NO: 4388 - DNA, 46 bp, Artificial Sequence
  Synthetic
ttgctccctacacgtattttccagcagccaatatggtctattaaat

SEQ ID NO: 4389 - DNA, 44 bp, Artificial Sequence
  Synthetic
ctatggatctgtctgaaagactgtcccgtaacataccggtttga

SEQ ID NO: 4390 - DNA, 38 bp, Artificial Sequence
  Synthetic
gctgtggacagtgtggtcagtttggcgcctttttagca

SEQ ID NO: 4391 - DNA, 47 bp, Artificial Sequence
  Synthetic
actgaaaaatgagaggtaatgctccaggcagtactaattcttcaaga

SEQ ID NO: 4392 - DNA, 45 bp, Artificial Sequence
  Synthetic
atcctgtgcaagaaaccgtggctacttgtaccttctaaactatca

SEQ ID NO: 4393 - DNA, 44 bp, Artificial Sequence
  Synthetic
ctaaaagtccagaagttgcagttgagagcttattttcacagcct

SEQ ID NO: 4394 - DNA, 43 bp, Artificial Sequence
  Synthetic
acctaaaacatccagaaggagatggcagttcctgcagtgcatc

SEQ ID NO: 4395 - DNA, 42 bp, Artificial Sequence
  Synthetic
aggagagtcctgctaggagacgtgtctcaggtgatgttgtgg

SEQ ID NO: 4396 - DNA, 43 bp, Artificial Sequence
  Synthetic
gcttgggatccgccaataattccgatatctccagcatttaagc

SEQ ID NO: 4397 - DNA, 41 bp, Artificial Sequence
  Synthetic
gacccacaattcctgttgacactgaatgactgcagagccag

SEQ ID NO: 4398 - DNA, 42 bp, Artificial Sequence
  Synthetic
ttagcaatgcagaagaaggtgtagtgctaaacgtttcggtgg

SEQ ID NO: 4399 - DNA, 43 bp, Artificial Sequence
  Synthetic
ctgaatttgaaattgaagcccctccatctctgaagcgggtgac

SEQ ID NO: 4400 - DNA, 44 bp, Artificial Sequence
  Synthetic
taggacgtcctagatacagtgaaaccgagtttgcattgttccac

SEQ ID NO: 4401 - DNA, 44 bp, Artificial Sequence
  Synthetic
cgcaaacgaaaacgaatagctatcagatacagtttaccagttgg

SEQ ID NO: 4402 - DNA, 40 bp, Artificial Sequence
  Synthetic
agttcctcatgtctcaggaagtgcgattcggatctggtag

SEQ ID NO: 4403 - DNA, 45 bp, Artificial Sequence
  Synthetic
acccaactatttattgtaggctgtgacaaggctttgctatatccc

SEQ ID NO: 4404 - DNA, 42 bp, Artificial Sequence
  Synthetic
tagtggttctctagtttccagtgattgttagtcccctgagca

SEQ ID NO: 4405 - DNA, 41 bp, Artificial Sequence
  Synthetic
tagtggtctgcggaaccggtgcgggcatagagtgggttgat

SEQ ID NO: 4406 - DNA, 38 bp, Artificial Sequence
  Synthetic
ggccctagattgggtgtgcgtttggggatacgttggcg

SEQ ID NO: 4407 - DNA, 39 bp, Artificial Sequence
  Synthetic
ccagggctctggcacatggtccctgttgcatagttgacc

SEQ ID NO: 4408 - DNA, 38 bp, Artificial Sequence
  Synthetic
ccactttggcggtccgctataggtcaatatgcgtccgc

SEQ ID NO: 4409 - DNA, 37 bp, Artificial Sequence
  Synthetic
ttgccgcttacgctgtgagaaacacaccccagtggcc

SEQ ID NO: 4410 - DNA, 40 bp, Artificial Sequence
  Synthetic
cagtgactttgaccaggggtggaatagggtcgctggtccg

SEQ ID NO: 4411 - DNA, 41 bp, Artificial Sequence
  Synthetic
cccagggtgcccagagtaacacggatgtttcctgaagcagt

SEQ ID NO: 4412 - DNA, 42 bp, Artificial Sequence
  Synthetic
tgctccattccactacggagctgtagataaggccggaagcgg

SEQ ID NO: 4413 - DNA, 41 bp, Artificial Sequence
  Synthetic
gggaacccatggtatctggtggctgcctcgtagatgccaag

SEQ ID NO: 4414 - DNA, 38 bp, Artificial Sequence
  Synthetic
tccctcctctcaaccctcggtagcacagcagcacacac

SEQ ID NO: 4415 - DNA, 39 bp, Artificial Sequence
  Synthetic
cgttgcagtcgagcccgtgatatgtcgccacaagcagtg

SEQ ID NO: 4416 - DNA, 38 bp, Artificial Sequence
  Synthetic
tccacctcaacgcagaccttccgtgcccgctccgtgat

SEQ ID NO: 4417 - DNA, 39 bp, Artificial Sequence
  Synthetic
gcccccaaagtcattgcgttgctgctttggctacaccgc

SEQ ID NO: 4418 - DNA, 38 bp, Artificial Sequence
  Synthetic
accacgggggctcccataacacctgaacaacccccgtc

SEQ ID NO: 4419 - DNA, 42 bp, Artificial Sequence
  Synthetic
aaatgtgatgagcttgccgggacccctatagtaagcaacggc

SEQ ID NO: 4420 - DNA, 39 bp, Artificial Sequence
  Synthetic
gctctcagagacgtgggaggacgccactggacacgtatc

SEQ ID NO: 4421 - DNA, 40 bp, Artificial Sequence
  Synthetic
tggaagagtgctccaaagctcctgaacattccgccgatgg

SEQ ID NO: 4422 - DNA, 40 bp, Artificial Sequence
  Synthetic
agtcaacatcctgggtgggtggccgagaccacgaaagtcg

SEQ ID NO: 4423 - DNA, 39 bp, Artificial Sequence
  Synthetic
ggcataccggcactagtgaggatttccacgggaggcgaa

SEQ ID NO: 4424 - DNA, 42 bp, Artificial Sequence
  Synthetic
ggcatcatgaacaccaagtgcccgcatcgatccgttcttgac

SEQ ID NO: 4425 - DNA, 40 bp, Artificial Sequence
  Synthetic
tccttcccccgaattcttcagctgggttcaggggcgaatc

SEQ ID NO: 4426 - DNA, 35 bp, Artificial Sequence
  Synthetic
tccaccacccaggcggaaggtgccgtggaaaccgc

SEQ ID NO: 4427 - DNA, 42 bp, Artificial Sequence
  Synthetic
ctacaggacatgaccaccccgaggcaggatttacgcagaaga

SEQ ID NO: 4428 - DNA, 42 bp, Artificial Sequence
  Synthetic
tatcagtgctgcaacctcgaccccacgtacaacctctcggta

SEQ ID NO: 4429 - DNA, 41 bp, Artificial Sequence
  Synthetic
cgagagcaagggagtcgaacgggagtacctggtcattgccg

SEQ ID NO: 4430 - DNA, 37 bp, Artificial Sequence
  Synthetic
ctggccggctcgatctttcgtgatccacgtccgcctc

SEQ ID NO: 4431 - DNA, 45 bp, Artificial Sequence
  Synthetic
aagaatgaacatcttcccctaatgttaagcacctcataacgatgt

SEQ ID NO: 4432 - DNA, 42 bp, Artificial Sequence
  Synthetic
tcttgggagtggagtcaatgaacttcttcaaccatttccatt

SEQ ID NO: 4433 - DNA, 45 bp, Artificial Sequence
  Synthetic
cgtgattagaacacacgagtactccacatcctgtaacatcagaaa

SEQ ID NO: 4434 - DNA, 42 bp, Artificial Sequence
  Synthetic
gacaaattgactcaggggagacatattgttgtgttcagtgcc

SEQ ID NO: 4435 - DNA, 41 bp, Artificial Sequence
  Synthetic
agaaggccaaactatcaaatgcatactgatccctcctggtg

SEQ ID NO: 4436 - DNA, 43 bp, Artificial Sequence
  Synthetic
gcacaaacagccatacaattattcaatctcccctgtggcattt

SEQ ID NO: 4437 - DNA, 46 bp, Artificial Sequence
  Synthetic
acaacataatggaccctgagtacacaaatgtcctacaaagggattt

SEQ ID NO: 4438 - DNA, 41 bp, Artificial Sequence
  Synthetic
tttgaggcttgctttaacagtgcgtgggccatagcttcaag

SEQ ID NO: 4439 - DNA, 43 bp, Artificial Sequence
  Synthetic
attggataccatgccaataattccacacagtgacattccgctc

SEQ ID NO: 4440 - DNA, 38 bp, Artificial Sequence
  Synthetic
ttgtgttacccaggcagcttatgtttcacgctgctgag

SEQ ID NO: 4441 - DNA, 45 bp, Artificial Sequence
  Synthetic
aaatgctaataatttggggagtgcatctggtacaatgctctttgt

SEQ ID NO: 4442 - DNA, 47 bp, Artificial Sequence
  Synthetic
catgaagacagaaggaacacttgagtgtatttattgctcccaaagga

SEQ ID NO: 4443 - DNA, 41 bp, Artificial Sequence
  Synthetic
aggaatggttgatggttggtatgctgctgcataccctgatc

SEQ ID NO: 4444 - DNA, 46 bp, Artificial Sequence
  Synthetic
gactgatgatcacagacatgagacctgtgtgttatgatgtctctgg

SEQ ID NO: 4445 - DNA, 43 bp, Artificial Sequence
  Synthetic
acactcaacaaagatcaacttctgtactatctcctgtgctccg

SEQ ID NO: 4446 - DNA, 44 bp, Artificial Sequence
  Synthetic
gccaacagcttctatgaagtgttgtgctataccaaaatgaacaa

SEQ ID NO: 4447 - DNA, 43 bp, Artificial Sequence
  Synthetic
acagaggtacaccaaggaatcaattgagttgttcagcatatgc

SEQ ID NO: 4448 - DNA, 45 bp, Artificial Sequence
  Synthetic
atcagaactgaagcattaatgaccattcactttcctcattcctga

SEQ ID NO: 4449 - DNA, 40 bp, Artificial Sequence
  Synthetic
caactcacccatccaaccaaactttttccgggtggctagt

SEQ ID NO: 4450 - DNA, 41 bp, Artificial Sequence
  Synthetic
aaactcaagaagtgcagtgctagaaggacacattggcacat

SEQ ID NO: 4451 - DNA, 50 bp, Artificial Sequence
  Synthetic
tactgttagtcatcacagtgactgactactataaattgactttgtggctt

SEQ ID NO: 4452 - DNA, 48 bp, Artificial Sequence
  Synthetic
atccacatggggcaaataatcatttgtctatgttgacagatattgtga

SEQ ID NO: 4453 - DNA, 46 bp, Artificial Sequence
  Synthetic
gcacaaatcacattatccattctggatgaatatgatggctgcaatt

SEQ ID NO: 4454 - DNA, 43 bp, Artificial Sequence
  Synthetic
agcatatgcagcaacaatccaatccaggttttttgtttggtat

SEQ ID NO: 4455 - DNA, 40 bp, Artificial Sequence
  Synthetic
ccctccactcaacctcctcctgtgataggtactcggatgt

SEQ ID NO: 4456 - DNA, 39 bp, Artificial Sequence
  Synthetic
caatccttgctgcagtcacacgcactgcatgttgtttga

SEQ ID NO: 4457 - DNA, 45 bp, Artificial Sequence
  Synthetic
agtgtcttaaccagcaaagtgtttcacaataggtaacaactgttt

SEQ ID NO: 4458 - DNA, 44 bp, Artificial Sequence
  Synthetic
tcttcccactagctgaaacatgtaactgttcattgtgtcacaaa

SEQ ID NO: 4459 - DNA, 47 bp, Artificial Sequence
  Synthetic
gcacctaatcatgttcttacaatggaaatccaatgatagatgggttg

SEQ ID NO: 4460 - DNA, 40 bp, Artificial Sequence
  Synthetic
gccatgagcaaactcctcactcttcattgtccctcagttt

SEQ ID NO: 4461 - DNA, 46 bp, Artificial Sequence
  Synthetic
tgtaggtagaatgtttgcaatgcacagctatcattttctctgctaa

SEQ ID NO: 4462 - DNA, 45 bp, Artificial Sequence
  Synthetic
gaacctacatatcctcacgggcttctctgctttataaaagggtaa

SEQ ID NO: 4463 - DNA, 49 bp, Artificial Sequence
  Synthetic
tacagtcagtagtagaccatgtgaaggctagtatcaaagtgataatttg

SEQ ID NO: 4464 - DNA, 38 bp, Artificial Sequence
  Synthetic
cctcccgggagagccatagtgtcgtcctggcaattccg

SEQ ID NO: 4465 - DNA, 42 bp, Artificial Sequence
  Synthetic
caggggccctagattgggtgtgtggggataggctgacgtcta

SEQ ID NO: 4466 - DNA, 39 bp, Artificial Sequence
  Synthetic
cgcatggcgtccgggttctagaaagagcaaccaggaagg

SEQ ID NO: 4467 - DNA, 36 bp, Artificial Sequence
  Synthetic
ggtgttgggtggcggtgatgcgttgtggggagtttg

SEQ ID NO: 4468 - DNA, 42 bp, Artificial Sequence
  Synthetic
tcatggacatgatcgctggtgcccaccatggagaaatacgct

SEQ ID NO: 4469 - DNA, 41 bp, Artificial Sequence
  Synthetic
tcagttatgccaacggaagcgggtcttggagggtagtgcca

SEQ ID NO: 4470 - DNA, 39 bp, Artificial Sequence
  Synthetic
gcccccttgtgtcatcggaggaagcaatcagtggggcag

SEQ ID NO: 4471 - DNA, 39 bp, Artificial Sequence
  Synthetic
agcccgttgctgctgtccagcagggtcgtgaaagaacac

SEQ ID NO: 4472 - DNA, 40 bp, Artificial Sequence
  Synthetic
cctcgtgttcttctgctttgcggaggccacatcccgtaga

SEQ ID NO: 4473 - DNA, 39 bp, Artificial Sequence
  Synthetic
aaagtcccctacttcgtgcgccggctatcttccgcgcta

SEQ ID NO: 4474 - DNA, 42 bp, Artificial Sequence
  Synthetic
ggagaccaagctcatcacgtggaagccgttgatgatgtcacc

SEQ ID NO: 4475 - DNA, 41 bp, Artificial Sequence
  Synthetic
ggaacgaggaccatcgcatcacacaaggtcttggtccacat

SEQ ID NO: 4476 - DNA, 41 bp, Artificial Sequence
  Synthetic
tccctgtggagaacctagggacggtggagaggagttgtccg

SEQ ID NO: 4477 - DNA, 39 bp, Artificial Sequence
  Synthetic
cgggtgctcaggaggtgcttaatgtggcatccgtggagt

SEQ ID NO: 4478 - DNA, 39 bp, Artificial Sequence
  Synthetic
gaagctggtcgcattgggcagacagacacgtcaagaccg

SEQ ID NO: 4479 - DNA, 41 bp, Artificial Sequence
  Synthetic
tctgtgagtgctatgacgcgggtaactgtagtctcggcggg

SEQ ID NO: 4480 - DNA, 38 bp, Artificial Sequence
  Synthetic
tgaagtcaccctgacgcacccggtgctcgtgacgacct

SEQ ID NO: 4481 - DNA, 41 bp, Artificial Sequence
  Synthetic
gtcccgccatgcagaggttatagacctcgagtttctgccag

SEQ ID NO: 4482 - DNA, 37 bp, Artificial Sequence
  Synthetic
tgtgggtgctggcctagctcacgaggaccttccccag

SEQ ID NO: 4483 - DNA, 36 bp, Artificial Sequence
  Synthetic
cgcccgcgtcactgccatatgcagtcgcctcaggag

SEQ ID NO: 4484 - DNA, 41 bp, Artificial Sequence
  Synthetic
ctgcaggaacatgtggagtgggcaggaaggggagtacaggg

SEQ ID NO: 4485 - DNA, 41 bp, Artificial Sequence
  Synthetic
gcaattaccttgcgagcccgaagggatcagtgagcatggac

SEQ ID NO: 4486 - DNA, 40 bp, Artificial Sequence
  Synthetic
tgtggcagaggaggatgagcggcgaatctccgagacttcc

SEQ ID NO: 4487 - DNA, 42 bp, Artificial Sequence
  Synthetic
acgacaacatcctctgagcccgggggcatggaagaataggac

SEQ ID NO: 4488 - DNA, 40 bp, Artificial Sequence
  Synthetic
agactgcaagttctggacagccttttgacgccgctgcttt

SEQ ID NO: 4489 - DNA, 38 bp, Artificial Sequence
  Synthetic
gcgtgtgcgagaagatggccaggagcttcccatcacgg

SEQ ID NO: 4490 - DNA, 41 bp, Artificial Sequence
  Synthetic
ttcaaggggggaaaactgcggcagctagttgtcagtacgcc

SEQ ID NO: 4491 - DNA, 40 bp, Artificial Sequence
  Synthetic
cgcgtgggagacagcaagactgtgggggcaaacatgatta

SEQ ID NO: 4492 - DNA, 40 bp, Artificial Sequence
  Synthetic
tgcctcagaaaacttggggtcctggacagaagcctagcgc

SEQ ID NO: 4493 - DNA, 45 bp, Artificial Sequence
  Synthetic
agatccgaaaatcgaaacgaacacatgaaacagacttctaagtgc

SEQ ID NO: 4494 - DNA, 46 bp, Artificial Sequence
  Synthetic
gtatgactacaaggagaaccgattttagtatgtgtgaacttccctc

SEQ ID NO: 4495 - DNA, 43 bp, Artificial Sequence
  Synthetic
aagaacatgaggaaaacaagccactactttctctggtgccata

SEQ ID NO: 4496 - DNA, 47 bp, Artificial Sequence
  Synthetic
atgagaaggaactatttcacagcgcccttcattatgtattcagtagc

SEQ ID NO: 4497 - DNA, 39 bp, Artificial Sequence
  Synthetic
tggagccacacagatgggaagtccgtaagagcatgtctc

SEQ ID NO: 4498 - DNA, 41 bp, Artificial Sequence
  Synthetic
aatcagaaacatggccaattggaaaggttctgcacaccttc

SEQ ID NO: 4499 - DNA, 43 bp, Artificial Sequence
  Synthetic
tttgcatcagaatagaccaggcatcacactgaaattcgctttc

SEQ ID NO: 4500 - DNA, 42 bp, Artificial Sequence
  Synthetic
agaagcagtaatgagaatgggagagttctcgccattttccgt

SEQ ID NO: 4501 - DNA, 38 bp, Artificial Sequence
  Synthetic
agccgcgtactctagctgatgcacaaggaagttgcaaa

SEQ ID NO: 4502 - DNA, 42 bp, Artificial Sequence
  Synthetic
gcagggagcaattagaagactccttgtttgtcaggttgtgtt

SEQ ID NO: 4503 - DNA, 42 bp, Artificial Sequence
  Synthetic
aattgtagaacgtaaaacaggggacactgtcctccacatcct

SEQ ID NO: 4504 - DNA, 42 bp, Artificial Sequence
  Synthetic
ggggctatatccctaggacggcttgggccttatcaaacagcc

SEQ ID NO: 4505 - DNA, 46 bp, Artificial Sequence
  Synthetic
tgtgctttgatagaaaacatcgagcgcatttatgttggaggtcact

SEQ ID NO: 4506 - DNA, 44 bp, Artificial Sequence
  Synthetic
ccaggaaaggcttctagacctccaatgttctatttggtcctcta

SEQ ID NO: 4507 - DNA, 42 bp, Artificial Sequence
  Synthetic
cgtggacattacaggacacatgctactgtttgtccacgtctt

SEQ ID NO: 4508 - DNA, 44 bp, Artificial Sequence
  Synthetic
aaaaggaagcatctaagtatggggagaaaaaatgatgctgctgc

SEQ ID NO: 4509 - DNA, 42 bp, Artificial Sequence
  Synthetic
agatgttaccctacactttgagcatgtccataaaggcgggat

SEQ ID NO: 4510 - DNA, 47 bp, Artificial Sequence
  Synthetic
atttccacaaacacccattgctataagtataactaggatgcaggtaa

SEQ ID NO: 4511 - DNA, 43 bp, Artificial Sequence
  Synthetic
atcctgattaccttaaaatggctgcacatttgttcccgcctta

SEQ ID NO: 4512 - DNA, 43 bp, Artificial Sequence
  Synthetic
cccagggtcaaaacaatggtattgggtggtatctacaactgtt

SEQ ID NO: 4513 - DNA, 40 bp, Artificial Sequence
  Synthetic
ccccagctacaagtagtttggattgacatgcaatggcctg

SEQ ID NO: 4514 - DNA, 36 bp, Artificial Sequence
  Synthetic
actacgtccgccgtctaggtgagcgccggacaaagg

SEQ ID NO: 4515 - DNA, 35 bp, Artificial Sequence
  Synthetic
cgggattcgagcgccccttagggctagcgctacgg

SEQ ID NO: 4516 - DNA, 39 bp, Artificial Sequence
  Synthetic
cgccgtcatcctccacccaaacatagggaggggggattt

SEQ ID NO: 4517 - DNA, 41 bp, Artificial Sequence
  Synthetic
aagacctccaagacctcctgcatgctggtgatggagggaag

SEQ ID NO: 4518 - DNA, 40 bp, Artificial Sequence
  Synthetic
ccttcctgggcctctatcctccgaggcgttctacgaaggc

SEQ ID NO: 4519 - DNA, 38 bp, Artificial Sequence
  Synthetic
cttccggtgcgggaaagcagtgacatagggggcatggc

SEQ ID NO: 4520 - DNA, 39 bp, Artificial Sequence
  Synthetic
tacaggcgccagctgtccttggaactggctgatttcggg

SEQ ID NO: 4521 - DNA, 38 bp, Artificial Sequence
  Synthetic
gacctgcgggccactaactcaggctggacaagtcaggg

SEQ ID NO: 4522 - DNA, 40 bp, Artificial Sequence
  Synthetic
ctggcccatatcctgcagcctgccaggagaatgtcatcca

SEQ ID NO: 4523 - DNA, 42 bp, Artificial Sequence
  Synthetic
aggcatactgatccccgagacccgcagctgcactaatgattg

SEQ ID NO: 4524 - DNA, 40 bp, Artificial Sequence
  Synthetic
ggggcagctacttgcctcagtggtttggcagagtagtcca

SEQ ID NO: 4525 - DNA, 40 bp, Artificial Sequence
  Synthetic
acctgatcccatctccaggcttgcaggacaggggtgatta

SEQ ID NO: 4526 - DNA, 46 bp, Artificial Sequence
  Synthetic
gctattcgccatactacccatgtcatagggttttaagaatgccatt

SEQ ID NO: 4527 - DNA, 37 bp, Artificial Sequence
  Synthetic
agttctgcccagtggatcccgtccgacgggtcttggg

SEQ ID NO: 4528 - DNA, 39 bp, Artificial Sequence
  Synthetic
gttcatggaccctcgacctgcattagggcagggtggctg

SEQ ID NO: 4529 - DNA, 46 bp, Artificial Sequence
  Synthetic
cagcccctactggaaatttcagaatattgaggtgtgaaacttcttg

SEQ ID NO: 4530 - DNA, 35 bp, Artificial Sequence
  Synthetic
gagcagtaccggtggcggttcctgccagccactcc

SEQ ID NO: 4531 - DNA, 40 bp, Artificial Sequence
  Synthetic
atcctccttctcctgcagcaacttggaaggcgaggtggag

SEQ ID NO: 4532 - DNA, 38 bp, Artificial Sequence
  Synthetic
tcgcttcctcttctcctcagcctccaggggggaaagcg

SEQ ID NO: 4533 - DNA, 41 bp, Artificial Sequence
  Synthetic
tatcagcccacttcccagggttccaaacacgtagactgggt

SEQ ID NO: 4534 - DNA, 42 bp, Artificial Sequence
  Synthetic
acccttaaggtccttaccccgcgaggaaggagggtggaatgt

SEQ ID NO: 4535 - DNA, 44 bp, Artificial Sequence
  Synthetic
tcaaaccaaggcctaccaccgagatgcaaattatgaaaggaaga

SEQ ID NO: 4536 - DNA, 41 bp, Artificial Sequence
  Synthetic
taagctcagacctccgggaagcacggcttgacaaacatggg

SEQ ID NO: 4537 - DNA, 37 bp, Artificial Sequence
  Synthetic
acgccggttgagtcgcgtcggacgtagttcaggaggc

SEQ ID NO: 4538 - DNA, 43 bp, Artificial Sequence
  Synthetic
agaagtacacatcagggagacagttcattgccatcatccattt

SEQ ID NO: 4539 - DNA, 45 bp, Artificial Sequence
  Synthetic
aagtcgaaaggttaaaacatggaacggcgtattttgacttggttt

SEQ ID NO: 4540 - DNA, 43 bp, Artificial Sequence
  Synthetic
tggttgcatacatgttagagagagattgttccaccagcaactg

SEQ ID NO: 4541 - DNA, 39 bp, Artificial Sequence
  Synthetic
attggagatgtgccacagcactgcctaagaatgtccacc

SEQ ID NO: 4542 - DNA, 43 bp, Artificial Sequence
  Synthetic
ggaaaagggcaacagctatactcattgactgttcgtctcttcc

SEQ ID NO: 4543 - DNA, 45 bp, Artificial Sequence
  Synthetic
aattggggaattgaacatatcgacacttggagtcatgtctggtaa

SEQ ID NO: 4544 - DNA, 40 bp, Artificial Sequence
  Synthetic
acaggggacagagaaactgactcagggccattaatctccc

SEQ ID NO: 4545 - DNA, 43 bp, Artificial Sequence
  Synthetic
tgtacttgggacatttgataccactctactttgctttggtggg

SEQ ID NO: 4546 - DNA, 39 bp, Artificial Sequence
  Synthetic
gtggagtccgctgttctgagtgatgcttaatgctggtcc

SEQ ID NO: 4547 - DNA, 40 bp, Artificial Sequence
  Synthetic
tatcagaatggaccaggcgattcacactgaagttcgcttt

SEQ ID NO: 4548 - DNA, 44 bp, Artificial Sequence
  Synthetic
aacacagttcgagtctctgaaactcccattctcattactgcttc

SEQ ID NO: 4549 - DNA, 42 bp, Artificial Sequence
  Synthetic
acaggaacaggatacaccatggccactttcccttttctgagt

SEQ ID NO: 4550 - DNA, 39 bp, Artificial Sequence
  Synthetic
ctaactcaaggtcgccagacttatggtgttggccaatgc

SEQ ID NO: 4551 - DNA, 46 bp, Artificial Sequence
  Synthetic
agagcactgacattaaatacgatgacgatagcccttctttttaact

SEQ ID NO: 4552 - DNA, 41 bp, Artificial Sequence
  Synthetic
ctttcacaatcactggggacaaccatcgccaggaacattcg

SEQ ID NO: 4553 - DNA, 42 bp, Artificial Sequence
  Synthetic
gctagcaagcattgacctgaagaagaggccttattttctcaa

SEQ ID NO: 4554 - DNA, 43 bp, Artificial Sequence
  Synthetic
ctcatagtgaatgcaccaaaccaaggtcctgtagaatctgtcc

SEQ ID NO: 4555 - DNA, 42 bp, Artificial Sequence
  Synthetic
cccagatggctcttcaattgttctcccctatggcacctatat

SEQ ID NO: 4556 - DNA, 37 bp, Artificial Sequence
  Synthetic
gacggcctcgctgactggagaatcgtgtgcgcgaaag

SEQ ID NO: 4557 - DNA, 38 bp, Artificial Sequence
  Synthetic
tattgccacgcatccggatcactgggctggggtggttt

SEQ ID NO: 4558 - DNA, 35 bp, Artificial Sequence
  Synthetic
acgccgtccaacttcacgcgttcaccgcgtcgtgc

SEQ ID NO: 4559 - DNA, 42 bp, Artificial Sequence
  Synthetic
tccaataaacccatcccctcgcgacggattcctgaggctaca

SEQ ID NO: 4560 - DNA, 41 bp, Artificial Sequence
  Synthetic
gggacggaggagagacgatgcaggtcggaccatccacccat

SEQ ID NO: 4561 - DNA, 45 bp, Artificial Sequence
  Synthetic
atacaccacatcgttggataatacggacgcgttaatcgaactttc

SEQ ID NO: 4562 - DNA, 41 bp, Artificial Sequence
  Synthetic
cgttatcatctgctcccgctgccggccgctgaaaaaagagt

SEQ ID NO: 4563 - DNA, 40 bp, Artificial Sequence
  Synthetic
cggattccaagtcagagcggcgggtcggtccaggtcaacg

SEQ ID NO: 4564 - DNA, 39 bp, Artificial Sequence
  Synthetic
tcagccacgacgcgagtgacgttatagcgccgtctttcg

SEQ ID NO: 4565 - DNA, 39 bp, Artificial Sequence
  Synthetic
tctcatcaccgagaccgcgggccaggctgtgggtctcgt

SEQ ID NO: 4566 - DNA, 36 bp, Artificial Sequence
  Synthetic
cgcccgatccctccaggtttacgcggtgccgttcac

SEQ ID NO: 4567 - DNA, 38 bp, Artificial Sequence
  Synthetic
catcgggtagacggcgctagcggatccgtcagccagta

SEQ ID NO: 4568 - DNA, 37 bp, Artificial Sequence
  Synthetic
ggaggaaactgccgcgggatcttcctcagagacggcc

SEQ ID NO: 4569 - DNA, 39 bp, Artificial Sequence
  Synthetic
gcacgctgcatggctaaatacccatgacgcgttcgggac

SEQ ID NO: 4570 - DNA, 40 bp, Artificial Sequence
  Synthetic
gcatgaactgcccgtggtggtggagcctcggtttggatac

SEQ ID NO: 4571 - DNA, 36 bp, Artificial Sequence
  Synthetic
tgaggttgcgggccaggttctcggacgagggctatg

SEQ ID NO: 4572 - DNA, 36 bp, Artificial Sequence
  Synthetic
tctgagcgagtcccttgcgcgcagcggctcatcagg

SEQ ID NO: 4573 - DNA, 38 bp, Artificial Sequence
  Synthetic
cgcaagtaatgggtgcgcgatacgtggtgtgcacgttg

SEQ ID NO: 4574 - DNA, 37 bp, Artificial Sequence
  Synthetic
cgagagcccgtcgtgatagtcctacgcggcgacagct

SEQ ID NO: 4575 - DNA, 36 bp, Artificial Sequence
  Synthetic
acatgcgccctgggtctgatcgatgggtccgcttca

SEQ ID NO: 4576 - DNA, 37 bp, Artificial Sequence
  Synthetic
cgtgcgccacgccaagatagtacgactcgtaggccgt

SEQ ID NO: 4577 - DNA, 38 bp, Artificial Sequence
  Synthetic
caggcggtgcagatcggttttcaatgcgggcaggcgtg

SEQ ID NO: 4578 - DNA, 39 bp, Artificial Sequence
  Synthetic
cgggtacgacctgcgatttagcgacagttgagcgcgtcg

SEQ ID NO: 4579 - DNA, 39 bp, Artificial Sequence
  Synthetic
ccgctggtcggtttctgactggcggtgtttccagcattt

SEQ ID NO: 4580 - DNA, 39 bp, Artificial Sequence
  Synthetic
gcgctccacgatctcggcatgtgctagaccgtaccgaat

SEQ ID NO: 4581 - DNA, 38 bp, Artificial Sequence
  Synthetic
accaggacaaggtggtgagctgccgatttttcgccgca

SEQ ID NO: 4582 - DNA, 39 bp, Artificial Sequence
  Synthetic
ggccttggtggacttccaggcggataatctcctgggcca

SEQ ID NO: 4583 - DNA, 40 bp, Artificial Sequence
  Synthetic
agagggctcatccgactctgcccacgctgatgtcctcggg

SEQ ID NO: 4584 - DNA, 39 bp, Artificial Sequence
  Synthetic
caggggcgagtccgtcgtcacgacgccatcaccgagaac

SEQ ID NO: 4585 - DNA, 41 bp, Artificial Sequence
  Synthetic
tcgcgcatagtgtggaagtggtcgcccaccatgaaggattt

SEQ ID NO: 4586 - DNA, 39 bp, Artificial Sequence
  Synthetic
cccctccgtattcttgtcgcgtccaccagctggactacg

SEQ ID NO: 4587 - DNA, 38 bp, Artificial Sequence
  Synthetic
tgctgggcgccaggaaaaacttcatgacgcccaagtgg

SEQ ID NO: 4588 - DNA, 38 bp, Artificial Sequence
  Synthetic
acctgacggtgaaccacccaaatcgcccctcacgtcag

SEQ ID NO: 4589 - DNA, 39 bp, Artificial Sequence
  Synthetic
cggcagcagtacacgtcgagcgcgtacgccgtgtaccac

SEQ ID NO: 4590 - DNA, 38 bp, Artificial Sequence
  Synthetic
cgtcgggcacagacccatggcgaccgggatcacgacga

SEQ ID NO: 4591 - DNA, 37 bp, Artificial Sequence
  Synthetic
gcgtagttgcgcaggccctgtacctggtgtcgcggtc

SEQ ID NO: 4592 - DNA, 41 bp, Artificial Sequence
  Synthetic
cgtaattcaccacgggcacgcccgtgagtgttacttcccca

SEQ ID NO: 4593 - DNA, 37 bp, Artificial Sequence
  Synthetic
actgacagttgcgcaatccgatctccatcgccagcgc

SEQ ID NO: 4594 - DNA, 38 bp, Artificial Sequence
  Synthetic
gcgcgttgccccaaaccactttgatttgagcgtgctgc

SEQ ID NO: 4595 - DNA, 35 bp, Artificial Sequence
  Synthetic
acaagccccagcaaccggtacccaagctggccgag

SEQ ID NO: 4596 - DNA, 36 bp, Artificial Sequence
  Synthetic
aagctacagcgctcgcggcactggcagaccttggtc

SEQ ID NO: 4597 - DNA, 38 bp, Artificial Sequence
  Synthetic
gggccacgctgacggctttttacggtctggatctcgcg

SEQ ID NO: 4598 - DNA, 37 bp, Artificial Sequence
  Synthetic
cggcttgaacgagcgccttgtcgctgctgatctgacg

SEQ ID NO: 4599 - DNA, 34 bp, Artificial Sequence
  Synthetic
gcgctacgaacccgcacagcctggcttacgggga

SEQ ID NO: 4600 - DNA, 35 bp, Artificial Sequence
  Synthetic
tacgcgcacgccaaaccgcgcgccaacgagttgac

SEQ ID NO: 4601 - DNA, 36 bp, Artificial Sequence
  Synthetic
ggcttcggcgtgcagctgtcgccacatccagcatgt

SEQ ID NO: 4602 - DNA, 40 bp, Artificial Sequence
  Synthetic
gttggacgacaacgccaagcgcaactctagcattttggcg

SEQ ID NO: 4603 - DNA, 39 bp, Artificial Sequence
  Synthetic
gtgcagcagcgcctacagagcgtttcctcttcctcttcg

SEQ ID NO: 4604 - DNA, 40 bp, Artificial Sequence
  Synthetic
tcaaccaggacttgctgtcggccgttgatccgcccgtcta

SEQ ID NO: 4605 - DNA, 37 bp, Artificial Sequence
  Synthetic
tgaccacccccgacgccaaacagctcgcgaagtgtct

SEQ ID NO: 4606 - DNA, 37 bp, Artificial Sequence
  Synthetic
cggaagcaggacccactaccgtgcgctagcgtcacgg

SEQ ID NO: 4607 - DNA, 38 bp, Artificial Sequence
  Synthetic
caaacagctgtcgcggtactcgacttcgcacgggcacg

SEQ ID NO: 4608 - DNA, 36 bp, Artificial Sequence
  Synthetic
cgccacagcagagccagcactttgcgactctgggcc

SEQ ID NO: 4609 - DNA, 40 bp, Artificial Sequence
  Synthetic
agctcgatgttgaacaccgacgcggagtgctgacgaagtg

SEQ ID NO: 4610 - DNA, 42 bp, Artificial Sequence
  Synthetic
tcgttttcctcctctccgtcgtgaatgtcctgggctaagcag

SEQ ID NO: 4611 - DNA, 39 bp, Artificial Sequence
  Synthetic
accagtctcagtctcagcagcattgagaaacagcggcgg

SEQ ID NO: 4612 - DNA, 40 bp, Artificial Sequence
  Synthetic
ctgttgctctcctctaccccgcgtcggacgcgattgatgg

SEQ ID NO: 4613 - DNA, 38 bp, Artificial Sequence
  Synthetic
ccactactgccggagccgagctccggcagtaacagtag

SEQ ID NO: 4614 - DNA, 41 bp, Artificial Sequence
  Synthetic
atagcggcgttaggtgacacgtacagcaaaggtacgacggt

SEQ ID NO: 4615 - DNA, 35 bp, Artificial Sequence
  Synthetic
gttgcgcacccgtaagccgagggggaggggcgaat

SEQ ID NO: 4616 - DNA, 39 bp, Artificial Sequence
  Synthetic
gctgctgttgctgctgttgttgagcagcaacagtcgcag

SEQ ID NO: 4617 - DNA, 39 bp, Artificial Sequence
  Synthetic
ggggatctcctcacgcacgcggattgcgaccccgaagtg

SEQ ID NO: 4618 - DNA, 39 bp, Artificial Sequence
  Synthetic
gccacaaagtcgcttttgccgctcatcgaccccgtgacg

SEQ ID NO: 4619 - DNA, 38 bp, Artificial Sequence
  Synthetic
cctcgcacagccgatgcaccatacgcaaggcatcgtgg

SEQ ID NO: 4620 - DNA, 38 bp, Artificial Sequence
  Synthetic
gcgatcaccacgctcgaggaacgcaggagattctggcc

SEQ ID NO: 4621 - DNA, 37 bp, Artificial Sequence
  Synthetic
cagccagaccgctagccgaaagccgtcccgaacatca

SEQ ID NO: 4622 - DNA, 39 bp, Artificial Sequence
  Synthetic
acccggcgtgtcgactcgtagggaaaaaaaggtggggcc

SEQ ID NO: 4623 - DNA, 35 bp, Artificial Sequence
  Synthetic
gcggactgcaccgggatgatctcacggcggcagtc

SEQ ID NO: 4624 - DNA, 36 bp, Artificial Sequence
  Synthetic
cgaccgcgcggctgatgatacgtctggcaccctacc

SEQ ID NO: 4625 - DNA, 41 bp, Artificial Sequence
  Synthetic
tgaagaaatagaccgggtgccgtctggatgaccgtatgggc

SEQ ID NO: 4626 - DNA, 35 bp, Artificial Sequence
  Synthetic
gaggccacggcgcagaagaaccgctgcccgtctac

SEQ ID NO: 4627 - DNA, 37 bp, Artificial Sequence
  Synthetic
cgcgccggtactcgagcaaacgtctacctggcctacc

SEQ ID NO: 4628 - DNA, 35 bp, Artificial Sequence
  Synthetic
agcggctgctggaagagggcgggtgacggcgacat

SEQ ID NO: 4629 - DNA, 38 bp, Artificial Sequence
  Synthetic
cacctggacatctaccgtcgccacaggcggttgagcgc

SEQ ID NO: 4630 - DNA, 35 bp, Artificial Sequence
  Synthetic
tgcctcagctgttaccgcggccttcccaagcggca

SEQ ID NO: 4631 - DNA, 35 bp, Artificial Sequence
  Synthetic
gctggtgcggcttttccacatcgtcccgtagcccg

SEQ ID NO: 4632 - DNA, 35 bp, Artificial Sequence
  Synthetic
ctcggtgagcgggtagcgaagcctgcgactgctgc

SEQ ID NO: 4633 - DNA, 39 bp, Artificial Sequence
  Synthetic
cagggccagggacagccttgtcgtcgtggttgatgttga

SEQ ID NO: 4634 - DNA, 37 bp, Artificial Sequence
  Synthetic
cgcaccctctgagtgctgcctgccacggtagcacctg

SEQ ID NO: 4635 - DNA, 36 bp, Artificial Sequence
  Synthetic
ccgtcttatcccgtgccgcataccgcccggagagtc

SEQ ID NO: 4636 - DNA, 39 bp, Artificial Sequence
  Synthetic
cgtaaggaaaccgcggcgggcctgggaaactcaagtctt

SEQ ID NO: 4637 - DNA, 39 bp, Artificial Sequence
  Synthetic
acagtccggcttgggtgtccatgtttgccggcttcgagg

SEQ ID NO: 4638 - DNA, 37 bp, Artificial Sequence
  Synthetic
cgcggagggtgattcgcactcccgggcgtctccatag

SEQ ID NO: 4639 - DNA, 41 bp, Artificial Sequence
  Synthetic
agttgttgaggtccaccagcagtaaacatcaagggccgctg

SEQ ID NO: 4640 - DNA, 36 bp, Artificial Sequence
  Synthetic
agacgaccggcttccagcgactgccaggtgcttcgg

SEQ ID NO: 4641 - DNA, 34 bp, Artificial Sequence
  Synthetic
gcttgcccgacgcgtgaaggccgagcgcaaacac

SEQ ID NO: 4642 - DNA, 40 bp, Artificial Sequence
  Synthetic
gcacgttgaccgacacgttctacaatcagctgcaggtgca

SEQ ID NO: 4643 - DNA, 39 bp, Artificial Sequence
  Synthetic
gctgttgcgacggcgaatgacgcaccaagtcaaatccac

SEQ ID NO: 4644 - DNA, 36 bp, Artificial Sequence
  Synthetic
ccggagcgtggcggtacaaggtgcgacgacccttct

SEQ ID NO: 4645 - DNA, 38 bp, Artificial Sequence
  Synthetic
cgtgtcgtacgcgcaccgttgataccgcggaatcaacg

SEQ ID NO: 4646 - DNA, 42 bp, Artificial Sequence
  Synthetic
tcagctccgaggctaggttagctgatcgacatgaagaccgcc

SEQ ID NO: 4647 - DNA, 40 bp, Artificial Sequence
  Synthetic
gaggcccatgatgagtagtcgcgccctggatcgtacccat

SEQ ID NO: 4648 - DNA, 38 bp, Artificial Sequence
  Synthetic
gcggccggcatcaggagaaacctcaagacgctgctagt

SEQ ID NO: 4649 - DNA, 39 bp, Artificial Sequence
  Synthetic
ccgatagcggttcctcagccaggtaacgcgcatctcagc

SEQ ID NO: 4650 - DNA, 35 bp, Artificial Sequence
  Synthetic
agggtggtccgcgttccgttgtgccacccggtgct

SEQ ID NO: 4651 - DNA, 37 bp, Artificial Sequence
  Synthetic
ccgaccagttctccatcgcgtgctttccccgagctcc

SEQ ID NO: 4652 - DNA, 39 bp, Artificial Sequence
  Synthetic
cccgtggccgtaccctgttgtaccagatgttcaccgtgg

SEQ ID NO: 4653 - DNA, 40 bp, Artificial Sequence
  Synthetic
cacgcatgtgctacgcggattagaggctcggcaattctcg

SEQ ID NO: 4654 - DNA, 36 bp, Artificial Sequence
  Synthetic
cgacgagcgcgggtcacaaacgtcgaacgcgatcgg

SEQ ID NO: 4655 - DNA, 38 bp, Artificial Sequence
  Synthetic
ctgacgccacgccgccattgtgttcctgataggcccgg

SEQ ID NO: 4656 - DNA, 35 bp, Artificial Sequence
  Synthetic
tgctgctctgcacgctctgacaccaaccaggcggc

SEQ ID NO: 4657 - DNA, 39 bp, Artificial Sequence
  Synthetic
gcgtcgcccttctccgtgatcaacgtggtctcttacgtg

SEQ ID NO: 4658 - DNA, 39 bp, Artificial Sequence
  Synthetic
cgtcgtggagacaagcaacaccagttttgggggcggagg

SEQ ID NO: 4659 - DNA, 37 bp, Artificial Sequence
  Synthetic
gtgctcagcggcgtgtacagcttggatcacgtcggcg

SEQ ID NO: 4660 - DNA, 36 bp, Artificial Sequence
  Synthetic
ggtagcgcttgcggcacaccacctcctgcatctcca

SEQ ID NO: 4661 - DNA, 39 bp, Artificial Sequence
  Synthetic
gcagcggcgagaggagaggattcaggtggatcctccgtc

SEQ ID NO: 4662 - DNA, 38 bp, Artificial Sequence
  Synthetic
tcctctcagtttccccgtctccacgtcgaaaccccggc

SEQ ID NO: 4663 - DNA, 37 bp, Artificial Sequence
  Synthetic
gtggtgccgtccacgtcgtgcaagccgtggtaaccgt

SEQ ID NO: 4664 - DNA, 35 bp, Artificial Sequence
  Synthetic
gcacgcgcgtttccccgtaagcgccgacaactccg

SEQ ID NO: 4665 - DNA, 37 bp, Artificial Sequence
  Synthetic
cggcaagctcacgcactgccgtagctcatttgcgccg

SEQ ID NO: 4666 - DNA, 35 bp, Artificial Sequence
  Synthetic
cggaacgtgacggttgccgttttccccgccggtgg

SEQ ID NO: 4667 - DNA, 37 bp, Artificial Sequence
  Synthetic
tgacgacggggaggatgacgagccactaccgcagagc

SEQ ID NO: 4668 - DNA, 39 bp, Artificial Sequence
  Synthetic
atcggctcgtatcccgaagtgctcagagacgcgttccgc

SEQ ID NO: 4669 - DNA, 36 bp, Artificial Sequence
  Synthetic
ccgtcctggcacgcctcttcagacgcagacaggtgc

SEQ ID NO: 4670 - DNA, 39 bp, Artificial Sequence
  Synthetic
cccggcgtgctgttggtctccgttgccgtagaagaagtt

SEQ ID NO: 4671 - DNA, 38 bp, Artificial Sequence
  Synthetic
agagcctcacctgcgtgacgtttctgggctactccgcc

SEQ ID NO: 4672 - DNA, 40 bp, Artificial Sequence
  Synthetic
gagcacttgcggctccatgagctggaggtccatacggatt

SEQ ID NO: 4673 - DNA, 37 bp, Artificial Sequence
  Synthetic
gcccgtcgtagcgcagaataagctgctgttcaccacg

SEQ ID NO: 4674 - DNA, 40 bp, Artificial Sequence
  Synthetic
caacgccgcgtgtaacttccacgctctttgacaccatcac

SEQ ID NO: 4675 - DNA, 36 bp, Artificial Sequence
  Synthetic
atatgtgggagcgcaaggccagaggtcctcgcaggc

SEQ ID NO: 4676 - DNA, 36 bp, Artificial Sequence
  Synthetic
gcgactttaccgcgaacgccggtctgcgtgggcgaa

SEQ ID NO: 4677 - DNA, 41 bp, Artificial Sequence
  Synthetic
tgcctgtccaaccaccatgacgtgtgatccatgagttcggc

SEQ ID NO: 4678 - DNA, 40 bp, Artificial Sequence
  Synthetic
gctcatgcagcgtctcacggggcgattgtaggtaacgagc

SEQ ID NO: 4679 - DNA, 36 bp, Artificial Sequence
  Synthetic
acaccagcgacaacgtgctctgcaccacctcggggt

SEQ ID NO: 4680 - DNA, 38 bp, Artificial Sequence
  Synthetic
cgtgtgcaccaccgtggagactcttggcgatggtcatg

SEQ ID NO: 4681 - DNA, 36 bp, Artificial Sequence
  Synthetic
cgtgcaccacggtgaacacgttgcctggacgcctgg

SEQ ID NO: 4682 - DNA, 39 bp, Artificial Sequence
  Synthetic
ggcgctgtgtccgagctcacctgctgtacaacaatccgg

SEQ ID NO: 4683 - DNA, 40 bp, Artificial Sequence
  Synthetic
ccaggtgagaaagagaagccgcctctcatcgtgccgcaga

SEQ ID NO: 4684 - DNA, 39 bp, Artificial Sequence
  Synthetic
cggcagcggtggtactggtatgcttactgtgtgaagcgg

SEQ ID NO: 4685 - DNA, 35 bp, Artificial Sequence
  Synthetic
gtccagaacgcggttgggaacgccacaggccgtag

SEQ ID NO: 4686 - DNA, 40 bp, Artificial Sequence
  Synthetic
catgttgccgtgtgacgagacgaggtgacgcgacctcctg

SEQ ID NO: 4687 - DNA, 41 bp, Artificial Sequence
  Synthetic
tgggcgatgcacaactctttctgctacggctgctgatacga

SEQ ID NO: 4688 - DNA, 35 bp, Artificial Sequence
  Synthetic
ggtggtggtgggcatcgtgcgctcggcagctcctt

SEQ ID NO: 4689 - DNA, 40 bp, Artificial Sequence
  Synthetic
gtcgcctcggtagctcagtagtctacggaccgtctgtcga

SEQ ID NO: 4690 - DNA, 48 bp, Artificial Sequence
  Synthetic
cgataggcggctataagatagagattgtctctctttatctttcttgtg

SEQ ID NO: 4691 - DNA, 41 bp, Artificial Sequence
  Synthetic
tatggttcttaggcgcgcatcaagtcatgattcgtaactgc

SEQ ID NO: 4692 - DNA, 38 bp, Artificial Sequence
  Synthetic
ccggcgtgcagcaaggttcgcttcgtaattctgacgca

SEQ ID NO: 4693 - DNA, 38 bp, Artificial Sequence
  Synthetic
tccctcggcgaccaacaccaagatgtgggccgagaact

SEQ ID NO: 4694 - DNA, 37 bp, Artificial Sequence
  Synthetic
gtagcgggagatacggcgttcaagccgccgttcaagc

SEQ ID NO: 4695 - DNA, 39 bp, Artificial Sequence
  Synthetic
gctatcgtcgccggtttcgggtggtggacgagacgagac

SEQ ID NO: 4696 - DNA, 37 bp, Artificial Sequence
  Synthetic
tcggcgttttcgggaagggcaaacccaagccggtcgg

SEQ ID NO: 4697 - DNA, 36 bp, Artificial Sequence
  Synthetic
cgacgcgatcacggtaaccctacgctagcggggctg

SEQ ID NO: 4698 - DNA, 42 bp, Artificial Sequence
  Synthetic
gcgttgtctcgcctatcagcgttaacgtgggtttcaggggaa

SEQ ID NO: 4699 - DNA, 37 bp, Artificial Sequence
  Synthetic
tacgagaccccgaggtacgcactgcagaccgtacggg

SEQ ID NO: 4700 - DNA, 36 bp, Artificial Sequence
  Synthetic
cggaacggcgtttcactgccttctgcaccgccgacg

SEQ ID NO: 4701 - DNA, 37 bp, Artificial Sequence
  Synthetic
gcgtggcagggctggaagaacccagcactccatcgac

SEQ ID NO: 4702 - DNA, 37 bp, Artificial Sequence
  Synthetic
accggtgtggaagccgaggcatacgccacagcatgcg

SEQ ID NO: 4703 - DNA, 35 bp, Artificial Sequence
  Synthetic
acatgggccatgtgtggtggtgtgcactgccgcga

SEQ ID NO: 4704 - DNA, 40 bp, Artificial Sequence
  Synthetic
ctccgggttcctgccttttccaaggccgtggaaaaccacc

SEQ ID NO: 4705 - DNA, 40 bp, Artificial Sequence
  Synthetic
aacaacgcagactgctgaaggccaggcatgggtctgtcga

SEQ ID NO: 4706 - DNA, 37 bp, Artificial Sequence
  Synthetic
agcttctccccgactccgcgagactggcagggacacg

SEQ ID NO: 4707 - DNA, 40 bp, Artificial Sequence
  Synthetic
cgataccaccacattcaggggcctggccgtcctgttcctg

SEQ ID NO: 4708 - DNA, 35 bp, Artificial Sequence
  Synthetic
gggactttccacacggcggaccgttgacgtgggcg

SEQ ID NO: 4709 - DNA, 40 bp, Artificial Sequence
  Synthetic
tcgacgacaggtgcggattagtgcgacagacatccccctg

SEQ ID NO: 4710 - DNA, 41 bp, Artificial Sequence
  Synthetic
caacaataccgccctacgttggttcagtgttggatcagact

SEQ ID NO: 4711 - DNA, 38 bp, Artificial Sequence
  Synthetic
ggacgtaacattcggacacggactcgcgggtttgggga

SEQ ID NO: 4712 - DNA, 35 bp, Artificial Sequence
  Synthetic
ggcgacgacagttccgtgggaaggcaccgcgacag

SEQ ID NO: 4713 - DNA, 35 bp, Artificial Sequence
  Synthetic
ccggcggtggtgaacgagaaccccagcaacggcct

SEQ ID NO: 4714 - DNA, 41 bp, Artificial Sequence
  Synthetic
gtaacccagccaaaccagcgcgattgctgacgctggaaacc

SEQ ID NO: 4715 - DNA, 36 bp, Artificial Sequence
  Synthetic
ccgtgccatcggtgggtaccagagaacgcagcgcac

SEQ ID NO: 4716 - DNA, 40 bp, Artificial Sequence
  Synthetic
gcgagaaccggtcgctcatagctcctcctggtgcctgtgg

SEQ ID NO: 4717 - DNA, 37 bp, Artificial Sequence
  Synthetic
ggaggctatatgaccgcgcggggccgcccaaacatct

SEQ ID NO: 4718 - DNA, 41 bp, Artificial Sequence
  Synthetic
ccttcatcgcgtttgccgtgccccttgagtttgatggtgcc

SEQ ID NO: 4719 - DNA, 39 bp, Artificial Sequence
  Synthetic
aaacgggcgcggttttataggccgggactttgacagccg

SEQ ID NO: 4720 - DNA, 40 bp, Artificial Sequence
  Synthetic
agctgatgcatttccagcgacgtctcctttacggggctgg

SEQ ID NO: 4721 - DNA, 38 bp, Artificial Sequence
  Synthetic
ttctctgtggtcggcgagtctgggcctgaagcgatgga

SEQ ID NO: 4722 - DNA, 37 bp, Artificial Sequence
  Synthetic
gcagtgctacggtggttccctacgatcctccggcgct

SEQ ID NO: 4723 - DNA, 38 bp, Artificial Sequence
  Synthetic
tggtaaagtgaagacgcgccgcaggctggaacgcaacg

SEQ ID NO: 4724 - DNA, 38 bp, Artificial Sequence
  Synthetic
gtgacgcagcagcatcgctccacagacgccgtttgcta

SEQ ID NO: 4725 - DNA, 41 bp, Artificial Sequence
  Synthetic
acacctggtcgacgtggttacgttgagtgccagtacagcgc

SEQ ID NO: 4726 - DNA, 36 bp, Artificial Sequence
  Synthetic
gtcagggccagaacccgcaggtgacgccggttgtcc

SEQ ID NO: 4727 - DNA, 40 bp, Artificial Sequence
  Synthetic
ccctgctgttggctacctctctttcctgtgcaccgtcatc

SEQ ID NO: 4728 - DNA, 39 bp, Artificial Sequence
  Synthetic
cgcatctgctcgccgtagattggatgattttgcgcgaca

SEQ ID NO: 4729 - DNA, 38 bp, Artificial Sequence
  Synthetic
acgagcacgcttccgaggggaagatcgtcctctcgccg

SEQ ID NO: 4730 - DNA, 39 bp, Artificial Sequence
  Synthetic
gaccgagccagagggacctccgacaggtaagatgtggct

SEQ ID NO: 4731 - DNA, 36 bp, Artificial Sequence
  Synthetic
cgtggaaaaccacccggcagtcctccgggttcctgc

SEQ ID NO: 4732 - DNA, 40 bp, Artificial Sequence
  Synthetic
cgggggggtgaaatttggagtgcagcacacgcaactagtc

SEQ ID NO: 4733 - DNA, 47 bp, Artificial Sequence
  Synthetic
aagttcgctgcaatatgcacaccaatgaaatggaagtctgaatacat

SEQ ID NO: 4734 - DNA, 48 bp, Artificial Sequence
  Synthetic
aggaaaaccgattcactgaaattggtcggattttatcttgttagcttt

SEQ ID NO: 4735 - DNA, 39 bp, Artificial Sequence
  Synthetic
aatcacagggaccatgcgtaaaggctggagaagttaggt

SEQ ID NO: 4736 - DNA, 42 bp, Artificial Sequence
  Synthetic
ctgcaaagatattggcgatctgatgctatcgatctgagctct

SEQ ID NO: 4737 - DNA, 39 bp, Artificial Sequence
  Synthetic
cattgcagggccactgagtaccatccatggctgcacaag

SEQ ID NO: 4738 - DNA, 42 bp, Artificial Sequence
  Synthetic
ttctcccttactgacccaaggcctacttcaagaacacagtac

SEQ ID NO: 4739 - DNA, 39 bp, Artificial Sequence
  Synthetic
aaacagatcggagacatggccaaggttctgcacaccttc

SEQ ID NO: 4740 - DNA, 41 bp, Artificial Sequence
  Synthetic
agaatggttagcggcattggggaatcagcctcccttcattg

SEQ ID NO: 4741 - DNA, 40 bp, Artificial Sequence
  Synthetic
gcgacaagcgaacaatggagatgccatatcatcagatggg

SEQ ID NO: 4742 - DNA, 43 bp, Artificial Sequence
  Synthetic
agaaggacaagaattgcatatgagagtgctgctgtttggaatt

SEQ ID NO: 4743 - DNA, 48 bp, Artificial Sequence
  Synthetic
atgagaacatggaagcaatggacttcttatagcccaatatctacttct

SEQ ID NO: 4744 - DNA, 40 bp, Artificial Sequence
  Synthetic
ggaagtgaaaattgatgacggcgaggctcagagttcactc

SEQ ID NO: 4745 - DNA, 46 bp, Artificial Sequence
  Synthetic
tttggtggacaacttttttaacgagtcgtaaagagacggaacataa

SEQ ID NO: 4746 - DNA, 40 bp, Artificial Sequence
  Synthetic
aagacgagcaagacgagaacgggttccctatcagcggcag

SEQ ID NO: 4747 - DNA, 44 bp, Artificial Sequence
  Synthetic
agaggaagaaagagaacaaacagtgcaggtgctcaaagtccatt

SEQ ID NO: 4748 - DNA, 43 bp, Artificial Sequence
  Synthetic
aaacacttcaggtttttggaggttcaccctatttaccaccttg

SEQ ID NO: 4749 - DNA, 40 bp, Artificial Sequence
  Synthetic
ctgccgacgttgcaagaggatttacttctccaccaccgca

SEQ ID NO: 4750 - DNA, 46 bp, Artificial Sequence
  Synthetic
tataggtaacggggcaatagttgagtgcattcgacatctaaaagca

SEQ ID NO: 4751 - DNA, 45 bp, Artificial Sequence
  Synthetic
tgaagggaatggctattttaaagcacaaaacgtcgcatagtttga

SEQ ID NO: 4752 - DNA, 40 bp, Artificial Sequence
  Synthetic
tgatgatactcgacatcgttgctagcacaatgggacgaag

SEQ ID NO: 4753 - DNA, 41 bp, Artificial Sequence
  Synthetic
cgcttctacggctcgcagtatagcattcgaagccaagtgat

SEQ ID NO: 4754 - DNA, 40 bp, Artificial Sequence
  Synthetic
gcattaggccatctttgggatcactaacccggaacatgaa

SEQ ID NO: 4755 - DNA, 40 bp, Artificial Sequence
  Synthetic
cgaaaacggtgtagccagtactttccatgcctttccttct

SEQ ID NO: 4756 - DNA, 39 bp, Artificial Sequence
  Synthetic
ttaacgaggtgcagctgccgcgcgtccgacaaatgatga

SEQ ID NO: 4757 - DNA, 40 bp, Artificial Sequence
  Synthetic
gggtttggctggctgttgctggacaaaaccctcgtccatt

SEQ ID NO: 4758 - DNA, 39 bp, Artificial Sequence
  Synthetic
ggcgtacagttttggagccaagttattgtggcgcagatg

SEQ ID NO: 4759 - DNA, 42 bp, Artificial Sequence
  Synthetic
ctctgacacaaaagctctagtccaaacgatcggtacccttcc

SEQ ID NO: 4760 - DNA, 47 bp, Artificial Sequence
  Synthetic
acgtgtcagtttctataaacgatgatgatcaaatggaagaaagccta

SEQ ID NO: 4761 - DNA, 41 bp, Artificial Sequence
  Synthetic
tgcgctcgtcagatagcaagccggtgaagtagttaccagcg

SEQ ID NO: 4762 - DNA, 40 bp, Artificial Sequence
  Synthetic
agtaggatagcacctgccgccgcgccttcacatgagctat

SEQ ID NO: 4763 - DNA, 44 bp, Artificial Sequence
  Synthetic
agcatataaaactgatttaccgcctttaagaaaggctgcacaag

SEQ ID NO: 4764 - DNA, 47 bp, Artificial Sequence
  Synthetic
aagcggttattgattacctgagcgagttgtatatagtaggacacaat

SEQ ID NO: 4765 - DNA, 43 bp, Artificial Sequence
  Synthetic
agagtctttttcccattggtccctcttgtcaaacatgccttac

SEQ ID NO: 4766 - DNA, 38 bp, Artificial Sequence
  Synthetic
gcatcgttgcacgggctgtactgctttctggtgcgagg

SEQ ID NO: 4767 - DNA, 41 bp, Artificial Sequence
  Synthetic
cggaaacgggaaatcagggcggcggacatgcttttctctct

SEQ ID NO: 4768 - DNA, 35 bp, Artificial Sequence
  Synthetic
ggttcgggtcctgcgggaatcccctgccagagcgt

SEQ ID NO: 4769 - DNA, 44 bp, Artificial Sequence
  Synthetic
gctgcaaggtcattagatatccgggaacgaaattggactaaacg

SEQ ID NO: 4770 - DNA, 40 bp, Artificial Sequence
  Synthetic
gctcgaccgttttcacgtggtgcaacgcctcatttcccat

SEQ ID NO: 4771 - DNA, 42 bp, Artificial Sequence
  Synthetic
ttgaagtaagctgttttaagcccagcctgcgaattcaacaag

SEQ ID NO: 4772 - DNA, 43 bp, Artificial Sequence
  Synthetic
taagctcctgcattaatggtgtagacacagaaactgtacagcc

SEQ ID NO: 4773 - DNA, 42 bp, Artificial Sequence
  Synthetic
tgttgctcgcataaattcgcggcgtggcaactattgaacgct

SEQ ID NO: 4774 - DNA, 42 bp, Artificial Sequence
  Synthetic
gctatgagcacaagtgaggcgcaagactcctctccgtgtctg

SEQ ID NO: 4775 - DNA, 35 bp, Artificial Sequence
  Synthetic
gacaacagcggggaggaagcaaatccgcggcgcag

SEQ ID NO: 4776 - DNA, 48 bp, Artificial Sequence
  Synthetic
tgtacataatccagcaagtaaaccccattgtctctactatgttgaact

SEQ ID NO: 4777 - DNA, 38 bp, Artificial Sequence
  Synthetic
tgctgacgtcactggcgatgacgccggtcgctgcatct

SEQ ID NO: 4778 - DNA, 38 bp, Artificial Sequence
  Synthetic
catccgcaaagatgaggctgctgttatagcgtgccacg

SEQ ID NO: 4779 - DNA, 44 bp, Artificial Sequence
  Synthetic
caaacgtccaggcagggtttcttgcaaatttttaaaagcctgag

SEQ ID NO: 4780 - DNA, 41 bp, Artificial Sequence
  Synthetic
ccccctcctggattttacactgactgtccgtaacatcatcc

SEQ ID NO: 4781 - DNA, 42 bp, Artificial Sequence
  Synthetic
cacatgcgggggatgaaggaagagcaaatgggtttcctgacc

SEQ ID NO: 4782 - DNA, 43 bp, Artificial Sequence
  Synthetic
gtttaccaccaaatttaaggccaggatggtttggccttcgttg

SEQ ID NO: 4783 - DNA, 41 bp, Artificial Sequence
  Synthetic
aactccgggagtgtacactaatgaaaatcaaccccgcaacc

SEQ ID NO: 4784 - DNA, 39 bp, Artificial Sequence
  Synthetic
tatcgcagctggtatttggcagtccatgaccgaactcct

SEQ ID NO: 4785 - DNA, 39 bp, Artificial Sequence
  Synthetic
cgtacgcggacattaccgagccgtctacagtggtgcgac

SEQ ID NO: 4786 - DNA, 38 bp, Artificial Sequence
  Synthetic
gctgcggccgcaacagctatcgcgcacccagtatacat

SEQ ID NO: 4787 - DNA, 41 bp, Artificial Sequence
  Synthetic
cgcccagacgtagggtacagtccgggagaaaaaaccactgt

SEQ ID NO: 4788 - DNA, 46 bp, Artificial Sequence
  Synthetic
acgtactagagcacatgaaggtcttttttatcggacgtacttttac

SEQ ID NO: 4789 - DNA, 39 bp, Artificial Sequence
  Synthetic
cgccgtagacgtcgacgcattgtacaacgcgacgtactg

SEQ ID NO: 4790 - DNA, 42 bp, Artificial Sequence
  Synthetic
ccaaccaaaggagaaaagcggcggttctgttgtgtgcgttac

SEQ ID NO: 4791 - DNA, 38 bp, Artificial Sequence
  Synthetic
cactccctcgatgatgccgcactccgaggcatcctgac

SEQ ID NO: 4792 - DNA, 42 bp, Artificial Sequence
  Synthetic
ttaagccctattccggaaccgcttgtgaagcattaggagcgc

SEQ ID NO: 4793 - DNA, 44 bp, Artificial Sequence
  Synthetic
ctgctcaagttgtgttctataccggcttaaacacaagatgcgtg

SEQ ID NO: 4794 - DNA, 42 bp, Artificial Sequence
  Synthetic
cgttcgcgttattgagaatcacgcctactgcgctaagaggaa

SEQ ID NO: 4795 - DNA, 46 bp, Artificial Sequence
  Synthetic
aacaagaacacctacgagtacatgcgatattgacataggtatccac

SEQ ID NO: 4796 - DNA, 40 bp, Artificial Sequence
  Synthetic
gggaaatgatcttcgggtggatgtgccatgggaaaaaagt

SEQ ID NO: 4797 - DNA, 44 bp, Artificial Sequence
  Synthetic
gtgtcaatcatgtttgactcctccttcatttggggttagcaaac

SEQ ID NO: 4798 - DNA, 39 bp, Artificial Sequence
  Synthetic
ggatacctgggccccactatcacagctgtttggcctata

SEQ ID NO: 4799 - DNA, 40 bp, Artificial Sequence
  Synthetic
tttccgggttttgtgtctcgcggtgtacgcccccagtttc

SEQ ID NO: 4800 - DNA, 45 bp, Artificial Sequence
  Synthetic
atggataaaaatcccactatggacccctgaggactttgtagcata

SEQ ID NO: 4801 - DNA, 40 bp, Artificial Sequence
  Synthetic
ccacagctggcgcacaagttggccctaattgcgacttcaa

SEQ ID NO: 4802 - DNA, 46 bp, Artificial Sequence
  Synthetic
gctatttgagccttcattccttcaggaataattctttctccggaaa

SEQ ID NO: 4803 - DNA, 39 bp, Artificial Sequence
  Synthetic
accggtgggttcccaggaatttcaggagctcatgggacg

SEQ ID NO: 4804 - DNA, 42 bp, Artificial Sequence
  Synthetic
acattcttttcattttcgtcgctgaaatggaaaccaggcagg

SEQ ID NO: 4805 - DNA, 40 bp, Artificial Sequence
  Synthetic
aaaacgctgggctcgaggactgctttgtcgctgtagatgt

SEQ ID NO: 4806 - DNA, 45 bp, Artificial Sequence
  Synthetic
ttcttgctttaagggctggcgacctaaaccttcaaaaattttagg

SEQ ID NO: 4807 - DNA, 42 bp, Artificial Sequence
  Synthetic
atggaaagccggttgtaagcgacgctgttgtagttcgttgga

SEQ ID NO: 4808 - DNA, 43 bp, Artificial Sequence
  Synthetic
aaccttcgagaactaaacaaactgttgtccgttcgtcaaaacc

SEQ ID NO: 4809 - DNA, 42 bp, Artificial Sequence
  Synthetic
ttcacgacgaacctaagacttaccggttcaaatttgcgcagg

SEQ ID NO: 4810 - DNA, 41 bp, Artificial Sequence
  Synthetic
cgcagcaacgctcaaagaaacactgcctgactctcccaaga

SEQ ID NO: 4811 - DNA, 42 bp, Artificial Sequence
  Synthetic
tgtagcctgctttcagcactgcgaatcgccactccatcatgg

SEQ ID NO: 4812 - DNA, 43 bp, Artificial Sequence
  Synthetic
ccgcagctgtctctacctcaagtatttattgaacagagcttct

SEQ ID NO: 4813 - DNA, 42 bp, Artificial Sequence
  Synthetic
ttaaccctccctcttggccagccgaggcaaaagtacagtggt

SEQ ID NO: 4814 - DNA, 43 bp, Artificial Sequence
  Synthetic
tgaagatttctgctgtcatttgtgtcttcttcaggcggtacag

SEQ ID NO: 4815 - DNA, 42 bp, Artificial Sequence
  Synthetic
ttgttgctccagttattgacaaacgaaggagaaactgcctcg

SEQ ID NO: 4816 - DNA, 41 bp, Artificial Sequence
  Synthetic
gtatgctcaaacagccgaaagaagggttacattatggccag

SEQ ID NO: 4817 - DNA, 43 bp, Artificial Sequence
  Synthetic
atacggtaagggcagcccaaagcttttagtaatacctgaaaca

SEQ ID NO: 4818 - DNA, 41 bp, Artificial Sequence
  Synthetic
ttctcatctttttatgcctgccaatcaaggtcactgactgc

SEQ ID NO: 4819 - DNA, 39 bp, Artificial Sequence
  Synthetic
cccccaggatgatttacccctaacaacagaaggaggacg

SEQ ID NO: 4820 - DNA, 38 bp, Artificial Sequence
  Synthetic
tcaactgtgctacacgctgcaataggtaccgagcccac

SEQ ID NO: 4821 - DNA, 43 bp, Artificial Sequence
  Synthetic
aaatggaaggtcagattcttcttcccatactgggttctgctgc

SEQ ID NO: 4822 - DNA, 45 bp, Artificial Sequence
  Synthetic
tcacaaggtcttaaactttcttggatcttgtgttaagtgtgaggg

SEQ ID NO: 4823 - DNA, 42 bp, Artificial Sequence
  Synthetic
aatggtgagctccgatgggttggacaaggctaaggaaccgtt

SEQ ID NO: 4824 - DNA, 43 bp, Artificial Sequence
  Synthetic
ctgtccttaagacggggattggagttgttaagttccagtttgt

SEQ ID NO: 4825 - DNA, 43 bp, Artificial Sequence
  Synthetic
ctggttccccaagcttcgtgtaacagtattggtagacactgat

SEQ ID NO: 4826 - DNA, 42 bp, Artificial Sequence
  Synthetic
tacactatacgcgtggttaaactgtacaaagggggaaaggga

SEQ ID NO: 4827 - DNA, 43 bp, Artificial Sequence
  Synthetic
cgcccaaggattctctcgtttaattatgcatcatcgagcaatt

SEQ ID NO: 4828 - DNA, 41 bp, Artificial Sequence
  Synthetic
ccagctgacatacactgtagtgatacatggtcatgagcggt

SEQ ID NO: 4829 - DNA, 38 bp, Artificial Sequence
  Synthetic
ttcctcacagggcggtagttcagacggtatcgctacag

SEQ ID NO: 4830 - DNA, 43 bp, Artificial Sequence
  Synthetic
ccgctgtgctggtgaaagatttgaacatttggaaaatcgctta

SEQ ID NO: 4831 - DNA, 43 bp, Artificial Sequence
  Synthetic
gcaaagaaagttcacctccaggttgtgcaagttgtatgttctg

SEQ ID NO: 4832 - DNA, 39 bp, Artificial Sequence
  Synthetic
ctggcaaacgggtggaaaaaccgtgttttgcgatgttcg

SEQ ID NO: 4833 - DNA, 39 bp, Artificial Sequence
  Synthetic
catagccccaggtcccgtaatctggtaaggcattatggc

SEQ ID NO: 4834 - DNA, 40 bp, Artificial Sequence
  Synthetic
gcctatggctggtcgctcaaacatctagcctcatctgcca

SEQ ID NO: 4835 - DNA, 41 bp, Artificial Sequence
  Synthetic
gttgaggcttgtgggttttccgcacagcgtcttgggttgtt

SEQ ID NO: 4836 - DNA, 40 bp, Artificial Sequence
  Synthetic
gcctgagcaccagttggcttatgggtgtgctcatagctca

SEQ ID NO: 4837 - DNA, 39 bp, Artificial Sequence
  Synthetic
gaatgcctagtggggctaacctggtggggtgaaatcctg

SEQ ID NO: 4838 - DNA, 41 bp, Artificial Sequence
  Synthetic
acagaaggtggctttatcacattccattatagcccctgtgg

SEQ ID NO: 4839 - DNA, 48 bp, Artificial Sequence
  Synthetic
tcaagagctggaaaataaacttccatcaaatctaacataggtgaacaa

SEQ ID NO: 4840 - DNA, 47 bp, Artificial Sequence
  Synthetic
gtaccaattacaacaagcaaaagcctgttaaggaaatgttttggctc

SEQ ID NO: 4841 - DNA, 41 bp, Artificial Sequence
  Synthetic
gatggtgactgcaggtggagtgagctgtagtttctcaagtc

SEQ ID NO: 4842 - DNA, 40 bp, Artificial Sequence
  Synthetic
atccaagttcattgactggctgtaatgtgtccgacttgcg

SEQ ID NO: 4843 - DNA, 43 bp, Artificial Sequence
  Synthetic
tttgtcagatggtttcaagcactctctgcccttatcttcaaga

SEQ ID NO: 4844 - DNA, 45 bp, Artificial Sequence
  Synthetic
cattgtagatcttcttagtgcctcccatccctctttctcacagaa

SEQ ID NO: 4845 - DNA, 47 bp, Artificial Sequence
  Synthetic
ataacgattttgtggctagatcgaaggtagtctggtatgaatcttct

SEQ ID NO: 4846 - DNA, 39 bp, Artificial Sequence
  Synthetic
cgctgtgttgacccagaaagcttggacaaaacagctgtt

SEQ ID NO: 4847 - DNA, 44 bp, Artificial Sequence
  Synthetic
gtaatctctatgctggcttccatgatcacaccctatagctgaac

SEQ ID NO: 4848 - DNA, 44 bp, Artificial Sequence
  Synthetic
atggattgacaataacacctgctgcattatcccagttgactttc

SEQ ID NO: 4849 - DNA, 43 bp, Artificial Sequence
  Synthetic
ttctgcagacgattcgacatttagatcgacagtatgagaacaa

SEQ ID NO: 4850 - DNA, 48 bp, Artificial Sequence
  Synthetic
tcggtggttccatttagaatagacagcagcatacaatgtaattcttac

SEQ ID NO: 4851 - DNA, 48 bp, Artificial Sequence
  Synthetic
tgcactgacagtatagatacgttgggttagaaatgtttgaatcgtcat

SEQ ID NO: 4852 - DNA, 46 bp, Artificial Sequence
  Synthetic
tgaaagacacagcaaaaggagattgaattttcagcttcatcttcga

SEQ ID NO: 4853 - DNA, 41 bp, Artificial Sequence
  Synthetic
ctgtttttggacaaacaccgggttgctgcttgatgacttac

SEQ ID NO: 4854 - DNA, 49 bp, Artificial Sequence
  Synthetic
ctcatattgagtcacaggagagcagcattttcttttctgatattttccc

SEQ ID NO: 4855 - DNA, 43 bp, Artificial Sequence
  Synthetic
ggactgtgcattttaaaacccaagtgtcgaaggaggaggagta

SEQ ID NO: 4856 - DNA, 39 bp, Artificial Sequence
  Synthetic
gtcaggagaaaccccccgcattcggtctctcctcctcct

SEQ ID NO: 4857 - DNA, 43 bp, Artificial Sequence
  Synthetic
actgtttggaactgggttggagtcagtgctatcaaatgcaata

SEQ ID NO: 4858 - DNA, 45 bp, Artificial Sequence
  Synthetic
gggaagtgtaatatacctaggaggcggattatacccagttgaccc

SEQ ID NO: 4859 - DNA, 48 bp, Artificial Sequence
  Synthetic
ttctgttgtgccattagaggatctctcttgtatctccactatctactg

SEQ ID NO: 4860 - DNA, 44 bp, Artificial Sequence
  Synthetic
gagcctcagcaactccacatacaaatacattcagatcagatgac

SEQ ID NO: 4861 - DNA, 39 bp, Artificial Sequence
  Synthetic
cccagctttactgacacagccgcatcaaaggcgggattt

SEQ ID NO: 4862 - DNA, 44 bp, Artificial Sequence
  Synthetic
aattgggcaggcggttcattgataattcaatagcatcagcagta

SEQ ID NO: 4863 - DNA, 44 bp, Artificial Sequence
  Synthetic
atgattctgatcatgaacgcctaggtagtacctataccaagcgg

SEQ ID NO: 4864 - DNA, 43 bp, Artificial Sequence
  Synthetic
agaagagaacaactatatgccagactggtagagcatctcccat

SEQ ID NO: 4865 - DNA, 44 bp, Artificial Sequence
  Synthetic
tagagctacaagatgccctacactcaacaacccaaaaagacaaa

SEQ ID NO: 4866 - DNA, 47 bp, Artificial Sequence
  Synthetic
gtccgcaccccaataattatttgcggaaatttgaagaggatatgtcc

SEQ ID NO: 4867 - DNA, 37 bp, Artificial Sequence
  Synthetic
acagaccacgatccccacaccactgctgccgtgcgac

SEQ ID NO: 4868 - DNA, 44 bp, Artificial Sequence
  Synthetic
gccttaaccacaaattctttggccttactgaacgacatcgaaat

SEQ ID NO: 4869 - DNA, 42 bp, Artificial Sequence
  Synthetic
tgccagcctattcacatacctgactacattaacggtctccat

SEQ ID NO: 4870 - DNA, 36 bp, Artificial Sequence
  Synthetic
atcacatgagaacggcgcgacgtcgcgcgaattcgg

SEQ ID NO: 4871 - DNA, 48 bp, Artificial Sequence
  Synthetic
atgtcacatggatcatcaaccaaagttcttgagtagtcatatgttctt

SEQ ID NO: 4872 - DNA, 42 bp, Artificial Sequence
  Synthetic
attgtgtaatggaggcagaaacagtcttccttccgtaagtct

SEQ ID NO: 4873 - DNA, 44 bp, Artificial Sequence
  Synthetic
caggatgaacagtgatcagtttgctgttggcattcattccattt

SEQ ID NO: 4874 - DNA, 44 bp, Artificial Sequence
  Synthetic
aacagcttatcaccttctactgctcgctctaaattcttggagac

SEQ ID NO: 4875 - DNA, 39 bp, Artificial Sequence
  Synthetic
aagcgtgtttgaatcagcggtttcttctatggcctctcc

SEQ ID NO: 4876 - DNA, 42 bp, Artificial Sequence
  Synthetic
gaccagttgtgcaagacgttgcaaaacacacaattaatttgc

SEQ ID NO: 4877 - DNA, 44 bp, Artificial Sequence
  Synthetic
aacaagacatcttagacgtgctaattttctacttcacacagcgg

SEQ ID NO: 4878 - DNA, 45 bp, Artificial Sequence
  Synthetic
cagaagatgaggtggacgaagtgggtcactatttggaaatgttgt

SEQ ID NO: 4879 - DNA, 43 bp, Artificial Sequence
  Synthetic
cccaacaggtacacaaatatcagaccatgtcatacccactgtc

SEQ ID NO: 4880 - DNA, 38 bp, Artificial Sequence
  Synthetic
tccacgattggacgccattatggtttgaaacagccgtc

SEQ ID NO: 4881 - DNA, 39 bp, Artificial Sequence
  Synthetic
caggcacagcaggaatattggtaccaagtaatgctgccc

SEQ ID NO: 4882 - DNA, 49 bp, Artificial Sequence
  Synthetic
gcatttgaatatgcacaaaggggagcatattgctatttaaaaatgctcg

SEQ ID NO: 4883 - DNA, 46 bp, Artificial Sequence
  Synthetic
atggaagcaatagccaagcgtcagtactgttttcttcataaagttc

SEQ ID NO: 4884 - DNA, 43 bp, Artificial Sequence
  Synthetic
aacaagttatgaaatgtggcaaacattctacagttttgccccg

SEQ ID NO: 4885 - DNA, 43 bp, Artificial Sequence
  Synthetic
accagcaccaaagacggaacactttaaacaattggattcacct

SEQ ID NO: 4886 - DNA, 47 bp, Artificial Sequence
  Synthetic
ctgggatttatgtcactgcacctaatgtacagttgtattacaccaat

SEQ ID NO: 4887 - DNA, 45 bp, Artificial Sequence
  Synthetic
aactctacttgtgtgttactgtccccatcattgctgtgtggtaac

SEQ ID NO: 4888 - DNA, 41 bp, Artificial Sequence
  Synthetic
ccaggtgcaggttacagacctccccttcatatacagggtta

SEQ ID NO: 4889 - DNA, 40 bp, Artificial Sequence
  Synthetic
tactgcacctatgggaacaccaaacagggcctgtaggtaa

SEQ ID NO: 4890 - DNA, 42 bp, Artificial Sequence
  Synthetic
cagcagttctagacttcttgcagcagttttgttagcccgttt

SEQ ID NO: 4891 - DNA, 45 bp, Artificial Sequence
  Synthetic
tccagattatttacaaatggctgcaacatttgttccttccgtaga

SEQ ID NO: 4892 - DNA, 43 bp, Artificial Sequence
  Synthetic
acaatggtatttgttggggtaatcaatgttggtactgcgtgtg

SEQ ID NO: 4893 - DNA, 47 bp, Artificial Sequence
  Synthetic
cttttatgcactgtagccaactctaacagtaagagcaaaaaaatgtg

SEQ ID NO: 4894 - DNA, 38 bp, Artificial Sequence
  Synthetic
tggattaacccgctcaatgcccaggcctttcgcgaccc

SEQ ID NO: 4895 - DNA, 38 bp, Artificial Sequence
  Synthetic
cccagattgggtgtgcgcgtcttccacgaggttgcgac

SEQ ID NO: 4896 - DNA, 41 bp, Artificial Sequence
  Synthetic
ggctttggaggacgggatcaacgaaagaagtgccaagagga

SEQ ID NO: 4897 - DNA, 39 bp, Artificial Sequence
  Synthetic
tcgcagcgccatacatcggccccaccatcaaatccacat

SEQ ID NO: 4898 - DNA, 40 bp, Artificial Sequence
  Synthetic
cctcgtgggggtggcctattcaacccctgcaaagaggaat

SEQ ID NO: 4899 - DNA, 36 bp, Artificial Sequence
  Synthetic
cccactcggggtcgctaacaatcccgcatggccgag

SEQ ID NO: 4900 - DNA, 39 bp, Artificial Sequence
  Synthetic
gttcaccaaaacctgtggcgccctgaagcaatcggtggg

SEQ ID NO: 4901 - DNA, 39 bp, Artificial Sequence
  Synthetic
ccactacagcgtggcagatccatcaagccggtggagagg

SEQ ID NO: 4902 - DNA, 38 bp, Artificial Sequence
  Synthetic
ttctgatgctgcctgagagggcgacaacgatggcgccg

SEQ ID NO: 4903 - DNA, 42 bp, Artificial Sequence
  Synthetic
tcttgcagtcctggtctgtccagccctaagatggccagaaga

SEQ ID NO: 4904 - DNA, 40 bp, Artificial Sequence
  Synthetic
cctgtttcggccaggttggggtctccacccctttgatgtt

SEQ ID NO: 4905 - DNA, 39 bp, Artificial Sequence
  Synthetic
taacggcgtgatgtggaccggattgacaggtcccttcgg

SEQ ID NO: 4906 - DNA, 38 bp, Artificial Sequence
  Synthetic
cactgacaactcaacacccccaggtgcgtgtaggtgcg

SEQ ID NO: 4907 - DNA, 39 bp, Artificial Sequence
  Synthetic
ggtgcgccaatcacgtactcaatgtcgtatgcccctccg

SEQ ID NO: 4908 - DNA, 42 bp, Artificial Sequence
  Synthetic
aaagtgcgatgaactggccagactctgtagtaggctacggca

SEQ ID NO: 4909 - DNA, 41 bp, Artificial Sequence
  Synthetic
gggaggttgggcacataccgggcagtgtcaaacatgcctga

SEQ ID NO: 4910 - DNA, 39 bp, Artificial Sequence
  Synthetic
ccaagctgggacaccatgtggtctgtagaggaggggcgt

SEQ ID NO: 4911 - DNA, 42 bp, Artificial Sequence
  Synthetic
aacacctcccactagtcgagcacctaaggccttctgcttgaa

SEQ ID NO: 4912 - DNA, 40 bp, Artificial Sequence
  Synthetic
gattcgcgactccgatgcttctttttgccaaggcccacac

SEQ ID NO: 4913 - DNA, 36 bp, Artificial Sequence
  Synthetic
gaaggggccgtgcagtggaacacgtgattgcctcgc

SEQ ID NO: 4914 - DNA, 40 bp, Artificial Sequence
  Synthetic
aggctataagggagagtggcgcacctgccagatctgctcc

SEQ ID NO: 4915 - DNA, 41 bp, Artificial Sequence
  Synthetic
ccacgcccctaagtgcaaaccttgtgatcccactacgaacg

SEQ ID NO: 4916 - DNA, 41 bp, Artificial Sequence
  Synthetic
gtaccgctccccatgactcccagacccccacaagaggttag

SEQ ID NO: 4917 - DNA, 42 bp, Artificial Sequence
  Synthetic
tccctctcccaggaggaaacgggccaaagcggtagaaacaac

SEQ ID NO: 4918 - DNA, 40 bp, Artificial Sequence
  Synthetic
gcttgtaacaccttgcgcggtgaattgctcagggggctaa

SEQ ID NO: 4919 - DNA, 42 bp, Artificial Sequence
  Synthetic
taaccacatcagctccgtgtggtggccatgattgttgttgga

SEQ ID NO: 4920 - DNA, 40 bp, Artificial Sequence
  Synthetic
accgaaaaggacatcagggtcgatgactttgcgggcttcg

SEQ ID NO: 4921 - DNA, 35 bp, Artificial Sequence
  Synthetic
aggaggacaaccgagccctagcgtcacctggggga

SEQ ID NO: 4922 - DNA, 40 bp, Artificial Sequence
  Synthetic
atcgggttggtttacggtaggcggtcgggcatgagacatg

SEQ ID NO: 4923 - DNA, 45 bp, Artificial Sequence
  Synthetic
atacatatactgtgatcatgggcgttgattttcgtgagatccact

SEQ ID NO: 4924 - DNA, 42 bp, Artificial Sequence
  Synthetic
gagtacaacaaatcacactcgggcataacacacaacagcgtt

SEQ ID NO: 4925 - DNA, 42 bp, Artificial Sequence
  Synthetic
tatgggtgtgttcgggcaaatactgtgtaacctgatcttcct

SEQ ID NO: 4926 - DNA, 45 bp, Artificial Sequence
  Synthetic
gatggggtcttcaaaactactcttcgtgatccagaccaatgtgta

SEQ ID NO: 4927 - DNA, 49 bp, Artificial Sequence
  Synthetic
actgatccagatacatacaccagtgaagtataagagaagtttgatacca

SEQ ID NO: 4928 - DNA, 43 bp, Artificial Sequence
  Synthetic
gttgagaaaacgaaacagacggtgggactttttgtgtgtgttt

SEQ ID NO: 4929 - DNA, 43 bp, Artificial Sequence
  Synthetic
aagtgcttcaaaccccagtgttaaggcacactaaaccttgatg

SEQ ID NO: 4930 - DNA, 44 bp, Artificial Sequence
  Synthetic
acatcaatagggcgcacaaatcctttcctcttcttaattactgg

SEQ ID NO: 4931 - DNA, 44 bp, Artificial Sequence
  Synthetic
attaccccataatttgcgaaaagcacttgggtaataagggcttc

SEQ ID NO: 4932 - DNA, 39 bp, Artificial Sequence
  Synthetic
gttggagtgtatcgcagaggaagtgaacccgacaccaaa

SEQ ID NO: 4933 - DNA, 45 bp, Artificial Sequence
  Synthetic
tgtacatttccaaacactttcaggtactttctgaaccatccatca

SEQ ID NO: 4934 - DNA, 44 bp, Artificial Sequence
  Synthetic
tgcaattgcagaacacttcaattccatcaaagtgcttgggatct

SEQ ID NO: 4935 - DNA, 44 bp, Artificial Sequence
  Synthetic
ctaagccccccaacaatcttgtgcaaacatatatctaggtcaaa

SEQ ID NO: 4936 - DNA, 45 bp, Artificial Sequence
  Synthetic
atgattatgcaacaaaaactgggcaccaaagatcttaccagtagc

SEQ ID NO: 4937 - DNA, 49 bp, Artificial Sequence
  Synthetic
aacctgctgtattgagtgacaatgcccttgtacttagagaataatgatt

SEQ ID NO: 4938 - DNA, 43 bp, Artificial Sequence
  Synthetic
acaaagcattccatcaaaatcccgcacatcaggatcacaaccc

SEQ ID NO: 4939 - DNA, 48 bp, Artificial Sequence
  Synthetic
aagagatacttcaagcctgatcaacatgtatatctttcatgggcataa

SEQ ID NO: 4940 - DNA, 42 bp, Artificial Sequence
  Synthetic
tcattggtcgagagaaccacgctcgaccgaaatccacgaaag

SEQ ID NO: 4941 - DNA, 41 bp, Artificial Sequence
  Synthetic
ttgcagatgcagcaagtgtggagcataaaagcgctcgtggt

SEQ ID NO: 4942 - DNA, 40 bp, Artificial Sequence
  Synthetic
agtggaacgtggacgacctcaatcgtcaagcactgcgtac

SEQ ID NO: 4943 - DNA, 39 bp, Artificial Sequence
  Synthetic
ccggggttgagtgtgactgttcactgccaagctggacac

SEQ ID NO: 4944 - DNA, 38 bp, Artificial Sequence
  Synthetic
aagtgaaaacaacgcggcgcgaacgcctgcagatcgac

SEQ ID NO: 4945 - DNA, 46 bp, Artificial Sequence
  Synthetic
aagcaattgagtcttgtatggaagggcttcaaattttgcactaagc

SEQ ID NO: 4946 - DNA, 40 bp, Artificial Sequence
  Synthetic
caggctttgtgtagttgcaacagtcacgaaaaagcagtcg

SEQ ID NO: 4947 - DNA, 42 bp, Artificial Sequence
  Synthetic
agaagatgaagctacaaatgctgcttaaggagctctgcgtcc

SEQ ID NO: 4948 - DNA, 47 bp, Artificial Sequence
  Synthetic
catcagctagcttcacaggcaggagtcttctgttaattgattgtcat

SEQ ID NO: 4949 - DNA, 43 bp, Artificial Sequence
  Synthetic
agtaggatttttggatgatgccactccatctaatgcatttcgc

SEQ ID NO: 4950 - DNA, 38 bp, Artificial Sequence
  Synthetic
acctacaccaagaccccgcaagtgcttgcctcctcctg

SEQ ID NO: 4951 - DNA, 43 bp, Artificial Sequence
  Synthetic
tgaaagacttgaagaggaagctaggtaatggattagcaggccc

SEQ ID NO: 4952 - DNA, 39 bp, Artificial Sequence
  Synthetic
tcgcagacgaataaaacgagcatcaccaccttggacaca

SEQ ID NO: 4953 - DNA, 41 bp, Artificial Sequence
  Synthetic
taggccacgtcctaccatacccgcaacaggaaggacgtctg

SEQ ID NO: 4954 - DNA, 44 bp, Artificial Sequence
  Synthetic
gggacctttaagaagtacaccttttctgatataaatctcgcgcc

SEQ ID NO: 4955 - DNA, 42 bp, Artificial Sequence
  Synthetic
tattgcatttacagaacagccacgtaagcggcttacacgaat

SEQ ID NO: 4956 - DNA, 46 bp, Artificial Sequence
  Synthetic
atcagatgttcattgttggttgtgccacatggtttagctaaatccc

SEQ ID NO: 4957 - DNA, 49 bp, Artificial Sequence
  Synthetic
agatgtttcttttatggcaagagggtactccatctttacaaaacatgtg

SEQ ID NO: 4958 - DNA, 41 bp, Artificial Sequence
  Synthetic
taataggccattttgggtgcacaaagttcgtttccccatgc

SEQ ID NO: 4959 - DNA, 45 bp, Artificial Sequence
  Synthetic
tgtaccaactaggaatgctcacaggagtactggatgtataggtat

SEQ ID NO: 4960 - DNA, 43 bp, Artificial Sequence
  Synthetic
cgaaatcggtcgcttgtatagcacaaagtaaagtgtgccaaat

SEQ ID NO: 4961 - DNA, 41 bp, Artificial Sequence
  Synthetic
aacctaatgcaacctcgccagcgctggatgggatggttcca

SEQ ID NO: 4962 - DNA, 37 bp, Artificial Sequence
  Synthetic
gggccggctgctaattgccgcagtaagtgcggtcagc

SEQ ID NO: 4963 - DNA, 35 bp, Artificial Sequence
  Synthetic
ccccctggcacataccgcaaccacaacgcgcctgc

SEQ ID NO: 4964 - DNA, 42 bp, Artificial Sequence
  Synthetic
tgttccttacccccggtctacctggaaatagggagggggtac

SEQ ID NO: 4965 - DNA, 40 bp, Artificial Sequence
  Synthetic
ttaccatctgccaccagcggtacttctgagcatgctcccg

SEQ ID NO: 4966 - DNA, 41 bp, Artificial Sequence
  Synthetic
ggactgcgattcgtaaggcggggttgtaggaaacaggtgca

SEQ ID NO: 4967 - DNA, 39 bp, Artificial Sequence
  Synthetic
ctgccctccaaccgctttacctttactgtggcggtcagc

SEQ ID NO: 4968 - DNA, 35 bp, Artificial Sequence
  Synthetic
ctgggctggaggtgcgctacgggggcaaaaaccgc

SEQ ID NO: 4969 - DNA, 39 bp, Artificial Sequence
  Synthetic
attcgccggctcgctgttttggtcaacattagacgcgtt

SEQ ID NO: 4970 - DNA, 38 bp, Artificial Sequence
  Synthetic
gacttgctcccgcctcggtagcacctggtatatgccgg

SEQ ID NO: 4971 - DNA, 38 bp, Artificial Sequence
  Synthetic
cttgactcagccacagacgtcgactgcacaacgccggg

SEQ ID NO: 4972 - DNA, 36 bp, Artificial Sequence
  Synthetic
gatgaggccccgtcccttccaaggtggacggtggcg

SEQ ID NO: 4973 - DNA, 38 bp, Artificial Sequence
  Synthetic
ggtcgttgttctggggtgagcgttggcggccttagctg

SEQ ID NO: 4974 - DNA, 40 bp, Artificial Sequence
  Synthetic
tccttgctggtggcgaaattggattggcgtcaggattgcc

SEQ ID NO: 4975 - DNA, 38 bp, Artificial Sequence
  Synthetic
gtaaccgcgacgtgtccagggtctcccccgtggtgaat

SEQ ID NO: 4976 - DNA, 39 bp, Artificial Sequence
  Synthetic
gaagcagctccgcctcgctcatccacacacatctgagct

SEQ ID NO: 4977 - DNA, 35 bp, Artificial Sequence
  Synthetic
gccgctgcctcacgtcgtaagcgaccgcggttagc

SEQ ID NO: 4978 - DNA, 38 bp, Artificial Sequence
  Synthetic
ttactccagcactgcccgtcatggtgagctcggcagtc

SEQ ID NO: 4979 - DNA, 41 bp, Artificial Sequence
  Synthetic
ttggttaatgtagcgaccggcgtgtgaccttggtccagtcg

SEQ ID NO: 4980 - DNA, 39 bp, Artificial Sequence
  Synthetic
ggccccgtctctatttccgctcctcaagcaatgctagcg

SEQ ID NO: 4981 - DNA, 41 bp, Artificial Sequence
  Synthetic
acttgacgttcgtaatgggcttaaaaaatccgttggtcgtc

SEQ ID NO: 4982 - DNA, 47 bp, Artificial Sequence
  Synthetic
tctcgtgtatgtctaacgatgttccaaacatctttgaattgtttcca

SEQ ID NO: 4983 - DNA, 43 bp, Artificial Sequence
  Synthetic
gtattaacgcattgcccagttgaattgaagtttggtttacgcg

SEQ ID NO: 4984 - DNA, 39 bp, Artificial Sequence
  Synthetic
acaaacaatggtagaccgcgcatacgaaactgtgcaagc

SEQ ID NO: 4985 - DNA, 47 bp, Artificial Sequence
  Synthetic
gttgcaaaaacaaagacagtttgaaggaatacgttcaattaaagctc

SEQ ID NO: 4986 - DNA, 39 bp, Artificial Sequence
  Synthetic
ccagctccggattatgtggtcgatgtacggcaaatcaat

SEQ ID NO: 4987 - DNA, 38 bp, Artificial Sequence
  Synthetic
cgatgaacaccgttttgcactaggccaacgttttccac

SEQ ID NO: 4988 - DNA, 38 bp, Artificial Sequence
  Synthetic
ggcaccactggattccgtttagtaaatttgggacgccg

SEQ ID NO: 4989 - DNA, 42 bp, Artificial Sequence
  Synthetic
ctagctcctgcaaactttctggaagccagtttttcattggtg

SEQ ID NO: 4990 - DNA, 41 bp, Artificial Sequence
  Synthetic
gtgtgcacaccgttgcatttaaggctgttatcatctgatcg

SEQ ID NO: 4991 - DNA, 43 bp, Artificial Sequence
  Synthetic
ctgcttcttccggtgaatattcaagccctgaattaaaaaaggc

SEQ ID NO: 4992 - DNA, 42 bp, Artificial Sequence
  Synthetic
caccgttgcctttactgtaagtatgttacaaaatacgcacgc

SEQ ID NO: 4993 - DNA, 38 bp, Artificial Sequence
  Synthetic
actctgggaatcggggggaggtcggtggcgctgtatgc

SEQ ID NO: 4994 - DNA, 37 bp, Artificial Sequence
  Synthetic
ccggtattcacggggcgacaacaccgtgtgtacccgc

SEQ ID NO: 4995 - DNA, 38 bp, Artificial Sequence
  Synthetic
cgatccgggccaagggcttgataattcccccggtgtcg

SEQ ID NO: 4996 - DNA, 36 bp, Artificial Sequence
  Synthetic
tgggcgggtatcatcggtcttcggacagcgttcccg

SEQ ID NO: 4997 - DNA, 46 bp, Artificial Sequence
  Synthetic
agctagaacgattcgcagttaatccagtatttgtctacagccttct

SEQ ID NO: 4998 - DNA, 39 bp, Artificial Sequence
  Synthetic
agcaatcaggtcagccaaaatgcctgatgtaccatttgc

SEQ ID NO: 4999 - DNA, 43 bp, Artificial Sequence
  Synthetic
gagagaaccaaggggaagtgaccatcctatttgttcctgaagg

SEQ ID NO: 5000 - DNA, 39 bp, Artificial Sequence
  Synthetic
ggaccagcggctacactagaagccaaaactcttgcctta

SEQ ID NO: 5001 - DNA, 50 bp, Artificial Sequence
  Synthetic
gtagcatgacaaaaatcttagagcctgtattgatagataactatgtctgg

SEQ ID NO: 5002 - DNA, 47 bp, Artificial Sequence
  Synthetic
gttagtggggaaattgaattgggcaggagtttacataattgccttac

SEQ ID NO: 5003 - DNA, 42 bp, Artificial Sequence
  Synthetic
aaactgcccatacaaaaggaaacaactcaggaatccaggtgg

SEQ ID NO: 5004 - DNA, 43 bp, Artificial Sequence
  Synthetic
ctagtgattttaacctgccacctctgacatttatcacagctgg

SEQ ID NO: 5005 - DNA, 43 bp, Artificial Sequence
  Synthetic
atacatactgacaatggcagcaattattcctgcttgattcccg

SEQ ID NO: 5006 - DNA, 45 bp, Artificial Sequence
  Synthetic
aggggatgctagattggtaataacaaaatgccagtctctttctcc

SEQ ID NO: 5007 - DNA, 43 bp, Artificial Sequence
  Synthetic
aacaccaaaaaagataaagccacctttctggggcttgttccat

SEQ ID NO: 5008 - DNA, 44 bp, Artificial Sequence
  Synthetic
acaactgctgtttatccattttcagtctgtcgagtaacgcctat

SEQ ID NO: 5009 - DNA, 41 bp, Artificial Sequence
  Synthetic
acagaggtacataatgtttgggctacttcttgtgggttggg

SEQ ID NO: 5010 - DNA, 44 bp, Artificial Sequence
  Synthetic
ctgctgttaaatggcagtctagctgtccgtgaaattgacagatc

SEQ ID NO: 5011 - DNA, 45 bp, Artificial Sequence
  Synthetic
tggtggtaatagcaacaatgagtcccacttctccaattgtccctc

SEQ ID NO: 5012 - DNA, 42 bp, Artificial Sequence
  Synthetic
gttgcaactcacagtctggggcggtatctttccacagccagg

SEQ ID NO: 5013 - DNA, 41 bp, Artificial Sequence
  Synthetic
agcagctaccaatgctgcttgtggaaaacccacctcctcct

SEQ ID NO: 5014 - DNA, 38 bp, Artificial Sequence
  Synthetic
agggactttccgctggggactgcaggatctgagggctc

SEQ ID NO: 5015 - DNA, 40 bp, Artificial Sequence
  Synthetic
acgaccttcaccgcgactccgcctcgaacatctccgtgtc

SEQ ID NO: 5016 - DNA, 37 bp, Artificial Sequence
  Synthetic
gagcgcgtgatggtcatcgcccatggccatcaacgcc

SEQ ID NO: 5017 - DNA, 36 bp, Artificial Sequence
  Synthetic
cgctctcaaacacctccccgagggcctttctggggc

SEQ ID NO: 5018 - DNA, 39 bp, Artificial Sequence
  Synthetic
taacgtcaaggtcgtcgtcgggttaagcacctgggcccg

SEQ ID NO: 5019 - DNA, 35 bp, Artificial Sequence
  Synthetic
ggtccgaaacgtcccgtcgaacagccaggtcgcgg

SEQ ID NO: 5020 - DNA, 42 bp, Artificial Sequence
  Synthetic
tccttgtgggacgagaacagccaagttacatcaccaacccgg

SEQ ID NO: 5021 - DNA, 37 bp, Artificial Sequence
  Synthetic
cgttgagggtctgcacgcacggcgtatctcatcaccg

SEQ ID NO: 5022 - DNA, 42 bp, Artificial Sequence
  Synthetic
ggtgcgctgcttcaagattctgccgctagagtacgagatcga

SEQ ID NO: 5023 - DNA, 35 bp, Artificial Sequence
  Synthetic
ccacgccctcgctgttcgtaagggagacgcgtggc

SEQ ID NO: 5024 - DNA, 40 bp, Artificial Sequence
  Synthetic
cactggtacatggcccactaccgcaaaacagggccgagag

SEQ ID NO: 5025 - DNA, 37 bp, Artificial Sequence
  Synthetic
gagcgcggccccagacttacctggcccatgatgcagg

SEQ ID NO: 5026 - DNA, 41 bp, Artificial Sequence
  Synthetic
ctgcatgtagcggtcgtagtggcgaacctttagccccgagg

SEQ ID NO: 5027 - DNA, 39 bp, Artificial Sequence
  Synthetic
gctctccggcggcgttgatggcggctttacgaccactac

SEQ ID NO: 5028 - DNA, 39 bp, Artificial Sequence
  Synthetic
gagagtccgtacccgccccacatgaactacgggccggac

SEQ ID NO: 5029 - DNA, 36 bp, Artificial Sequence
  Synthetic
ggggtgagcgagtggagcacgttgccaggttctgcc

SEQ ID NO: 5030 - DNA, 35 bp, Artificial Sequence
  Synthetic
cggagaacgcgaggcccatcgaaacagccgcctgg

SEQ ID NO: 5031 - DNA, 37 bp, Artificial Sequence
  Synthetic
cgtgcttcagggggcggttcaccggagctctcggtaa

SEQ ID NO: 5032 - DNA, 39 bp, Artificial Sequence
  Synthetic
cgaagagcgcactcccccaaaaagagtggtttgccgtgg

SEQ ID NO: 5033 - DNA, 40 bp, Artificial Sequence
  Synthetic
aaaggcgccaacaaacctaggaccagaccctgcagctaca

SEQ ID NO: 5034 - DNA, 35 bp, Artificial Sequence
  Synthetic
gcgggacttcgcccagttccgtagtctccgcgaga

SEQ ID NO: 5035 - DNA, 38 bp, Artificial Sequence
  Synthetic
gtttgcctccagccacaacacaccggggaaacaggcac

SEQ ID NO: 5036 - DNA, 36 bp, Artificial Sequence
  Synthetic
ggacaaggccgggtcccgtatcagcctcgcagaccc

SEQ ID NO: 5037 - DNA, 40 bp, Artificial Sequence
  Synthetic
ctcccggaaggtattgctcgcagcttcatggagggcagcc

SEQ ID NO: 5038 - DNA, 39 bp, Artificial Sequence
  Synthetic
cggcgtagatgcgcttctcccggatctggtggccatagg

SEQ ID NO: 5039 - DNA, 35 bp, Artificial Sequence
  Synthetic
ccggcggacgcgactaacagttggtcgggttgccc

SEQ ID NO: 5040 - DNA, 36 bp, Artificial Sequence
  Synthetic
caagggggtgtgggtgacgaagccccggatcctcgt

SEQ ID NO: 5041 - DNA, 37 bp, Artificial Sequence
  Synthetic
gtccgccgggatgtcggatgagggcgggttcatcctg

SEQ ID NO: 5042 - DNA, 37 bp, Artificial Sequence
  Synthetic
cgtactaccctttcgacgcgctcctggagtcggcgac

SEQ ID NO: 5043 - DNA, 35 bp, Artificial Sequence
  Synthetic
gtgcgccgtgctgtgtctgatcgcgatcgggggag

SEQ ID NO: 5044 - DNA, 36 bp, Artificial Sequence
  Synthetic
gctgggcatgctgatcccggtccaatccggacgccc

SEQ ID NO: 5045 - DNA, 39 bp, Artificial Sequence
  Synthetic
gtgacgtcggcgcgactcagggctacgtgtacttcgagg

SEQ ID NO: 5046 - DNA, 35 bp, Artificial Sequence
  Synthetic
aggagccccacgttctcgaacagcttcgcccagcc

SEQ ID NO: 5047 - DNA, 37 bp, Artificial Sequence
  Synthetic
gggcggtccagaaccactgctttcccaacggcaagcc

SEQ ID NO: 5048 - DNA, 37 bp, Artificial Sequence
  Synthetic
acaacccccacctcgctcagtacgtatggcgctgagc

SEQ ID NO: 5049 - DNA, 39 bp, Artificial Sequence
  Synthetic
agcgacgtcgagtttaactgcaggcaggtcacacatggc

SEQ ID NO: 5050 - DNA, 39 bp, Artificial Sequence
  Synthetic
ggaacgcgtaatcggccaccgcaccatcgagctgtacaa

SEQ ID NO: 5051 - DNA, 37 bp, Artificial Sequence
  Synthetic
ttcggtgctgtttcaggggtttgctccgccgtgatcg

SEQ ID NO: 5052 - DNA, 35 bp, Artificial Sequence
  Synthetic
gctttgtgcgcatgccccgtgcgaacggcgtcctc

SEQ ID NO: 5053 - DNA, 40 bp, Artificial Sequence
  Synthetic
cttcgcccaccgattcctgtccaacaatctgtcgacagga

SEQ ID NO: 5054 - DNA, 34 bp, Artificial Sequence
  Synthetic
gtatgcgacgcggctggtatacaggcgggcggac

SEQ ID NO: 5055 - DNA, 36 bp, Artificial Sequence
  Synthetic
tggtggcggcgcacaacattccaggtacacgcacgc

SEQ ID NO: 5056 - DNA, 38 bp, Artificial Sequence
  Synthetic
cacacggcgtgcctgaagagttcaggtcccggaactcg

SEQ ID NO: 5057 - DNA, 37 bp, Artificial Sequence
  Synthetic
gcgagcaccgaccccctagatggggcacaccggaatc

SEQ ID NO: 5058 - DNA, 42 bp, Artificial Sequence
  Synthetic
aggacgtctccaagctctccgacgacaggaaggcaaacagaa

SEQ ID NO: 5059 - DNA, 36 bp, Artificial Sequence
  Synthetic
gcgacgtccggcgacatagtcgtgcaggtccccaac

SEQ ID NO: 5060 - DNA, 39 bp, Artificial Sequence
  Synthetic
cgctatcgtcggctgcggttggaaaagaagacaaccggc

SEQ ID NO: 5061 - DNA, 36 bp, Artificial Sequence
  Synthetic
caggtcgaggatcgcgtcgcagacgctgcagcaggg

SEQ ID NO: 5062 - DNA, 38 bp, Artificial Sequence
  Synthetic
gggggcggagtcgttcaacctgccggggtaaaatccac

SEQ ID NO: 5063 - DNA, 39 bp, Artificial Sequence
  Synthetic
tgcgttatcacctcctcgctcgatacaacggctcggccc

SEQ ID NO: 5064 - DNA, 35 bp, Artificial Sequence
  Synthetic
cggctccctgacgatgcgtcggtccaacagcaccg

SEQ ID NO: 5065 - DNA, 38 bp, Artificial Sequence
  Synthetic
ttttcgagaagaaggcgtcgcgtccgtcagggtctcgc

SEQ ID NO: 5066 - DNA, 38 bp, Artificial Sequence
  Synthetic
cgcctatgcgcgtccctgtggcaggcggttgttatcgc

SEQ ID NO: 5067 - DNA, 39 bp, Artificial Sequence
  Synthetic
acgacgatgcatgttcggcgcaaaagataggtcgccggg

SEQ ID NO: 5068 - DNA, 37 bp, Artificial Sequence
  Synthetic
gttcgaggcggatccggtcagcccacgatgacgccaa

SEQ ID NO: 5069 - DNA, 34 bp, Artificial Sequence
  Synthetic
tggcaggccgaaaacgccataactccgcgcggcc

SEQ ID NO: 5070 - DNA, 36 bp, Artificial Sequence
  Synthetic
cggtcgtagtccaacgtgcctagtggtcggcgtggg

SEQ ID NO: 5071 - DNA, 34 bp, Artificial Sequence
  Synthetic
gcatgccccgcaaaacgccccaccacaacacggc

SEQ ID NO: 5072 - DNA, 36 bp, Artificial Sequence
  Synthetic
atgcagaaggggtgcaggcaacggacgagatcgccc

SEQ ID NO: 5073 - DNA, 37 bp, Artificial Sequence
  Synthetic
ggggcggggtttgttgtgagaacgcagctgtcttcgc

SEQ ID NO: 5074 - DNA, 36 bp, Artificial Sequence
  Synthetic
ctccccagagcctgctggttgggtcgtgccatccga

SEQ ID NO: 5075 - DNA, 39 bp, Artificial Sequence
  Synthetic
tttcgcgggaagaaccttccggaacacgcttcaccccgg

SEQ ID NO: 5076 - DNA, 39 bp, Artificial Sequence
  Synthetic
ccatcggaggccccccagattgtacgtgtgctttcgggc

SEQ ID NO: 5077 - DNA, 37 bp, Artificial Sequence
  Synthetic
gggtggcgctctctgccaatcgcaggagccgtagtcc

SEQ ID NO: 5078 - DNA, 40 bp, Artificial Sequence
  Synthetic
cgatcctgccgctcgttcgacgagtcgaaatcccacacag

SEQ ID NO: 5079 - DNA, 39 bp, Artificial Sequence
  Synthetic
acgaagtgtcttgtgcagccaaaggtcgctgaggctctg

SEQ ID NO: 5080 - DNA, 45 bp, Artificial Sequence
  Synthetic
aatcgtgcgtaaattgctataccccaatttcttgcaggtcaacac

SEQ ID NO: 5081 - DNA, 41 bp, Artificial Sequence
  Synthetic
caggcactcctggtcaacagtcgccattctgctcgacacag

SEQ ID NO: 5082 - DNA, 43 bp, Artificial Sequence
  Synthetic
tttgctgcgacaacaatgccgaacagtataatgccatcattgt

SEQ ID NO: 5083 - DNA, 41 bp, Artificial Sequence
  Synthetic
gtggtgtctaatcagcagacagacagatcgttgtccagtgc

SEQ ID NO: 5084 - DNA, 41 bp, Artificial Sequence
  Synthetic
tggaccatggggaagctgattgatacctcagaaaatgcaca

SEQ ID NO: 5085 - DNA, 39 bp, Artificial Sequence
  Synthetic
gggcacggtgctgtctaatagatgttttggtccgcgtac

SEQ ID NO: 5086 - DNA, 44 bp, Artificial Sequence
  Synthetic
tgaatggtataaagctagaggtggcacagactcgtggtcaatgt

SEQ ID NO: 5087 - DNA, 38 bp, Artificial Sequence
  Synthetic
aaggtactacgaccgcaggggtttaggggctggggcga

SEQ ID NO: 5088 - DNA, 39 bp, Artificial Sequence
  Synthetic
aagggttaaacgcgctaatccaacatcgggtggacaatc

SEQ ID NO: 5089 - DNA, 38 bp, Artificial Sequence
  Synthetic
ggtccccgggatattttgccaaacacggggtgccatgg

SEQ ID NO: 5090 - DNA, 40 bp, Artificial Sequence
  Synthetic
ggcgaggaggagactgccttatcgctcctgtataggcaca

SEQ ID NO: 5091 - DNA, 40 bp, Artificial Sequence
  Synthetic
gttagtcgcctggggcaacgagcctacctgaacaccagag

SEQ ID NO: 5092 - DNA, 49 bp, Artificial Sequence
  Synthetic
ttgagcaagacataggactaaccggcagttaataaatctatttcctgca

SEQ ID NO: 5093 - DNA, 39 bp, Artificial Sequence
  Synthetic
cactgaccgtttgcttactgtgaccacctctttgccatc

SEQ ID NO: 5094 - DNA, 39 bp, Artificial Sequence
  Synthetic
actgaccaaggttcagactcaagcagctgtgtttgctta

SEQ ID NO: 5095 - DNA, 43 bp, Artificial Sequence
  Synthetic
cataggcctgggaaacttgaatcacaatatctaatggggcatc

SEQ ID NO: 5096 - DNA, 41 bp, Artificial Sequence
  Synthetic
gaggagtttcagcttgcctttaaattctcaggggtaaggtc

SEQ ID NO: 5097 - DNA, 45 bp, Artificial Sequence
  Synthetic
tgatctacgggatcgtatgacagagaaacaaaaacttcctgccaa

SEQ ID NO: 5098 - DNA, 41 bp, Artificial Sequence
  Synthetic
actgaaacggtgtgtactgccacgcctaaatccttgcgctt

SEQ ID NO: 5099 - DNA, 43 bp, Artificial Sequence
  Synthetic
agaatgcacctgttttaattgtggtaaaggccccaatacctcc

SEQ ID NO: 5100 - DNA, 46 bp, Artificial Sequence
  Synthetic
tcgaaaaaacatcaaaagacgcttgatttgtagcttcatcttcctc

SEQ ID NO: 5101 - DNA, 50 bp, Artificial Sequence
  Synthetic
ttgctttctcaaattgaacattggacttttctagcatagtataaagtcac

SEQ ID NO: 5102 - DNA, 45 bp, Artificial Sequence
  Synthetic
acttgggaaatttgggtattggtacgcagcaggtgtaataggttt

SEQ ID NO: 5103 - DNA, 42 bp, Artificial Sequence
  Synthetic
tacacaaatcccgcctttgatccaaaatctggatctggtgca

SEQ ID NO: 5104 - DNA, 46 bp, Artificial Sequence
  Synthetic
agaactacagcctttagggtcttactttctgcaagattatccacta

SEQ ID NO: 5105 - DNA, 48 bp, Artificial Sequence
  Synthetic
tgttggacatccatactttgaagtgctaactttaggaacttctacagc

SEQ ID NO: 5106 - DNA, 44 bp, Artificial Sequence
  Synthetic
aatccaaatcagtatcctccagaggatcatgtgctacgtccatg

SEQ ID NO: 5107 - DNA, 41 bp, Artificial Sequence
  Synthetic
ggtcttagcctggtttggagaagctcaaactcaaaccgtgc

SEQ ID NO: 5108 - DNA, 43 bp, Artificial Sequence
  Synthetic
ctggaaaggtttgtgtagacagttgatatcacgcaaagtaggt

SEQ ID NO: 5109 - DNA, 38 bp, Artificial Sequence
  Synthetic
tgctgtttgcagaacttggtgatctgccatggcgatag

SEQ ID NO: 5110 - DNA, 40 bp, Artificial Sequence
  Synthetic
agctgattgatgatgccgatggtcttctgtaacctgctgg

SEQ ID NO: 5111 - DNA, 43 bp, Artificial Sequence
  Synthetic
agaaacatctgtggtggaaaagcactacaccgtaacagttcaa

SEQ ID NO: 5112 - DNA, 44 bp, Artificial Sequence
  Synthetic
acaatgggcatttgacaatgacacatctgcagctaaagcataat

SEQ ID NO: 5113 - DNA, 41 bp, Artificial Sequence
  Synthetic
agacttgagaaaagaggatggcgtcgaaacgctctgtcaga

SEQ ID NO: 5114 - DNA, 40 bp, Artificial Sequence
  Synthetic
cgcagagcctcagccctagagaggtttccgaagacgagga

SEQ ID NO: 5115 - DNA, 42 bp, Artificial Sequence
  Synthetic
cgcgacttcaacgacttcaagcagtttgcaggaccttgaaca

SEQ ID NO: 5116 - DNA, 39 bp, Artificial Sequence
  Synthetic
aaacgggacactgctgaaaatatcaggagggcatgtacc

SEQ ID NO: 5117 - DNA, 43 bp, Artificial Sequence
  Synthetic
gtggtacaacccactgttaaacctgtctagagggacaccaaat

SEQ ID NO: 5118 - DNA, 44 bp, Artificial Sequence
  Synthetic
aactctaggggctacaggaggaaggtgtaatttctaataaggct

SEQ ID NO: 5119 - DNA, 44 bp, Artificial Sequence
  Synthetic
tctttgcaaagaactagcacaccccataaagttctctgggtctt

SEQ ID NO: 5120 - DNA, 38 bp, Artificial Sequence
  Synthetic
tgctccagatcccgcctttacgtatatttccgctgggc

SEQ ID NO: 5121 - DNA, 45 bp, Artificial Sequence
  Synthetic
ttgatgtttttggtgacttcagtgacttcacgaaacacatcatcc

SEQ ID NO: 5122 - DNA, 49 bp, Artificial Sequence
  Synthetic
aattaggtgacactgaaaatcctgccattctgcctattatcattaccag

SEQ ID NO: 5123 - DNA, 43 bp, Artificial Sequence
  Synthetic
ttggggctgcaaacttcaaaacggccatttgcaagtttgatta

SEQ ID NO: 5124 - DNA, 45 bp, Artificial Sequence
  Synthetic
tgctttaattctactgactcatgggagctgacaacatgtatgagg

SEQ ID NO: 5125 - DNA, 40 bp, Artificial Sequence
  Synthetic
agactgactcaaatctggcagcactcccggtacatgagtg

SEQ ID NO: 5126 - DNA, 43 bp, Artificial Sequence
  Synthetic
aaatggactacatcaaggaaggaaaaatttgctgctcattgcc

SEQ ID NO: 5127 - DNA, 45 bp, Artificial Sequence
  Synthetic
tactggagtgagcaagaagaattcttcctttctgctgaataaagc

SEQ ID NO: 5128 - DNA, 46 bp, Artificial Sequence
  Synthetic
ttcaggatgtaagctttcaacatccttgttatggccgttttctcat

SEQ ID NO: 5129 - DNA, 49 bp, Artificial Sequence
  Synthetic
gaagggtttagtgtttgtgaaaacgccacatcaattaaatcttgtcttg

SEQ ID NO: 5130 - DNA, 47 bp, Artificial Sequence
  Synthetic
aagaatctagctgatgtggtatgcttttcaggtaaatcaagcaatga

SEQ ID NO: 5131 - DNA, 42 bp, Artificial Sequence
  Synthetic
atctgatgaggagacccaggacgcaactggtatctatttgga

SEQ ID NO: 5132 - DNA, 43 bp, Artificial Sequence
  Synthetic
caaggcttcaagcagtttcaattctgtcatcgaataagcgtct

SEQ ID NO: 5133 - DNA, 47 bp, Artificial Sequence
  Synthetic
aatacgtttttttgggggaaaagtttttagtatcttgcaatggttgt

SEQ ID NO: 5134 - DNA, 47 bp, Artificial Sequence
  Synthetic
attgggagctggttagaaaagagcccaagtctattatagccactctt

SEQ ID NO: 5135 - DNA, 40 bp, Artificial Sequence
  Synthetic
agaagaagaacagccaccgacgatcccacctgcgaaggag

SEQ ID NO: 5136 - DNA, 40 bp, Artificial Sequence
  Synthetic
attgctgcgcatttttggtagtaatacctgttgtgccctc

SEQ ID NO: 5137 - DNA, 49 bp, Artificial Sequence
  Synthetic
agagagctcactacctacagaatccaatttcacctgtaatattagcatc

SEQ ID NO: 5138 - DNA, 43 bp, Artificial Sequence
  Synthetic
ctggtgatgtaagtcttgaatttgcaatctggatcaggagccg

SEQ ID NO: 5139 - DNA, 48 bp, Artificial Sequence
  Synthetic
ctaatttaggggagtttagtggggactactgtatgcccagataaaatt

SEQ ID NO: 5140 - DNA, 47 bp, Artificial Sequence
  Synthetic
ttggaactcagttacattttcatgctttcatagtagggatggtctac

SEQ ID NO: 5141 - DNA, 48 bp, Artificial Sequence
  Synthetic
aaggtattcaaattggtagaggtgggctttgttaaataaaggatgacc

SEQ ID NO: 5142 - DNA, 45 bp, Artificial Sequence
  Synthetic
taatgctgttattcaggacggaacagttcttaaaatttgctgccc

SEQ ID NO: 5143 - DNA, 43 bp, Artificial Sequence
  Synthetic
tatggctcgtgaaggtaaaatggagcatttgtaggtggcaata

SEQ ID NO: 5144 - DNA, 46 bp, Artificial Sequence
  Synthetic
ctactgaaaatcctgctccagaaatcttgcaaatcaactaaccaaa

SEQ ID NO: 5145 - DNA, 39 bp, Artificial Sequence
  Synthetic
tctctcgaacggaagcggtacgccaaaataccagagacg

SEQ ID NO: 5146 - DNA, 48 bp, Artificial Sequence
  Synthetic
gtgcagaaattgtaagtcatgaaggcaaattaacaggcaataccaaat

SEQ ID NO: 5147 - DNA, 41 bp, Artificial Sequence
  Synthetic
aacttctgcttcaattcgcacaagacagatcacaggcaatt

SEQ ID NO: 5148 - DNA, 43 bp, Artificial Sequence
  Synthetic
ggaaattccctggcactatacaacaagtccccaatagctctgt

SEQ ID NO: 5149 - DNA, 44 bp, Artificial Sequence
  Synthetic
cccataacactgcgttgttggccaaataaatctttgaatttgcc

SEQ ID NO: 5150 - DNA, 46 bp, Artificial Sequence
  Synthetic
tcaagaggaagctagggatccacacattaaatctattcctccaaca

SEQ ID NO: 5151 - DNA, 42 bp, Artificial Sequence
  Synthetic
gcaaaggtcctgaaataactgtgaaagggtatgacatcagcg

SEQ ID NO: 5152 - DNA, 46 bp, Artificial Sequence
  Synthetic
aagaattatcaatcaagggcaacgagtctggatttctggtttgaac

SEQ ID NO: 5153 - DNA, 48 bp, Artificial Sequence
  Synthetic
atagggttttcagatttcatttgccctggattataaactttgggatct

SEQ ID NO: 5154 - DNA, 45 bp, Artificial Sequence
  Synthetic
atggagcctaagcaaaatcaattgtcccaatgttctcctattgtg

SEQ ID NO: 5155 - DNA, 48 bp, Artificial Sequence
  Synthetic
tcagattggaatgttaaatgggagcgcagattttttagaaactgaagt

SEQ ID NO: 5156 - DNA, 43 bp, Artificial Sequence
  Synthetic
atttggccagtattaatacccacacaggttgtaaagcgtccag

SEQ ID NO: 5157 - DNA, 42 bp, Artificial Sequence
  Synthetic
aaaacgtcaacaaaagccaggtatcttcccatgttctaggtg

SEQ ID NO: 5158 - DNA, 43 bp, Artificial Sequence
  Synthetic
attcctaactttgatggaaacgtcttgtcaaagttgctccacg

SEQ ID NO: 5159 - DNA, 42 bp, Artificial Sequence
  Synthetic
attcgttatggctaccgatgaaataatagggatcgagctggg

SEQ ID NO: 5160 - DNA, 40 bp, Artificial Sequence
  Synthetic
ggcggccaacccagcttatgcatgcgagtcttcacaccat

SEQ ID NO: 5161 - DNA, 41 bp, Artificial Sequence
  Synthetic
cgaatgttgaagcatgtggttactatggtggaattgcccag

SEQ ID NO: 5162 - DNA, 48 bp, Artificial Sequence
  Synthetic
ttaccattcacttggtagaacaggtctatgaaatttggtagcattgca

SEQ ID NO: 5163 - DNA, 45 bp, Artificial Sequence
  Synthetic
tggacggaactcttctaggcgtcctcaaatttataaattggtgag

SEQ ID NO: 5164 - DNA, 42 bp, Artificial Sequence
  Synthetic
ccacaagggttacccactactgtctgtcatctgtagtgagaa

SEQ ID NO: 5165 - DNA, 45 bp, Artificial Sequence
  Synthetic
ttgggtgaaatagctcagtactacatcctgtgtacatgagtgaaa

SEQ ID NO: 5166 - DNA, 46 bp, Artificial Sequence
  Synthetic
cattccatggacatcaggtgtaccccagcactagtataagtatcag

SEQ ID NO: 5167 - DNA, 47 bp, Artificial Sequence
  Synthetic
gctggcttggataatcacaggagacttgaaaggttaattttccaatc

SEQ ID NO: 5168 - DNA, 40 bp, Artificial Sequence
  Synthetic
tgcttctaaccccagtgtgtaaaagggacactaaacctgg

SEQ ID NO: 5169 - DNA, 40 bp, Artificial Sequence
  Synthetic
tggattccaagagcacctagagtctggggtagttagtgcg

SEQ ID NO: 5170 - DNA, 43 bp, Artificial Sequence
  Synthetic
acaggaagttctatcccatcatttgagtacgagctaccctcaa

SEQ ID NO: 5171 - DNA, 45 bp, Artificial Sequence
  Synthetic
agacaattggatttcattgctgatgtgctctccctaaactggtaa

SEQ ID NO: 5172 - DNA, 47 bp, Artificial Sequence
  Synthetic
aatcccactcaagagaaaagagagcttgtgacatttgttctaaccac

SEQ ID NO: 5173 - DNA, 42 bp, Artificial Sequence
  Synthetic
cgcgcattggcagaacatttaatgttttggatcaggaggtaa

SEQ ID NO: 5174 - DNA, 40 bp, Artificial Sequence
  Synthetic
atcttgaacccagaagctctgatgtgctgtgcatgcaaat

SEQ ID NO: 5175 - DNA, 47 bp, Artificial Sequence
  Synthetic
atgcccaaccaggtgataatgtggatctactagtttgtatttgtctt

SEQ ID NO: 5176 - DNA, 42 bp, Artificial Sequence
  Synthetic
atacaccaacaaccaggatgatctttttcctgttgtgcacaa

SEQ ID NO: 5177 - DNA, 46 bp, Artificial Sequence
  Synthetic
agtgtgttttacaatgtgttccctggtctagggtcattgtcattga

SEQ ID NO: 5178 - DNA, 49 bp, Artificial Sequence
  Synthetic
aaatcgaaacaaacaaatttgcagcgaaatctgaatacatgaagcatac

SEQ ID NO: 5179 - DNA, 39 bp, Artificial Sequence
  Synthetic
cctgttctcagcggtccaaatgggtcctcaatgcttaat

SEQ ID NO: 5180 - DNA, 43 bp, Artificial Sequence
  Synthetic
aggaattatttcacatcagaggtgttgatgtacacccccttca

SEQ ID NO: 5181 - DNA, 49 bp, Artificial Sequence
  Synthetic
ccaagacttgaaccacacaaatggcttagaagcatatctcctatctcaa

SEQ ID NO: 5182 - DNA, 43 bp, Artificial Sequence
  Synthetic
aagacatgaccaaagagttctttgattcctccactcctttggg

SEQ ID NO: 5183 - DNA, 42 bp, Artificial Sequence
  Synthetic
tgcccttaggatgaagtggatgccattatccttttgtctgcc

SEQ ID NO: 5184 - DNA, 38 bp, Artificial Sequence
  Synthetic
ggccccgttcacttcagaaactaagatctgcatggccc

SEQ ID NO: 5185 - DNA, 41 bp, Artificial Sequence
  Synthetic
acatgttggagagagaactggtcgatatacacgctgcttgt

SEQ ID NO: 5186 - DNA, 41 bp, Artificial Sequence
  Synthetic
agtacacagattggcgggatgttcttctgttgggttttgtc

SEQ ID NO: 5187 - DNA, 41 bp, Artificial Sequence
  Synthetic
cgaagagcaacagccattctaacccactcactatcagttgg

SEQ ID NO: 5188 - DNA, 44 bp, Artificial Sequence
  Synthetic
gtttcaaaactggggaattgaacctgtcaggcaatattccgatc

SEQ ID NO: 5189 - DNA, 46 bp, Artificial Sequence
  Synthetic
attcatcgtccatgatgtgggaattgatatgtgttaactagcactg

SEQ ID NO: 5190 - DNA, 44 bp, Artificial Sequence
  Synthetic
ctcttctctaactgtgaatgtgaggacaggagaattgcctctca

SEQ ID NO: 5191 - DNA, 45 bp, Artificial Sequence
  Synthetic
agtgagagggtattggagaggcaattgttactctatcacctttca

SEQ ID NO: 5192 - DNA, 43 bp, Artificial Sequence
  Synthetic
gacgatgagaattttcaagaacaggactcctctgcacactgta

SEQ ID NO: 5193 - DNA, 43 bp, Artificial Sequence
  Synthetic
tttctgaacaggtagaagtgcaaaactattacatgcggcactt

SEQ ID NO: 5194 - DNA, 38 bp, Artificial Sequence
  Synthetic
gggccctccagatccaccgacgctctgcgtctgtgctt

SEQ ID NO: 5195 - DNA, 44 bp, Artificial Sequence
  Synthetic
ggaggctcgggatccgtataccaacactttaatgtattctgagg

SEQ ID NO: 5196 - DNA, 40 bp, Artificial Sequence
  Synthetic
ggatacacaccttttggaggcaaattgcaggccttactgg

SEQ ID NO: 5197 - DNA, 45 bp, Artificial Sequence
  Synthetic
tggtgaacatccttccgttacattgtacttgaacatctatctgag

SEQ ID NO: 5198 - DNA, 40 bp, Artificial Sequence
  Synthetic
aaacgcaaacactcctcctctgaagataaagccgtccagt

SEQ ID NO: 5199 - DNA, 49 bp, Artificial Sequence
  Synthetic
taaagcaatagaggttccaaaggtggcaaatttattaggatcaggtaac

SEQ ID NO: 5200 - DNA, 46 bp, Artificial Sequence
  Synthetic
ctgcagaggtagatgacagtagaataaaaagctgattttgtttggg

SEQ ID NO: 5201 - DNA, 38 bp, Artificial Sequence; identical to SEQ ID NO: 4464
  Synthetic

SEQ ID NO: 5202 - DNA, 36 bp, Artificial Sequence
  Synthetic
ggtgtgcgcgccacaagaaaagatgggcgcgccttg

SEQ ID NO: 5203 - DNA, 41 bp, Artificial Sequence
  Synthetic
ttcacgctgctggcatcctgttccacatgtttgcggaaccc

SEQ ID NO: 5204 - DNA, 40 bp, Artificial Sequence
  Synthetic
cggtcactggggtgtcctgaaccttcaaccaattgcctga

SEQ ID NO: 5205 - DNA, 41 bp, Artificial Sequence
  Synthetic
tggggccctataacccacaagtgcatagtgccagcagtagg

SEQ ID NO: 5206 - DNA, 39 bp, Artificial Sequence
  Synthetic
gcttcaccaagacctgcggaggggcacaggagctggtta

SEQ ID NO: 5207 - DNA, 42 bp, Artificial Sequence
  Synthetic
cctctacggagtctcctcgagcatgaggacgacatactccca

SEQ ID NO: 5208 - DNA, 37 bp, Artificial Sequence
  Synthetic
tggaccctcatcttcctgtgctaggtgcatgcgggca

SEQ ID NO: 5209 - DNA, 41 bp, Artificial Sequence
  Synthetic
gtggcgacatcttgaggggtctgtcccagcagcaccaagtc

SEQ ID NO: 5210 - DNA, 39 bp, Artificial Sequence
  Synthetic
aagggcccgtatgccagatgtaagtgacctagcccccag

SEQ ID NO: 5211 - DNA, 40 bp, Artificial Sequence
  Synthetic
ggccctggacttcatccctgtggcgaggagttgtcggtaa

SEQ ID NO: 5212 - DNA, 39 bp, Artificial Sequence
  Synthetic
cagacccaacgacggtgcttggcgtagcgagcaccgtga

SEQ ID NO: 5213 - DNA, 38 bp, Artificial Sequence
  Synthetic
gacggacgcccttatgaccgtctaccacctgcgtcacg

SEQ ID NO: 5214 - DNA, 40 bp, Artificial Sequence
  Synthetic
cacggggtgcgcatggtatgggagtgtttaggtaggcacg

SEQ ID NO: 5215 - DNA, 42 bp, Artificial Sequence
  Synthetic
ctgggggctgtccaaaatgagaacttccaggtctgcagacat

SEQ ID NO: 5216 - DNA, 42 bp, Artificial Sequence
  Synthetic
tgcagaagaactgaaacccgctccacatgtgtttcctccaga

SEQ ID NO: 5217 - DNA, 38 bp, Artificial Sequence
  Synthetic
tcgtcgtgagcggcttagcccggcaaggatgtcaacaa

SEQ ID NO: 5218 - DNA, 40 bp, Artificial Sequence
  Synthetic
gttacgcaggctacaccagtggtctcgcagccatgaggac

SEQ ID NO: 5219 - DNA, 40 bp, Artificial Sequence
  Synthetic
tgtgcagcaacacttggcatggcacactagggctggtagt

SEQ ID NO: 5220 - DNA, 41 bp, Artificial Sequence
  Synthetic
tgttgtggggtctcagctccccagtgagcattgacgtgact

SEQ ID NO: 5221 - DNA, 38 bp, Artificial Sequence
  Synthetic
gttccctcctgctctcccgatcgtatccgggcatttgc

SEQ ID NO: 5222 - DNA, 42 bp, Artificial Sequence
  Synthetic
catctcctgacccgacaacagcggggcattgagctaaaggat

SEQ ID NO: 5223 - DNA, 40 bp, Artificial Sequence
  Synthetic
tgcgagaagatggcactctacgtgcagatcccatcacggt

SEQ ID NO: 5224 - DNA, 41 bp, Artificial Sequence
  Synthetic
gtggggtgctcactaccagtttgatgttggctgccctacac

SEQ ID NO: 5225 - DNA, 40 bp, Artificial Sequence
  Synthetic
gcgagctgcttgggagacagtgatgatgttgcccaaccac

SEQ ID NO: 5226 - DNA, 40 bp, Artificial Sequence
  Synthetic
ggcgccacccttaagagcttaccttgggcaatgagtttgg

SEQ ID NO: 5227 - DNA, 45 bp, Artificial Sequence
  Synthetic
gtaaggaagtgggccttaatggctttttcaattgctatgccattt

SEQ ID NO: 5228 - DNA, 45 bp, Artificial Sequence
  Synthetic
aagccgctcaagaattgttcaatttgctctgtttagttcatttcc

SEQ ID NO: 5229 - DNA, 44 bp, Artificial Sequence
  Synthetic
aattggagttcttatagctgacgcctcctcttttgccttctctc

SEQ ID NO: 5230 - DNA, 43 bp, Artificial Sequence
  Synthetic
aaagcctcagataaccaacaagatgagagtaagtctggcagcc

SEQ ID NO: 5231 - DNA, 44 bp, Artificial Sequence
  Synthetic
ccaccctcttaagttgagaaacaggagaaagcactgttgaaact

SEQ ID NO: 5232 - DNA, 43 bp, Artificial Sequence
  Synthetic
tatcagcagattggaagaagaaggtcatcttcttggcttgtcc

SEQ ID NO: 5233 - DNA, 49 bp, Artificial Sequence
  Synthetic
tttggagagaaggaagatgttatgcgctgttgaaattcaaataaagcag

SEQ ID NO: 5234 - DNA, 43 bp, Artificial Sequence
  Synthetic
agagttacttctgatccacgaaggaagatcgtctcctggaaca

SEQ ID NO: 5235 - DNA, 40 bp, Artificial Sequence
  Synthetic
ccatagcggttcagaaaatggccagttgctcgccaattag

SEQ ID NO: 5236 - DNA, 41 bp, Artificial Sequence
  Synthetic
ccagattgggttgctagacaaaaatcaaattggtctgcagc

SEQ ID NO: 5237 - DNA, 44 bp, Artificial Sequence
  Synthetic
agggtagtatgctttaaattcccaaaacatatacacaggctccc

SEQ ID NO: 5238 - DNA, 48 bp, Artificial Sequence
  Synthetic
aacaagcaatttccataagtctgacatgtttcttttccaaatggtgat

SEQ ID NO: 5239 - DNA, 45 bp, Artificial Sequence
  Synthetic
aaaacctacactatctcccctcccgtggttctagagtaagagctg

SEQ ID NO: 5240 - DNA, 42 bp, Artificial Sequence
  Synthetic
aaaacgcattccagcagtaaacaccccaacccatttaaacac

SEQ ID NO: 5241 - DNA, 43 bp, Artificial Sequence
  Synthetic
taggcctactgttcctgtagagcattatagctgatgcctctgg

SEQ ID NO: 5242 - DNA, 43 bp, Artificial Sequence
  Synthetic
ttttacaacaaccaaccagaaacgttcaaattgaacagcccga

SEQ ID NO: 5243 - DNA, 49 bp, Artificial Sequence
  Synthetic
tggttttacgtactggtagtagacattcctaattcaggtggtaaactag

SEQ ID NO: 5244 - DNA, 49 bp, Artificial Sequence
  Synthetic
agtttcaggcaatcagtttagagtgatctattaaagcaaacttgttagg

SEQ ID NO: 5245 - DNA, 44 bp, Artificial Sequence
  Synthetic
atatgccagacatttttggacacggagcatgtggttcaggtatg

SEQ ID NO: 5246 - DNA, 42 bp, Artificial Sequence
  Synthetic
atcaatgctatgaatccaggcattgtcctcaataccggatgg

SEQ ID NO: 5247 - DNA, 41 bp, Artificial Sequence
  Synthetic
cacttgtccatttgtgtcattcgtgtttgttttgacagccg

SEQ ID NO: 5248 - DNA, 40 bp, Artificial Sequence
  Synthetic
tccatggggccaaagaaatagctatgaggcccatgcaact

SEQ ID NO: 5249 - DNA, 43 bp, Artificial Sequence
  Synthetic
ctatcgactcttcaaacacggcatagactcaggtactccttcc

SEQ ID NO: 5250 - DNA, 46 bp, Artificial Sequence
  Synthetic
cgagaacgaaaatgacagtgatacactgtttctgcctgtgttaaat

SEQ ID NO: 5251 - DNA, 38 bp, Artificial Sequence
  Synthetic
tacaggtagaagggcgccatccccacttccaccactat

SEQ ID NO: 5252 - DNA, 49 bp, Artificial Sequence
  Synthetic
acagacctacgtgaccatatagacttgtaataaatagcacattctaggc

SEQ ID NO: 5253 - DNA, 46 bp, Artificial Sequence
  Synthetic
tggagacatatgcaatacaatgcagttactgatgcttcttcacaaa

SEQ ID NO: 5254 - DNA, 39 bp, Artificial Sequence
  Synthetic
aatcccactttcactgacccaaatgccctccagtttctg

SEQ ID NO: 5255 - DNA, 41 bp, Artificial Sequence
  Synthetic
acggatgaatatgttgcacgcgcaagtagtctggatgttcc

SEQ ID NO: 5256 - DNA, 45 bp, Artificial Sequence
  Synthetic
gtgttgaggtaggtcgtggtccaatttatttaataaaggatggcc

SEQ ID NO: 5257 - DNA, 44 bp, Artificial Sequence
  Synthetic
tatggttgatactggctttggtgaacttcacttttgttagcctg

SEQ ID NO: 5258 - DNA, 44 bp, Artificial Sequence
  Synthetic
tttcctacacctagtggttctatggtgtgctcgttgtaaccaat

SEQ ID NO: 5259 - DNA, 47 bp, Artificial Sequence
  Synthetic
taggacgcaaatttttactacaagctgtagcttttcgttttcctaat

SEQ ID NO: 5260 - DNA, 42 bp, Artificial Sequence
  Synthetic
atgcgtgccaaatccctgtttaaaaaacaatggaatggttgg

SEQ ID NO: 5261 - DNA, 41 bp, Artificial Sequence
  Synthetic
agaatgtgtgtactgcaagcaatcccgaaaagcaaagtcat

SEQ ID NO: 5262 - DNA, 44 bp, Artificial Sequence
  Synthetic
ttccataatataaggggtcggtggcgtgttcttgatgatctgca

SEQ ID NO: 5263 - DNA, 43 bp, Artificial Sequence
  Synthetic
cggacagagcccattacaatattgtttgtacgcacaaccgaag

SEQ ID NO: 5264 - DNA, 42 bp, Artificial Sequence
  Synthetic
atatgcacacacttagaagtctgcagttgattcgcctcgttc

SEQ ID NO: 5265 - DNA, 50 bp, Artificial Sequence
  Synthetic
aggaaaaccgtttcattgaaattggctttctctaggtaatatatgtggac

SEQ ID NO: 5266 - DNA, 41 bp, Artificial Sequence
  Synthetic
aacaagccaattaaagtgggcatcctcaaagtccaccttct

SEQ ID NO: 5267 - DNA, 45 bp, Artificial Sequence
  Synthetic
ttttacagcagaggtgtcccactgtatttatgtacactcccttca

SEQ ID NO: 5268 - DNA, 43 bp, Artificial Sequence
  Synthetic
gttggaaccacataaatgggaaaagcttggcctactgcagttc

SEQ ID NO: 5269 - DNA, 41 bp, Artificial Sequence; identical to SEQ ID NO: 4498
  Synthetic

SEQ ID NO: 5270 - DNA, 46 bp, Artificial Sequence
  Synthetic
acaaagactgaacaaaaggagctacgcatcctttgtcattgtgttc

SEQ ID NO: 5271 - DNA, 44 bp, Artificial Sequence
  Synthetic
aattggcaaatgttgtgaggaagaaattgtgaaggagagctctg

SEQ ID NO: 5272 - DNA, 43 bp, Artificial Sequence
  Synthetic
agtaccagcggaaatgctcgctctcttgttgatttgttgaagt

SEQ ID NO: 5273 - DNA, 40 bp, Artificial Sequence
  Synthetic
tgacttcgccctcatagtgaaacctatctactcctgcctg

SEQ ID NO: 5274 - DNA, 38 bp, Artificial Sequence
  Synthetic
cccaaatggcccttcagctacccctgtgacatcggtat

SEQ ID NO: 5275 - DNA, 44 bp, Artificial Sequence
  Synthetic
ggatgaagactaccaaggcaggatttccttatgactgacaaacg

SEQ ID NO: 5276 - DNA, 47 bp, Artificial Sequence
  Synthetic
agatggacctgacatctgtacattctcaataaatgggatacggagag

SEQ ID NO: 5277 - DNA, 48 bp, Artificial Sequence
  Synthetic
attggtttaaggtgtgttacatgcaagaaacaacagctaacttttctg

SEQ ID NO: 5278 - DNA, 43 bp, Artificial Sequence
  Synthetic
aggaggagtctgaatatccatatgcgccttaacagctgatcgc

SEQ ID NO: 5279 - DNA, 46 bp, Artificial Sequence
  Synthetic
cgggatgatgatgagagcgaattatctgatatgtcactttcagatc

SEQ ID NO: 5280 - DNA, 39 bp, Artificial Sequence
  Synthetic
tgcaatagcctcagtcccagttgcctttttttccctctg

SEQ ID NO: 5281 - DNA, 44 bp, Artificial Sequence
  Synthetic
cacagtaggtgtcagttttactgaaactacagcatgtcttgttg

SEQ ID NO: 5282 - DNA, 41 bp, Artificial Sequence
  Synthetic
aagtgaccaagaagacgaggagcttgtagccagtctaagcg

SEQ ID NO: 5283 - DNA, 47 bp, Artificial Sequence
  Synthetic
gactcacaatatggttctgaacagttggtgctaaaaagatttctctg

SEQ ID NO: 5284 - DNA, 38 bp, Artificial Sequence
  Synthetic
ccggctgttcgcaagcgatctgagggtggtatctctgg

SEQ ID NO: 5285 - DNA, 43 bp, Artificial Sequence
  Synthetic
agctgctccacaagatatttatcctttgtatatcaggggggca

SEQ ID NO: 5286 - DNA, 49 bp, Artificial Sequence
  Synthetic
tcctttattcaggatcacagctagtaatattatcagatgctgaagcttc

SEQ ID NO: 5287 - DNA, 43 bp, Artificial Sequence
  Synthetic
tagacgctattatgaacaagtgccgtaactaaggaagcaggcc

SEQ ID NO: 5288 - DNA, 43 bp, Artificial Sequence
  Synthetic
ttgagttacaaacactgggtgaagcgatgcagcaagagaactt

SEQ ID NO: 5289 - DNA, 38 bp, Artificial Sequence
  Synthetic
cagatggctgtttggcttccttggtgatcggttgggta

SEQ ID NO: 5290 - DNA, 44 bp, Artificial Sequence
  Synthetic
cctaaccgatttgcctttggagccaaactagtctctcagtttct

SEQ ID NO: 5291 - DNA, 46 bp, Artificial Sequence
  Synthetic
tgtgcaggaacacagtttcagcctcaataactgtgttaactaattc

SEQ ID NO: 5292 - DNA, 46 bp, Artificial Sequence
  Synthetic
tttcagaaaacgtagatcctccaatattcacatgtatattcaggcc

SEQ ID NO: 5293 - DNA, 39 bp, Artificial Sequence
  Synthetic
tggcatgcaattggtatgtggaacttcaaaattcgcgcg

SEQ ID NO: 5294 - DNA, 48 bp, Artificial Sequence
  Synthetic
tcggaagaatgattggtggaatcgcataatcactgagtttgagttcag

SEQ ID NO: 5295 - DNA, 44 bp, Artificial Sequence
  Synthetic
ggtgaaaatggacgaaggacaatgtttgaaattttcctttgagg

SEQ ID NO: 5296 - DNA, 42 bp, Artificial Sequence
  Synthetic
agggaagggtactcactggtcggaccacttggctgttttgga

SEQ ID NO: 5297 - DNA, 44 bp, Artificial Sequence
  Synthetic
ttgcttcaaatgagaatgtggaaaccccagtatctgcttctcag

SEQ ID NO: 5298 - DNA, 43 bp, Artificial Sequence
  Synthetic
acttggaatgcaggaccttttttccccatttgaatgcctgtca

SEQ ID NO: 5299 - DNA, 49 bp, Artificial Sequence
  Synthetic
ttgaggacacaagagtctgaatgtccatcagtcattatagtaaaacatg

SEQ ID NO: 5300 - DNA, 47 bp, Artificial Sequence
  Synthetic
gacaattggcatggttcgaaccgtatcctatttgataatccaggttt

SEQ ID NO: 5301 - DNA, 44 bp, Artificial Sequence
  Synthetic
aatggatggacagagactgatagtcaatcagtcattgccacaac

SEQ ID NO: 5302 - DNA, 41 bp, Artificial Sequence
  Synthetic
gtgtcttgaaacgatggaagttggtcataggtttggcgacc

SEQ ID NO: 5303 - DNA, 48 bp, Artificial Sequence
  Synthetic
aattggcaaatgtcgtgaggaagagtaattgtaaaagagagctctgta

SEQ ID NO: 5304 - DNA, 44 bp, Artificial Sequence
  Synthetic
atgttcgaaagtaagagcatgaagctcaagtcaatgcttgcaag

SEQ ID NO: 5305 - DNA, 43 bp, Artificial Sequence
  Synthetic
tccaatcctctgatgatttcgctcctgcttctattccctcatg

SEQ ID NO: 5306 - DNA, 41 bp, Artificial Sequence
  Synthetic
ggacaacgaccttggaccagcgtggcatcggtatgggtatc

SEQ ID NO: 5307 - DNA, 40 bp, Artificial Sequence
  Synthetic
caacacggcgaccctacaagtcttgcagtgaagtgttcag

SEQ ID NO: 5308 - DNA, 43 bp, Artificial Sequence
  Synthetic
ttggaaaaactaactaacactgggtttcaacggtttctggcac

SEQ ID NO: 5309 - DNA, 47 bp, Artificial Sequence
  Synthetic
aattccggttgaccttctatgtccatctatttcatcgttttcttcct

SEQ ID NO: 5310 - DNA, 38 bp, Artificial Sequence
  Synthetic
acgaaagtttgcaggaggcatctgtatccacctccagc

SEQ ID NO: 5311 - DNA, 46 bp, Artificial Sequence
  Synthetic
ggcagtacggaggctatagacctatattgctattgtcacttgtacc

SEQ ID NO: 5312 - DNA, 47 bp, Artificial Sequence
  Synthetic
agatgaagggggagattggagaggctcctaaaaatgttataaactct

SEQ ID NO: 5313 - DNA, 46 bp, Artificial Sequence
  Synthetic
ggcatacagacattaaaccaccagttcaatagctttatgtgcttta

SEQ ID NO: 5314 - DNA, 41 bp, Artificial Sequence
  Synthetic
gacaaaaccgctacctgtgtaacgtgttgtacccttccttt

SEQ ID NO: 5315 - DNA, 39 bp, Artificial Sequence
  Synthetic
gggcaccgcaaagacctacggagtccacagtgtccaggt

SEQ ID NO: 5316 - DNA, 43 bp, Artificial Sequence
  Synthetic
ttggacaggtgcaggcaatgtctttgtgtttcactatggtatg

SEQ ID NO: 5317 - DNA, 44 bp, Artificial Sequence
  Synthetic
attgtggtaataacgtcccctgcgcaatagtaacatgggcaata

SEQ ID NO: 5318 - DNA, 44 bp, Artificial Sequence
  Synthetic
tatccgtctacataggcctgcctaatctactaaagcgaacagtc

SEQ ID NO: 5319 - DNA, 41 bp, Artificial Sequence
  Synthetic
gcctgtaccatcgcgttctacagaagatatagtgggcgaat

SEQ ID NO: 5320 - DNA, 39 bp, Artificial Sequence
  Synthetic
attggggaacactgggctaataagttctaaaggggggca

SEQ ID NO: 5321 - DNA, 40 bp, Artificial Sequence
  Synthetic
ggtactatgggtgacactgtgccaggtgaagcaggcatac

SEQ ID NO: 5322 - DNA, 44 bp, Artificial Sequence
  Synthetic
ctgtacctgggcaatatgatgcatcatattcctcaacatgtctg

SEQ ID NO: 5323 - DNA, 43 bp, Artificial Sequence
  Synthetic
tcctacaatcctccattttgctgaaaccacagacataagccaa

SEQ ID NO: 5324 - DNA, 40 bp, Artificial Sequence
  Synthetic
gagaccctccttacagccatgactgatgtgtcctgttgac

SEQ ID NO: 5325 - DNA, 40 bp, Artificial Sequence
  Synthetic
tgaaacgatggaggttgttcagagtcataggtctgtcggc

SEQ ID NO: 5326 - DNA, 43 bp, Artificial Sequence
  Synthetic
gaaagcaaagttggcaaatgttgtaagaaagttcggtgtcctg

SEQ ID NO: 5327 - DNA, 43 bp, Artificial Sequence
  Synthetic
tcttcaatcctctgacgattttgccggcttgaatcccttcatg

SEQ ID NO: 5328 - DNA, 43 bp, Artificial Sequence
  Synthetic
cggacatgagtattggagttactgtgctggaccaagatcattg

SEQ ID NO: 5329 - DNA, 41 bp, Artificial Sequence
  Synthetic
acagaagaccagtcgggatatccgcatcaattcgggctctg

SEQ ID NO: 5330 - DNA, 39 bp, Artificial Sequence
  Synthetic
ggtggtaaatcccagcacaggttccagggaagcggtcac

SEQ ID NO: 5331 - DNA, 38 bp, Artificial Sequence
  Synthetic
gagttcctctagggatggccgatgccgcctgtagcacg

SEQ ID NO: 5332 - DNA, 38 bp, Artificial Sequence
  Synthetic
ccggtggcctcagctgcttcgagggagaatggttcacc

SEQ ID NO: 5333 - DNA, 41 bp, Artificial Sequence
  Synthetic
agggtggcatcttcgacaactgtgatgtccagcctaggagg

SEQ ID NO: 5334 - DNA, 37 bp, Artificial Sequence
  Synthetic
cagtggggctccgcgtactctcctgggcagctcatca

SEQ ID NO: 5335 - DNA, 41 bp, Artificial Sequence
  Synthetic
taggaggttattggcacgccctcactgggattccgggaatc

SEQ ID NO: 5336 - DNA, 40 bp, Artificial Sequence
  Synthetic
tcttcagtggtcagcgtcggtaccaacatggcaagaacca

SEQ ID NO: 5337 - DNA, 37 bp, Artificial Sequence
  Synthetic
tgcttcgctggttccgacttgtggcgccagaaagggc

SEQ ID NO: 5338 - DNA, 38 bp, Artificial Sequence
  Synthetic
cgtgctggtggcgatgcactgccaacactagcatgact

SEQ ID NO: 5339 - DNA, 40 bp, Artificial Sequence
  Synthetic
gccggcctttgtgcaaactgacacacttcagcagcaatgt

SEQ ID NO: 5340 - DNA, 42 bp, Artificial Sequence
  Synthetic
aggactgtgccatagttcgggagcacaccattcactctctga

SEQ ID NO: 5341 - DNA, 39 bp, Artificial Sequence
  Synthetic
ccattgccaatgggggctaccttctcacgacccaaacgc

SEQ ID NO: 5342 - DNA, 42 bp, Artificial Sequence
  Synthetic
ctccctagggaggctcagaccaacgatagccggttttacccg

SEQ ID NO: 5343 - DNA, 37 bp, Artificial Sequence
  Synthetic
gtgcccggttgctggcgaagggtcgcagtggcaaaca

SEQ ID NO: 5344 - DNA, 39 bp, Artificial Sequence
  Synthetic
ctgggtgtgtcggcagtgaccacatcaccggctggaatt

SEQ ID NO: 5345 - DNA, 38 bp, Artificial Sequence
  Synthetic
ggcaggtaccgtgcgctcttaccacgtgacaccagcct

SEQ ID NO: 5346 - DNA, 38 bp, Artificial Sequence
  Synthetic
ggaacatgtggccccccatcacccgccaagcaaggggt

SEQ ID NO: 5347 - DNA, 39 bp, Artificial Sequence
  Synthetic
tgtgaagccggtggcggaagcgtagctagcagccatggg

SEQ ID NO: 5348 - DNA, 36 bp, Artificial Sequence
  Synthetic
cggcctctttcctgctgggaaggagcagagcagccg

SEQ ID NO: 5349 - DNA, 39 bp, Artificial Sequence
  Synthetic
gcgctcggcgttctactctggagacggttgacccagtcg

SEQ ID NO: 5350 - DNA, 40 bp, Artificial Sequence
  Synthetic
gatggggtgcagcaaaggatggatccacaagtacagcgcg

SEQ ID NO: 5351 - DNA, 39 bp, Artificial Sequence
  Synthetic
cgtctagcgcctacgacctgaggcaaatcaccggcgaag

SEQ ID NO: 5352 - DNA, 39 bp, Artificial Sequence
  Synthetic
ctgctgtgtccctactgccctctcggcaagaacagtcgt

SEQ ID NO: 5353 - DNA, 41 bp, Artificial Sequence
  Synthetic
agctggtgtgcaggagagaagaccctcccacaacctaaggg

SEQ ID NO: 5354 - DNA, 40 bp, Artificial Sequence
  Synthetic
tcgacgaacatgacatgcaggtcaaagcatgcacccggac

SEQ ID NO: 5355 - DNA, 41 bp, Artificial Sequence
  Synthetic
cttggctgaatgtgttgctgggggcttccgcatatccgtac

SEQ ID NO: 5356 - DNA, 40 bp, Artificial Sequence
  Synthetic
gagttggtgatgtgccaggtccgcgaggcaagagcttcag

SEQ ID NO: 5357 - DNA, 42 bp, Artificial Sequence
  Synthetic
atttggaagcttgtgaattcgactagcacgcaaacacacaat

SEQ ID NO: 5358 - DNA, 47 bp, Artificial Sequence
  Synthetic
aggcagtgtaagcatttttatcatgagctccagaataatatcttgca

SEQ ID NO: 5359 - DNA, 43 bp, Artificial Sequence
  Synthetic
ggcaattccctggaactatttcaagtttttgcaattgctcctc

SEQ ID NO: 5360 - DNA, 42 bp, Artificial Sequence
  Synthetic
tgcgttctagcaacaaaaaagcaacctactccaaacgactct

SEQ ID NO: 5361 - DNA, 40 bp, Artificial Sequence
  Synthetic
gtgggataggtgcaatgtcatttatgaactgtcccgcgat

SEQ ID NO: 5362 - DNA, 39 bp, Artificial Sequence
  Synthetic
caaggcttgctcccgaagaccaaatttggcctggttgtt

SEQ ID NO: 5363 - DNA, 48 bp, Artificial Sequence
  Synthetic
ctaaaagtcagttttggctgcaactgttacatcatccaatagagctat

SEQ ID NO: 5364 - DNA, 42 bp, Artificial Sequence
  Synthetic
tttggacacaattagacctgagtgattgaaacgctcgctgag

SEQ ID NO: 5365 - DNA, 40 bp, Artificial Sequence
  Synthetic
ccccaccacctccacaaccgtcggtttgttgtggctgttt

SEQ ID NO: 5366 - DNA, 37 bp, Artificial Sequence
  Synthetic
gtggaaggtcacccaggcggtgtggtgcaggaggagg

SEQ ID NO: 5367 - DNA, 38 bp, Artificial Sequence
  Synthetic
gcgaccccccagtaatcatttttagctctgttgcggac

SEQ ID NO: 5368 - DNA, 47 bp, Artificial Sequence
  Synthetic
atgctgcttttgctactaacatactcgccatagcaaatacaaaatgt

SEQ ID NO: 5369 - DNA, 41 bp, Artificial Sequence
  Synthetic
ccactagcacaggttccagtgctgacccgtgttggaggaat

SEQ ID NO: 5370 - DNA, 43 bp, Artificial Sequence
  Synthetic
tccagacagagattttcttgatgttcatatcccgctggtgttg

SEQ ID NO: 5371 - DNA, 43 bp, Artificial Sequence
  Synthetic
agtcattatacaccctcatgacagtttttacgtttgcgcctgt

SEQ ID NO: 5372 - DNA, 45 bp, Artificial Sequence
  Synthetic
ccaaatgtttattgtaggatgcacatcattttctgcacatggaac

SEQ ID NO: 5373 - DNA, 46 bp, Artificial Sequence
  Synthetic
atccagtgatgctcaattgtttaacccattattatgaccttgggct

SEQ ID NO: 5374 - DNA, 48 bp, Artificial Sequence
  Synthetic
caaacgtaaaaattgaggtctgaccttccttgaatactgtgtaaaagt

SEQ ID NO: 5375 - DNA, 43 bp, Artificial Sequence
  Synthetic
tcgaacaatcaagcagtgccactatctctgttatgttcctttc

SEQ ID NO: 5376 - DNA, 42 bp, Artificial Sequence
  Synthetic
atcgtgcggtcttggtaaatgtttgttgttcaaagtggttcc

SEQ ID NO: 5377 - DNA, 45 bp, Artificial Sequence
  Synthetic
atgcgactgctagcatcatttatgatgagttctgaggatgttctt

SEQ ID NO: 5378 - DNA, 48 bp, Artificial Sequence
  Synthetic
ccagaagttagatgtgtttgcagaacatttatatatagcacgggtcta

SEQ ID NO: 5379 - DNA, 47 bp, Artificial Sequence
  Synthetic
ctggttatgagactttcagggtcgtgacttgcctatttatttgtgac

SEQ ID NO: 5380 - DNA, 39 bp, Artificial Sequence
  Synthetic
aagaactgactcccggaaccagttcgtttgttgcttggc

SEQ ID NO: 5381 - DNA, 48 bp, Artificial Sequence
  Synthetic
ctaattcaaaatgcacaagctgtggttcagttttcttgtcatcagttg

SEQ ID NO: 5382 - DNA, 45 bp, Artificial Sequence
  Synthetic
tgagattccaattaagcagaccatctcataatcctctgctgtgtc

SEQ ID NO: 5383 - DNA, 44 bp, Artificial Sequence
  Synthetic
tctctcctatcattgttggcaacttatagtaaccggtgctggtt

SEQ ID NO: 5384 - DNA, 49 bp, Artificial Sequence
  Synthetic
actttgtcgatttgaaaatgagaggtggtagaactaagctttctaattc

SEQ ID NO: 5385 - DNA, 45 bp, Artificial Sequence
  Synthetic
ccctccgtgctcgaagatttgttaagtcagtacctttattactgt

SEQ ID NO: 5386 - DNA, 42 bp, Artificial Sequence
  Synthetic
tgaaacggaggatcataactctgcgctgaggagaggtggtaa

SEQ ID NO: 5387 - DNA, 40 bp, Artificial Sequence
  Synthetic
agcattgcctacagatatgccaatgcttcagaaacgcagc

SEQ ID NO: 5388 - DNA, 43 bp, Artificial Sequence
  Synthetic
cgaggcgcattagatggtaatgttcaattgagtaggtgctcta

SEQ ID NO: 5389 - DNA, 47 bp, Artificial Sequence
  Synthetic
agatgaatcaggccgatttgacctcataaagattcattaggttttcc

SEQ ID NO: 5390 - DNA, 39 bp, Artificial Sequence
  Synthetic
aaaaggcgaagagggaggagccgtcgtcgtcgtcgtaac

SEQ ID NO: 5391 - DNA, 45 bp, Artificial Sequence
  Synthetic
tctccagaaaatggggttgcaatttaatagtgtcatgtgcaaaca

SEQ ID NO: 5392 - DNA, 46 bp, Artificial Sequence
  Synthetic
cccctattgaacgtctacaatcctaacttgctgtacaaaacgtcta

SEQ ID NO: 5393 - DNA, 43 bp, Artificial Sequence
  Synthetic
tttcagatgtcttggacaaagtcagcacctttgcaacaggctt

SEQ ID NO: 5394 - DNA, 46 bp, Artificial Sequence
  Synthetic
aatttgctatcacagatgcatgtgtactagtctccatactaatcgc

SEQ ID NO: 5395 - DNA, 41 bp, Artificial Sequence
  Synthetic
agacaggatatggcatttgaccctactgtcctgttggtggt

SEQ ID NO: 5396 - DNA, 46 bp, Artificial Sequence
  Synthetic
aaatgggcaaggatatttatggtgatcttgcataaagctgttcctt

SEQ ID NO: 5397 - DNA, 48 bp, Artificial Sequence
  Synthetic
atggtgttttatggggtaatgactgctgaagttaatatttcgcgtatt

SEQ ID NO: 5398 - DNA, 41 bp, Artificial Sequence
  Synthetic
aacatgccctcaaactttggtttttgtgctacgtttgcagt

SEQ ID NO: 5399 - DNA, 40 bp, Artificial Sequence
  Synthetic
ggagatcctccatacagccattgtgttctgttgactgtgt

SEQ ID NO: 5400 - DNA, 42 bp, Artificial Sequence
  Synthetic
gaactcatgccttgaaacaatggaggccttgggttagtttgt

SEQ ID NO: 5401 - DNA, 48 bp, Artificial Sequence
  Synthetic
aatggtcacacaaagaacaataggggctcttattagatagcctctctt

SEQ ID NO: 5402 - DNA, 43 bp, Artificial Sequence
  Synthetic
ccaaactggcaaatgttgtgagtgaaagaaagctcagtgtctt

SEQ ID NO: 5403 - DNA, 45 bp, Artificial Sequence
  Synthetic
tgaagctccgaacacaaatacccattgaaatacttcaggtcaatg

SEQ ID NO: 5404 - DNA, 43 bp, Artificial Sequence
  Synthetic
tccaatcctccgacgattttgcgaatctatccactcctgcttg

SEQ ID NO: 5405 - DNA, 42 bp, Artificial Sequence
  Synthetic
cccagatggctctccaattgttcctctatggcacctatatgt

SEQ ID NO: 5406 - DNA, 43 bp, Artificial Sequence
  Synthetic
tgaagtctgcttaaagtgggagccagggggttacaaagtcttc

SEQ ID NO: 5407 - DNA, 43 bp, Artificial Sequence
  Synthetic
ccctagtagttcatataggagaccgattctggcatcaatccgg

SEQ ID NO: 5408 - DNA, 46 bp, Artificial Sequence
  Synthetic
tggagcctcagagagctaaaaattacaagcactgtagctctaattc

SEQ ID NO: 5409 - DNA, 44 bp, Artificial Sequence
  Synthetic
aaggtcaccattcaagattgattctgacacaacacagtctaacg

SEQ ID NO: 5410 - DNA, 47 bp, Artificial Sequence
  Synthetic
aacaccagaaagacaatccaaaaggttttcagcttcatcttcaatcc

SEQ ID NO: 5411 - DNA, 38 bp, Artificial Sequence
  Synthetic
tcctcaaggagtgcgtttggtgtcgtacgatgtggaag

SEQ ID NO: 5412 - DNA, 46 bp, Artificial Sequence
  Synthetic
gcttttaaaaatcctgaacaaaggcaatgtcccatagagtacgtag

SEQ ID NO: 5413 - DNA, 38 bp, Artificial Sequence
  Synthetic
caggaagaggaactgggggttgagttggccttccagac

SEQ ID NO: 5414 - DNA, 46 bp, Artificial Sequence
  Synthetic
caacagatgttggtgctgttggctacttcaaattcttcgttagagg

SEQ ID NO: 5415 - DNA, 48 bp, Artificial Sequence
  Synthetic
tcaaacctttgacattttagagccaacaaacctattacctaattgggt

SEQ ID NO: 5416 - DNA, 45 bp, Artificial Sequence
  Synthetic
cgccattgcaggaatttgctgcttactcttattgtaccttctgag

SEQ ID NO: 5417 - DNA, 45 bp, Artificial Sequence
  Synthetic
agtgagcgtttactaattgtgggaactttgatatctccaccatct

SEQ ID NO: 5418 - DNA, 50 bp, Artificial Sequence
  Synthetic
gttggagacacagaaaatcctagctgtttgtttaggatctatagacaagt

SEQ ID NO: 5419 - DNA, 41 bp, Artificial Sequence
  Synthetic
aactacaacaggacagagcaggtcaggccataagctgattg

SEQ ID NO: 5420 - DNA, 43 bp, Artificial Sequence
  Synthetic
aggatttgtcacaagaggcggcaactgaaacaatacacaacaa

SEQ ID NO: 5421 - DNA, 44 bp, Artificial Sequence
  Synthetic
ggactaggaaatgaagctgaagatcccattgctatcagactcag

SEQ ID NO: 5422 - DNA, 40 bp, Artificial Sequence
  Synthetic
cgtcgacgcctagaagacgacgttgttctctccgttgggc

SEQ ID NO: 5423 - DNA, 41 bp, Artificial Sequence
  Synthetic
gcaaactaaaatacaggggcatgccttcagcaacccatgaa

SEQ ID NO: 5424 - DNA, 42 bp, Artificial Sequence
  Synthetic
aattggtgccaatagacgcccgcactactatttcaggaccaa

SEQ ID NO: 5425 - DNA, 39 bp, Artificial Sequence
  Synthetic
cctagacgggtagcgactagctgtagtggccacaaatgt

SEQ ID NO: 5426 - DNA, 44 bp, Artificial Sequence
  Synthetic
tgtacaatagaagagtcagacaggtaattgaactgaatcgcctg

SEQ ID NO: 5427 - DNA, 41 bp, Artificial Sequence
  Synthetic
tcgtccttaatactggctctcgacctttaatgctgctccac

SEQ ID NO: 5428 - DNA, 45 bp, Artificial Sequence
  Synthetic
tgcttctggtaaggtgtatcttccaatcatctgtactcagcactc

SEQ ID NO: 5429 - DNA, 46 bp, Artificial Sequence
  Synthetic
acttctaagtcttccaaacgcaaagcaagtagaacaaagttcacat

SEQ ID NO: 5430 - DNA, 41 bp, Artificial Sequence
  Synthetic
gactcacagccaacctctctgttgcaagaggattatgtctc

SEQ ID NO: 5431 - DNA, 46 bp, Artificial Sequence
  Synthetic
ttcaggatcttgcatcgtttgaaccataacaaaatggtcctttcca

SEQ ID NO: 5432 - DNA, 44 bp, Artificial Sequence
  Synthetic
atcagattttatgtaagtgccagcgctgagaaagaagcagttgc

SEQ ID NO: 5433 - DNA, 48 bp, Artificial Sequence
  Synthetic
cagtgcagaaaatgaagctgaagcattgttattttcagttccagtttc

SEQ ID NO: 5434 - DNA, 42 bp, Artificial Sequence
  Synthetic
gcataatgccagagtggataacaatgactcactagctgtagc

SEQ ID NO: 5435 - DNA, 46 bp, Artificial Sequence
  Synthetic
tgatgttacatatgcatgttggagtggattaccatctaaacccgtt

SEQ ID NO: 5436 - DNA, 48 bp, Artificial Sequence
  Synthetic
aaatgctgcaaaagacattgatacaacataataacatgctcttgtctt

SEQ ID NO: 5437 - DNA, 39 bp, Artificial Sequence
  Synthetic
ctctcccactgcctggaaacatagtttcggagttccagg

SEQ ID NO: 5438 - DNA, 48 bp, Artificial Sequence
  Synthetic
gacactgtcacactaccaaaaggaattaacccttttactggtattcat

SEQ ID NO: 5439 - DNA, 41 bp, Artificial Sequence
  Synthetic
ttttcctgatgtcaccgttgttggaccagaaacagtgacat

SEQ ID NO: 5440 - DNA, 43 bp, Artificial Sequence
  Synthetic
tacactttttaaatcagccttcccgtctgctcctcctcaaagg

SEQ ID NO: 5441 - DNA, 48 bp, Artificial Sequence
  Synthetic
cccacaaacaaatataattcctggcattgcaggttcaatattagaagt

SEQ ID NO: 5442 - DNA, 43 bp, Artificial Sequence
  Synthetic
aatccagaaactcaacggctagtgtagttccaataccaagcgg

SEQ ID NO: 5443 - DNA, 40 bp, Artificial Sequence
  Synthetic
ctatggaaaacgagagcagctgtctcccattgttcctgct

SEQ ID NO: 5444 - DNA, 41 bp, Artificial Sequence
  Synthetic
acaaccaacatccagtattgaggcagcttgttcaggacagg

SEQ ID NO: 5445 - DNA, 45 bp, Artificial Sequence
  Synthetic
tgtttgactcatggggtcagtcgatggacagtctaaaatctgttt

SEQ ID NO: 5446 - DNA, 42 bp, Artificial Sequence
  Synthetic
ttcaggtacgtctttattgttgcctaccactcccggtcattg

SEQ ID NO: 5447 - DNA, 38 bp, Artificial Sequence
  Synthetic
gcccatcctggacatggagacgcccgtctggtccacca

SEQ ID NO: 5448 - DNA, 42 bp, Artificial Sequence
  Synthetic
ctcaagttttcgcacccgtcgcgaggaaatgctggcaggttc

SEQ ID NO: 5449 - DNA, 36 bp, Artificial Sequence
  Synthetic
gattccattcggggtgccgctgtggcctcccgttcc

SEQ ID NO: 5450 - DNA, 38 bp, Artificial Sequence
  Synthetic
taaggccctgggagcgcgtgccataaacgccgactacg

SEQ ID NO: 5451 - DNA, 38 bp, Artificial Sequence
  Synthetic
gcctcttccagtaactcggccctttgcggacgagctgc

SEQ ID NO: 5452 - DNA, 37 bp, Artificial Sequence
  Synthetic
gcgagtagttggtgatgcggcgcccggcctgacgatt

SEQ ID NO: 5453 - DNA, 36 bp, Artificial Sequence
  Synthetic
gagcttggccatgtacgcgcaacctccccggctgga

SEQ ID NO: 5454 - DNA, 36 bp, Artificial Sequence
  Synthetic
gtcggcgagcccacacacaaccacaccccccagtac

SEQ ID NO: 5455 - DNA, 35 bp, Artificial Sequence
  Synthetic
agaactgcccccgaagccacgagccacgccagaac

SEQ ID NO: 5456 - DNA, 36 bp, Artificial Sequence
  Synthetic
gttcgtcctgccccactggacagggccgagagaacg

SEQ ID NO: 5457 - DNA, 35 bp, Artificial Sequence
  Synthetic
gtggtccgtctcgctaacggagccgtcaagcgcgt

SEQ ID NO: 5458 - DNA, 37 bp, Artificial Sequence
  Synthetic
ccgaaggtcctcccagatccctgcagcaccatggccg

SEQ ID NO: 5459 - DNA, 40 bp, Artificial Sequence
  Synthetic
gcagaaccgggccacgatctggggcgataacatctgcatt

SEQ ID NO: 5460 - DNA, 35 bp, Artificial Sequence
  Synthetic
attggcgcgcggaccacaaccttccccaacgcgag

SEQ ID NO: 5461 - DNA, 39 bp, Artificial Sequence
  Synthetic
tgcactttgcgtgtctggtgtgatacgtcccgctcagga

SEQ ID NO: 5462 - DNA, 38 bp, Artificial Sequence
  Synthetic
cgtgtcgtcgaatgccaggccgcatcgatccggagatc

SEQ ID NO: 5463 - DNA, 36 bp, Artificial Sequence
  Synthetic
ggtgcggtgcctgccgataagccacttccccgactg

SEQ ID NO: 5464 - DNA, 37 bp, Artificial Sequence
  Synthetic
gaatgggagctcgggtccacaaccttccgtcccctgc

SEQ ID NO: 5465 - DNA, 37 bp, Artificial Sequence
  Synthetic
atcgccttgtgtgtgtgctggcccaagattcggcgcg

SEQ ID NO: 5466 - DNA, 37 bp, Artificial Sequence
  Synthetic
ggcgaacacggggctgcattccccctcgcacatcctc

SEQ ID NO: 5467 - DNA, 35 bp, Artificial Sequence
  Synthetic
cgccggatcgaggtaccgttggaggagcaagcggc

SEQ ID NO: 5468 - DNA, 40 bp, Artificial Sequence
  Synthetic
aggatcttgggtgctgacgcgccgagatttacaaggacca

SEQ ID NO: 5469 - DNA, 35 bp, Artificial Sequence
  Synthetic
tcagggggtgcgtcacgcttttaaccgcgagcgcc

SEQ ID NO: 5470 - DNA, 39 bp, Artificial Sequence
  Synthetic
ggccacctgacacagaggcgagcggctcaagatctttcg

SEQ ID NO: 5471 - DNA, 35 bp, Artificial Sequence
  Synthetic
tgtgggtgtgtaggcgatgctacgcgcgccaaacc

SEQ ID NO: 5472 - DNA, 35 bp, Artificial Sequence
  Synthetic
aagtctgcgggggagcggtgaggccgctgttggtg

SEQ ID NO: 5473 - DNA, 38 bp, Artificial Sequence
  Synthetic
atggtcgccgtcattatggccgcgaatgtgtgcggagg

SEQ ID NO: 5474 - DNA, 37 bp, Artificial Sequence
  Synthetic
cgctctccatcctgcatcaggagtgtcacgcgggagg

SEQ ID NO: 5475 - DNA, 36 bp, Artificial Sequence
  Synthetic
caggggcgatggaagcggagtgcgcctggattcgct

SEQ ID NO: 5476 - DNA, 39 bp, Artificial Sequence
  Synthetic
tccaggcagcgatgtttggcgtgctcagcccctgcttta

SEQ ID NO: 5477 - DNA, 39 bp, Artificial Sequence
  Synthetic
gtcctgtcggacgacggtgcatcatcagctcaagacggg

SEQ ID NO: 5478 - DNA, 39 bp, Artificial Sequence
  Synthetic
gccagggcgcagaagacgtcggtgttttacctgctgcag

SEQ ID NO: 5479 - DNA, 36 bp, Artificial Sequence
  Synthetic
cgctcaaacgccccgaggagttgcgcgccatccaac

SEQ ID NO: 5480 - DNA, 42 bp, Artificial Sequence
  Synthetic
acagggtgttgcaatacgacccatgcaaacagcctgtacgac

SEQ ID NO: 5481 - DNA, 38 bp, Artificial Sequence
  Synthetic
ggcggcgaacaaggcacatgttttgggggatgtccgtg

SEQ ID NO: 5482 - DNA, 38 bp, Artificial Sequence
  Synthetic
gctacgccaccaccatgcaggtttcggtccgttgtgac

SEQ ID NO: 5483 - DNA, 39 bp, Artificial Sequence
  Synthetic
cttcgaccggggtctcggacgagagcgtgtttatcctgg

SEQ ID NO: 5484 - DNA, 37 bp, Artificial Sequence
  Synthetic
gccccgttaggcgccagaagtttttctcgggggacgc

SEQ ID NO: 5485 - DNA, 39 bp, Artificial Sequence
  Synthetic
tgtgtctgtcctccggaagggctcatcccgccgaccttg

SEQ ID NO: 5486 - DNA, 36 bp, Artificial Sequence
  Synthetic
cggcacgctgttgacgcttgtggcctcgaataccga

SEQ ID NO: 5487 - DNA, 37 bp, Artificial Sequence
  Synthetic
ccccgcgtcagacaaaccctgagtcttcggacctcgc

SEQ ID NO: 5488 - DNA, 37 bp, Artificial Sequence
  Synthetic
ccgggacttttggatgtcgccacgaccacctgctccg

SEQ ID NO: 5489 - DNA, 39 bp, Artificial Sequence
  Synthetic
ccttcatgacggcgctggtactggaatagtggcgctggc

SEQ ID NO: 5490 - DNA, 38 bp, Artificial Sequence
  Synthetic
gtcaaagtcgccgccctccctcaagaaccccaccaacc

SEQ ID NO: 5491 - DNA, 37 bp, Artificial Sequence
  Synthetic
cggctcagctggtgggagtcaccttcggtgggggcta

SEQ ID NO: 5492 - DNA, 34 bp, Artificial Sequence
  Synthetic
tcagcttgcgggcctcgttgccatcgcgtggtgc

SEQ ID NO: 5493 - DNA, 36 bp, Artificial Sequence
  Synthetic
tgtacctgcgggcgaagatgtgggggactgcatcgg

SEQ ID NO: 5494 - DNA, 36 bp, Artificial Sequence
  Synthetic
tccacctcctgccacttggttggcctgggactgggt

SEQ ID NO: 5495 - DNA, 36 bp, Artificial Sequence
  Synthetic
gatggccgcgtggaactgcaagcgcgtggacatcct

SEQ ID NO: 5496 - DNA, 35 bp, Artificial Sequence
  Synthetic
tgcgaaagttgcgcccctgccctgagtcagtgcca

SEQ ID NO: 5497 - DNA, 38 bp, Artificial Sequence
  Synthetic
gcagggtctcgagttcggctcatgcaggagacgtaccg

SEQ ID NO: 5498 - DNA, 39 bp, Artificial Sequence
  Synthetic
ccgagcctcccaggtgcagaaccgagggcttcaaggagg

SEQ ID NO: 5499 - DNA, 39 bp, Artificial Sequence
  Synthetic
gttgccgtcttgggctttgtcggattacctccgttcgcg

SEQ ID NO: 5500 - DNA, 36 bp, Artificial Sequence
  Synthetic
cgtctacgtccgaagcgggatggccgggcagaagtt

SEQ ID NO: 5501 - DNA, 37 bp, Artificial Sequence
  Synthetic
gattccccagagcagccccgcttgatggcggcctgct

SEQ ID NO: 5502 - DNA, 38 bp, Artificial Sequence
  Synthetic
acatctcgcgcgcgctgtggtgaacgtcttttcgcact

SEQ ID NO: 5503 - DNA, 42 bp, Artificial Sequence
  Synthetic
ggtccgggtaaaacaacagccgagctttttttcgtccacacg

SEQ ID NO: 5504 - DNA, 37 bp, Artificial Sequence
  Synthetic
caggaggctgggatcgaaggcgcagcagctggaaggc

SEQ ID NO: 5505 - DNA, 36 bp, Artificial Sequence
  Synthetic
ggatcagctgctttgtgcgctcggggcccatgaacc

SEQ ID NO: 5506 - DNA, 36 bp, Artificial Sequence
  Synthetic
cgtcaggacggagagccaggatccagcggggccaga

SEQ ID NO: 5507 - DNA, 36 bp, Artificial Sequence
  Synthetic
gtgcggggcattgtgtctccggcgaggtgggcttct

SEQ ID NO: 5508 - DNA, 38 bp, Artificial Sequence
  Synthetic
gatcccccccgcgttccatgcagggcacatatgatcgc

SEQ ID NO: 5509 - DNA, 38 bp, Artificial Sequence
  Synthetic
ggtaggccgcgctacacgtcctacgttctggccctggt

SEQ ID NO: 5510 - DNA, 38 bp, Artificial Sequence
  Synthetic
gaggccctcttgcacgaacggaaccttaccaccccggc

SEQ ID NO: 5511 - DNA, 35 bp, Artificial Sequence
  Synthetic
gggtggttccgccttgcgtagcaagacccggggga

SEQ ID NO: 5512 - DNA, 38 bp, Artificial Sequence
  Synthetic
aaaagccagcgcgggtgggaccggcaagtttccaaagc

SEQ ID NO: 5513 - DNA, 36 bp, Artificial Sequence
  Synthetic
tgcgtgcaggcgtttaacgaccttgagggcgggcat

SEQ ID NO: 5514 - DNA, 38 bp, Artificial Sequence
  Synthetic
ctgcaccgagatcgtccatcccgcttcccaggttgcag

SEQ ID NO: 5515 - DNA, 39 bp, Artificial Sequence
  Synthetic
atcaggggccgtgatatgccgaggacatccgcgacgaaa

SEQ ID NO: 5516 - DNA, 39 bp, Artificial Sequence
  Synthetic
ctcctcgtccgtccggcactttgtgtttggagccaaggc

SEQ ID NO: 5517 - DNA, 40 bp, Artificial Sequence
  Synthetic
ttcagtcggtatcgctggcgccgcttctggtccacgagag

SEQ ID NO: 5518 - DNA, 38 bp, Artificial Sequence
  Synthetic
ccacgttcgagctcggggtggtgacgcaggtactcgtg

SEQ ID NO: 5519 - DNA, 36 bp, Artificial Sequence
  Synthetic
ggggacacgggctaccctcatgtgcgttcgatgcgg

SEQ ID NO: 5520 - DNA, 39 bp, Artificial Sequence
  Synthetic
tgtctggttcgaggacgaccactcgtgcgtctgcgtgtc

SEQ ID NO: 5521 - DNA, 37 bp, Artificial Sequence
  Synthetic
ggccgtgaatcccccgtcatttgccgacaccgtggtg

SEQ ID NO: 5522 - DNA, 36 bp, Artificial Sequence
  Synthetic
gtgtcccgcggggagaaaggacgacgcccccgaaga

SEQ ID NO: 5523 - DNA, 37 bp, Artificial Sequence
  Synthetic
tggtcgccaccacgcattgggaagtcacgaggtacgg

SEQ ID NO: 5524 - DNA, 35 bp, Artificial Sequence
  Synthetic
actcgttggcgcgctgaatcaccaccatccgcgtg

SEQ ID NO: 5525 - DNA, 38 bp, Artificial Sequence
  Synthetic
gcggcccgggagagaagagacacagagggccactcacg

SEQ ID NO: 5526 - DNA, 36 bp, Artificial Sequence
  Synthetic
aggttcaccatgcaggcgtgcccgacgcctcgtgaa

SEQ ID NO: 5527 - DNA, 39 bp, Artificial Sequence
  Synthetic
taacgatgcggggggtggcctccacaaaatctcggtcca

SEQ ID NO: 5528 - DNA, 38 bp, Artificial Sequence
  Synthetic
cgcctgtgcgtgtccttgtgttgcaggcggttgctgtc

SEQ ID NO: 5529 - DNA, 35 bp, Artificial Sequence
  Synthetic
ccgtcttcggtgccagtcctgttggtgccggtggg

SEQ ID NO: 5530 - DNA, 39 bp, Artificial Sequence
  Synthetic
tgtttggcgtcgtgagtcccgcctgcgtagttcaagagg

SEQ ID NO: 5531 - DNA, 37 bp, Artificial Sequence
  Synthetic
ggacagcagcggggagtgttcctctccgtgggggtct

SEQ ID NO: 5532 - DNA, 34 bp, Artificial Sequence
  Synthetic
cggccatgcacaccagcaggcgcggaccaggtaa

SEQ ID NO: 5533 - DNA, 37 bp, Artificial Sequence
  Synthetic
acgaacggccacgacagtgacgtacgccgaggctatg

SEQ ID NO: 5534 - DNA, 37 bp, Artificial Sequence
  Synthetic
ataacgacaaacggcccctcgttgctgatcccccgcc

SEQ ID NO: 5535 - DNA, 39 bp, Artificial Sequence
  Synthetic
tccaagccagccaagttaacggcaaaatccgccggggtg

SEQ ID NO: 5536 - DNA, 41 bp, Artificial Sequence
  Synthetic
ccccggtgtcgttcaacaaagattggggagaagcaggtgtc

SEQ ID NO: 5537 - DNA, 38 bp, Artificial Sequence
  Synthetic
tctggacatgtcggcggaatcctgtcgtcggggtcgtc

SEQ ID NO: 5538 - DNA, 36 bp, Artificial Sequence
  Synthetic
ttcttgcggaccacggcccgcgtgtatgggcatgcc

SEQ ID NO: 5539 - DNA, 37 bp, Artificial Sequence
  Synthetic
tcctccgcaaacaggcccgatcgtgcgcactaggtcc

SEQ ID NO: 5540 - DNA, 36 bp, Artificial Sequence
  Synthetic
gcaggaagctccacagggcagaacaacgccctgccc

SEQ ID NO: 5541 - DNA, 40 bp, Artificial Sequence
  Synthetic
gtcgttcggggtgctcgttgacaaaacttacgacaggcca

SEQ ID NO: 5542 - DNA, 36 bp, Artificial Sequence
  Synthetic
ccccggagacccccaaaccttgacacaggcgctcgg

SEQ ID NO: 5543 - DNA, 36 bp, Artificial Sequence
  Synthetic
ctggacgccatggacagggatggtcgaggggggctt

SEQ ID NO: 5544 - DNA, 37 bp, Artificial Sequence
  Synthetic
gtggtacacgagcacgagccaaggatcgccgggtggt

SEQ ID NO: 5545 - DNA, 39 bp, Artificial Sequence
  Synthetic
ccgcagatcgcagcggtctccctggcggtgaatgtagtc

SEQ ID NO: 5546 - DNA, 42 bp, Artificial Sequence
  Synthetic
tcagatcacccgcatcatccgatctggatgcggggaaaactc

SEQ ID NO: 5547 - DNA, 38 bp, Artificial Sequence
  Synthetic
tcagccttaccacgcccgacctcctcctccagtccaat

SEQ ID NO: 5548 - DNA, 38 bp, Artificial Sequence
  Synthetic
acttccgggcctcagaaccctccggatagccaggcctg

SEQ ID NO: 5549 - DNA, 37 bp, Artificial Sequence
  Synthetic
gggacctgcggccaacacactggggtgaggggacact

SEQ ID NO: 5550 - DNA, 38 bp, Artificial Sequence
  Synthetic
cgggctaaccaggaaatccgtgtcacacggccgggcta

SEQ ID NO: 5551 - DNA, 38 bp, Artificial Sequence
  Synthetic
cccgacggcgtagtggaggaggtcccccacaaagcgaa

SEQ ID NO: 5552 - DNA, 38 bp, Artificial Sequence
  Synthetic
cgccagcctgtttgtcctgggagccgttgtacgccaga

SEQ ID NO: 5553 - DNA, 37 bp, Artificial Sequence
  Synthetic
gtataccctgtccgtgggcgaccaccaggaccaccga

SEQ ID NO: 5554 - DNA, 38 bp, Artificial Sequence
  Synthetic
actcggaaagcgaagacgaggcaccgactgttggcggc

SEQ ID NO: 5555 - DNA, 42 bp, Artificial Sequence
  Synthetic
gctccgctaaaagaccgcatcggtgatgggggggaagagaga

SEQ ID NO: 5556 - DNA, 45 bp, Artificial Sequence
  Synthetic
ttcaattcagacagggaatcaacactgatttacccaggtgttgtt

SEQ ID NO: 5557 - DNA, 42 bp, Artificial Sequence
  Synthetic
ggggctgtggctgtattgaattgagttctcagtatgttgttc

SEQ ID NO: 5558 - DNA, 44 bp, Artificial Sequence
  Synthetic
gctggcgaaatcacatgtgtccaaattttgattgaaagataccc

SEQ ID NO: 5559 - DNA, 40 bp, Artificial Sequence
  Synthetic
agcggctttgaaatgatttgggcaccgagaagctactgtc

SEQ ID NO: 5560 - DNA, 42 bp, Artificial Sequence
  Synthetic
attcctatgggagtgggcctcaaccactgaacaaatggcact

SEQ ID NO: 5561 - DNA, 41 bp, Artificial Sequence
  Synthetic
tccttgccacaagaacacatcaggcctgttaataggaagtt

SEQ ID NO: 5562 - DNA, 40 bp, Artificial Sequence
  Synthetic
gaacgcccaccaaatattgcccatgcctcaaggtcggtcg

SEQ ID NO: 5563 - DNA, 44 bp, Artificial Sequence
  Synthetic
tttggaagatccagcgtctagagacacaagagttgcctgaactt

SEQ ID NO: 5564 - DNA, 42 bp, Artificial Sequence
  Synthetic
ctttcccgaccaccagttggataggtgtccttgttgggattg

SEQ ID NO: 5565 - DNA, 44 bp, Artificial Sequence
  Synthetic
gtggaccatatggccataattaagatcctaagtgacgggttctt

SEQ ID NO: 5566 - DNA, 47 bp, Artificial Sequence
  Synthetic
caagtacggtccattacccaaaagatgttttaacctttcgactttgt

SEQ ID NO: 5567 - DNA, 41 bp, Artificial Sequence
  Synthetic
attggagatgtgccacagcactgtctaagaatgtccaccat

SEQ ID NO: 5568 - DNA, 43 bp, Artificial Sequence
  Synthetic
atgaggagttcacaatggtgggatcttctggttgcttttctga

SEQ ID NO: 5569 - DNA, 40 bp, Artificial Sequence
  Synthetic
ttcagaaagatgcgaaagtgctccatcacactgtcgatgt

SEQ ID NO: 5570 - DNA, 45 bp, Artificial Sequence
  Synthetic
attcatcgtcgatgatgtgggaatgatccattgataggtattgac

SEQ ID NO: 5571 - DNA, 38 bp, Artificial Sequence
  Synthetic
ggacatttgacaccacccagtgctttgctttggtggag

SEQ ID NO: 5572 - DNA, 46 bp, Artificial Sequence
  Synthetic
aggtaaggaagacagaagatacggcttttgcaaggttactcagttc

SEQ ID NO: 5573 - DNA, 44 bp, Artificial Sequence
  Synthetic
gaaagcgtctgagtttagtatggaagtgcaacacatctcacaca

SEQ ID NO: 5574 - DNA, 44 bp, Artificial Sequence
  Synthetic
tctggttctaaatttcaactggtgcgcatcttagaagcattcgc

SEQ ID NO: 5575 - DNA, 43 bp, Artificial Sequence
  Synthetic
actgaaactggcattagagcatttttggggcaaagaaacgaaa

SEQ ID NO: 5576 - DNA, 39 bp, Artificial Sequence
  Synthetic
gtgatgaggtggatcaggggatttgtcacaatcctcccg

SEQ ID NO: 5577 - DNA, 47 bp, Artificial Sequence
  Synthetic
gttagtacgcctgaagaaaatggctgctttctgattagttctttcca

SEQ ID NO: 5578 - DNA, 44 bp, Artificial Sequence
  Synthetic
ccgttacctgtagcagcagtcttttttaatgactgcaacaacag

SEQ ID NO: 5579 - DNA, 41 bp, Artificial Sequence
  Synthetic
accgtatcccaatcggaaagccactggtactagagccgacc

SEQ ID NO: 5580 - DNA, 39 bp, Artificial Sequence
  Synthetic
aaagggttcagggggtgctactgtgactctaggtgttgt

SEQ ID NO: 5581 - DNA, 49 bp, Artificial Sequence
  Synthetic
agatcctatatcagacgttacagcagctatattttcatcttgtcctgta

SEQ ID NO: 5582 - DNA, 46 bp, Artificial Sequence
  Synthetic
ttgcagatgttatcacagtacacagtaactctaacgcgaccactat

SEQ ID NO: 5583 - DNA, 48 bp, Artificial Sequence
  Synthetic
aactgcaattgtagatgcagtggcctcatcatcaaattgtatttcact

SEQ ID NO: 5584 - DNA, 41 bp, Artificial Sequence
  Synthetic
aacgcttactacaagtaggccacctcaacagtttcctgagg

SEQ ID NO: 5585 - DNA, 40 bp, Artificial Sequence
  Synthetic
atcctctggctcaaacagatgaagctgtgtttgttttggg

SEQ ID NO: 5586 - DNA, 49 bp, Artificial Sequence
  Synthetic
cttgcaatttcagaacatttcagcagaaaatctggatatttacaggtgc

SEQ ID NO: 5587 - DNA, 45 bp, Artificial Sequence
  Synthetic
atcaatttccactaggtagacggtgctcttttctaacacgtttgt

SEQ ID NO: 5588 - DNA, 45 bp, Artificial Sequence
  Synthetic
tttgtctgaataaattgctgatgcgtgaaaaatatttgccagccc

SEQ ID NO: 5589 - DNA, 45 bp, Artificial Sequence
  Synthetic
aacggtctcttagagtcaaacaaggaaacacttgagtcagccata

SEQ ID NO: 5590 - DNA, 42 bp, Artificial Sequence
  Synthetic
agtcattgtcaccagatgctactattgtgacacttggagtct

SEQ ID NO: 5591 - DNA, 44 bp, Artificial Sequence
  Synthetic
tagtggagttgttgaagatgaagctgtctttttgcaccaacagt

SEQ ID NO: 5592 - DNA, 42 bp, Artificial Sequence
  Synthetic
accaactccttcggaagtgggaagtcgtgagtaaccgtgtct

SEQ ID NO: 5593 - DNA, 46 bp, Artificial Sequence
  Synthetic
ttggatatagaccattaggatccgcgtctagtcactggtaagtctg

SEQ ID NO: 5594 - DNA, 45 bp, Artificial Sequence
  Synthetic
aactgatgtaggtggtgttagtggtagctgtctcactttcttctg

SEQ ID NO: 5595 - DNA, 41 bp, Artificial Sequence
  Synthetic
ttaaatttcagttttccgcgggatgagctggtgttcgtaaa

SEQ ID NO: 5596 - DNA, 41 bp, Artificial Sequence
  Synthetic
ctgcgccaaatccagcttttgtccttctgatgtagcagaca

SEQ ID NO: 5597 - DNA, 44 bp, Artificial Sequence
  Synthetic
aagtcagttttccttgggtcgagctcgtttaccatttaacaaac

SEQ ID NO: 5598 - DNA, 41 bp, Artificial Sequence
  Synthetic
ggtcagtcatttggtcagcagatctcacaaatggacgtctg

SEQ ID NO: 5599 - DNA, 43 bp, Artificial Sequence
  Synthetic
gaattatactcatgggccaggagactgatactagcttccacag

SEQ ID NO: 5600 - DNA, 41 bp, Artificial Sequence
  Synthetic
ttcagtcgctctgcggagaggtgctagtgctggagagaacc

SEQ ID NO: 5601 - DNA, 40 bp, Artificial Sequence
  Synthetic
aagaggactgagaagccctggacgtggtttgttcctgccg

SEQ ID NO: 5602 - DNA, 43 bp, Artificial Sequence
  Synthetic
acaggttaaaacatattgtgtgggcgactccaacaggctctct

SEQ ID NO: 5603 - DNA, 42 bp, Artificial Sequence
  Synthetic
tggcaactatgtccatgtgccacccgaacttcttttcctcca

SEQ ID NO: 5604 - DNA, 46 bp, Artificial Sequence
  Synthetic
cagaagatggatccaaatagggctttttggtccctgttttatgtct

SEQ ID NO: 5605 - DNA, 42 bp, Artificial Sequence
  Synthetic
gtgccgagcacctagaagacagtttgccatgatgtgtcctgg

SEQ ID NO: 5606 - DNA, 41 bp, Artificial Sequence
  Synthetic
ttaccagttgccaagatagagccgccttggtccatctttcc

SEQ ID NO: 5607 - DNA, 45 bp, Artificial Sequence
  Synthetic
agatgtaggggatgcctatttttccctggtagggtaaatgcagta

SEQ ID NO: 5608 - DNA, 42 bp, Artificial Sequence
  Synthetic
tctactccagatgagaagttccaattggccatagttcacagc

SEQ ID NO: 5609 - DNA, 45 bp, Artificial Sequence
  Synthetic
tagaggcaacaatccaaaaaagccggattttctcttcctggtgta

SEQ ID NO: 5610 - DNA, 44 bp, Artificial Sequence
  Synthetic
gcagagaccttctacacagatggcatatcctgcttttccctctt

SEQ ID NO: 5611 - DNA, 48 bp, Artificial Sequence
  Synthetic
attcctggaaaagatagagcccggggttagttcttttataatgctatg

SEQ ID NO: 5612 - DNA, 38 bp, Artificial Sequence
  Synthetic
gcacacagacaatggccccaacctacccaccatgccac

SEQ ID NO: 5613 - DNA, 44 bp, Artificial Sequence
  Synthetic
tttccaggtctattacagagaaggcttccacagtagttcaccag

SEQ ID NO: 5614 - DNA, 38 bp, Artificial Sequence
  Synthetic
ccagactgtgcagacatcctcttcacctgccgtaaagc

SEQ ID NO: 5615 - DNA, 48 bp, Artificial Sequence
  Synthetic
ggcaaaggtcctggagatattgggcacaaatatctatactttgtgtag

SEQ ID NO: 5616 - DNA, 38 bp, Artificial Sequence
  Synthetic
aggcgccagagagctcattatacatcccgctctgaagt

SEQ ID NO: 5617 - DNA, 44 bp, Artificial Sequence
  Synthetic
atggagcctggtaggaatcagacaatatactaagcaagcacttg

SEQ ID NO: 5618 - DNA, 43 bp, Artificial Sequence
  Synthetic
acacctctatgtgtggcaatgaattgaggttgtggaactcgag

SEQ ID NO: 5619 - DNA, 47 bp, Artificial Sequence
  Synthetic
gagtcatgtgataagcactattgggttacatcttaatagggcaaagc

SEQ ID NO: 5620 - DNA, 40 bp, Artificial Sequence
  Synthetic
agccaatcaacacaaggcctagggtttgcttcacctcctg

SEQ ID NO: 5621 - DNA, 44 bp, Artificial Sequence
  Synthetic
cctcctagggaaggggagttgtccgatttttatctatgtcaatg

SEQ ID NO: 5622 - DNA, 45 bp, Artificial Sequence
  Synthetic
aatgactctttatcgcctgactggtgatatttgcctctaggtagc

SEQ ID NO: 5623 - DNA, 40 bp, Artificial Sequence
  Synthetic
agacttaaggcggcccaactgcctcgcgaatgcttggaaa

SEQ ID NO: 5624 - DNA, 50 bp, Artificial Sequence
  Synthetic
acctaataggagttcctgttacacccatatctattgccaatttataggtc

SEQ ID NO: 5625 - DNA, 46 bp, Artificial Sequence
  Synthetic
gtttgggcacaagtcaggattgcctgttattcactatatggtatcc

SEQ ID NO: 5626 - DNA, 41 bp, Artificial Sequence
  Synthetic
cagtacttggccggtactgggtgcttctaactggcagcttt

SEQ ID NO: 5627 - DNA, 42 bp, Artificial Sequence
  Synthetic
aacatcgtcaaactcacctcatgatcacaccagtcacattga

SEQ ID NO: 5628 - DNA, 49 bp, Artificial Sequence
  Synthetic
acatctggatgctttcctataatgcctctgagaagattaggtagttgtc

SEQ ID NO: 5629 - DNA, 45 bp, Artificial Sequence
  Synthetic
accatacatttgttcagaaggggattttgtcatcagagtggaacc

SEQ ID NO: 5630 - DNA, 46 bp, Artificial Sequence
  Synthetic
aggaacaattgtttatcaaagaggccttttattaccttgctcctgc

SEQ ID NO: 5631 - DNA, 42 bp, Artificial Sequence
  Synthetic
aagaggtttcttcggagctattgacctgcaatcattccttcc

SEQ ID NO: 5632 - DNA, 48 bp, Artificial Sequence
  Synthetic
taagctcacaaatagagcttgcagctcatcttcactgtttattatccc

SEQ ID NO: 5633 - DNA, 44 bp, Artificial Sequence
  Synthetic
tgctgcatctttaaatgatgatggcctagaagcagcagttgagt

SEQ ID NO: 5634 - DNA, 44 bp, Artificial Sequence
  Synthetic
aaggaggtcgcactcagctattgtatatgagacccatacaactg

SEQ ID NO: 5635 - DNA, 40 bp, Artificial Sequence
  Synthetic
cggaagccatggaggttgctcccaattgtcctcattgcct

SEQ ID NO: 5636 - DNA, 44 bp, Artificial Sequence
  Synthetic
tcttgatcgtcttttcttcaaatgcgaaggccctcttttcaaac

SEQ ID NO: 5637 - DNA, 44 bp, Artificial Sequence
  Synthetic
aggccattttcatcatgggagatctcctccataacaaaccagtt

SEQ ID NO: 5638 - DNA, 46 bp, Artificial Sequence
  Synthetic
actgaggaatgtgatttagccttacaacagaatgtttcggactaca

SEQ ID NO: 5639 - DNA, 38 bp, Artificial Sequence
  Synthetic
agaggaagcagatggagagcgagtctcctgtagtgcag

SEQ ID NO: 5640 - DNA, 43 bp, Artificial Sequence
  Synthetic
accttttatgaggaggttacaggaccatatctggcagcatctg

SEQ ID NO: 5641 - DNA, 49 bp, Artificial Sequence
  Synthetic
aaaattgaaggagatacatgggcagacccaagtatattacacttccaaa

SEQ ID NO: 5642 - DNA, 49 bp, Artificial Sequence
  Synthetic
ggcagggccatctgttatagatttctatgtcaataatagatggatcagg

SEQ ID NO: 5643 - DNA, 46 bp, Artificial Sequence
  Synthetic
tcttcaactacacatcctgaccctttcaccttgataatttggtgaa

SEQ ID NO: 5644 - DNA, 43 bp, Artificial Sequence
  Synthetic
ctgtttgaacaggttcctacacgaatattcaaactgcacagcg

SEQ ID NO: 5645 - DNA, 50 bp, Artificial Sequence
  Synthetic
ctcgtgcatctataactaccagaaggactcaatagcagataaatcttgat

SEQ ID NO: 5646 - DNA, 41 bp, Artificial Sequence
  Synthetic
ttttgcagatgactgtctggatgaagtactctggctgtggg

SEQ ID NO: 5647 - DNA, 44 bp, Artificial Sequence
  Synthetic
agagacagagaacgcttagtatggccaacacctagaggatttcc

SEQ ID NO: 5648 - DNA, 40 bp, Artificial Sequence
  Synthetic
tcctccatggggtgaatattggcctggcttcaagggtcta

SEQ ID NO: 5649 - DNA, 38 bp, Artificial Sequence
  Synthetic
ttttgggcgtaaggagcagcatccccaacatttcctgc

SEQ ID NO: 5650 - DNA, 47 bp, Artificial Sequence
  Synthetic
tttagcatttgtacccccaccacaagaagacaaatatctgtatgtgt

SEQ ID NO: 5651 - DNA, 49 bp, Artificial Sequence
  Synthetic
aagcgcaaaaggtctaagtaatttcgcatacagtaaacatttcacagta

SEQ ID NO: 5652 - DNA, 45 bp, Artificial Sequence
  Synthetic
ttaacggcgaaatatgaatcagagaaatagcccatgcaaatcttg

SEQ ID NO: 5653 - DNA, 44 bp, Artificial Sequence
  Synthetic
ccttaccaggttgacactatttgtgtagctaacacacacagtct

SEQ ID NO: 5654 - DNA, 47 bp, Artificial Sequence
  Synthetic
agactttatcagatgaaactgtggccaaaatatcctgtaaggcagtg

SEQ ID NO: 5655 - DNA, 38 bp, Artificial Sequence
  Synthetic
aagtcaaatggtgcagtggggtatgcaatggctggttc

SEQ ID NO: 5656 - DNA, 47 bp, Artificial Sequence
  Synthetic
aattgggacccaccgatttatccagcataatactccaatacactttc

SEQ ID NO: 5657 - DNA, 38 bp, Artificial Sequence
  Synthetic
acaaccgcagacgacaagcccttgtcctcgtcgtcgtc

SEQ ID NO: 5658 - DNA, 45 bp, Artificial Sequence
  Synthetic
aagttgaaggaacaacatgggctttcccaaatatataacactgct

SEQ ID NO: 5659 - DNA, 45 bp, Artificial Sequence
  Synthetic
agaagaaggaattccagatgttgggtgtttctgctcctaaaccag

SEQ ID NO: 5660 - DNA, 43 bp, Artificial Sequence
  Synthetic
actcgttctgctgaccttttccgggattttcaaattcaaatgt

SEQ ID NO: 5661 - DNA, 45 bp, Artificial Sequence
  Synthetic
agtgataaataacaccggcctaccctggcacatttttttcactag

SEQ ID NO: 5662 - DNA, 43 bp, Artificial Sequence
  Synthetic
tcctgaaagagaacgtttagtttggtaccgactccaagaggac

SEQ ID NO: 5663 - DNA, 43 bp, Artificial Sequence
  Synthetic
atgccagacatttcttttgtaaggagctcatctggaggattcc

SEQ ID NO: 5664 - DNA, 46 bp, Artificial Sequence
  Synthetic
tcctcctcaaggattggaggatacctttaggacacatagctgctaa

SEQ ID NO: 5665 - DNA, 38 bp, Artificial Sequence
  Synthetic
aacaaccggttctggtcgttaagacacaggcaccgata

SEQ ID NO: 5666 - DNA, 42 bp, Artificial Sequence
  Synthetic
agaagaatcccgctcttagaatgatttgtcagctgtgatcgg

SEQ ID NO: 5667 - DNA, 47 bp, Artificial Sequence
  Synthetic
agtacagtccattatccaaaggtgttccgtgttttaatctttcaacc

SEQ ID NO: 5668 - DNA, 42 bp, Artificial Sequence
  Synthetic
aatattgctcctttaatggtggcaaggaatctggtcttgcga

SEQ ID NO: 5669 - DNA, 41 bp, Artificial Sequence
  Synthetic
agagcaacagtatcagcagaccccaatttgtgtgctatggc

SEQ ID NO: 5670 - DNA, 41 bp, Artificial Sequence
  Synthetic
gaagagcaacagccattctaagacccttccgctgactatca

SEQ ID NO: 5671 - DNA, 43 bp, Artificial Sequence
  Synthetic
tgagacactttcaaaaggatgcaacattgtcgatgggttcaat

SEQ ID NO: 5672 - DNA, 41 bp, Artificial Sequence
  Synthetic
cagggaatggaaaagttgacgattctggcccgttaatctcc

SEQ ID NO: 5673 - DNA, 43 bp, Artificial Sequence
  Synthetic
acgttcgacactgttcaaataatcacctactctgttccggtgg

SEQ ID NO: 5674 - DNA, 41 bp, Artificial Sequence
  Synthetic
agagtctgcagtattgagaggattgcttaatgctggtccat

SEQ ID NO: 5675 - DNA, 45 bp, Artificial Sequence
  Synthetic
aacacattaactgaaagaggagtgggatgtttgttcgttccactg

SEQ ID NO: 5676 - DNA, 48 bp, Artificial Sequence
  Synthetic
tgaggcaaattctcagagaatcaggccattagttcttattccactgta

SEQ ID NO: 5677 - DNA, 47 bp, Artificial Sequence
  Synthetic
atcaacaatcttttgtaccgagtcccaattcttccagatagaccatt

SEQ ID NO: 5678 - DNA, 47 bp, Artificial Sequence
  Synthetic
cttgccatttcagaacatagatagcctcctttgcttaacatatctcg

SEQ ID NO: 5679 - DNA, 43 bp, Artificial Sequence
  Synthetic
caccagaatgcacagggagatgttatttgatcaattgccgatt

SEQ ID NO: 5680 - DNA, 47 bp, Artificial Sequence
  Synthetic
aactgtacgaacgagtgaaaagactgaaatatttcaaagcaaccagt

SEQ ID NO: 5681 - DNA, 41 bp, Artificial Sequence
  Synthetic
acttctgcctcatcacagccgcagatttgtaaattccgcag

SEQ ID NO: 5682 - DNA, 49 bp, Artificial Sequence
  Synthetic
tatcgccaagtgagaaagatcatcgtccacctatttaaaatgaatctga

SEQ ID NO: 5683 - DNA, 40 bp, Artificial Sequence
  Synthetic
gtgtggttgtacacagtgtggatgcagctgttgtatgtcc

SEQ ID NO: 5684 - DNA, 44 bp, Artificial Sequence
  Synthetic
agggtggtggaattgcttaagtgaccaaatgacaatccaaacag

SEQ ID NO: 5685 - DNA, 46 bp, Artificial Sequence
  Synthetic
accacagtgtctaaaggaatgtggctctattaacagttgattagca

SEQ ID NO: 5686 - DNA, 45 bp, Artificial Sequence
  Synthetic
acacagatagtaatgcagctgctgtctacacataattccacaatc

SEQ ID NO: 5687 - DNA, 41 bp, Artificial Sequence
  Synthetic
aacatgtgcagcactggaagtccatttcacgagccttaaat

SEQ ID NO: 5688 - DNA, 46 bp, Artificial Sequence
  Synthetic
actgtggaggttgtattcgatggcgtatataaatgtccatgctgta

SEQ ID NO: 5689 - DNA, 38 bp, Artificial Sequence
  Synthetic
ccccgccgcgaaaacgatacttgtgacgccgtagtgct

SEQ ID NO: 5690 - DNA, 41 bp, Artificial Sequence
  Synthetic
tgtgttgtgtgtgtggattagttagctagcaagacaggagg

SEQ ID NO: 5691 - DNA, 48 bp, Artificial Sequence
  Synthetic
ttaaactactgcagacatacgtgtgtacaaacaatacaaaaacccaac

SEQ ID NO: 5692 - DNA, 46 bp, Artificial Sequence
  Synthetic
ggacatttctcctcccaccaatacgtaaagtaaaaggatcactgta

SEQ ID NO: 5693 - DNA, 45 bp, Artificial Sequence
  Synthetic
aggctatagaattgcaacctttaggtcattaattgcggatgaagc

SEQ ID NO: 5694 - DNA, 41 bp, Artificial Sequence
  Synthetic
ctcctgtttccaaggtggtcaactgctggcatgataaaagt

SEQ ID NO: 5695 - DNA, 44 bp, Artificial Sequence
  Synthetic
tatggcagatgtagggtttggagcacctcagcttttgaagtttg

SEQ ID NO: 5696 - DNA, 41 bp, Artificial Sequence
  Synthetic
attggaatgttggtgtagctccatatggcctgagactgcac

SEQ ID NO: 5697 - DNA, 46 bp, Artificial Sequence
  Synthetic
tgtactgccaaatggtattgctaagctttctaaaacatgcttgtgc

SEQ ID NO: 5698 - DNA, 45 bp, Artificial Sequence
  Synthetic
aaatggttcaatgggcgtatgaaaagcataatagtaagcaattgc

SEQ ID NO: 5699 - DNA, 49 bp, Artificial Sequence
  Synthetic
aaatgttgtagggaatgtgatggtccctgatacttaagtaaattagcaa

SEQ ID NO: 5700 - DNA, 41 bp, Artificial Sequence
  Synthetic
gattcctcaagaagcggcaggatcgtcgtcgttgtcctctt

SEQ ID NO: 5701 - DNA, 49 bp, Artificial Sequence
  Synthetic
caagagttgagcgacttaaagcagctccaacatttcaatttattagcac

SEQ ID NO: 5702 - DNA, 40 bp, Artificial Sequence
  Synthetic
tgtaggtgagcatcccaatgtagctgcacatcgatttgag

SEQ ID NO: 5703 - DNA, 44 bp, Artificial Sequence
  Synthetic
tggggacagattgtttttttatggtatcaccaacaactccatct

SEQ ID NO: 5704 - DNA, 43 bp, Artificial Sequence
  Synthetic
tcgttagttagcagcgaatctcattccctgagctttatgtacc

SEQ ID NO: 5705 - DNA, 40 bp, Artificial Sequence
  Synthetic
attaatgcaatggactctcgcacctgaggaggtgaaggaa

SEQ ID NO: 5706 - DNA, 42 bp, Artificial Sequence
  Synthetic
aagcgaccacggaatatctatgagtttagtagtgcgacgctt

SEQ ID NO: 5707 - DNA, 43 bp, Artificial Sequence
  Synthetic
ttaccctcctattatttgcccacaaacgtttgtgtgcgatgtt

SEQ ID NO: 5708 - DNA, 41 bp, Artificial Sequence
  Synthetic
aagctggcaagaacaacacccagaagatgactcaaatgcct

SEQ ID NO: 5709 - DNA, 42 bp, Artificial Sequence
  Synthetic
atggctggatcaagtgagcaggccatttgcctagcctgactt

SEQ ID NO: 5710 - DNA, 42 bp, Artificial Sequence
  Synthetic
tcttcaaatgcatttatcgtcgctagactcaggcactccttc

SEQ ID NO: 5711 - DNA, 49 bp, Artificial Sequence
  Synthetic
acctaacaacaaatggaagtaatgcgttttagatctttctcgatcatgt

SEQ ID NO: 5712 - DNA, 46 bp, Artificial Sequence
  Synthetic
aagctatcactagtatctcagggttcttgtctgaaagcttccaatc

SEQ ID NO: 5713 - DNA, 46 bp, Artificial Sequence
  Synthetic
atatgttccagctaggacaagcaccaagttcatcttctagtgttga

SEQ ID NO: 5714 - DNA, 41 bp, Artificial Sequence
  Synthetic
atcaactaatatctcctcggccctaggtcttcttgggggtc

SEQ ID NO: 5715 - DNA, 43 bp, Artificial Sequence
  Synthetic
gaggaatctccagaagcatcacgatcaatatcctccgtgttct

SEQ ID NO: 5716 - DNA, 43 bp, Artificial Sequence
  Synthetic
aatcctcatcatggaatctcaccaagttgtgtttgtctgttcg

SEQ ID NO: 5717 - DNA, 48 bp, Artificial Sequence
  Synthetic
atacactagagaacgatgtgcaagtgttgcatttgattcattgtatga

SEQ ID NO: 5718 - DNA, 45 bp, Artificial Sequence
  Synthetic
gaacagagaaaagcagtaccccatctaaataccgagatccatgtt

SEQ ID NO: 5719 - DNA, 44 bp, Artificial Sequence
  Synthetic
acaaagttgctcttgctcctccgtacaattcacgaagattactc

SEQ ID NO: 5720 - DNA, 49 bp, Artificial Sequence
  Synthetic
aatctctacttcaatctggacgcagtcctaagtttttgattatccctta

SEQ ID NO: 5721 - DNA, 44 bp, Artificial Sequence
  Synthetic
tgtgatagtaaccaatcaggaatcccccctccaaagaatcgttt

SEQ ID NO: 5722 - DNA, 43 bp, Artificial Sequence
  Synthetic
agaatggtatattcctcttcccagcacatctgctccacctaga

SEQ ID NO: 5723 - DNA, 46 bp, Artificial Sequence
  Synthetic
agtacaataggtatcaacggaatgctgtgtagaatgcaagagttcc

SEQ ID NO: 5724 - DNA, 43 bp, Artificial Sequence
  Synthetic
aagcataccaatcacggaaagggagcttgttgttatgagtagc

SEQ ID NO: 5725 - DNA, 43 bp, Artificial Sequence
  Synthetic
acccaaaaataaggttaatgccaggcacagccatcaacagtcg

SEQ ID NO: 5726 - DNA, 46 bp, Artificial Sequence
  Synthetic
atgagaatgtaatctgcaacacaacgactataagatgcctgattgc

SEQ ID NO: 5727 - DNA, 42 bp, Artificial Sequence
  Synthetic
acttactcaacagcaactgaaagaccagctgagagtgttctg

SEQ ID NO: 5728 - DNA, 48 bp, Artificial Sequence
  Synthetic
aaacgctgttgattattaccagagcaattgtcaaatcctcatctaact

SEQ ID NO: 5729 - DNA, 48 bp, Artificial Sequence
  Synthetic
tagacgaaacaagatcagcatcttctgaataaccattctcaattgctt

SEQ ID NO: 5730 - DNA, 42 bp, Artificial Sequence
  Synthetic
cagtgttgggggattcaattacaatgcagcaactgatggatc

SEQ ID NO: 5731 - DNA, 45 bp, Artificial Sequence
  Synthetic
aagtggacttgaaacacctgaccttctgatcctgttattaccacc

SEQ ID NO: 5732 - DNA, 49 bp, Artificial Sequence
  Synthetic
gtctcaaaattttaacaccggtagcttgcagtatcttttaatctgtgtg

SEQ ID NO: 5733 - DNA, 40 bp, Artificial Sequence
  Synthetic
atttgggttgcaacagtttggaaatctcgtgacggaacac

SEQ ID NO: 5734 - DNA, 41 bp, Artificial Sequence
  Synthetic
tagggcatgccgatttgtttctgcagacccataacatatgt

SEQ ID NO: 5735 - DNA, 48 bp, Artificial Sequence
  Synthetic
cgtaagcccttagattacaaacgtcaccatgcacatattcaatctctt

SEQ ID NO: 5736 - DNA, 40 bp, Artificial Sequence
  Synthetic
ccaagtcttggtctgttggtgactgatcacgttgcaacaa

SEQ ID NO: 5737 - DNA, 43 bp, Artificial Sequence
  Synthetic
ggatacattctgcttcaatgtacgctttcagcacccaacatgg

SEQ ID NO: 5738 - DNA, 43 bp, Artificial Sequence
  Synthetic
tgaaacttgtactattgccggtaaaagcgcattatcaagcaaa

SEQ ID NO: 5739 - DNA, 44 bp, Artificial Sequence
  Synthetic
acttacaatcgccaacaattattccacatcgccaattacaacag

SEQ ID NO: 5740 - DNA, 45 bp, Artificial Sequence
  Synthetic
tgattacagggcttttatcagtgttttagactctgcagctttcac

SEQ ID NO: 5741 - DNA, 48 bp, Artificial Sequence
  Synthetic
ggtttctactgttaaaattggtggcacaatgtaaggtttatcaaaagc

SEQ ID NO: 5742 - DNA, 46 bp, Artificial Sequence
  Synthetic
agatgcagagtttgtagaaccagttcttataaaagacgtgctcatc

SEQ ID NO: 5743 - DNA, 46 bp, Artificial Sequence
  Synthetic
ttcaatcagcactttctgttgtttccgccttcttcatcataaatgt

SEQ ID NO: 5744 - DNA, 45 bp, Artificial Sequence
  Synthetic
tatgcagttttttaaaatgggccgacgtatacattgctcagcagt

SEQ ID NO: 5745 - DNA, 43 bp, Artificial Sequence
  Synthetic
aggcgtttccttatggtacttgaactgcctaattgtacacatg

SEQ ID NO: 5746 - DNA, 46 bp, Artificial Sequence
  Synthetic
cttcctcgttcatgacaatgtagcgtcaacaccattaacaacagta

SEQ ID NO: 5747 - DNA, 46 bp, Artificial Sequence
  Synthetic
aaccagtgtccgtaattaaagttgcacacacaacaagtcttctgta

SEQ ID NO: 5748 - DNA, 48 bp, Artificial Sequence
  Synthetic
ataccagctgactacatcttgcccctacaaaagaaacattacaagtca

SEQ ID NO: 5749 - DNA, 45 bp, Artificial Sequence
  Synthetic
agatgctgttacttttgcaacagtccattaacaacagcactttca

SEQ ID NO: 5750 - DNA, 44 bp, Artificial Sequence
  Synthetic
gctattatagtcagtgtcgaacagcagcaacaccactcaaaagt

SEQ ID NO: 5751 - DNA, 47 bp, Artificial Sequence
  Synthetic
gttcttaaatctaagtggtggctgcgcaaaactactgagtacaatgt

SEQ ID NO: 5752 - DNA, 42 bp, Artificial Sequence
  Synthetic
tttggatgttgtgtggaagcatgacaatgaaaggttgcatat

SEQ ID NO: 5753 - DNA, 46 bp, Artificial Sequence
  Synthetic
acacaattgtcaatggtgtgcaacacaaaacttactaccaccattt

SEQ ID NO: 5754 - DNA, 42 bp, Artificial Sequence
  Synthetic
aacaactttgtcagttcgtatgcttacaacacgccaagtcat

SEQ ID NO: 5755 - DNA, 40 bp, Artificial Sequence
  Synthetic
ctggtgatgctggccattcaatcaaacacacaagaccaca

SEQ ID NO: 5756 - DNA, 44 bp, Artificial Sequence
  Synthetic
ttttacactacaagctgcttttggtcaggtgttgtgactccaaa

SEQ ID NO: 5757 - DNA, 40 bp, Artificial Sequence
  Synthetic
gtgttgaatccaatgcaggtgtaacgtaaccattggcaac

SEQ ID NO: 5758 - DNA, 42 bp, Artificial Sequence
  Synthetic
ttttgctccatggtggttgtgtcagcaaactaggtaacaaac

SEQ ID NO: 5759 - DNA, 38 bp, Artificial Sequence
  Synthetic
tttgcgcaaaatggcacaacatagcagacacggacaac

SEQ ID NO: 5760 - DNA, 44 bp, Artificial Sequence
  Synthetic
ctggtgaaggttttaacatcttagctgttcacaccaaaaacacc

SEQ ID NO: 5761 - DNA, 47 bp, Artificial Sequence
  Synthetic
ttatgctgctatattgaatggttgctcattataatgctccacaaaca

SEQ ID NO: 5762 - DNA, 46 bp, Artificial Sequence
  Synthetic
taaccctggttttcttactccgtaaatgtaagacagagtgacaaag

SEQ ID NO: 5763 - DNA, 45 bp, Artificial Sequence
  Synthetic
gcacttatttgttctcactcattgcaccagcaaactaacgtagtc

SEQ ID NO: 5764 - DNA, 47 bp, Artificial Sequence
  Synthetic
tatggttgctaatggtttgaatgcaagtttaaaagacagaaagagcg

SEQ ID NO: 5765 - DNA, 40 bp, Artificial Sequence
  Synthetic
aacttgtgtgacgaccctgaaaagaaaaaggccaacaacg

SEQ ID NO: 5766 - DNA, 42 bp, Artificial Sequence
  Synthetic
tgctgcagctatgtacaaagaagtgcatggcactaacaactt

SEQ ID NO: 5767 - DNA, 43 bp, Artificial Sequence
  Synthetic
agatgttacaaaggaaaaccaggaaacgacacgttcacaagtc

SEQ ID NO: 5768 - DNA, 46 bp, Artificial Sequence
  Synthetic
tacagttgaattggaaccaccttgagatacttaatttggggtccag

SEQ ID NO: 5769 - DNA, 41 bp, Artificial Sequence
  Synthetic
gactaatggttctggtagcggttcctgcgtagtgttggaat

SEQ ID NO: 5770 - DNA, 40 bp, Artificial Sequence
  Synthetic
ctagtgccgctcgactagagaatgcacggacacagtaatc

SEQ ID NO: 5771 - DNA, 45 bp, Artificial Sequence
  Synthetic
ggagatattggttcttactggttgttctatggggtcaaaccaatt

SEQ ID NO: 5772 - DNA, 47 bp, Artificial Sequence
  Synthetic
tgatgcctgttatgggtatgactaagatgtcacttttcataaagcac

SEQ ID NO: 5773 - DNA, 43 bp, Artificial Sequence
  Synthetic
agttgctactgctggttaccatgttaacatctttgttccacac

SEQ ID NO: 5774 - DNA, 43 bp, Artificial Sequence
  Synthetic
tttcgatgagggttcagaattaacaattgcagcatcacccttt

SEQ ID NO: 5775 - DNA, 45 bp, Artificial Sequence
  Synthetic
tgtctgaaatccatagtagctaccagccataaaacttggtagtgc

SEQ ID NO: 5776 - DNA, 45 bp, Artificial Sequence
  Synthetic
agccactttgtattatcagaatggtagatcttcctcagtccaaca

SEQ ID NO: 5777 - DNA, 46 bp, Artificial Sequence
  Synthetic
ttgtctaagcatcctaaacctgagtagatgtttgacccagtctaac

SEQ ID NO: 5778 - DNA, 42 bp, Artificial Sequence
  Synthetic
tttgggttccatggacattgatggcgaatgtcagaccaatca

SEQ ID NO: 5779 - DNA, 47 bp, Artificial Sequence
  Synthetic
atacggttacttacaaatccactgcagcaacattatgagaagtcaaa

SEQ ID NO: 5780 - DNA, 38 bp, Artificial Sequence
  Synthetic
cgctctgtgcaaaagctgtcaacactcaactctggcac

SEQ ID NO: 5781 - DNA, 44 bp, Artificial Sequence
  Synthetic
gcttccagctcctagagttctcaacattatagtcaattggttcc

SEQ ID NO: 5782 - DNA, 50 bp, Artificial Sequence
  Synthetic
tttaggcttacaaactcagacagtggcgaatataacatagtcatattcac

SEQ ID NO: 5783 - DNA, 43 bp, Artificial Sequence
  Synthetic
aagactagtggtgacttggctcacatgttcataggtacaaaca

SEQ ID NO: 5784 - DNA, 45 bp, Artificial Sequence
  Synthetic
tgtacctctacaagttggtttttccgttagaacacaaccttcagg

SEQ ID NO: 5785 - DNA, 45 bp, Artificial Sequence
  Synthetic
acattgccaatgtggtactgttgcaatgcatgtttaaagcaacaa

SEQ ID NO: 5786 - DNA, 41 bp, Artificial Sequence
  Synthetic
gtcgcactgtgcagagtcatgattgctttagggttgtacaa

SEQ ID NO: 5787 - DNA, 39 bp, Artificial Sequence
  Synthetic
tcatgcatttcacactcctgcaacggtgctggtttcaat

SEQ ID NO: 5788 - DNA, 47 bp, Artificial Sequence
  Synthetic
agagaacattgcttttaacgttgttctaatggctactggtaattcac

SEQ ID NO: 5789 - DNA, 46 bp, Artificial Sequence
  Synthetic
ctgtttgtggttatacagactttgccagagtaaaacgttcgtatga

SEQ ID NO: 5790 - DNA, 40 bp, Artificial Sequence
  Synthetic
acaagactttttgcctcgcacacgcctatatccatgttca

SEQ ID NO: 5791 - DNA, 48 bp, Artificial Sequence
  Synthetic
ccaaggttcatgaggtcataattgagcattatctttacaccatagcat

SEQ ID NO: 5792 - DNA, 40 bp, Artificial Sequence
  Synthetic
tggctctgattatggtgttgcaaacaacaattgcgtcgtg

SEQ ID NO: 5793 - DNA, 50 bp, Artificial Sequence
  Synthetic
aactccactgttatgagtttgtcctgtgtttgcaattaaatttactcagg

SEQ ID NO: 5794 - DNA, 48 bp, Artificial Sequence
  Synthetic
aaatgtatttgctgttgagagtggtaggaaccaattattgaatgcaaa

SEQ ID NO: 5795 - DNA, 38 bp, Artificial Sequence
  Synthetic
ctgcttttgtgggtgcactaaatgtcctgtgcgtgaaa

SEQ ID NO: 5796 - DNA, 44 bp, Artificial Sequence
  Synthetic
acgtttattgtgttgtacgttgactaacagttaaagcacttgcc

SEQ ID NO: 5797 - DNA, 44 bp, Artificial Sequence
  Synthetic
ggcaccatctactctatcactcccagcttgctgataaacaacaa

SEQ ID NO: 5798 - DNA, 41 bp, Artificial Sequence
  Synthetic
agtgtttcagctatcgtcacagcctcaacctggaccgaagt

SEQ ID NO: 5799 - DNA, 38 bp, Artificial Sequence
  Synthetic
agcgtcatacctagcttgcccttctatggcactgcgac

SEQ ID NO: 5800 - DNA, 44 bp, Artificial Sequence
  Synthetic
atgttgcattgcagactgatgttgttaaaagatgcagcaagaat

SEQ ID NO: 5801 - DNA, 43 bp, Artificial Sequence
  Synthetic
ctgctttgaatgtattcgtttctcattgttgtgcaagctgtct

SEQ ID NO: 5802 - DNA, 48 bp, Artificial Sequence
  Synthetic
tcacatctcgcataatgtttgaaccgtgacattgcaattttcaatttg

SEQ ID NO: 5803 - DNA, 45 bp, Artificial Sequence
  Synthetic
acactgttcaaaaattgcaaactctagccactttaagtcgactaa

SEQ ID NO: 5804 - DNA, 46 bp, Artificial Sequence
  Synthetic
tacagtaatggctctaggtttgttcgcattgctaagcgattgatta

SEQ ID NO: 5805 - DNA, 43 bp, Artificial Sequence
  Synthetic
ttttccatacagcttggcactggtgtggttacattgaagacaa

SEQ ID NO: 5806 - DNA, 48 bp, Artificial Sequence
  Synthetic
aagctttgtttcacttgccatatgtatatgattggtaaatgtggtaca

SEQ ID NO: 5807 - DNA, 42 bp, Artificial Sequence
  Synthetic
aattgggattctaattgggcctttaacgagtgttgatacggc

SEQ ID NO: 5808 - DNA, 46 bp, Artificial Sequence
  Synthetic
acgagtaaaacacggtgatttttctctttcgttttctgtcatgttg

SEQ ID NO: 5809 - DNA, 39 bp, Artificial Sequence
  Synthetic
gaaagggcaaacgggtggatggtcctgtgccaagataat

SEQ ID NO: 5810 - DNA, 43 bp, Artificial Sequence
  Synthetic
tttgacaagcctcaggaaaaagatacgagaaggcttaggagta

SEQ ID NO: 5811 - DNA, 42 bp, Artificial Sequence
  Synthetic
ccagagaccttgaccacaacttttagctttaacaccattggc

SEQ ID NO: 5812 - DNA, 44 bp, Artificial Sequence
  Synthetic
aacttcacctgcaactgctgagcatgtttagtttacttcatcaa

SEQ ID NO: 5813 - DNA, 43 bp, Artificial Sequence
  Synthetic
actgaacctaggtgaacgctagtgcgatctttgattactccag

SEQ ID NO: 5814 - DNA, 46 bp, Artificial Sequence
  Synthetic
cttttagtatttggcttccgtccttaagtagccaaatacctaggac

SEQ ID NO: 5815 - DNA, 38 bp, Artificial Sequence
  Synthetic
ggaaatccccatgcactgttcacacttagcagctgact

SEQ ID NO: 5816 - DNA, 40 bp, Artificial Sequence
  Synthetic
aatggggaacaggagcagcagtgcaaaatgtccaggcact

SEQ ID NO: 5817 - DNA, 46 bp, Artificial Sequence
  Synthetic
agaagcaaactatgttaaaccaccaattgcaccataggagctaatt

SEQ ID NO: 5818 - DNA, 49 bp, Artificial Sequence
  Synthetic
aggacaatggataaaaaagtgtgggattaattagctttttccagtctcc

SEQ ID NO: 5819 - DNA, 46 bp, Artificial Sequence
  Synthetic
agtgctatatgacaacgaggaaaataggtcttctgaatcttggtaa

SEQ ID NO: 5820 - DNA, 43 bp, Artificial Sequence
  Synthetic
cactatccgtcgagacttgcagtgtgttagatggtccttttac

SEQ ID NO: 5821 - DNA, 40 bp, Artificial Sequence
  Synthetic
aaatggattgccagtgtggtgtacatacccagaggaaccc

SEQ ID NO: 5822 - DNA, 42 bp, Artificial Sequence
  Synthetic
gcttccattgttcccctggagggcagagggtctacaggtaca

SEQ ID NO: 5823 - DNA, 47 bp, Artificial Sequence
  Synthetic
cagccgcagaggttattattggtatccaaaggtatagattcaccaat

SEQ ID NO: 5824 - DNA, 40 bp, Artificial Sequence
  Synthetic
cgcctttgaggaggaggtaaccgcagcagcagcaagtgta

SEQ ID NO: 5825 - DNA, 42 bp, Artificial Sequence
  Synthetic
atctcctgccttggaaactgtgtttaccaccagtagaggtta

SEQ ID NO: 5826 - DNA, 45 bp, Artificial Sequence
  Synthetic
tccggtaaattatatttgccaccctcacgtaatcatctgtaggca

SEQ ID NO: 5827 - DNA, 41 bp, Artificial Sequence
  Synthetic
aatcctgagtctgaacgtttgggtagacccaacacctaacg

SEQ ID NO: 5828 - DNA, 48 bp, Artificial Sequence
  Synthetic
tggtgacaagattccagaacaaaatgactccccaggaataatatatgt

SEQ ID NO: 5829 - DNA, 40 bp, Artificial Sequence
  Synthetic
ccatctattggggatgcgtacatttccttagggggctctg

SEQ ID NO: 5830 - DNA, 41 bp, Artificial Sequence
  Synthetic
ggcagtttggcttcgaggtgcattgatggcctggaactgac

SEQ ID NO: 5831 - DNA, 36 bp, Artificial Sequence
  Synthetic
tcctgtcacaccccaccgttgaccctgtccgtgtgc

SEQ ID NO: 5832 - DNA, 41 bp, Artificial Sequence
  Synthetic
agcatgtgccccaatcttggagatccaggtgtagatgcagg

SEQ ID NO: 5833 - DNA, 40 bp, Artificial Sequence
  Synthetic
tccgactacctcccggagatgcgctcctccacctcaaaca

SEQ ID NO: 5834 - DNA, 39 bp, Artificial Sequence
  Synthetic
ccagagacggtgttgcgccggcaaaggatgaccaggttc

SEQ ID NO: 5835 - DNA, 38 bp, Artificial Sequence
  Synthetic
tgggtgcaaggctcgtgcgcaaaacatatggcatcccg

SEQ ID NO: 5836 - DNA, 42 bp, Artificial Sequence
  Synthetic
acacccagttatgcagtgccatgatagaattccaggaggttt

SEQ ID NO: 5837 - DNA, 37 bp, Artificial Sequence
  Synthetic
gtaggtgcctccagagcccctaagtttgggggcgccc

SEQ ID NO: 5838 - DNA, 38 bp, Artificial Sequence
  Synthetic
ccggtatcgggccagaggtggtggagtgttgggcttag

SEQ ID NO: 5839 - DNA, 40 bp, Artificial Sequence
  Synthetic
tccgtagaagggtcctcgtcctacccctgaaggtgaaccg

SEQ ID NO: 5840 - DNA, 35 bp, Artificial Sequence
  Synthetic
tgggccctcaagtccagccagagaagggccggtgg

SEQ ID NO: 5841 - DNA, 40 bp, Artificial Sequence
  Synthetic
gggccaagaacccagacgagtaccacctcctcttcttgct

SEQ ID NO: 5842 - DNA, 42 bp, Artificial Sequence
  Synthetic
aagccagacagcagccaattgtccactttataccaggggcag

SEQ ID NO: 5843 - DNA, 38 bp, Artificial Sequence
  Synthetic
accggtcgcccagtcctacggacccttctacggactcg

SEQ ID NO: 5844 - DNA, 40 bp, Artificial Sequence
  Synthetic
cccgtcttactgcccagcctggaaatgcataggagtgcga

SEQ ID NO: 5845 - DNA, 37 bp, Artificial Sequence
  Synthetic
cgagttacgctccttggagggccttcttccacggcgc

SEQ ID NO: 5846 - DNA, 35 bp, Artificial Sequence
  Synthetic
tgaccctcgcgccccatcttccacacccaccaccg

SEQ ID NO: 5847 - DNA, 38 bp, Artificial Sequence
  Synthetic
cacaaagctgtgtgacggtcccatcgagctcgctggcg

SEQ ID NO: 5848 - DNA, 37 bp, Artificial Sequence
  Synthetic
cggaagccctcgtttcggccatcactctcccaggccc

SEQ ID NO: 5849 - DNA, 40 bp, Artificial Sequence
  Synthetic
gtggattcgggggaagctggtccttctacgagcacgaaga

SEQ ID NO: 5850 - DNA, 37 bp, Artificial Sequence
  Synthetic
tcttgagctggcgcgggtaacgctgcaggatctggtc

SEQ ID NO: 5851 - DNA, 37 bp, Artificial Sequence
  Synthetic
gccagagccaacctcagctcaagtcgagggcatggcc

SEQ ID NO: 5852 - DNA, 39 bp, Artificial Sequence
  Synthetic
gcaccaccatcgtccacgagccgctatgctattgggaat

SEQ ID NO: 5853 - DNA, 38 bp, Artificial Sequence
  Synthetic
gaccggacggccacgttgtgagagtatggggcccctcc

SEQ ID NO: 5854 - DNA, 40 bp, Artificial Sequence
  Synthetic
cgtcgtccaggaccaaggggaaggaggagaacccgaggat

SEQ ID NO: 5855 - DNA, 37 bp, Artificial Sequence
  Synthetic
ccgaagggaggtgatggggaaaaaccatcccccggcc

SEQ ID NO: 5856 - DNA, 38 bp, Artificial Sequence
  Synthetic
gagggggaatcgtcggttagggtttgctcgcacggccc

SEQ ID NO: 5857 - DNA, 40 bp, Artificial Sequence
  Synthetic
aacgctcttttccttcaccgctcagatccctctggcgacg

SEQ ID NO: 5858 - DNA, 39 bp, Artificial Sequence
  Synthetic
gtggccaggcccaacgactacctccctcttttcactcct

SEQ ID NO: 5859 - DNA, 40 bp, Artificial Sequence
  Synthetic
agaaggggctgtggacataggctactgccggtccctgagg

SEQ ID NO: 5860 - DNA, 37 bp, Artificial Sequence
  Synthetic
gacacgccctggtcggactagagcctctccaggtccc

SEQ ID NO: 5861 - DNA, 34 bp, Artificial Sequence
  Synthetic
ccggcagccccttcatcctgcaggtcgcgccaaa

SEQ ID NO: 5862 - DNA, 36 bp, Artificial Sequence
  Synthetic
cgctgcctggtgaatgcgctcatccccctgcgtgtc

SEQ ID NO: 5863 - DNA, 36 bp, Artificial Sequence
  Synthetic
gctcggtagcagcggactcctaacggccggaatgcg

SEQ ID NO: 5864 - DNA, 38 bp, Artificial Sequence
  Synthetic
cctgccattcccagccactcccctcgcgagctgaacag

SEQ ID NO: 5865 - DNA, 40 bp, Artificial Sequence
  Synthetic
gagggccagatgcaggagcttgatagagggacatctgggc

SEQ ID NO: 5866 - DNA, 36 bp, Artificial Sequence
  Synthetic
ttcagctgctggacacgcagcgcacctacttcaccc

SEQ ID NO: 5867 - DNA, 35 bp, Artificial Sequence
  Synthetic
ggcgaggcgttgtggcacatgccatcctctcgcgg

SEQ ID NO: 5868 - DNA, 40 bp, Artificial Sequence
  Synthetic
gccaggtggattttgagctccgcctccagaatcagcggcg

SEQ ID NO: 5869 - DNA, 42 bp, Artificial Sequence
  Synthetic
ggcatagaggcctaggtccacaaacaagaccaccatcctgct

SEQ ID NO: 5870 - DNA, 42 bp, Artificial Sequence
  Synthetic
agcccaggaccagttctactccctggtcaaagaaggcgagaa

SEQ ID NO: 5871 - DNA, 44 bp, Artificial Sequence
  Synthetic
agatggggatatttaaaaggggcaggtttaacgagcagagaaga

SEQ ID NO: 5872 - DNA, 39 bp, Artificial Sequence
  Synthetic
acctacgcccttgccccctccgtcgctaaaaacacctgg

SEQ ID NO: 5873 - DNA, 40 bp, Artificial Sequence
  Synthetic
ctcccagtcagatgtccgtgctttgacctgtgcctcagca

SEQ ID NO: 5874 - DNA, 36 bp, Artificial Sequence
  Synthetic
gccaggatgccaccgaggttgaacaggccactcggg

SEQ ID NO: 5875 - DNA, 38 bp, Artificial Sequence
  Synthetic
acccggtccttgtgactgcttacgttgttgcatgccgc

SEQ ID NO: 5876 - DNA, 38 bp, Artificial Sequence
  Synthetic
atgacccaacgaaacagtcccgtcgcaggggcattggc

SEQ ID NO: 5877 - DNA, 39 bp, Artificial Sequence
  Synthetic
catggtcgggctcgggagagagtccggacagtttcatgc

SEQ ID NO: 5878 - DNA, 44 bp, Artificial Sequence
  Synthetic
ggggcattaactaagcttatgagctttcctccagaaagagtgac

SEQ ID NO: 5879 - DNA, 39 bp, Artificial Sequence
  Synthetic
ccagtttgccccatcgtttcccgcaaggatcccatgccc

SEQ ID NO: 5880 - DNA, 40 bp, Artificial Sequence
  Synthetic
cgaggatgaagcaacccccgggtagatggcgagactcttg

SEQ ID NO: 5881 - DNA, 40 bp, Artificial Sequence
  Synthetic
gctccgccacgtattccccgatctacgcttttagccacgg

SEQ ID NO: 5882 - DNA, 38 bp, Artificial Sequence
  Synthetic
tctctcaggacctcaaaggcgggcgaaccaagcccagg

SEQ ID NO: 5883 - DNA, 39 bp, Artificial Sequence
  Synthetic
atgtggcggctcttgaacccagacactccgagcctactg

SEQ ID NO: 5884 - DNA, 37 bp, Artificial Sequence
  Synthetic
cccggccatctttgccggattctggtagaggcgctgc

SEQ ID NO: 5885 - DNA, 38 bp, Artificial Sequence
  Synthetic
ggggacacggagcctgaccaaacttccagcaccaggcg

SEQ ID NO: 5886 - DNA, 40 bp, Artificial Sequence
  Synthetic
gatctcgtcccagttttgcggctcgacctggtcctcggag

SEQ ID NO: 5887 - DNA, 35 bp, Artificial Sequence
  Synthetic
gcccccggccatactccaatcttgagccggctggg

SEQ ID NO: 5888 - DNA, 39 bp, Artificial Sequence
  Synthetic
gcccatcatcccccgagcatcttccagcctctctttcca

SEQ ID NO: 5889 - DNA, 40 bp, Artificial Sequence
  Synthetic
catcgcaatcatgaagtcctccacaagcgttttgacccac

SEQ ID NO: 5890 - DNA, 38 bp, Artificial Sequence
  Synthetic
ggaccacgggtgtcaccagcgacctgcttctggacgcc

SEQ ID NO: 5891 - DNA, 41 bp, Artificial Sequence
  Synthetic
aatcccatgtcagggttggggttggtatcatgcacctcgct

SEQ ID NO: 5892 - DNA, 36 bp, Artificial Sequence
  Synthetic
cccgtgccgcagcgtaaacttctacggccccaggtc

SEQ ID NO: 5893 - DNA, 38 bp, Artificial Sequence
  Synthetic
gtgacgatgccatcaaccagctcggctactcgggggtt

SEQ ID NO: 5894 - DNA, 38 bp, Artificial Sequence
  Synthetic
aaacaccccccccactggcctcaagggggtcagtacct

SEQ ID NO: 5895 - DNA, 37 bp, Artificial Sequence
  Synthetic
ggggcacctaaagacccccctttcgctcttggccggg

SEQ ID NO: 5896 - DNA, 41 bp, Artificial Sequence
  Synthetic
tgtcttccacaccatccacagcacattttccccaggcagtc

SEQ ID NO: 5897 - DNA, 38 bp, Artificial Sequence
  Synthetic
cggagccccaagccacctttgtcgcccgatgtcgtaaa

SEQ ID NO: 5898 - DNA, 39 bp, Artificial Sequence
  Synthetic
tcttcatacaggcccgcaatttcactatctgctgctgac

SEQ ID NO: 5899 - DNA, 40 bp, Artificial Sequence
  Synthetic
cctggtccagcgttgcctcccgatttgacctcacacgaga

SEQ ID NO: 5900 - DNA, 40 bp, Artificial Sequence
  Synthetic
ttggtatagggcaaggttgggcgtggtgctacgcgagttg

SEQ ID NO: 5901 - DNA, 39 bp, Artificial Sequence
  Synthetic
ccttggggtagccgacggtgggtcacctgactactgaga

SEQ ID NO: 5902 - DNA, 41 bp, Artificial Sequence
  Synthetic
tgggcagcatgcttggataacttctcttcgaacacctggcc

SEQ ID NO: 5903 - DNA, 39 bp, Artificial Sequence
  Synthetic
ccgaaagggccaggtcggagcagcctatttttgagcacc

SEQ ID NO: 5904 - DNA, 38 bp, Artificial Sequence
  Synthetic
atttccgtcagccagggtgaccatgtgtgtgggcgcag

SEQ ID NO: 5905 - DNA, 37 bp, Artificial Sequence
  Synthetic
tcacctggatcccctcaccgcgtgagtggcaagggct

SEQ ID NO: 5906 - DNA, 41 bp, Artificial Sequence
  Synthetic
ggatcgattggaaaagggcccagcggcctgtttctaaacgt

SEQ ID NO: 5907 - DNA, 39 bp, Artificial Sequence
  Synthetic
gccagcaggtaaggcaggcccagatcttcctcagtggct

SEQ ID NO: 5908 - DNA, 39 bp, Artificial Sequence
  Synthetic
ctagattcagcgatcccccggtacgagcgggatagcagg

SEQ ID NO: 5909 - DNA, 36 bp, Artificial Sequence
  Synthetic
gagcttgcggctgagctcctccgtgaaggcagggtc

SEQ ID NO: 5910 - DNA, 36 bp, Artificial Sequence
  Synthetic
ctccagggagatgggggccattgccgatgccctggc

SEQ ID NO: 5911 - DNA, 39 bp, Artificial Sequence
  Synthetic
cagctgctgcttgtcgaggatgaagaagctgctggcggc

SEQ ID NO: 5912 - DNA, 39 bp, Artificial Sequence
  Synthetic
acacggcgtacatgtcgatgggtcttgcgggccaacacc

SEQ ID NO: 5913 - DNA, 36 bp, Artificial Sequence
  Synthetic
cccctgtcgaccagaggacgacggccaccaacgagg

SEQ ID NO: 5914 - DNA, 36 bp, Artificial Sequence
  Synthetic
gcaggcacagggtctcggtgccaagctgcagtcctg

SEQ ID NO: 5915 - DNA, 37 bp, Artificial Sequence
  Synthetic
ccagcagggcacagaggtgacgctttcggggcgtaag

SEQ ID NO: 5916 - DNA, 41 bp, Artificial Sequence
  Synthetic
ttccttcagcgtctatgcccagactggcagctgaaccagaa

SEQ ID NO: 5917 - DNA, 36 bp, Artificial Sequence
  Synthetic
cgggcctctggaccctcacaccggccagcctcaact

SEQ ID NO: 5918 - DNA, 39 bp, Artificial Sequence
  Synthetic
agatgtagccgcacggaccctgcacagactagcgaggat

SEQ ID NO: 5919 - DNA, 37 bp, Artificial Sequence
  Synthetic
tgagccggcagaggaccagcggtgttcacccgggatg

SEQ ID NO: 5920 - DNA, 38 bp, Artificial Sequence
  Synthetic
cgggtgaggcggctaagaggatatccgccgtctgctgc

SEQ ID NO: 5921 - DNA, 44 bp, Artificial Sequence
  Synthetic
ttcgagtatccttctttgatgttcgctgctaactcttgcaaaca

SEQ ID NO: 5922 - DNA, 44 bp, Artificial Sequence
  Synthetic
cttagtgaagagtctttgtcaccactctataagggctatgctcc

SEQ ID NO: 5923 - DNA, 42 bp, Artificial Sequence
  Synthetic
cccgcgattggaagctgtataaacaatcgtcttttgctttgt

SEQ ID NO: 5924 - DNA, 46 bp, Artificial Sequence
  Synthetic
ttcctttaagttcggtgattatccagctgactcatgactaagcata

SEQ ID NO: 5925 - DNA, 40 bp, Artificial Sequence
  Synthetic
tgtcccccaaggaagagctacagtgcatcgaaacgaactg

SEQ ID NO: 5926 - DNA, 43 bp, Artificial Sequence
  Synthetic
ttccacttctcttagttctcaaaggggaggaactgactgatcc

SEQ ID NO: 5927 - DNA, 43 bp, Artificial Sequence
  Synthetic
tgcaagcaggcccatagatgggggtaatttctgatagaggtac

SEQ ID NO: 5928 - DNA, 43 bp, Artificial Sequence
  Synthetic
acacctttagacagagttcagagagctgaatgtgacgcccata

SEQ ID NO: 5929 - DNA, 45 bp, Artificial Sequence
  Synthetic
cagaacggttgcttatggttggtttcatcgtctacagtatccatt

SEQ ID NO: 5930 - DNA, 43 bp, Artificial Sequence
  Synthetic
tgagtcttttcaacaagacagagctggccaaagagctgtttca

SEQ ID NO: 5931 - DNA, 49 bp, Artificial Sequence
  Synthetic
gatgttattccagcagaaaagcctgtcatatctatttcccaaaatgtgt

SEQ ID NO: 5932 - DNA, 44 bp, Artificial Sequence
  Synthetic
ctgaagccatttgcacttatcttctaaacggttggtgaatgtcc

SEQ ID NO: 5933 - DNA, 41 bp, Artificial Sequence
  Synthetic
ttcaaccgacactgttgacacaggttaacagagtgtgtcac

SEQ ID NO: 5934 - DNA, 43 bp, Artificial Sequence
  Synthetic
gctgagggagcaattgagctttctttgggaaatatttcgaatc

SEQ ID NO: 5935 - DNA, 48 bp, Artificial Sequence
  Synthetic
ccttgtactgtggggtattcatcattctgatagatattctgttgatcc

SEQ ID NO: 5936 - DNA, 41 bp, Artificial Sequence
  Synthetic
ttcgcactgagtagaggctttgttacactcatgcattgatg

SEQ ID NO: 5937 - DNA, 41 bp, Artificial Sequence
  Synthetic
ttgaagggggatggactggaccctgttcattctgatgatga

SEQ ID NO: 5938 - DNA, 43 bp, Artificial Sequence
  Synthetic
ctatcagattctggcgatctactcagaaactgattgcccccag

SEQ ID NO: 5939 - DNA, 44 bp, Artificial Sequence
  Synthetic
aggtggttatttgatcgttgggagcggtcatatgaaaatgtgta

SEQ ID NO: 5940 - DNA, 43 bp, Artificial Sequence
  Synthetic
atggactctgtagtagctgtgctcttttccaactacagcaaat

SEQ ID NO: 5941 - DNA, 41 bp, Artificial Sequence
  Synthetic
attgtgcagacactgtgggtccacctctggtatagtagctt

SEQ ID NO: 5942 - DNA, 45 bp, Artificial Sequence
  Synthetic
gaggcagacttcgccatgagctacagcattctttaggatctaatt

SEQ ID NO: 5943 - DNA, 40 bp, Artificial Sequence
  Synthetic
aaactcccgcgaactgttttggcaattgtgtttgttgctc

SEQ ID NO: 5944 - DNA, 41 bp, Artificial Sequence
  Synthetic
ctcagggaactaagggcttggacagctttcacattgctatg

SEQ ID NO: 5945 - DNA, 44 bp, Artificial Sequence
  Synthetic
aacgtaggcaaaagtagagaaactacttcagatacttgcagcaa

SEQ ID NO: 5946 - DNA, 45 bp, Artificial Sequence
  Synthetic
ttgatgaagctaccattgcatatcagtaaaaaagccctggcatta

SEQ ID NO: 5947 - DNA, 42 bp, Artificial Sequence
  Synthetic
aaaaggctttggacacagttagagctgagagtttccatcctc

SEQ ID NO: 5948 - DNA, 43 bp, Artificial Sequence
  Synthetic
taccaacctgtacctccgttggcaatagtaaaaccatgccaat

SEQ ID NO: 5949 - DNA, 40 bp, Artificial Sequence
  Synthetic
cgccaacaacatcgcgactcgggatgatgtcctggatcct

SEQ ID NO: 5950 - DNA, 37 bp, Artificial Sequence
  Synthetic
gacaggcgaaggggaaggggaggagtgggagcgggaa

SEQ ID NO: 5951 - DNA, 40 bp, Artificial Sequence
  Synthetic
agtactacgtggtcatgggtagaatcattcgcgctcttcc

SEQ ID NO: 5952 - DNA, 41 bp, Artificial Sequence
  Synthetic
cgtactaaacgtgcctctgttacgtggacatgtaccagcag

SEQ ID NO: 5953 - DNA, 41 bp, Artificial Sequence
  Synthetic
agttcgccctggggtgataccgggtcaattggtctgactgt

SEQ ID NO: 5954 - DNA, 40 bp, Artificial Sequence
  Synthetic
ggctcgtctgccattttagaggattgagttcgtgcaacac

SEQ ID NO: 5955 - DNA, 41 bp, Artificial Sequence
  Synthetic
acagaaacacctcagggatatgttacgtgtgcggattgttg

SEQ ID NO: 5956 - DNA, 45 bp, Artificial Sequence
  Synthetic
acctgatggtttggaggtgggaattaaaatccacatcttcaacag

SEQ ID NO: 5957 - DNA, 46 bp, Artificial Sequence
  Synthetic
gtgggtcatccatattatgatgtccagacactttagggacttcaat

SEQ ID NO: 5958 - DNA, 45 bp, Artificial Sequence
  Synthetic
ggttagagacacagaaaactctagcgatgtgttttgcctgtcatc

SEQ ID NO: 5959 - DNA, 49 bp, Artificial Sequence
  Synthetic
gtgatcaacaacaacgaacaatagcgttactaatgacccacttactgta

SEQ ID NO: 5960 - DNA, 40 bp, Artificial Sequence
  Synthetic
cttctgtatgcctcttggggacttggattttcgtgtcctc

SEQ ID NO: 5961 - DNA, 41 bp, Artificial Sequence
  Synthetic
cctgagctcacctatgtccggtcccaggatatattcgtctc

SEQ ID NO: 5962 - DNA, 42 bp, Artificial Sequence
  Synthetic
ggagatcccaaaagattttcaacgtgtcctatgagcgctgat

SEQ ID NO: 5963 - DNA, 42 bp, Artificial Sequence
  Synthetic
agtctgctcctaagcctgaaaagatttcttcttacccttggg

SEQ ID NO: 5964 - DNA, 44 bp, Artificial Sequence
  Synthetic
cttccctgaaggttgagacaatttgaatgctcaaatcaaaggcg

SEQ ID NO: 5965 - DNA, 46 bp, Artificial Sequence
  Synthetic
aaatccatctacgtgcatttccttactctgaaatggattcttgatg

SEQ ID NO: 5966 - DNA, 46 bp, Artificial Sequence
  Synthetic
aacggtttcaataaaaagctgtgctagacatgaagtatgcagagac

SEQ ID NO: 5967 - DNA, 40 bp, Artificial Sequence
  Synthetic
gtacagctcacagttggcgtaagcgatacgactatctagc

SEQ ID NO: 5968 - DNA, 45 bp, Artificial Sequence
  Synthetic
caaggcagcgtggaattatacaaccatattcaaagcctaaaacgg

SEQ ID NO: 5969 - DNA, 45 bp, Artificial Sequence
  Synthetic
gatctttatgctctgggggttgcttttttctggatcaaaacgttc

SEQ ID NO: 5970 - DNA, 47 bp, Artificial Sequence
  Synthetic
tctgtttctgtctataaccgaagtcactctctccatgatctttcaag

SEQ ID NO: 5971 - DNA, 42 bp, Artificial Sequence
  Synthetic
gctgttgccgagggaagaaacgattcttttctcgttcaatga

SEQ ID NO: 5972 - DNA, 45 bp, Artificial Sequence
  Synthetic
ttgcctgaatgagagtggacttgattatctaattcaaacagctcc

SEQ ID NO: 5973 - DNA, 43 bp, Artificial Sequence
  Synthetic
tcaaacagcatgatgtccgatagcaggcgttatggttatgcta

SEQ ID NO: 5974 - DNA, 45 bp, Artificial Sequence
  Synthetic
ataccctgtcagaaatacacgagcacaaaacaatcacaacagctc

SEQ ID NO: 5975 - DNA, 40 bp, Artificial Sequence
  Synthetic
gcagactttctgggggaggaaagagagctcagatctgtgt

SEQ ID NO: 5976 - DNA, 41 bp, Artificial Sequence
  Synthetic
tgatgagttgcgtaattggatgcacaggagacaatggcaac

SEQ ID NO: 5977 - DNA, 39 bp, Artificial Sequence
  Synthetic
tgcttgcgaaaggtgtgtacccattattccacccccatc

SEQ ID NO: 5978 - DNA, 41 bp, Artificial Sequence
  Synthetic
aaaggagaacctcgagccttgttggtaaaggatgtctgatg

SEQ ID NO: 5979 - DNA, 44 bp, Artificial Sequence
  Synthetic
ttagctcccaggttacgtcatgtatgagactgatagatgtttgt

SEQ ID NO: 5980 - DNA, 50 bp, Artificial Sequence
  Synthetic
tatcgatgtttctcgcttaacagaactctagatccttaaatagagcattt

SEQ ID NO: 5981 - DNA, 43 bp, Artificial Sequence
  Synthetic
ccgctttcctgtgtgtaatcatctctgctatcgaaaaggtttc

SEQ ID NO: 5982 - DNA, 44 bp, Artificial Sequence
  Synthetic
gatcttcagttacaacttgacagctgagttcgaggtgtttctct

SEQ ID NO: 5983 - DNA, 42 bp, Artificial Sequence
  Synthetic
aacgacctcggtacaaaaaccctggtttatgaagtggtggat

SEQ ID NO: 5984 - DNA, 42 bp, Artificial Sequence
  Synthetic
gcaaaacatctccttcctgcattgttgcttataagaaggctg

SEQ ID NO: 5985 - DNA, 41 bp, Artificial Sequence
  Synthetic
gaagctgacttcgccgatcttacttctcccagactgttctt

SEQ ID NO: 5986 - DNA, 42 bp, Artificial Sequence
  Synthetic
cgtatccttgccggtattcactcgatattacggagacaaaga

SEQ ID NO: 5987 - DNA, 43 bp, Artificial Sequence
  Synthetic
tgcacaagctttactgaacactacgaactcatagactagggat

SEQ ID NO: 5988 - DNA, 41 bp, Artificial Sequence
  Synthetic
cactgttcgcggttacaaacccttgtggttcagtaggagaa

SEQ ID NO: 5989 - DNA, 38 bp, Artificial Sequence
  Synthetic
tctagggatttggcctccacgaacccctacatccatgc

SEQ ID NO: 5990 - DNA, 41 bp, Artificial Sequence
  Synthetic
aggtttagggcttcttcctgcataccataaacagcctcagt

SEQ ID NO: 5991 - DNA, 46 bp, Artificial Sequence
  Synthetic
caagtagcgaaaaatccaacagcccacaaaccaaaaccttctatag

SEQ ID NO: 5992 - DNA, 38 bp, Artificial Sequence
  Synthetic
ctgctcagctcttgcggttataaccgcgaatcccatag

SEQ ID NO: 5993 - DNA, 43 bp, Artificial Sequence
  Synthetic
tttgtcacgaatatagccactgatttgggttcttctgagctag

SEQ ID NO: 5994 - DNA, 48 bp, Artificial Sequence
  Synthetic
agatcctctaaatttgaacctccgcatactaagttgtccattgttgat

SEQ ID NO: 5995 - DNA, 44 bp, Artificial Sequence
  Synthetic
tccagacatagcaacaatgacagaaacttcaataaacgaaagcg

SEQ ID NO: 5996 - DNA, 45 bp, Artificial Sequence
  Synthetic
tgatggttacttcctcaaaacaagaacggtaaaagaaggtcgttt

SEQ ID NO: 5997 - DNA, 40 bp, Artificial Sequence
  Synthetic
tcagaaccctgacggattgtctgagagagattgtggtact

SEQ ID NO: 5998 - DNA, 43 bp, Artificial Sequence
  Synthetic
ggctgcatcgtctcgagaacttaaaaaacacttgttggagaga

SEQ ID NO: 5999 - DNA, 45 bp, Artificial Sequence
  Synthetic
tctccagcagcaaaaactaaaattctggttcggtttctttacctc

SEQ ID NO: 6000 - DNA, 42 bp, Artificial Sequence
  Synthetic
tgtacggaagaagaattgaggtctaagaagaaggtggacgac

SEQ ID NO: 6001 - DNA, 41 bp, Artificial Sequence
  Synthetic
caacgttctctcctgcacgagttactggggttgaaatgttc

SEQ ID NO: 6002 - DNA, 44 bp, Artificial Sequence
  Synthetic
caagtagtcattgctatgctcgaatagagttgtacaagcgattg

SEQ ID NO: 6003 - DNA, 41 bp, Artificial Sequence
  Synthetic
agccgataatgctcgctcactcctccaactaaaagaccatt

SEQ ID NO: 6004 - DNA, 48 bp, Artificial Sequence
  Synthetic
gtccttcctgtttagggaaacgacgttttatttttatagcggacttct

SEQ ID NO: 6005 - DNA, 41 bp, Artificial Sequence
  Synthetic
cattctgtggcttctgcattagataaggatggccgattcgt

SEQ ID NO: 6006 - DNA, 46 bp, Artificial Sequence
  Synthetic
tacgatccaaattgagaaccttgcctgatacaccagaaatagtcga

SEQ ID NO: 6007 - DNA, 43 bp, Artificial Sequence
  Synthetic
tcttactagctccttgtcgagaacaggacttggagaagctttc

SEQ ID NO: 6008 - DNA, 38 bp, Artificial Sequence
  Synthetic
aatgccgctcgagtcaatgtagttcacgagcagtttgc

SEQ ID NO: 6009 - DNA, 38 bp, Artificial Sequence
  Synthetic
cgacaacccacgatcttgctgcgctcatttcttggttg

SEQ ID NO: 6010 - DNA, 41 bp, Artificial Sequence
  Synthetic
tcgctcccactaatgcaactcttgaagcttttggtacagta

SEQ ID NO: 6011 - DNA, 42 bp, Artificial Sequence
  Synthetic
aaacagtgaggacgacaaagtaaagtcggagatactgggagg

SEQ ID NO: 6012 - DNA, 42 bp, Artificial Sequence
  Synthetic
gcaatcgctaaaacaatcgattgcagcaattgtggctatcgc

SEQ ID NO: 6013 - DNA, 47 bp, Artificial Sequence
  Synthetic
gtaggtaaaacctcgtttggtcaacatctgtatcaaaaaaaggcagc

SEQ ID NO: 6014 - DNA, 43 bp, Artificial Sequence
  Synthetic
caggctgcacaccatcactacttttttatggttttgtctgtgc

SEQ ID NO: 6015 - DNA, 43 bp, Artificial Sequence
  Synthetic
ggaactgaccctataaggaatgcgtaacgacatcattgcatga

SEQ ID NO: 6016 - DNA, 41 bp, Artificial Sequence
  Synthetic
gacaaccatttttgctttgctgtgggatttggcgaagaaga

SEQ ID NO: 6017 - DNA, 42 bp, Artificial Sequence
  Synthetic
cgatcaaatcgcaaacaaacacttgatcgtgtgtgtcgtgat

SEQ ID NO: 6018 - DNA, 44 bp, Artificial Sequence
  Synthetic
gcgaacgtttacaaatggctcccaaaattttcgcaaaagcatac

SEQ ID NO: 6019 - DNA, 50 bp, Artificial Sequence
  Synthetic
atctgtgcagcttaaaacctaatgtctttagagaaagtcataaatacgga

SEQ ID NO: 6020 - DNA, 40 bp, Artificial Sequence
  Synthetic
ggcttctgtcaccttgctcagctttagttgtggcttcaac

SEQ ID NO: 6021 - DNA, 40 bp, Artificial Sequence
  Synthetic
ccgcacaagaaagccctcttggaaagactcctttggtgtt

SEQ ID NO: 6022 - DNA, 46 bp, Artificial Sequence
  Synthetic
ctgtcaattctacattatgtgcagcgatcttttttggagcatatgc

SEQ ID NO: 6023 - DNA, 46 bp, Artificial Sequence
  Synthetic
gaagctggttctacaacagaaactacagtttctccatagatagcac

SEQ ID NO: 6024 - DNA, 41 bp, Artificial Sequence
  Synthetic
gctcaaagtccaaaaaaacgcatcttggagcatcttgtgga

SEQ ID NO: 6025 - DNA, 44 bp, Artificial Sequence
  Synthetic
gcctgaccccagaaaccatttcttcttcattaaaatcagcaacg

SEQ ID NO: 6026 - DNA, 42 bp, Artificial Sequence
  Synthetic
tcgtttccttttccaggttcattggtcgaggacaatatgctc

SEQ ID NO: 6027 - DNA, 44 bp, Artificial Sequence
  Synthetic
ttaggtcctgtagctttagactcatcaaagagactcccgtagac

SEQ ID NO: 6028 - DNA, 41 bp, Artificial Sequence
  Synthetic
aaggcactattcgttgcaccaaagagttcagttccttggat

SEQ ID NO: 6029 - DNA, 41 bp, Artificial Sequence
  Synthetic
aatcacaatgcgctcccatttagtgcatgagaatcgtcttg

SEQ ID NO: 6030 - DNA, 42 bp, Artificial Sequence
  Synthetic
agaagcaaggatgaggttttctgtgttggagcacacatcacg

SEQ ID NO: 6031 - DNA, 42 bp, Artificial Sequence
  Synthetic
gcccctaaaacccgacaaagagaacgtccctaatattgaaga

SEQ ID NO: 6032 - DNA, 42 bp, Artificial Sequence
  Synthetic
aaaagcatctaggagctccccaaaggactggatatgaagtgg

SEQ ID NO: 6033 - DNA, 39 bp, Artificial Sequence
  Synthetic
cacaggagcaaccacgaagagtaaaagagtgccttggtg

SEQ ID NO: 6034 - DNA, 49 bp, Artificial Sequence
  Synthetic
acctctctgtaagcaaatactgacaggttacttccggatattaatgatc

SEQ ID NO: 6035 - DNA, 41 bp, Artificial Sequence
  Synthetic
cgaagcggtgaatgcatgaaggatgagatgttgaagagagc

SEQ ID NO: 6036 - DNA, 48 bp, Artificial Sequence
  Synthetic
actggaaaagctacaatggattgtagaagagtaagaagttcattgctt

SEQ ID NO: 6037 - DNA, 40 bp, Artificial Sequence
  Synthetic
tctgccatcaaagcatttcgaatgggaatgacgagtgatt

SEQ ID NO: 6038 - DNA, 38 bp, Artificial Sequence
  Synthetic
aatttggcggctggtaatcctgacttcggcgaatttgg

SEQ ID NO: 6039 - DNA, 42 bp, Artificial Sequence
  Synthetic
ttccgaccgagcaatctcagtttgggagtaaaagttcaggtt

SEQ ID NO: 6040 - DNA, 45 bp, Artificial Sequence
  Synthetic
caacacttttttaaggcatcttccagtagtgttgttgaagctcaa

SEQ ID NO: 6041 - DNA, 45 bp, Artificial Sequence
  Synthetic
ccaaagcgttcatatctcggactaagaaaaggtccttttgttgat

SEQ ID NO: 6042 - DNA, 40 bp, Artificial Sequence
  Synthetic
aagcaaccttgacgggcattgccattccactaaaaagcct

SEQ ID NO: 6043 - DNA, 40 bp, Artificial Sequence
  Synthetic
aaaccggcgtatttcttcctgaaaacaattcccctgtgga

SEQ ID NO: 6044 - DNA, 46 bp, Artificial Sequence
  Synthetic
agaccctcttacgctggttaacctttggagataataatagaggatt

SEQ ID NO: 6045 - DNA, 41 bp, Artificial Sequence
  Synthetic
tctttgtcatcgatttggtcacggaggggaaagcatcatca

SEQ ID NO: 6046 - DNA, 42 bp, Artificial Sequence
  Synthetic
cgtccactaccaagacctagatacgccaatcaaaatctcctt

SEQ ID NO: 6047 - DNA, 42 bp, Artificial Sequence
  Synthetic
tagctctgcagattttgtagcaccctccgggatagtcttagg

SEQ ID NO: 6048 - DNA, 45 bp, Artificial Sequence
  Synthetic
agctaaaccaacccgaagaatctgttcttacacatatcgatcgta

SEQ ID NO: 6049 - DNA, 47 bp, Artificial Sequence
  Synthetic
tctcaaaatccctttaaagcagagcatacgcggaaatttctacttct

SEQ ID NO: 6050 - DNA, 45 bp, Artificial Sequence
  Synthetic
atctggaaattcaagaaagtcgtggggtaagggatcaggaattcc

SEQ ID NO: 6051 - DNA, 42 bp, Artificial Sequence
  Synthetic
ctgaaggaatcgctcaaggacgtgttccaatttggtttggtt

SEQ ID NO: 6052 - DNA, 39 bp, Artificial Sequence
  Synthetic
tggaggggccattccgtaattgttgttcgagatccttgg

SEQ ID NO: 6053 - DNA, 39 bp, Artificial Sequence
  Synthetic
aacctgggagacaagatgcaccattggagataaaagcgc

SEQ ID NO: 6054 - DNA, 44 bp, Artificial Sequence
  Synthetic
caccctaatatagttccgctgcctcttgatacagtttgaaagct

SEQ ID NO: 6055 - DNA, 42 bp, Artificial Sequence
  Synthetic
cagatgcttttacgacttgcaaccaagatattggtgtgcggt

SEQ ID NO: 6056 - DNA, 40 bp, Artificial Sequence
  Synthetic
aagttcccatgatcgcctcaacaggaaactctaacccttt

SEQ ID NO: 6057 - DNA, 40 bp, Artificial Sequence
  Synthetic
gagcttgtcccaattgctccgtcaaaaagaaacggatcgt

SEQ ID NO: 6058 - DNA, 46 bp, Artificial Sequence
  Synthetic
tatcagcgatgcagtttctacagcagaagatacccacaataaaagc

SEQ ID NO: 6059 - DNA, 38 bp, Artificial Sequence
  Synthetic
tgttccccgtacaagcaagtttctgccccatatctgca

SEQ ID NO: 6060 - DNA, 43 bp, Artificial Sequence
  Synthetic
ctgctcagctgttaaaaagtcaaatggtaagtgttcttcccac

SEQ ID NO: 6061 - DNA, 38 bp, Artificial Sequence
  Synthetic
ccccaggcaaagcaaaaagcaagctcactgttgctgtt

SEQ ID NO: 6062 - DNA, 45 bp, Artificial Sequence
  Synthetic
ggtaactgttgtattcgcacgggcgatatatcaatgaggtaggac

SEQ ID NO: 6063 - DNA, 46 bp, Artificial Sequence
  Synthetic
gatcctaacgtgtctcctattgctgtagtaggtatctgaatctgtg

SEQ ID NO: 6064 - DNA, 43 bp, Artificial Sequence
  Synthetic
ttttcctgtgttttttcgatcagcggagcaactcttactgacg

SEQ ID NO: 6065 - DNA, 43 bp, Artificial Sequence
  Synthetic
gggagttggagaaatcatgggaccctcaaactcaacaagaact

SEQ ID NO: 6066 - DNA, 42 bp, Artificial Sequence
  Synthetic
ttcgagcccttttgaagagtgatcgcaatctaatgacgagaa

SEQ ID NO: 6067 - DNA, 42 bp, Artificial Sequence
  Synthetic
tcagagcctgtggatagtcttgcagcgtattccattccattt

SEQ ID NO: 6068 - DNA, 43 bp, Artificial Sequence
  Synthetic
agggaaatcagaaaatcccgcaaaaccttcctcttaagtctcc

SEQ ID NO: 6069 - DNA, 43 bp, Artificial Sequence
  Synthetic
agcgtacatccatgatttattgtgttatcgcggctatcgtctt

SEQ ID NO: 6070 - DNA, 39 bp, Artificial Sequence
  Synthetic
cgcgctccgttaagatgattcaaggccctattgacaaag

SEQ ID NO: 6071 - DNA, 43 bp, Artificial Sequence
  Synthetic
ccttcggcaacaaaaatcgttgcaaaaattctccaacggaaag

SEQ ID NO: 6072 - DNA, 40 bp, Artificial Sequence
  Synthetic
ttaacttcaacaagcgctgcaacaaaagagggcgtgattg

SEQ ID NO: 6073 - DNA, 44 bp, Artificial Sequence
  Synthetic
caggacgcaccggagataaaattaaagatgctgttattgatgcg

SEQ ID NO: 6074 - DNA, 38 bp, Artificial Sequence
  Synthetic
gtagtgccagctcgggataaacccgtcactaaacactg

SEQ ID NO: 6075 - DNA, 40 bp, Artificial Sequence
  Synthetic
tcctgcagccagaccatgtaatgtctccggaaaagacaac

SEQ ID NO: 6076 - DNA, 42 bp, Artificial Sequence
  Synthetic
cttaatctttctgaatggggcgttccagtaggagcatacagc

SEQ ID NO: 6077 - DNA, 40 bp, Artificial Sequence
  Synthetic
ttacgaaggccatacggtatctaaattggctattcgtgcg

SEQ ID NO: 6078 - DNA, 44 bp, Artificial Sequence
  Synthetic
gtgcggggagaactcttgttggttctcgtatttaaaatcgattc

SEQ ID NO: 6079 - DNA, 46 bp, Artificial Sequence
  Synthetic
caacgaaatacgcttgatacccattggaagttgcaaaaaagattgt

SEQ ID NO: 6080 - DNA, 42 bp, Artificial Sequence
  Synthetic
aatgtcgaggctttaaacgttttcatatcgcaaacgccttgt

SEQ ID NO: 6081 - DNA, 40 bp, Artificial Sequence
  Synthetic
cgtctgcgtaagatgcatcttaacgtcttccctaatccca

SEQ ID NO: 6082 - DNA, 40 bp, Artificial Sequence
  Synthetic
gcgtaatggtgtgatgcctgctgcttgctctctaaactct

SEQ ID NO: 6083 - DNA, 44 bp, Artificial Sequence
  Synthetic
tccgtaacttctgattcagaattgaccttcccatgaatgcctat

SEQ ID NO: 6084 - DNA, 38 bp, Artificial Sequence
  Synthetic
catggcaaaggttcgcctcacacactttcttcgcgaag

SEQ ID NO: 6085 - DNA, 41 bp, Artificial Sequence
  Synthetic
aggcgattctggaccaaaatcgaacgcttactacaggagat

SEQ ID NO: 6086 - DNA, 41 bp, Artificial Sequence
  Synthetic
ttgccttaggagaaaagggaaggacaatcacacatcccacc

SEQ ID NO: 6087 - DNA, 39 bp, Artificial Sequence
  Synthetic
agcttcggaaggagacaagttcgatccgagatggcttta

SEQ ID NO: 6088 - DNA, 42 bp, Artificial Sequence
  Synthetic
agcaattacgggatgaacatctggcaagctttgaatacggtg

SEQ ID NO: 6089 - DNA, 45 bp, Artificial Sequence
  Synthetic
gttcacctctttcaacggtatatgagtatggctaaggagattcgc

SEQ ID NO: 6090 - DNA, 43 bp, Artificial Sequence
  Synthetic
ctccacaaatcagccgatccctatcgatcagatttatgcagat

SEQ ID NO: 6091 - DNA, 41 bp, Artificial Sequence
  Synthetic
tgctcgctgcaaattccgaaagttttgcgttagtagaagct

SEQ ID NO: 6092 - DNA, 44 bp, Artificial Sequence
  Synthetic
aacagctcaccaatcgagaatcagatgtcggttttatgcttagt

SEQ ID NO: 6093 - DNA, 40 bp, Artificial Sequence
  Synthetic
catgtgcggcaagccttttggtgtttgcctctctacaaga

SEQ ID NO: 6094 - DNA, 42 bp, Artificial Sequence
  Synthetic
caagagcacaatggtatccgagctagcattgcatcaggacta

SEQ ID NO: 6095 - DNA, 43 bp, Artificial Sequence
  Synthetic
tggaagaggttcttttatgaatcgttagcactgcattcacagc

SEQ ID NO: 6096 - DNA, 45 bp, Artificial Sequence
  Synthetic
tatagggagcgaatgttgctgtttgctaagaaactatctctctgg

SEQ ID NO: 6097 - DNA, 38 bp, Artificial Sequence
  Synthetic
ttggcgagatagcgttgttcacaggctgtgatggaaat

SEQ ID NO: 6098 - DNA, 41 bp, Artificial Sequence
  Synthetic
ggtgctttgtgccaactctttgctttaccaataagctcgaa

SEQ ID NO: 6099 - DNA, 43 bp, Artificial Sequence
  Synthetic
ctaagggaacagaaggcttgataatctccaagcaagcgtctac

SEQ ID NO: 6100 - DNA, 39 bp, Artificial Sequence
  Synthetic
tgctaaaaggtcgcgctagaagcatgatctttgttgcag

SEQ ID NO: 6101 - DNA, 42 bp, Artificial Sequence
  Synthetic
gtggaaattcgggggagtcttttctaaggacaaaaaccactg

SEQ ID NO: 6102 - DNA, 45 bp, Artificial Sequence
  Synthetic
aaggacaatatagccttggagaaaccgactctcctagtactccat

SEQ ID NO: 6103 - DNA, 47 bp, Artificial Sequence
  Synthetic
tcctggttttcctctcttaatagctcaccacattctgaaatccaaat

SEQ ID NO: 6104 - DNA, 47 bp, Artificial Sequence
  Synthetic
ccggaagacttattagcagcagctgtctgattactagaaaattgcat

SEQ ID NO: 6105 - DNA, 44 bp, Artificial Sequence
  Synthetic
actagctaagcagttaggccttttgactaaacatccgattgttc

SEQ ID NO: 6106 - DNA, 40 bp, Artificial Sequence
  Synthetic
ttcacactacacaatgtgtcgcccaccctttcctggagta

SEQ ID NO: 6107 - DNA, 44 bp, Artificial Sequence
  Synthetic
tgacggatgttgttaaaggttctccacaatgacatcttcttggc

SEQ ID NO: 6108 - DNA, 48 bp, Artificial Sequence
  Synthetic
ttctcagaagaggatgtgcatgagaaatcggatcatctaaattctgaa

SEQ ID NO: 6109 - DNA, 42 bp, Artificial Sequence
  Synthetic
tcgcagaattgatgatcatatgcctgcgttatcgagcgtatg

SEQ ID NO: 6110 - DNA, 43 bp, Artificial Sequence
  Synthetic
atatgctgaggatttagaacaagcagtatccccttctgcgatg

SEQ ID NO: 6111 - DNA, 40 bp, Artificial Sequence
  Synthetic
gtcgcatcgagcaaagcatctgatgttttgtcgagcaatt

SEQ ID NO: 6112 - DNA, 44 bp, Artificial Sequence
  Synthetic
tagcagggatagaggaagccaaggattcttcaagaaatctacga

SEQ ID NO: 6113 - DNA, 47 bp, Artificial Sequence
  Synthetic
ctccttctttgacaaagtcagagatctgtcatatttctgaattgtct

SEQ ID NO: 6114 - DNA, 50 bp, Artificial Sequence
  Synthetic
ggagcatatttagaaacagttcccttcatatccttaatcttatgacacag

SEQ ID NO: 6115 - DNA, 42 bp, Artificial Sequence
  Synthetic
gcgattcagttagcacgtattccccagctcctaaacgcaaat

SEQ ID NO: 6116 - DNA, 39 bp, Artificial Sequence
  Synthetic
tccgaagaaagcttgggtgctgcaggtatcagcatttgg

SEQ ID NO: 6117 - DNA, 40 bp, Artificial Sequence
  Synthetic
cgttgcgtgatctcaaggctctctcgtaacagcagatacc

SEQ ID NO: 6118 - DNA, 44 bp, Artificial Sequence
  Synthetic
ggaaattttctttccggagaacgagtgcgtcgggttaattttcc

SEQ ID NO: 6119 - DNA, 44 bp, Artificial Sequence
  Synthetic
gatcccagccatcaatgtgatagctttactgtatcggtgtcaaa

SEQ ID NO: 6120 - DNA, 40 bp, Artificial Sequence
  Synthetic
ctagtcagcgagtgggatgacattatatcaccccccctcc

SEQ ID NO: 6121 - DNA, 47 bp, Artificial Sequence
  Synthetic
tatgccgcatattttaacgcgtacaacagaatccctataaagaatgt

SEQ ID NO: 6122 - DNA, 42 bp, Artificial Sequence
  Synthetic
tccacagttacagaaatcgatgagtagaccgatgaaacgcat

SEQ ID NO: 6123 - DNA, 38 bp, Artificial Sequence
  Synthetic
gcgctatgatggttacagcgagcatcgtcgctacaatc

SEQ ID NO: 6124 - DNA, 44 bp, Artificial Sequence
  Synthetic
accagtattttgggtcatatcttgtctcaaagaggggaagagtc

SEQ ID NO: 6125 - DNA, 41 bp, Artificial Sequence
  Synthetic
gaaagggggagctatttatgccaagaattgtacagggccac

SEQ ID NO: 6126 - DNA, 42 bp, Artificial Sequence
  Synthetic
gcaattcaagcaagtgtggatgcgaaactccagaaacccata

SEQ ID NO: 6127 - DNA, 41 bp, Artificial Sequence
  Synthetic
atacacatttgcagaggagagcccaatctctccaaccagac

SEQ ID NO: 6128 - DNA, 41 bp, Artificial Sequence
  Synthetic
gcatcgacaccatcaccatctccggactgattaatcgtgac

SEQ ID NO: 6129 - DNA, 42 bp, Artificial Sequence
  Synthetic
tttacgcagttgctgtactactcaaaaagaggcgaggtctct

SEQ ID NO: 6130 - DNA, 43 bp, Artificial Sequence
  Synthetic
ttgctctgaaacacttctgtcgtttcatttttttctcacgtcg

SEQ ID NO: 6131 - DNA, 44 bp, Artificial Sequence
  Synthetic
ttgatggaattggacgattctacatgcccctcataatcactgag

SEQ ID NO: 6132 - DNA, 48 bp, Artificial Sequence
  Synthetic
gccaagccaataatggtgatgatggtatgttgtatcattcaaattgga

SEQ ID NO: 6133 - DNA, 44 bp, Artificial Sequence
  Synthetic
ggtgagaatggacggaaaacaattttcctttgagaatgttgcac

SEQ ID NO: 6134 - DNA, 40 bp, Artificial Sequence
  Synthetic
aaggaccagaagtggaggaaagtacactgatttgacctgc

SEQ ID NO: 6135 - DNA, 46 bp, Artificial Sequence
  Synthetic
gggatgtgtttgtcataagggaacttgagtcaagaagaaggttctg

SEQ ID NO: 6136 - DNA, 45 bp, Artificial Sequence
  Synthetic
aacagacactatcaagagttggagaacacatgcacattcagactc

SEQ ID NO: 6137 - DNA, 41 bp, Artificial Sequence
  Synthetic
cacatgtgtgtgcagggataacttctggttgaaagacaccc

SEQ ID NO: 6138 - DNA, 47 bp, Artificial Sequence
  Synthetic
tgagatgatttgggatccgaacgcgatatcttgctttattgagaagt

SEQ ID NO: 6139 - DNA, 40 bp, Artificial Sequence
  Synthetic
tctacggaaggagtacctgagttatcgtcagcatccacag

SEQ ID NO: 6140 - DNA, 41 bp, Artificial Sequence
  Synthetic
tggcttcggaggaaatttgtatgtcaagacagaggctccag

SEQ ID NO: 6141 - DNA, 46 bp, Artificial Sequence
  Synthetic
tgaaggagttaactggagtccacttcagtttgatatcagtccaatt

SEQ ID NO: 6142 - DNA, 45 bp, Artificial Sequence
  Synthetic
aaatccagcattgtacacacaagagcaagattttctttcccacat

SEQ ID NO: 6143 - DNA, 42 bp, Artificial Sequence
  Synthetic
atcaccttacacagggaattctgggtttcagctggagcatgt

SEQ ID NO: 6144 - DNA, 42 bp, Artificial Sequence
  Synthetic
actggactatgaagctagatgcacgtaaaagggctggtttca

SEQ ID NO: 6145 - DNA, 44 bp, Artificial Sequence
  Synthetic
agagcagaatttttggaatcgatgactgcttcaacgattgcaac

SEQ ID NO: 6146 - DNA, 49 bp, Artificial Sequence
  Synthetic
aggagaattgggaataataagagccgttcccataaagattcttgtaatc

SEQ ID NO: 6147 - DNA, 43 bp, Artificial Sequence
  Synthetic
caatcagatcctttttactggggagccaatgaaatagcagcag

SEQ ID NO: 6148 - DNA, 38 bp, Artificial Sequence
  Synthetic
ccagttgcatgggcctcataccaaaagcagcttctgtg

SEQ ID NO: 6149 - DNA, 42 bp, Artificial Sequence
  Synthetic
tcatcctagctccagtgctggtcttctggtaggcctgcaaat

SEQ ID NO: 6150 - DNA, 46 bp, Artificial Sequence
  Synthetic
catcacaatggcaaaacctccttccaatggaatatctaactgtctt

SEQ ID NO: 6151 - DNA, 41 bp, Artificial Sequence
  Synthetic
cctgcattgtgacgaagacttgtctattctttgaggtgcag

SEQ ID NO: 6152 - DNA, 42 bp, Artificial Sequence
  Synthetic
tttgacaaagacacagactcagattttcccaattctgcgtcc

SEQ ID NO: 6153 - DNA, 41 bp, Artificial Sequence
  Synthetic
aagaggcgactgttcgaggagaatcttcagcttcatgagtt

SEQ ID NO: 6154 - DNA, 46 bp, Artificial Sequence
  Synthetic
atacccatggagaatacccagagtcatattcctgatgagaaagcaa

SEQ ID NO: 6155 - DNA, 48 bp, Artificial Sequence
  Synthetic
cactgcaagacaagttaatgacaatgttccaatgttcaatttgatctt

SEQ ID NO: 6156 - DNA, 41 bp, Artificial Sequence
  Synthetic
agtgaaactggagaatgggaagtgttggtggagctggtaac

SEQ ID NO: 6157 - DNA, 40 bp, Artificial Sequence
  Synthetic
gacgaccgaaagcgtcaccgtgtgatcccgatctcgatcc

SEQ ID NO: 6158 - DNA, 39 bp, Artificial Sequence
  Synthetic
cctccagaggccgtagaggggccacttgtgccaacagat

SEQ ID NO: 6159 - DNA, 46 bp, Artificial Sequence
  Synthetic
gcaggtagcaacgatagaataggtctttgagatttactggtaaagc

SEQ ID NO: 6160 - DNA, 41 bp, Artificial Sequence
  Synthetic
tgaggctataggaccaagtgaacagaagcactggggtcaat

SEQ ID NO: 6161 - DNA, 46 bp, Artificial Sequence
  Synthetic
caaacgagctactataaggaccagccctaaaaaaatgtacctgacc

SEQ ID NO: 6162 - DNA, 41 bp, Artificial Sequence
  Synthetic
ttttgcagatgtcctattggctttttgtacccttgcaaccg

SEQ ID NO: 6163 - DNA, 45 bp, Artificial Sequence
  Synthetic
atcagtttagagcttttcgactgaacagacatgtcagctaaagca

SEQ ID NO: 6164 - DNA, 40 bp, Artificial Sequence
  Synthetic
taggtgaacattgggacacagcctctaatggtgggcatcc

SEQ ID NO: 6165 - DNA, 43 bp, Artificial Sequence
  Synthetic
acgacgagaacaatgttatgttagggggatggtatcacccaca

SEQ ID NO: 6166 - DNA, 45 bp, Artificial Sequence
  Synthetic
attggttacaaagagcacaaggcgtcagaaacagttcattactcc

SEQ ID NO: 6167 - DNA, 39 bp, Artificial Sequence
  Synthetic
gttaacagctttcagccagggcattgtgacctatgggcg

SEQ ID NO: 6168 - DNA, 43 bp, Artificial Sequence
  Synthetic
tgaatgcaagtccatatgatttggaaaaactgcttcacgggac

SEQ ID NO: 6169 - DNA, 47 bp, Artificial Sequence
  Synthetic
ttgttccatgggttatgtacttgctccatgatctttattgtaagcac

SEQ ID NO: 6170 - DNA, 44 bp, Artificial Sequence
  Synthetic
gagtgctgctactatacgtagtgtaaccatcacacaagtcttca

SEQ ID NO: 6171 - DNA, 44 bp, Artificial Sequence
  Synthetic
tggtaacatgatagatggttttgcttgccatcaaatcacctact

SEQ ID NO: 6172 - DNA, 43 bp, Artificial Sequence
  Synthetic
acgggagttgctaggtgtttacagaggtttataaacacctcta

SEQ ID NO: 6173 - DNA, 45 bp, Artificial Sequence
  Synthetic
acgtagaagaatttgtctttcaggcgatgaatgtaacaagccacg

SEQ ID NO: 6174 - DNA, 43 bp, Artificial Sequence
  Synthetic
tgacaaatattaccctgttgtggtggaactctccatgcttgat

SEQ ID NO: 6175 - DNA, 43 bp, Artificial Sequence
  Synthetic
ttaactgtcacaagtgctggacaagacttcagaagactcctcc

SEQ ID NO: 6176 - DNA, 46 bp, Artificial Sequence
  Synthetic
acctgctaatattgtacttccacaaactgccaatcacataaggtta

SEQ ID NO: 6177 - DNA, 48 bp, Artificial Sequence
  Synthetic
aaactgtgcttaatgttgttggaccgctctaacaatacataactttgt

SEQ ID NO: 6178 - DNA, 47 bp, Artificial Sequence
  Synthetic
atcaatgacgttgcatttgtttcggtgctatatcatgtcttaaggat

SEQ ID NO: 6179 - DNA, 46 bp, Artificial Sequence
  Synthetic
aggaaatgtgttttgtgatggagtactggaaaaagactttaccttt

SEQ ID NO: 6180 - DNA, 42 bp, Artificial Sequence
  Synthetic
aaaattgttcaatggcaagaggcctacaaatctagcagggcg

SEQ ID NO: 6181 - DNA, 48 bp, Artificial Sequence
  Synthetic
ttgagtcgtgaagatcttgagattgatgaattagctttttaccgcaag

SEQ ID NO: 6182 - DNA, 48 bp, Artificial Sequence
  Synthetic
ttaaattgataggacacaccgtctgctttagagctatcaaaacccaac

SEQ ID NO: 6183 - DNA, 43 bp, Artificial Sequence
  Synthetic
ggtgacagctcagagagtggtggttttttaacaccacttaact

SEQ ID NO: 6184 - DNA, 48 bp, Artificial Sequence
  Synthetic
tggctttagctaatatgttaccagcagagcttaataaaagaggcaata

SEQ ID NO: 6185 - DNA, 45 bp, Artificial Sequence
  Synthetic
ctaaggaattgaaacggcccattcttaacatcagtaaccgtatga

SEQ ID NO: 6186 - DNA, 48 bp, Artificial Sequence
  Synthetic
aactggtttgaaactgaagcttactggtgtagttaaaacagagacatt

SEQ ID NO: 6187 - DNA, 47 bp, Artificial Sequence
  Synthetic
tgtgttgcactttattacacatgcatacgatatttgactatgtggcg

SEQ ID NO: 6188 - DNA, 45 bp, Artificial Sequence
  Synthetic
actcgttctatgtcgtattgcagtaaagcatataccctcatcagc

SEQ ID NO: 6189 - DNA, 42 bp, Artificial Sequence
  Synthetic
aagcttaaacgtgcttttggtgacaccacacaatcacgttaa

SEQ ID NO: 6190 - DNA, 43 bp, Artificial Sequence
  Synthetic
gcctactgcttccgtctcaaagtaggatttaccattttcacaa

SEQ ID NO: 6191 - DNA, 47 bp, Artificial Sequence
  Synthetic
gatcttgtggatctgttggttatgtctaagctccaattgatgcatat

SEQ ID NO: 6192 - DNA, 48 bp, Artificial Sequence
  Synthetic
agatgctttagcttctatgactggtaccattcttaagacgcttaatag

SEQ ID NO: 6193 - DNA, 45 bp, Artificial Sequence
  Synthetic
tgtgtacaagcatacatttagaggcgtgtactcaactgatggaac

SEQ ID NO: 6194 - DNA, 46 bp, Artificial Sequence
  Synthetic
gcaaaggttattgctaagtgggttagcacaaaagcactatcttaat

SEQ ID NO: 6195 - DNA, 48 bp, Artificial Sequence
  Synthetic
tgactgatgtcaaatgtgctaatgtacttagaattagaagcaacatgc

SEQ ID NO: 6196 - DNA, 47 bp, Artificial Sequence
  Synthetic
tgctaagaaaaatcttgatgaggcggctttctctagctgttttaact

SEQ ID NO: 6197 - DNA, 50 bp, Artificial Sequence
  Synthetic
gtatggcagattcaaactatccaggatcagatatctcattcaactgctta

SEQ ID NO: 6198 - DNA, 46 bp, Artificial Sequence
  Synthetic
gaactgctactgaatatgcttccacttaggatctacagaaaacgca

SEQ ID NO: 6199 - DNA, 44 bp, Artificial Sequence
  Synthetic
cggcaagtttgtacaagtgcccatgtgtcaaaacataagacaca

SEQ ID NO: 6200 - DNA, 47 bp, Artificial Sequence
  Synthetic
tcagttctttgttgttaagaggacacttttacacgctcatagcattt

SEQ ID NO: 6201 - DNA, 48 bp, Artificial Sequence
  Synthetic
ttttggtgactatgttattgcagcccagcataggcatgatataagaat

SEQ ID NO: 6202 - DNA, 41 bp, Artificial Sequence
  Synthetic
atccagctttgcatgtagcttcacactaaaacagcaagtgc

SEQ ID NO: 6203 - DNA, 50 bp, Artificial Sequence
  Synthetic
ttggaaaagccaggctctattatgatagtataagcgtaaatttcatcctg

SEQ ID NO: 6204 - DNA, 40 bp, Artificial Sequence
  Synthetic
ctgggatgatatgttacgccgcccaacccataagtacagg

SEQ ID NO: 6205 - DNA, 47 bp, Artificial Sequence
  Synthetic
gttgattcaacctttgtcacagaatccatcatcactcaaaatcatca

SEQ ID NO: 6206 - DNA, 42 bp, Artificial Sequence
  Synthetic
agatggatggtgacgatgtctacaaaacatccagctcctaat

SEQ ID NO: 6207 - DNA, 40 bp, Artificial Sequence
  Synthetic
ttatgcagagtgttggagcttgttctgatgcaactgccac

SEQ ID NO: 6208 - DNA, 46 bp, Artificial Sequence
  Synthetic
cttgaaattgtttgctgcagaaacctgatgcataactctgcttaaa

SEQ ID NO: 6209 - DNA, 44 bp, Artificial Sequence
  Synthetic
acacattggtatgaaacgttactgcgcaagatgtgacttccctg

SEQ ID NO: 6210 - DNA, 48 bp, Artificial Sequence
  Synthetic
accataaatgcattacctgagatggtggtaagcatactaacttcatct

SEQ ID NO: 6211 - DNA, 41 bp, Artificial Sequence
  Synthetic
caaaccgtggattctgctcaatgtttctgcagtctgtgaat

SEQ ID NO: 6212 - DNA, 38 bp, Artificial Sequence
  Synthetic
atcacccagctcatgctcctaaatcgccagttgcctta

SEQ ID NO: 6213 - DNA, 39 bp, Artificial Sequence
  Synthetic
gaagccactggtttgtttgcttcaccaggaggagctttc

SEQ ID NO: 6214 - DNA, 48 bp, Artificial Sequence
  Synthetic
taaacgtgccacagtttacaattcttacaagtaatcacatgtaacact

SEQ ID NO: 6215 - DNA, 48 bp, Artificial Sequence
  Synthetic
tttgaggcacataaggactcttttacttatccacattacagttccaaa

SEQ ID NO: 6216 - DNA, 42 bp, Artificial Sequence
  Synthetic
gcatggatgctaagcaggttgacctaaattgcatcttgtgat

SEQ ID NO: 6217 - DNA, 42 bp, Artificial Sequence
  Synthetic
acaacataccctactaatgtggccttaagctctgggtggtgt

SEQ ID NO: 6218 - DNA, 44 bp, Artificial Sequence
  Synthetic
agagtctttcgatgataagaggtcccaaccttgtccaccactac

SEQ ID NO: 6219 - DNA, 46 bp, Artificial Sequence
  Synthetic
tgcatttgttaataggcttgtaccgaaacaaactcctgaacaacca

SEQ ID NO: 6220 - DNA, 45 bp, Artificial Sequence
  Synthetic
ttctccaatggaaagagttagtctcttcatcatacagcctgtagg

SEQ ID NO: 6221 - DNA, 47 bp, Artificial Sequence
  Synthetic
aatggggtattttgcattttggacgccaattaaaaatccttcactag

SEQ ID NO: 6222 - DNA, 41 bp, Artificial Sequence
  Synthetic
ctggacatacagcctgaagactccatcaccccaatgcatat

SEQ ID NO: 6223 - DNA, 47 bp, Artificial Sequence
  Synthetic
ccggctagacttgaaatagttaagcccagtgactaactatggtttca

SEQ ID NO: 6224 - DNA, 43 bp, Artificial Sequence
  Synthetic
tcatgcctttaaatgcaaccgtaacaagcctttattctgcatc

SEQ ID NO: 6225 - DNA, 42 bp, Artificial Sequence
  Synthetic
gtaaggattttacgcctgtacagggttatcagactgcctggc

SEQ ID NO: 6226 - DNA, 45 bp, Artificial Sequence
  Synthetic
acaaggtcttttagaggtctctgtggttaggatgacaaatcgttt

SEQ ID NO: 6227 - DNA, 47 bp, Artificial Sequence
  Synthetic
attgggttacacctctcacttctagactcatacaatcaacagcatta

SEQ ID NO: 6228 - DNA, 48 bp, Artificial Sequence
  Synthetic
tgagcagcctgatgtcttttattcaccatatatcttagcagcatcaat

SEQ ID NO: 6229 - DNA, 47 bp, Artificial Sequence
  Synthetic
cctgcaggtgttcttactaatcatacagaaatttttaggagctttga

SEQ ID NO: 6230 - DNA, 43 bp, Artificial Sequence
  Synthetic
aagtgattattgtggaggcaattcttctgcagaccaacccaaa

SEQ ID NO: 6231 - DNA, 40 bp, Artificial Sequence
  Synthetic
ccgaaccagcattgctatttcgcagctgtcgtgtaagact

SEQ ID NO: 6232 - DNA, 48 bp, Artificial Sequence
  Synthetic
tgtggtgattatgcagcatgtaagcattaatgttatcacagaaactac

SEQ ID NO: 6233 - DNA, 38 bp, Artificial Sequence
  Synthetic
gcatcaaagtgttgcctccaggcagccaaagtgtatcc

SEQ ID NO: 6234 - DNA, 44 bp, Artificial Sequence
  Synthetic
tgcttatgtttctcaacagcttagtccttctccatagcttgtgc

SEQ ID NO: 6235 - DNA, 43 bp, Artificial Sequence
  Synthetic
gtagtggttactactaccctgaaccacagcgcaggtactcata

SEQ ID NO: 6236 - DNA, 50 bp, Artificial Sequence
  Synthetic
gtaaaatggccttggtatgtatggcaatagtaaaacaagcatagctacac

SEQ ID NO: 6237 - DNA, 46 bp, Artificial Sequence
  Synthetic
agagttcctagtcatgcttggtggatttaccataaagagtgaatgt

SEQ ID NO: 6238 - DNA, 49 bp, Artificial Sequence
  Synthetic
ttgaggactatcatactctgacgggtacctagttttataccttgaatgt

SEQ ID NO: 6239 - DNA, 40 bp, Artificial Sequence
  Synthetic
aatccagtagtagagcgtcctcaaactggtcggactgatc

SEQ ID NO: 6240 - DNA, 42 bp, Artificial Sequence
  Synthetic
ccaggctgatgtcaataccccgcggaatagcctcatcgctac

SEQ ID NO: 6241 - DNA, 45 bp, Artificial Sequence
  Synthetic
ttgctagtcttgttctggcaaaacatgcttagttacttgctgagg

SEQ ID NO: 6242 - DNA, 47 bp, Artificial Sequence
  Synthetic
tgacagtacactttcaggttttgagtgataggcattcaaattctcat

SEQ ID NO: 6243 - DNA, 47 bp, Artificial Sequence
  Synthetic
gcagaaaagtcgagataaggcacctatagtctgctataaccttctct

SEQ ID NO: 6244 - DNA, 42 bp, Artificial Sequence
  Synthetic
ggaaggacctctttgcatcagattcgctttcaacatgatgtt

SEQ ID NO: 6245 - DNA, 46 bp, Artificial Sequence
  Synthetic
ctacagagattcgcttggagaagcttctgttttggagtaagtggag

SEQ ID NO: 6246 - DNA, 41 bp, Artificial Sequence
  Synthetic
ggcttcgccgagatcagaagtgtggcagttctgatgtccag

SEQ ID NO: 6247 - DNA, 42 bp, Artificial Sequence
  Synthetic
gaaagtgacagggcccctttttcaatatgatggttttaccca

SEQ ID NO: 6248 - DNA, 42 bp, Artificial Sequence
  Synthetic
aacacagttcgagtctctgaaactcccattctcatcactgct

SEQ ID NO: 6249 - DNA, 40 bp, Artificial Sequence
  Synthetic
ccctcccgggagagccatagtggtcaccccagcgattccg

SEQ ID NO: 6250 - DNA, 40 bp, Artificial Sequence
  Synthetic
tggagtatacgtgttgccgcgcagaagttttacgcgtcgc

SEQ ID NO: 6251 - DNA, 35 bp, Artificial Sequence
  Synthetic
gctcgtcggcgctcctgtatcaagggccctcacgc

SEQ ID NO: 6252 - DNA, 42 bp, Artificial Sequence
  Synthetic
acacctacagtggcagtcaggtcgcgcctactaataggtcca

SEQ ID NO: 6253 - DNA, 39 bp, Artificial Sequence
  Synthetic
gcatgtcctgcgtttaccccagccaagatgccccaatgg

SEQ ID NO: 6254 - DNA, 38 bp, Artificial Sequence
  Synthetic
tactgctggcactacgcaccggccgcagacacttgatg

SEQ ID NO: 6255 - DNA, 40 bp, Artificial Sequence
  Synthetic
ctcccagtggtcggtggtttgcgcacgtcttgagaaaccc

SEQ ID NO: 6256 - DNA, 41 bp, Artificial Sequence
  Synthetic
tgaccgcagtgagcaacatccagcaaggcagtatagcaagc

SEQ ID NO: 6257 - DNA, 38 bp, Artificial Sequence
  Synthetic
cgctgctgctgggacacatgttaccccgcacgtaccac

SEQ ID NO: 6258 - DNA, 39 bp, Artificial Sequence
  Synthetic
aggtcatcacctggggtgcgctaatcgtgcagagacggg

SEQ ID NO: 6259 - DNA, 41 bp, Artificial Sequence
  Synthetic
atggagcaggttcgagaacgctcccaacgaggtcctgatct

SEQ ID NO: 6260 - DNA, 42 bp, Artificial Sequence
  Synthetic
tgttgcggggatctttagggcttgctaagggtttccactggt

SEQ ID NO: 6261 - DNA, 41 bp, Artificial Sequence
  Synthetic
gggaaccgcaccgttacaactccgcgagaaacttaccgtag

SEQ ID NO: 6262 - DNA, 40 bp, Artificial Sequence
  Synthetic
acgtaccgatatgtcgcctccgacagaggacgaccgagtc

SEQ ID NO: 6263 - DNA, 40 bp, Artificial Sequence
  Synthetic
gcaggctcctcccccaagttggtccatgtagtgttggctt

SEQ ID NO: 6264 - DNA, 42 bp, Artificial Sequence
  Synthetic
atggaggagtgctcacaagctgccttgaactggtgggctatt

SEQ ID NO: 6265 - DNA, 38 bp, Artificial Sequence
  Synthetic
tactcggggggtgggttgccaagccgcttaccacgaac

SEQ ID NO: 6266 - DNA, 36 bp, Artificial Sequence
  Synthetic
cgtaggacctggggagggagtggttgccccgggatg

SEQ ID NO: 6267 - DNA, 40 bp, Artificial Sequence
  Synthetic
aaagggatacaagggcgtgtggcagttattgctgccccgc

SEQ ID NO: 6268 - DNA, 38 bp, Artificial Sequence
  Synthetic
tgccggctgctgagttctttaggggcttacatggaggg

SEQ ID NO: 6269 - DNA, 41 bp, Artificial Sequence
  Synthetic
cagacgctgagctagtggacgtgtaatgttgctgcccatct

SEQ ID NO: 6270 - DNA, 41 bp, Artificial Sequence
  Synthetic
tcagctggacggctctaatgtgtcctgtggtttcgaggacg

SEQ ID NO: 6271 - DNA, 42 bp, Artificial Sequence
  Synthetic
aagagaaactgcccatcagccccgcttctagacgacgttgaa

SEQ ID NO: 6272 - DNA, 38 bp, Artificial Sequence
  Synthetic
ttccaaccaccatcatggcgaatgcggccccctttagc

SEQ ID NO: 6273 - DNA, 39 bp, Artificial Sequence
  Synthetic
ctccctcacggagcggctttacgataaccacactgggcc

SEQ ID NO: 6274 - DNA, 39 bp, Artificial Sequence
  Synthetic
tagagcagccctgagagcctttggcctgtggagcatctc

SEQ ID NO: 6275 - DNA, 45 bp, Artificial Sequence
  Synthetic
tcaagaagtacacatcaggaagacattcattgccatcatccattt

SEQ ID NO: 6276 - DNA, 44 bp, Artificial Sequence
  Synthetic
agtcgaaaggctaaagcatggaaacgtattttgacttggtttct

SEQ ID NO: 6277 - DNA, 45 bp, Artificial Sequence
  Synthetic
agagaagaaagaagaactccaggatctctccaacatgtatgcaac

SEQ ID NO: 6278 - DNA, 45 bp, Artificial Sequence
  Synthetic
tagcatctttattggagatgtgccactgcttaaggatgtctacca

SEQ ID NO: 6279 - DNA, 42 bp, Artificial Sequence
  Synthetic
tgaagagttcacaatggttgggatcaatctcctggttgcttt

SEQ ID NO: 6280 - DNA, 44 bp, Artificial Sequence
  Synthetic
aaagtgctttttcaaaattggggagcaatatcccaatcattccc

SEQ ID NO: 6281 - DNA, 42 bp, Artificial Sequence
  Synthetic
acacagggaacagagaaactgattgaccaacactgattcagg

SEQ ID NO: 6282 - DNA, 42 bp, Artificial Sequence
  Synthetic
gatgtgcttgggacatttgataccactttgctttggtggagc

SEQ ID NO: 6283 - DNA, 42 bp, Artificial Sequence
  Synthetic
agacaggagatatgggccagcagccttctctcctttcgcaag

SEQ ID NO: 6284 - DNA, 40 bp, Artificial Sequence
  Synthetic
ctgccgacgccttaccgattgcttccgttggcataactga

SEQ ID NO: 6285 - DNA, 40 bp, Artificial Sequence
  Synthetic
gcccccttgtgtcatcggaggaaacaatcagtggggcaga

SEQ ID NO: 6286 - DNA, 39 bp, Artificial Sequence
  Synthetic
gcccattgctgctgtccaccggcagggtcgtgaaagaac

SEQ ID NO: 6287 - DNA, 40 bp, Artificial Sequence
  Synthetic
atctgaagggtaggtgggtgccggaggagaggccacatcc

SEQ ID NO: 6288 - DNA, 39 bp, Artificial Sequence; identical to SEQ ID NO: 4473
  Synthetic

SEQ ID NO: 6289 - DNA, 37 bp, Artificial Sequence
  Synthetic
ccgcgtgcggtgacatcagtatctcctggcccctacg

SEQ ID NO: 6290 - DNA, 37 bp, Artificial Sequence
  Synthetic
agaccttgtgggctggccctaaaggtccgaggagccg

SEQ ID NO: 6291 - DNA, 38 bp, Artificial Sequence
  Synthetic
tcacggacaactcctctccaccgagcatgcaggtgggc

SEQ ID NO: 6292 - DNA, 40 bp, Artificial Sequence
  Synthetic
tttgtgacgagtgccactccacggtcaaggacagtgccga

SEQ ID NO: 6293 - DNA, 38 bp, Artificial Sequence
  Synthetic
accgcggtcttgacgtgtctgagcatcggtcgacacga

SEQ ID NO: 6294 - DNA, 40 bp, Artificial Sequence
  Synthetic
gagtgctatgacgcgggctgagcctaactgtagtctcggc

SEQ ID NO: 6295 - DNA, 38 bp, Artificial Sequence
  Synthetic
acctggaggtcgtcacgagcttgacaggcaatacgcgg

SEQ ID NO: 6296 - DNA, 42 bp, Artificial Sequence
  Synthetic
accaactggcagaaactcgaggcccgccaagtattgtatccc

SEQ ID NO: 6297 - DNA, 38 bp, Artificial Sequence
  Synthetic
agatcatgagcggtgaggtcccagaggatggcgggcag

SEQ ID NO: 6298 - DNA, 42 bp, Artificial Sequence
  Synthetic
ctcagcagcctcactgtaacccacactccgagcttatccact

SEQ ID NO: 6299 - DNA, 39 bp, Artificial Sequence
  Synthetic
gggacgttccccattaacgcctagttcggcgcaggaagg

SEQ ID NO: 6300 - DNA, 39 bp, Artificial Sequence
  Synthetic
cgagcccgaaccggacgtacgcctctgctgttatatggg

SEQ ID NO: 6301 - DNA, 39 bp, Artificial Sequence
  Synthetic
ccggactacaaccccccgctccacaggtggttcgtagtc

SEQ ID NO: 6302 - DNA, 36 bp, Artificial Sequence
  Synthetic
tcttccatgccccccctggccatgacccgtcgctga

SEQ ID NO: 6303 - DNA, 39 bp, Artificial Sequence
  Synthetic
ctgacgcccccacattcagccatggcaacggacgtcttt

SEQ ID NO: 6304 - DNA, 39 bp, Artificial Sequence
  Synthetic
acgacgtggttagcaagctcccccgctgtcctggtgagt

SEQ ID NO: 6305 - DNA, 40 bp, Artificial Sequence
  Synthetic
tcacttgctacatcaaggcccggcatggtgcagtcctgga

SEQ ID NO: 6306 - DNA, 42 bp, Artificial Sequence
  Synthetic
ccagtcaattcctggctaggcatatcatcctcgcccacagtg

SEQ ID NO: 6307 - DNA, 40 bp, Artificial Sequence
  Synthetic
gtccgcgctaggcttctgtctgcccagttgaagaggtact

SEQ ID NO: 6308 - DNA, 48 bp, Artificial Sequence
  Synthetic
acccagaaacatattgcttttgtgttgttttgtgcaaaatatacagca

SEQ ID NO: 6309 - DNA, 40 bp, Artificial Sequence
  Synthetic
tgtgtcacaaaccgctggtatgatattttgtgcagtcgtc

SEQ ID NO: 6310 - DNA, 39 bp, Artificial Sequence
  Synthetic
gcacaacaagcgtatagggtgtgcactctaccaccagtc

SEQ ID NO: 6311 - DNA, 41 bp, Artificial Sequence
  Synthetic
gacagtcagcaaaggccaaacgacctgtgtttggccatagc

SEQ ID NO: 6312 - DNA, 41 bp, Artificial Sequence
  Synthetic
gggaatgacagtgcttatgctgtttagccactgtttccctg

SEQ ID NO: 6313 - DNA, 39 bp, Artificial Sequence
  Synthetic
tggggggggctgttatatcccagataatggctgcaacca

SEQ ID NO: 6314 - DNA, 41 bp, Artificial Sequence
  Synthetic
tatgggcacgtttaagccttacctaaacggttcgctagggt

SEQ ID NO: 6315 - DNA, 41 bp, Artificial Sequence
  Synthetic
atgtgaatttcaaggatgacgctcccacatgtacctcccat

SEQ ID NO: 6316 - DNA, 38 bp, Artificial Sequence
  Synthetic
ttccacccagaaggccgcgaaccgggtcctgtcactgt

SEQ ID NO: 6317 - DNA, 44 bp, Artificial Sequence
  Synthetic
gctgacgtgctatctggcattgtaaatataatgctataaggccc

SEQ ID NO: 6318 - DNA, 40 bp, Artificial Sequence
  Synthetic
tggcagatcgcattttgcagtggttccaatgcctaggccc

SEQ ID NO: 6319 - DNA, 43 bp, Artificial Sequence
  Synthetic
ccccagctgtgttggacatcgcaggatttgtaaagtttgtact

SEQ ID NO: 6320 - DNA, 40 bp, Artificial Sequence
  Synthetic
tacttgctccagctgcctcttcaccatcatcaacatcagc

SEQ ID NO: 6321 - DNA, 38 bp, Artificial Sequence
  Synthetic
cgactatgtgacacgcaccatggcctacagtaagcaac

SEQ ID NO: 6322 - DNA, 43 bp, Artificial Sequence
  Synthetic
atccagattatttgggaatggccctgcgcaagtaaaagaacat

SEQ ID NO: 6323 - DNA, 46 bp, Artificial Sequence
  Synthetic
attggaggattggaactttgggtaaatctatatgtgtcctccaagc

SEQ ID NO: 6324 - DNA, 42 bp, Artificial Sequence
  Synthetic
gtaaggttgttctaggtcaggagaaattggtggtgtgcacac

SEQ ID NO: 6325 - DNA, 44 bp, Artificial Sequence
  Synthetic
tgtgcgacacaagctgcaataacagcaaagataattcttgttgt

SEQ ID NO: 6326 - DNA, 46 bp, Artificial Sequence
  Synthetic
gaatcggagcagggaaattccgcaatagtattattacagtcctctg

SEQ ID NO: 6327 - DNA, 49 bp, Artificial Sequence
  Synthetic
tatcaggattcacatgaacagtggcaaagtacattccatcataatccac

SEQ ID NO: 6328 - DNA, 39 bp, Artificial Sequence
  Synthetic
accgcaaatcgcagctggagtgagacagtgcctctctcc

SEQ ID NO: 6329 - DNA, 41 bp, Artificial Sequence
  Synthetic
agacttcaagaggaggctcgggtaagctgtttcccggacct

SEQ ID NO: 6330 - DNA, 46 bp, Artificial Sequence
  Synthetic
ctccatctattacacgccctttgagtgggatattaaaaggtcttgt

SEQ ID NO: 6331 - DNA, 46 bp, Artificial Sequence
  Synthetic
acatcattaggtggtggggagtcatatgcaggatttaaaactgtag

SEQ ID NO: 6332 - DNA, 44 bp, Artificial Sequence
  Synthetic
catcagtttgcagtttcagcagtgaaagtctatatctggtgcag

SEQ ID NO: 6333 - DNA, 46 bp, Artificial Sequence
  Synthetic
atcacctacttacccttacacaccgggtgcaagaaaaaatcataat

SEQ ID NO: 6334 - DNA, 45 bp, Artificial Sequence
  Synthetic
ttatgctggatctgaaaggcttctttccaggatcaattacatcaa

SEQ ID NO: 6335 - DNA, 46 bp, Artificial Sequence
  Synthetic
acagaaaatcctaacacgtatcctgagacacgtccattctattgtc

SEQ ID NO: 6336 - DNA, 46 bp, Artificial Sequence
  Synthetic
gtgatgtaggatttggagctgctaggtactcctgatttatcttcct

SEQ ID NO: 6337 - DNA, 47 bp, Artificial Sequence
  Synthetic
acaaacctcaaaacaatttaggaccttgagtataaagagccactagg

SEQ ID NO: 6338 - DNA, 43 bp, Artificial Sequence
  Synthetic
gaggcaaacttagaaaccgtttctgtttgaacttgcacttacc

SEQ ID NO: 6339 - DNA, 39 bp, Artificial Sequence
  Synthetic
aagaatgaagtgggccatgtgttgccatatcacccttgg

SEQ ID NO: 6340 - DNA, 44 bp, Artificial Sequence
  Synthetic
tcagaaagatgagacttgacaatgcttactctctcaacagggcc

SEQ ID NO: 6341 - DNA, 41 bp, Artificial Sequence
  Synthetic
aactcccattgtactggcatacatactggcaggaaccttct

SEQ ID NO: 6342 - DNA, 43 bp, Artificial Sequence
  Synthetic
agctgtagagattgcaaataagactacatcacctccatccagg

SEQ ID NO: 6343 - DNA, 44 bp, Artificial Sequence
  Synthetic
ttcagccaaaaaggaggacatggtgtcttgagaaaataccatgc

SEQ ID NO: 6344 - DNA, 48 bp, Artificial Sequence
  Synthetic
tgaggaatcacctaaagcaagtgagaatgtatagtcagatgcattcat

SEQ ID NO: 6345 - DNA, 45 bp, Artificial Sequence
  Synthetic
ccaagatgtgggaaatgggaacactaaatttttaagcacccattg

SEQ ID NO: 6346 - DNA, 48 bp, Artificial Sequence
  Synthetic
aattgttgcctttctgtttttcgccaaaaattgataaggctctccatt

SEQ ID NO: 6347 - DNA, 43 bp, Artificial Sequence
  Synthetic
tgaggaacttgaaagactaaaaccgacgggctttccttggtaa

SEQ ID NO: 6348 - DNA, 43 bp, Artificial Sequence
  Synthetic
actttccacacttttcatctctctgcattgcgacctatgggag

SEQ ID NO: 6349 - DNA, 45 bp, Artificial Sequence
  Synthetic
tcttggacaagaatggcatgtgaacatgtagatcttcatgaacaa

SEQ ID NO: 6350 - DNA, 48 bp, Artificial Sequence
  Synthetic
ctagcgaagttaaagcccaatcatcatcatggttaacagtatcagtac

SEQ ID NO: 6351 - DNA, 43 bp, Artificial Sequence
  Synthetic
attgacttgtttgttaagcgtcgaaaaccatctccacaaactg

SEQ ID NO: 6352 - DNA, 46 bp, Artificial Sequence
  Synthetic
tttgtcttttagatcaggcttggccaacaggtttctcgttaaaatt

SEQ ID NO: 6353 - DNA, 42 bp, Artificial Sequence
  Synthetic
ttaatcctgctaatgggcatatgctttacctgcagctacagc

SEQ ID NO: 6354 - DNA, 42 bp, Artificial Sequence
  Synthetic
cagtggcaggaagcatggtagctaaaacaagagcaactaacc

SEQ ID NO: 6355 - DNA, 44 bp, Artificial Sequence
  Synthetic
ctcctctgagtaaggatttacctgagcctacacctacacccata

SEQ ID NO: 6356 - DNA, 48 bp, Artificial Sequence
  Synthetic
tgttgagtacaaagtaacagtctggacatataaatcatcagatgccaa

SEQ ID NO: 6357 - DNA, 50 bp, Artificial Sequence
  Synthetic
acgaaattgtagtgttcgtgttaagccaccattagcagtaatatcataat

SEQ ID NO: 6358 - DNA, 46 bp, Artificial Sequence
  Synthetic
cagtagctgctggtttggaatcactctttaaatatgtaggtaccaa

SEQ ID NO: 6359 - DNA, 49 bp, Artificial Sequence
  Synthetic
atacatctttggttccacatacacgccttcactaataacatcaggaaat

SEQ ID NO: 6360 - DNA, 43 bp, Artificial Sequence
  Synthetic
tggtaatgttaaacctggtgaaactgaaatgccccttgtggtc

SEQ ID NO: 6361 - DNA, 43 bp, Artificial Sequence
  Synthetic
attgtgcttggtttgtacaaaatgatttgccatagcccaaaca

SEQ ID NO: 6362 - DNA, 44 bp, Artificial Sequence
  Synthetic
agaggctcggattaatgataagaagacgaaccatgctaaaaagc

SEQ ID NO: 6363 - DNA, 48 bp, Artificial Sequence
  Synthetic
ctcagtttgtatttattgccgtgcccacgtaatttacatataccatct

SEQ ID NO: 6364 - DNA, 50 bp, Artificial Sequence
  Synthetic
tttggtgattttatacaaacagcccgtcaacataggcatcatataagaat

SEQ ID NO: 6365 - DNA, 44 bp, Artificial Sequence
  Synthetic
cagatcctgctatgcacgttgcactaaaacaacaagttcgtaaa

SEQ ID NO: 6366 - DNA, 47 bp, Artificial Sequence
  Synthetic
tgctatcagtgctaagaatagagctggcctgtcatagtactaagaat

SEQ ID NO: 6367 - DNA, 46 bp, Artificial Sequence
  Synthetic
acatgaattttgttgttcacatggttcaaaacttgagcacattcat

SEQ ID NO: 6368 - DNA, 46 bp, Artificial Sequence
  Synthetic
aagtctagctatagatgcttaccctacacgaaagactttttggtat

SEQ ID NO: 6369 - DNA, 44 bp, Artificial Sequence
  Synthetic
tgaacgtttaaagttatttgctgcatggtagcagaagcatagct

SEQ ID NO: 6370 - DNA, 43 bp, Artificial Sequence
  Synthetic
atgttgctaattatcagcacattggagactttcccgtaccagg

SEQ ID NO: 6371 - DNA, 49 bp, Artificial Sequence
  Synthetic
ctttccactgcaaataggtttttcaaagtataacaatctctctcagcaa

SEQ ID NO: 6372 - DNA, 45 bp, Artificial Sequence
  Synthetic
tgatgcttttcctgtagccaagatctttatgcacatcatagacat

SEQ ID NO: 6373 - DNA, 48 bp, Artificial Sequence
  Synthetic
atcacacggtgtaatctaggtggggtagttacaatattcttcagcatg

SEQ ID NO: 6374 - DNA, 41 bp, Artificial Sequence
  Synthetic
ctcaaagttgagttttggttcgcctgtctgttcggctgaag

SEQ ID NO: 6375 - DNA, 43 bp, Artificial Sequence
  Synthetic
ttttacatttaggtgcagggtctgccagatggtaaccactgtc

SEQ ID NO: 6376 - DNA, 46 bp, Artificial Sequence
  Synthetic
atcgttcttgtgagagtactactgtcaggtaaacaagaacacctac

SEQ ID NO: 6377 - DNA, 47 bp, Artificial Sequence
  Synthetic
tcgtaaacgtagaagtatttctgctaaactgacattaaagggttcaa

SEQ ID NO: 6378 - DNA, 45 bp, Artificial Sequence
  Synthetic
aaatgcttatgtctctcaacagctccttctccatagctaaagcag

SEQ ID NO: 6379 - DNA, 44 bp, Artificial Sequence
  Synthetic
tacagggtgtcaaacttggcatacagtaacatatacgggcaaat

SEQ ID NO: 6380 - DNA, 44 bp, Artificial Sequence
  Synthetic
atctgagcgaaattaccaaacctagacacagtgaatttaggttg

SEQ ID NO: 6381 - DNA, 47 bp, Artificial Sequence
  Synthetic
tcaacagtgttttggtaaaagaggaccaagctttaacatttcagcat

SEQ ID NO: 6382 - DNA, 46 bp, Artificial Sequence
  Synthetic
ctggtactcagcacatttcaaatgggatcatcaagagtagcaagta

SEQ ID NO: 6383 - DNA, 39 bp, Artificial Sequence
  Synthetic
tgcagcaatatgcacccacttcgccttgttcattgatga

SEQ ID NO: 6384 - DNA, 42 bp, Artificial Sequence
  Synthetic
cgaaagaggcgaagaaacaattgatttcggtgggagactttg

SEQ ID NO: 6385 - DNA, 45 bp, Artificial Sequence
  Synthetic
cctaatggacctccttgttatcagttcaatgctcaatttcaaagc

SEQ ID NO: 6386 - DNA, 45 bp, Artificial Sequence
  Synthetic
aaaacgagtcaactaaagtgggctgtcaaagtctactttctctgg

SEQ ID NO: 6387 - DNA, 49 bp, Artificial Sequence
  Synthetic
gaattatttcacagcagaggtgtcccagtattaatgtatacccccttca

SEQ ID NO: 6388 - DNA, 45 bp, Artificial Sequence
  Synthetic
aaatgggagaaatactgtgtccttgccttgaaatttggcctatgg

SEQ ID NO: 6389 - DNA, 42 bp, Artificial Sequence
  Synthetic
ccccaagggagtggaagaagtgacttagccaatagagtccta

SEQ ID NO: 6390 - DNA, 45 bp, Artificial Sequence
  Synthetic
aattgggaggttttacgtacagatgatcaaccttccttcttggtc

SEQ ID NO: 6391 - DNA, 40 bp, Artificial Sequence
  Synthetic
ggcgataatggacgaagaacattccctttgaggatgttgc

SEQ ID NO: 6392 - DNA, 39 bp, Artificial Sequence
  Synthetic
tcctgagaggatccgtagccctatccactggccacagcg

SEQ ID NO: 6393 - DNA, 44 bp, Artificial Sequence
  Synthetic
aagaggacaactatccactagaggagaatccattgcttccacgt

SEQ ID NO: 6394 - DNA, 47 bp, Artificial Sequence
  Synthetic
aagctttcagcatctattactgacactgtatatttctcctagcacac

SEQ ID NO: 6395 - DNA, 42 bp, Artificial Sequence
  Synthetic
aagagacggagagagaccgaggttcaatgttggacgaggagg

SEQ ID NO: 6396 - DNA, 45 bp, Artificial Sequence
  Synthetic
aaatgttggaggtggagatgtaaaaaaactgtagtgcatgctaaa

SEQ ID NO: 6397 - DNA, 43 bp, Artificial Sequence
  Synthetic
cggaggacttatatagggcttgttgcaagtgtagtttgttcaa

SEQ ID NO: 6398 - DNA, 43 bp, Artificial Sequence
  Synthetic
acacctgttaaaccaaatacagctgttgcagatgactcaggag

SEQ ID NO: 6399 - DNA, 39 bp, Artificial Sequence
  Synthetic
tgcagcctatacctgaaaggcctgggctgttgcatcaat

SEQ ID NO: 6400 - DNA, 45 bp, Artificial Sequence
  Synthetic
cactttagttagagccagggaactggatcacttataggtacctgt

SEQ ID NO: 6401 - DNA, 40 bp, Artificial Sequence
  Synthetic
ggtggttcgagtgagcagatgtgcactgtttgacctatag

SEQ ID NO: 6402 - DNA, 50 bp, Artificial Sequence
  Synthetic
tacaggtgaatattgggatgtagcagtttactaattgtattgcaggacaa

SEQ ID NO: 6403 - DNA, 39 bp, Artificial Sequence
  Synthetic
ctttcatggaagacgggagcaatcacccatagtccctgc

SEQ ID NO: 6404 - DNA, 38 bp, Artificial Sequence
  Synthetic
gtacctccccctcagactgcggtaaatgacagcgggtt

SEQ ID NO: 6405 - DNA, 44 bp, Artificial Sequence
  Synthetic
tcgcactgtttatgcagagcatgcagtattgtaaacaacattct

SEQ ID NO: 6406 - DNA, 43 bp, Artificial Sequence
  Synthetic
ttttggtaagtgacaaatgcccggctttaaagtgcacggtaac

SEQ ID NO: 6407 - DNA, 42 bp, Artificial Sequence
  Synthetic
attcggatttccatttcatcgacgatagtgcattcgggtcac

SEQ ID NO: 6408 - DNA, 46 bp, Artificial Sequence
  Synthetic
tcattgaaattggagtaacacggatattttgttggctttctctagg

SEQ ID NO: 6409 - DNA, 41 bp, Artificial Sequence
  Synthetic
aagaggcgaagagacaattgaaggttcggtgggagactttg

SEQ ID NO: 6410 - DNA, 43 bp, Artificial Sequence
  Synthetic
agactttgatgactgcaaagatgtttagagatctgggctctgg

SEQ ID NO: 6411 - DNA, 43 bp, Artificial Sequence
  Synthetic
gggctactgaatacataatgaagggaaagtcatccatggctgc

SEQ ID NO: 6412 - DNA, 43 bp, Artificial Sequence
  Synthetic
tgtgttcttgaaataggagacatgcataggaacatgggcctcg

SEQ ID NO: 6413 - DNA, 41 bp, Artificial Sequence
  Synthetic
gggagtggaggaaggctctaagacgcatatagactgttgaa

SEQ ID NO: 6414 - DNA, 39 bp, Artificial Sequence
  Synthetic
gtgatgccccctttgatgacacaagtgtgctgcctcttc

SEQ ID NO: 6415 - DNA, 48 bp, Artificial Sequence
  Synthetic
cagaaaataactggaggccttatggactgagaaatttgctttaaggat

SEQ ID NO: 6416 - DNA, 40 bp, Artificial Sequence
  Synthetic
acagagattcgcttggggaactgttttggagggagtgaag

SEQ ID NO: 6417 - DNA, 43 bp, Artificial Sequence
  Synthetic
agggacaacatgaccaagaaaatagctcttttttgtcagcttt

SEQ ID NO: 6418 - DNA, 45 bp, Artificial Sequence
  Synthetic
ccgttggagggaatgagaagagttagtcatcatctttctcacaac

SEQ ID NO: 6419 - DNA, 43 bp, Artificial Sequence
  Synthetic
tccaatcctctgatgatttcgctcctgcttgtattccctcatg

SEQ ID NO: 6420 - DNA, 43 bp, Artificial Sequence
  Synthetic
aacaacgaccttggaccagctgtagtctttaatgaacagctga

SEQ ID NO: 6421 - DNA, 41 bp, Artificial Sequence
  Synthetic
tcttccctagcagttcatatcggatcaattcgggccctaga

SEQ ID NO: 6422 - DNA, 38 bp, Artificial Sequence
  Synthetic
ccagctacccgaccctacaacttgcagtgatgtgtcca

SEQ ID NO: 6423 - DNA, 47 bp, Artificial Sequence
  Synthetic
tggaaccatataatgaagtgcaagacctctgagttgtttaattcctc

SEQ ID NO: 6424 - DNA, 44 bp, Artificial Sequence
  Synthetic
acatgccttaaaacgaaagtatggacttgctgtatcacgacatg

SEQ ID NO: 6425 - DNA, 48 bp, Artificial Sequence
  Synthetic
tgacagtgtatttgacctgtcagatcatatgctatgtcactttcatct

SEQ ID NO: 6426 - DNA, 41 bp, Artificial Sequence
  Synthetic
gacgtggtccagattagatttgcaacgttgggatagggcat

SEQ ID NO: 6427 - DNA, 45 bp, Artificial Sequence
  Synthetic
aaaagcaaagcacatgaagcaatactctgatttagcaagactctc

SEQ ID NO: 6428 - DNA, 40 bp, Artificial Sequence
  Synthetic
agagaattacaacaccccaccagaacccccactcttttgg

SEQ ID NO: 6429 - DNA, 43 bp, Artificial Sequence
  Synthetic
ggccttcagatccatctattgttacaacaggagctccagatgt

SEQ ID NO: 6430 - DNA, 41 bp, Artificial Sequence
  Synthetic
cacatggatacgaggaaattccaaataggttcggtgcctct

SEQ ID NO: 6431 - DNA, 46 bp, Artificial Sequence
  Synthetic
tgccttaacatccagacgtgggacatagttagttttttacccaatc

SEQ ID NO: 6432 - DNA, 43 bp, Artificial Sequence
  Synthetic
tcctgaaacacaacgtttagtatggtaacacctaaaggctgcc

SEQ ID NO: 6433 - DNA, 41 bp, Artificial Sequence
  Synthetic
attggttgtgttcctgctattggcagtcacctgtttgcaca

SEQ ID NO: 6434 - DNA, 43 bp, Artificial Sequence
  Synthetic
tttacgacgcgaacagttatttgcctgcatctcctatagtgcc

SEQ ID NO: 6435 - DNA, 40 bp, Artificial Sequence
  Synthetic
gaaccctatgtttcatgcgacctgttgttccttggctgag

SEQ ID NO: 6436 - DNA, 42 bp, Artificial Sequence
  Synthetic
tctgcagtagtatggtacaacagaagtatgtttcgggcccat

SEQ ID NO: 6437 - DNA, 48 bp, Artificial Sequence
  Synthetic
ggctcaaatagaccagtgattcagcatatatattgactagtgtgtgtc

SEQ ID NO: 6438 - DNA, 44 bp, Artificial Sequence
  Synthetic
ctcgaggtctggatacgagatgggctttgatctatcatctgtca

SEQ ID NO: 6439 - DNA, 42 bp, Artificial Sequence
  Synthetic
aaaagtacacatcaggaaggcaaattgccatcatccacttca

SEQ ID NO: 6440 - DNA, 49 bp, Artificial Sequence
  Synthetic
aaaaggtcgaaaggttgaaacatgcctccttattttaacttgatttctg

SEQ ID NO: 6441 - DNA, 42 bp, Artificial Sequence
  Synthetic
atgctagaaagagaattggtccgttaaacactgcctgttccg

SEQ ID NO: 6442 - DNA, 41 bp, Artificial Sequence
  Synthetic
tctctcttggaaatgtgccacagtctaaggatgtccaccat

SEQ ID NO: 6443 - DNA, 45 bp, Artificial Sequence
  Synthetic
gaagagcaacagctattctcagaaactctcccgcttactatcaac

SEQ ID NO: 6444 - DNA, 41 bp, Artificial Sequence
  Synthetic
agatcaatggccctgagtcacaatttcccagttcctgatta

SEQ ID NO: 6445 - DNA, 39 bp, Artificial Sequence
  Synthetic
tgccccaccagaacagagtatcaaccctgatcctctcac

SEQ ID NO: 6446 - DNA, 44 bp, Artificial Sequence
  Synthetic
aagagatatggcccagcattaagcacattagccttctctccttt

SEQ ID NO: 6447 - DNA, 43 bp, Artificial Sequence
  Synthetic
tggaggagtattgcaaacattatggatggcaaaacacgcatct

SEQ ID NO: 6448 - DNA, 46 bp, Artificial Sequence
  Synthetic
ggttagattaagggtttgtgtacgtaagagaagcacttgaagactg

SEQ ID NO: 6449 - DNA, 49 bp, Artificial Sequence
  Synthetic
aaaaggagattgtttttggacagtgctacctgtgtaacagtattttcag

SEQ ID NO: 6450 - DNA, 42 bp, Artificial Sequence
  Synthetic
gggaagtggatctagaacggttcattaatggcggatcccaag

SEQ ID NO: 6451 - DNA, 45 bp, Artificial Sequence
  Synthetic
gtggatcacgttctggtagacccatctactgttacagatggtctt

SEQ ID NO: 6452 - DNA, 43 bp, Artificial Sequence
  Synthetic
actggcggtgtcactcaatcctagaactgcaaaactagtctca

SEQ ID NO: 6453 - DNA, 45 bp, Artificial Sequence
  Synthetic
agcagcaccagacaatgcatttttctgttagtataggtctgtgta

SEQ ID NO: 6454 - DNA, 46 bp, Artificial Sequence
  Synthetic
agaccctataaatgcaacagatgttgctttctgcatattcatcctc

SEQ ID NO: 6455 - DNA, 43 bp, Artificial Sequence
  Synthetic
taggtgatacagagaatccagcaacaattcattcgttggtctg

SEQ ID NO: 6456 - DNA, 45 bp, Artificial Sequence
  Synthetic
gtgtgccattagaattagtggacactatcactggtcatgcgtaag

SEQ ID NO: 6457 - DNA, 39 bp, Artificial Sequence
  Synthetic
ctagtggacagcagtgaccttcaggcgccaaaaacttac

SEQ ID NO: 6458 - DNA, 49 bp, Artificial Sequence
  Synthetic
ctgtgtggaaacctggatattgtgtaagatgtacctttagtgtctttgt

SEQ ID NO: 6459 - DNA, 45 bp, Artificial Sequence
  Synthetic
gtgcctggatattttacacagcagttccttatatcccactccaaa

SEQ ID NO: 6460 - DNA, 46 bp, Artificial Sequence
  Synthetic
agaagtgtaccagtagcattgtttattgttccatgtacaaaacttg

SEQ ID NO: 6461 - DNA, 43 bp, Artificial Sequence
  Synthetic
agatggaaacgaggtgtctgtgaggtaatttaatttgcactgg

SEQ ID NO: 6462 - DNA, 43 bp, Artificial Sequence
  Synthetic
cattggcagcatctgaaagcaccatattgggatttctttaggc

SEQ ID NO: 6463 - DNA, 41 bp, Artificial Sequence
  Synthetic
atgtgcattttaccaaggaagcattccagtcctcacttgcc

SEQ ID NO: 6464 - DNA, 45 bp, Artificial Sequence
  Synthetic
ttttacatgggtggcggatgcctttgtgatgtattagtaaatcct

SEQ ID NO: 6465 - DNA, 40 bp, Artificial Sequence
  Synthetic
caggtgggggtcgggtaacacaggaggcccaataggatct

SEQ ID NO: 6466 - DNA, 43 bp, Artificial Sequence
  Synthetic
acagaccctgttacacaatctgccagatccttctgttacagca

SEQ ID NO: 6467 - DNA, 45 bp, Artificial Sequence
  Synthetic
gtatccaccctgactcatttgaattcaataatacctgtgtcaccg

SEQ ID NO: 6468 - DNA, 46 bp, Artificial Sequence
  Synthetic
ccacagtccggtaaactttatctaccgtattcatcagtaggcagta

SEQ ID NO: 6469 - DNA, 38 bp, Artificial Sequence
  Synthetic
cattgggatgctgcaaagcctaaaggaggacatgcacc

SEQ ID NO: 6470 - DNA, 45 bp, Artificial Sequence
  Synthetic
tgccaccagctataaacattatctgtgagaggaaccttgcataat

SEQ ID NO: 6471 - DNA, 41 bp, Artificial Sequence
  Synthetic
tctacctcctctagaaagcggtcttaaaccccccgtctacg

SEQ ID NO: 6472 - DNA, 43 bp, Artificial Sequence
  Synthetic
cttgatcctatgattgttgttggcatacacctctcccggttag

SEQ ID NO: 6473 - DNA, 50 bp, Artificial Sequence
  Synthetic
gcactatccctatacaatagacaccgcaataatagtaaatctaacacctg

SEQ ID NO: 6474 - DNA, 45 bp, Artificial Sequence
  Synthetic
tagcgaatggtatgttgtgacagtagctcttccattgtatccaaa

SEQ ID NO: 6475 - DNA, 48 bp, Artificial Sequence
  Synthetic
tttcacctcagagacaaagcaaaagtagcttcatcttctcctaatcca

SEQ ID NO: 6476 - DNA, 43 bp, Artificial Sequence
  Synthetic
gtgccgctgcagaagaagtaaaaaatcacaatgttgctgcata

SEQ ID NO: 6477 - DNA, 44 bp, Artificial Sequence
  Synthetic
ccaaattatttctgctcctgttaccgctttggaagtgtagtcgt

SEQ ID NO: 6478 - DNA, 39 bp, Artificial Sequence
  Synthetic
ctccagagagtcgccccgtaactctgtcggtcgacttcg

SEQ ID NO: 6479 - DNA, 47 bp, Artificial Sequence
  Synthetic
agaccctataagttcaggttctgaatctgcagcacttatatctgaaa

SEQ ID NO: 6480 - DNA, 44 bp, Artificial Sequence
  Synthetic
ggggagggatttcaacgtgttatcaatattttgtgttggctgtt

SEQ ID NO: 6481 - DNA, 48 bp, Artificial Sequence
  Synthetic
gaacaatacgagtcagcagattaggctttctgaccaatagttagtcca

SEQ ID NO: 6482 - DNA, 45 bp, Artificial Sequence
  Synthetic
tgaaggagaatctatgatcatgccccttgcagctatttctggaat

SEQ ID NO: 6483 - DNA, 43 bp, Artificial Sequence
  Synthetic
aatgttttacagatggctctttggtgagtacacgagcaacagg

SEQ ID NO: 6484 - DNA, 45 bp, Artificial Sequence
  Synthetic
tgtctttaacccagaaagagagagaccacctctaccaatttcaag

SEQ ID NO: 6485 - DNA, 38 bp, Artificial Sequence
  Synthetic
ccagccactggtgaacactgggatccttttgctggagc

SEQ ID NO: 6486 - DNA, 41 bp, Artificial Sequence
  Synthetic
ctcggatttaacaagcattgctgttgcctgtttcccctttg

SEQ ID NO: 6487 - DNA, 40 bp, Artificial Sequence
  Synthetic
gcagtttggcttcgaggtgcattgatggcctggaactgac

SEQ ID NO: 6488 - DNA, 39 bp, Artificial Sequence
  Synthetic
ccagagacggtgttgcgccggcaaaggaggaccaggttc

SEQ ID NO: 6489 - DNA, 43 bp, Artificial Sequence
  Synthetic
gtagacacccagttatgcagtgtgatagaattccaggaggttt

SEQ ID NO: 6490 - DNA, 36 bp, Artificial Sequence
  Synthetic
agtaggtgcctccagagcccaagtttgggggcgccc

SEQ ID NO: 6491 - DNA, 38 bp, Artificial Sequence; identical to SEQ ID NO: 5838
  Synthetic

SEQ ID NO: 6492 - DNA, 39 bp, Artificial Sequence
  Synthetic
cctggggccaccttcatcaccacttcggtctcccctagg

SEQ ID NO: 6493 - DNA, 36 bp, Artificial Sequence
  Synthetic
gtggctgcctttgggatgcagcaggcaaggcgagca

SEQ ID NO: 6494 - DNA, 39 bp, Artificial Sequence
  Synthetic
agttgatgatctgtaggcgcacatctacgaggccatcaa

SEQ ID NO: 6495 - DNA, 35 bp, Artificial Sequence
  Synthetic
atgcgggatctgccggtcgaaacccgatggccccg

SEQ ID NO: 6496 - DNA, 36 bp, Artificial Sequence
  Synthetic
actcgtgaggcaccccatcctggctcccgcgcatac

SEQ ID NO: 6497 - DNA, 40 bp, Artificial Sequence
  Synthetic
tccccgggagattcgcgacacatgatcagccacgaacgaa

SEQ ID NO: 6498 - DNA, 39 bp, Artificial Sequence
  Synthetic
gtttcagatcccacgcctccaaaaacacggccaagggag

SEQ ID NO: 6499 - DNA, 41 bp, Artificial Sequence
  Synthetic
agctatgcctcccgtcgactgagaagcccagttatccaccc

SEQ ID NO: 6500 - DNA, 40 bp, Artificial Sequence
  Synthetic
cggccaatcccggggtaactagggactggctgtctcctac

SEQ ID NO: 6501 - DNA, 39 bp, Artificial Sequence
  Synthetic
cctgcgtagaacgatggggcgctggtcggcacacatccg

SEQ ID NO: 6502 - DNA, 39 bp, Artificial Sequence
  Synthetic
gactctgtttccagccagagggacaatttctggcggcgg

SEQ ID NO: 6503 - DNA, 37 bp, Artificial Sequence
  Synthetic
ccgccatctcgtgggccttcgctggaagagcaggtcc

SEQ ID NO: 6504 - DNA, 39 bp, Artificial Sequence
  Synthetic
ggcctcattcgcctctcgcgctccgagaacaggaagaca

SEQ ID NO: 6505 - DNA, 39 bp, Artificial Sequence
  Synthetic
gcaggcaggcctccagcttaaacaagggaagagcgggag

SEQ ID NO: 6506 - DNA, 37 bp, Artificial Sequence
  Synthetic
gccgtgcctaggatgcggaggatgtgaatgcccccgg

SEQ ID NO: 6507 - DNA, 38 bp, Artificial Sequence
  Synthetic
tgcgagcaaaggcggcgatccggaacagatcacagtca

SEQ ID NO: 6508 - DNA, 36 bp, Artificial Sequence
  Synthetic
tcgccagagggatctgcacctggaggctgtgctccc

SEQ ID NO: 6509 - DNA, 38 bp, Artificial Sequence
  Synthetic
cgacctcagctccgagtgggaagaggtagcgccccagg

SEQ ID NO: 6510 - DNA, 35 bp, Artificial Sequence
  Synthetic
cccacttttggcgcgacctcctcggcgcacaggtt

SEQ ID NO: 6511 - DNA, 35 bp, Artificial Sequence
  Synthetic
actcctgctggccctcccttcaccgactgccccct

SEQ ID NO: 6512 - DNA, 36 bp, Artificial Sequence
  Synthetic
catgagcaagggcccagggacttccaatcccccggg

SEQ ID NO: 6513 - DNA, 38 bp, Artificial Sequence
  Synthetic
ttccggccgttagcgtgccaccacagctatgatgccag

SEQ ID NO: 6514 - DNA, 38 bp, Artificial Sequence
  Synthetic
gcctctggctgttcagctcgcttctgcttctgcctggc

SEQ ID NO: 6515 - DNA, 36 bp, Artificial Sequence
  Synthetic
aggggtcagcggctgtcaaccggtcttcctctgcca

SEQ ID NO: 6516 - DNA, 36 bp, Artificial Sequence
  Synthetic
cggccaggctctgaccagattgagaccctggcgcac

SEQ ID NO: 6517 - DNA, 37 bp, Artificial Sequence
  Synthetic
agatgcggcgcagacagccacagggggatgccagagg

SEQ ID NO: 6518 - DNA, 40 bp, Artificial Sequence
  Synthetic
ctcgtcaggccgcgagaggatggcctcaaacactgacatt

SEQ ID NO: 6519 - DNA, 35 bp, Artificial Sequence
  Synthetic
cctttgagcccgaggtgccagagtgctccggctgc

SEQ ID NO: 6520 - DNA, 40 bp, Artificial Sequence
  Synthetic
gtagcgccgctgattctggacatcatcgatcccggctaca

SEQ ID NO: 6521 - DNA, 42 bp, Artificial Sequence
  Synthetic
tctgttccttctgctccagtgctcattacctctcgctgtcga

SEQ ID NO: 6522 - DNA, 37 bp, Artificial Sequence
  Synthetic
gatgcgcctgacgttgtgcggccccactgtatccacc

SEQ ID NO: 6523 - DNA, 44 bp, Artificial Sequence
  Synthetic
tcgaagagtttatatggatgtgcatatggtttttgtctgatggc

SEQ ID NO: 6524 - DNA, 41 bp, Artificial Sequence
  Synthetic
ttggcttctgacatctcccagctgtgcgtagtgttgctgtg

SEQ ID NO: 6525 - DNA, 37 bp, Artificial Sequence
  Synthetic
agtagcgggcctcggtgtggatggacgaggagctcat

SEQ ID NO: 6526 - DNA, 40 bp, Artificial Sequence
  Synthetic
gcagtggctatgcctccatgccaagagctggtgggagagg

SEQ ID NO: 6527 - DNA, 38 bp, Artificial Sequence
  Synthetic
gagatggtgtccggagaccccacaccgtgggccccttt

SEQ ID NO: 6528 - DNA, 41 bp, Artificial Sequence
  Synthetic
aagagccagggggggaagtcgtcttttcaccacgtccacga

SEQ ID NO: 6529 - DNA, 39 bp, Artificial Sequence
  Synthetic
aagcctgcctcatccttgaccaaagcagcagcctcagga

SEQ ID NO: 6530 - DNA, 39 bp, Artificial Sequence
  Synthetic
ccctgggcttggttcgcctccaaatactggccggtactc

SEQ ID NO: 6531 - DNA, 37 bp, Artificial Sequence
  Synthetic
tgggcagtaggctcggagtgtcacgggagccacaacc

SEQ ID NO: 6532 - DNA, 36 bp, Artificial Sequence
  Synthetic
cccgcctggtgctggaagttcagggacgttggtggc

SEQ ID NO: 6533 - DNA, 39 bp, Artificial Sequence
  Synthetic
agatggccatcagtaggcaccctggcccgcagacacatt

SEQ ID NO: 6534 - DNA, 38 bp, Artificial Sequence
  Synthetic
cagtcctaggtcagcggccgactcgggggcctctacac

SEQ ID NO: 6535 - DNA, 38 bp, Artificial Sequence
  Synthetic
tgtgctggaaagagaggctggatcttgtccgccgccag

SEQ ID NO: 6536 - DNA, 37 bp, Artificial Sequence
  Synthetic
tgggacctggggccgtagacctggtgcctgaagaccc

SEQ ID NO: 6537 - DNA, 37 bp, Artificial Sequence
  Synthetic
tgctgtatgcctcgcagcgctatcctgctgcagggcg

SEQ ID NO: 6538 - DNA, 40 bp, Artificial Sequence
  Synthetic
ggggggcctggagtcgatcaccacccgctgtatgaggaag

SEQ ID NO: 6539 - DNA, 36 bp, Artificial Sequence
  Synthetic
tggcacgcgattggggcacccctcctcgtgcaccta

SEQ ID NO: 6540 - DNA, 37 bp, Artificial Sequence
  Synthetic
aagggcgcacaccactcctgtgatggatccagcgagt

SEQ ID NO: 6541 - DNA, 37 bp, Artificial Sequence
  Synthetic
acaccctcaacccccgagtgccggatcaacgtacacg

SEQ ID NO: 6542 - DNA, 35 bp, Artificial Sequence
  Synthetic
gccctccagatcgccaccttgggggtgcagggtga

SEQ ID NO: 6543 - DNA, 42 bp, Artificial Sequence
  Synthetic
tgacggatgtctttaacggcgcaggatgtgttggcctttagg

SEQ ID NO: 6544 - DNA, 42 bp, Artificial Sequence
  Synthetic
gcgtaacgtcattgtccaccgacattcatgacctgccccact

SEQ ID NO: 6545 - DNA, 40 bp, Artificial Sequence
  Synthetic
actgacccccttgagcacgcgaagccgtctctctgagatg

SEQ ID NO: 6546 - DNA, 39 bp, Artificial Sequence
  Synthetic
gtgtcctggtttaaggccgcagtgctgctccaatgtccg

SEQ ID NO: 6547 - DNA, 36 bp, Artificial Sequence
  Synthetic
tgtacccatcccggccctcatgggcaggctctcacg

SEQ ID NO: 6548 - DNA, 39 bp, Artificial Sequence
  Synthetic
tcgatgagggagcaaacacccgcacagtcacggggatct

SEQ ID NO: 6549 - DNA, 43 bp, Artificial Sequence
  Synthetic
gtggtcagcagcagatagtgaatcttgagctccaactactttg

SEQ ID NO: 6550 - DNA, 36 bp, Artificial Sequence
  Synthetic
cgtagcaccacgtggctgctccagcccctgcatacc

SEQ ID NO: 6551 - DNA, 36 bp, Artificial Sequence
  Synthetic
cgctctccgggcacgtcttagttcggggcctgtgtc

SEQ ID NO: 6552 - DNA, 37 bp, Artificial Sequence
  Synthetic
cccgtgcctccttactacggatggatcgcgagggagc

SEQ ID NO: 6553 - DNA, 37 bp, Artificial Sequence
  Synthetic
aggcctctgcgtccggagtcacagacttggccttggg

SEQ ID NO: 6554 - DNA, 40 bp, Artificial Sequence
  Synthetic
ctggatgagggagcgccaattacaagggtgggctaactct

SEQ ID NO: 6555 - DNA, 37 bp, Artificial Sequence
  Synthetic
ccagggtccccacagtggatggctctgaccagcaaga

SEQ ID NO: 6556 - DNA, 38 bp, Artificial Sequence
  Synthetic
gggcagttcctcgttgcgcacccagatgcctcacctgg

SEQ ID NO: 6557 - DNA, 39 bp, Artificial Sequence
  Synthetic
cagacgcccccagccctaacaggcacatctacagcatca

SEQ ID NO: 6558 - DNA, 37 bp, Artificial Sequence
  Synthetic
ccaccaccgtcagggagtctaggggtggtggatgtgc

SEQ ID NO: 6559 - DNA, 36 bp, Artificial Sequence
  Synthetic
cacgttgctgggtgggggaaccttcatcacggggcc

SEQ ID NO: 6560 - DNA, 36 bp, Artificial Sequence
  Synthetic
ctgtcctcccagggacccgacccgcatgcgcaacca

SEQ ID NO: 6561 - DNA, 40 bp, Artificial Sequence
  Synthetic
ggtggttacaggagacgtgggttggttctgcccaaccacg

SEQ ID NO: 6562 - DNA, 38 bp, Artificial Sequence
  Synthetic
cgtagctcaccgccagctccggactcgggagccttaat

SEQ ID NO: 6563 - DNA, 42 bp, Artificial Sequence
  Synthetic
aacgatggaatggccaccaggtggcaataaccgaggccttca

SEQ ID NO: 6564 - DNA, 38 bp, Artificial Sequence
  Synthetic
gcaccgtcaggcacctgtgctcttagggaggtggccac

SEQ ID NO: 6565 - DNA, 38 bp, Artificial Sequence
  Synthetic
gagtctgcgatagagggccaggcacaagagcgccgcct

SEQ ID NO: 6566 - DNA, 39 bp, Artificial Sequence
  Synthetic
cgtacgtgcgtgtctttgcccaggaagctgtacgcggag

SEQ ID NO: 6567 - DNA, 37 bp, Artificial Sequence
  Synthetic
tggactcagccaccttgtcgttgaggaccccggtcga

SEQ ID NO: 6568 - DNA, 35 bp, Artificial Sequence
  Synthetic
gccgctgggtgacacagacaacaccccccgatgcc

SEQ ID NO: 6569 - DNA, 44 bp, Artificial Sequence
  Synthetic
tttcaggctttgcaaacacagtgtattagttgctctgtaactgg

SEQ ID NO: 6570 - DNA, 42 bp, Artificial Sequence
  Synthetic
atagggtggacggtgagcaaccaccacagtatgaaaccaccc

SEQ ID NO: 6571 - DNA, 41 bp, Artificial Sequence
  Synthetic
aacaacatgtttggactgggtagttttacaccctccgcaac

SEQ ID NO: 6572 - DNA, 40 bp, Artificial Sequence
  Synthetic
agaagtacgcctgctgcattatatgtcacttgcgtttccc

SEQ ID NO: 6573 - DNA, 50 bp, Artificial Sequence
  Synthetic
gtagacattataaacgagcagagcacacttctaaatgatatccattgtga

SEQ ID NO: 6574 - DNA, 40 bp, Artificial Sequence
  Synthetic
tttgggtggggttgtcatttcattttgcatcagctaacgg

SEQ ID NO: 6575 - DNA, 43 bp, Artificial Sequence
  Synthetic
atgtgttgttatttaaggcaagggaaataccaagcacaggcac

SEQ ID NO: 6576 - DNA, 46 bp, Artificial Sequence
  Synthetic
gctggaaaaaaaaaggctacactgacacattgtcttttcctctttg

SEQ ID NO: 6577 - DNA, 40 bp, Artificial Sequence
  Synthetic
aaacctactgaccacggacccgggtttcgttggtgcccag

SEQ ID NO: 6578 - DNA, 43 bp, Artificial Sequence
  Synthetic
accaggatatatgtcattgtttgcagtacccttaacgttccgc

SEQ ID NO: 6579 - DNA, 49 bp, Artificial Sequence
  Synthetic
tactgctactacgtgtacataacctcacaacaggatacatatatgcaat

SEQ ID NO: 6580 - DNA, 44 bp, Artificial Sequence
  Synthetic
ctcctactcctgtagtgccgaaataatacctcagttccatacac

SEQ ID NO: 6581 - DNA, 47 bp, Artificial Sequence
  Synthetic
aaatcgtatagttgtccccaaagtgcaaatttatttgggtcgggtag

SEQ ID NO: 6582 - DNA, 48 bp, Artificial Sequence
  Synthetic
gctgtttgatgttaatcctggtgagcaaccaataatacatagttgtgt

SEQ ID NO: 6583 - DNA, 44 bp, Artificial Sequence
  Synthetic
tatcagattatttcgaatggctgcattaaaacattgctctcggc

SEQ ID NO: 6584 - DNA, 41 bp, Artificial Sequence
  Synthetic
actggctacaacgtgcacaggttacaaaaagcagattgccc

SEQ ID NO: 6585 - DNA, 41 bp, Artificial Sequence
  Synthetic
ggtgatacctaccgctttttacattttctgcaggaggagga

SEQ ID NO: 6586 - DNA, 38 bp, Artificial Sequence
  Synthetic
cagtgaccatgccctgccttaacggcggccattttagg

SEQ ID NO: 6587 - DNA, 42 bp, Artificial Sequence
  Synthetic
ccattgtttggggcatatagttgttacactgctgttgccaaa

SEQ ID NO: 6588 - DNA, 42 bp, Artificial Sequence
  Synthetic
ataccacttctgtcactggctgtgttaaggaaatgcaagcac

SEQ ID NO: 6589 - DNA, 38 bp, Artificial Sequence
  Synthetic
tcctgaagaggaggagcgactgcattacaggtaccgca

SEQ ID NO: 6590 - DNA, 42 bp, Artificial Sequence
  Synthetic
aaaacgaaagtatctgacaagccctacagcttccagtctcgg

SEQ ID NO: 6591 - DNA, 45 bp, Artificial Sequence
  Synthetic
tgaagttatgtgccagcctcccgaccgtttataaaaatacaaagc

SEQ ID NO: 6592 - DNA, 45 bp, Artificial Sequence
  Synthetic
ggcagcatggataaataaatgttgctgtgcaataggtttccaatc

SEQ ID NO: 6593 - DNA, 44 bp, Artificial Sequence
  Synthetic
aaaagctggctattccgttgatgtgtgtatggaaaggctttagc

SEQ ID NO: 6594 - DNA, 41 bp, Artificial Sequence
  Synthetic
agaagaaccaggtcccctcagcatgtcctgttcccacctcc

SEQ ID NO: 6595 - DNA, 42 bp, Artificial Sequence
  Synthetic
attcctttggaaactttacctccaaggcctaacgactggaat

SEQ ID NO: 6596 - DNA, 42 bp, Artificial Sequence
  Synthetic
ctgacccgattcctcccagatttcaataactacagcatttgc

SEQ ID NO: 6597 - DNA, 45 bp, Artificial Sequence
  Synthetic
agcccaatttcgactattgttgaaagcatatctgaagtgtcatgt

SEQ ID NO: 6598 - DNA, 41 bp, Artificial Sequence
  Synthetic
aattgcctttcagatgacactgtctactggctttgcaggag

SEQ ID NO: 6599 - DNA, 41 bp, Artificial Sequence
  Synthetic
ggttgtgaaccagcgttaggtttaacctcatcactgcaagg

SEQ ID NO: 6600 - DNA, 40 bp, Artificial Sequence
  Synthetic
tttcagctgaattgtcccagtttttagcagccctgtttga

SEQ ID NO: 6601 - DNA, 40 bp, Artificial Sequence
  Synthetic
ttgcggaacagcattaacagaacaacttgtagctccttgt

SEQ ID NO: 6602 - DNA, 40 bp, Artificial Sequence
  Synthetic
gcttgcctgcagtgttggaaaccgcatcaggctgatccag

SEQ ID NO: 6603 - DNA, 39 bp, Artificial Sequence
  Synthetic
ctccaggagcttctgttgggccttcaccgtcggccatag

SEQ ID NO: 6604 - DNA, 41 bp, Artificial Sequence
  Synthetic
acagacagcaggaggcacaagggccaacggactagctagat

SEQ ID NO: 6605 - DNA, 38 bp, Artificial Sequence
  Synthetic
gcacagggggggtacaggaagtgctgtaactgcacccg

SEQ ID NO: 6606 - DNA, 44 bp, Artificial Sequence
  Synthetic
cagcaacactgtcaatatgcacaatctcactagcattaggacca

SEQ ID NO: 6607 - DNA, 45 bp, Artificial Sequence
  Synthetic
agaaacaccagaatggattgtaagaactgaaactggcattcttct

SEQ ID NO: 6608 - DNA, 42 bp, Artificial Sequence
  Synthetic
ggcacaaatgacaatgtcagaatgaccgtactatgggtctcc

SEQ ID NO: 6609 - DNA, 43 bp, Artificial Sequence
  Synthetic
gctgcagccattatgtgatgcggtatctatatagctccagcac

SEQ ID NO: 6610 - DNA, 41 bp, Artificial Sequence
  Synthetic
tgatgcaaactggaaatgcttctattgtcctcctggtcgtc

SEQ ID NO: 6611 - DNA, 38 bp, Artificial Sequence
  Synthetic
acatggaccaaggtgtctgggttacacgtgtcccttcg

SEQ ID NO: 6612 - DNA, 42 bp, Artificial Sequence
  Synthetic
acagaagacaggatccagcggcgctgtcagggttacactggt

SEQ ID NO: 6613 - DNA, 39 bp, Artificial Sequence
  Synthetic
gatggtcaacgtgcagtaacaatcatgccacagggttac

SEQ ID NO: 6614 - DNA, 46 bp, Artificial Sequence
  Synthetic
tggcgttactgcttttcttattgtgtatgtatatgatcaggaggcc

SEQ ID NO: 6615 - DNA, 43 bp, Artificial Sequence
  Synthetic
atcctgtagtactgtggacacctaagacacacgaaaagcaaca

SEQ ID NO: 6616 - DNA, 35 bp, Artificial Sequence
  Synthetic
attgggacccgaccccccataacgacaggggggcg

SEQ ID NO: 6617 - DNA, 45 bp, Artificial Sequence
  Synthetic
acagaggaaaccatactatttgagcatccaaaaagtcaggatccg

SEQ ID NO: 6618 - DNA, 43 bp, Artificial Sequence
  Synthetic
gttcccaaggtgtctggatatcaacttattgggatcaggcaaa

SEQ ID NO: 6619 - DNA, 45 bp, Artificial Sequence
  Synthetic
acccagctatttattatagggtgcaagacatattgcatggggtac

SEQ ID NO: 6620 - DNA, 42 bp, Artificial Sequence
  Synthetic
tctgtttacgtagggaacagatgtgaattgcgtcgcccatag

SEQ ID NO: 6621 - DNA, 48 bp, Artificial Sequence
  Synthetic
actacacgtagcaccaatatgactgcatgtactctttaaaattggaag

SEQ ID NO: 6622 - DNA, 46 bp, Artificial Sequence
  Synthetic
gtactgttgtgtatgtatgggtggcacacaaacatgcataaggaaa

SEQ ID NO: 6623 - DNA, 39 bp, Artificial Sequence
  Synthetic
ccggtttcggtcgtgcacaagcgcgaaacagctaacagt

SEQ ID NO: 6624 - DNA, 40 bp, Artificial Sequence
  Synthetic
tgagtgtcgtacagcctccaggtactcaccggttccgcag

SEQ ID NO: 6625 - DNA, 38 bp, Artificial Sequence
  Synthetic
gcgcgcgacaaggaagactttttagggatgggctggcg

SEQ ID NO: 6626 - DNA, 39 bp, Artificial Sequence
  Synthetic
cgccagagctctcgcgcatcgggtaagttccctgttgca

SEQ ID NO: 6627 - DNA, 37 bp, Artificial Sequence
  Synthetic
tctcaccgaatgtggccgtgcgtcgatgtgcgtccgc

SEQ ID NO: 6628 - DNA, 40 bp, Artificial Sequence
  Synthetic
cgtcatgttcggcttggcctggccaacagaaggatgacaa

SEQ ID NO: 6629 - DNA, 40 bp, Artificial Sequence
  Synthetic
ggatggggcgccttgcaatatgccagcaatagggtctcat

SEQ ID NO: 6630 - DNA, 40 bp, Artificial Sequence
  Synthetic
tgacttcaacgccagcacggccgcatttgaggtaagtggt

SEQ ID NO: 6631 - DNA, 42 bp, Artificial Sequence
  Synthetic
ccttgctcttactcggacctgcacgatgttttggtggaggtg

SEQ ID NO: 6632 - DNA, 41 bp, Artificial Sequence
  Synthetic
attccctcactggcctgtggtgcacagatgcgtcataagca

SEQ ID NO: 6633 - DNA, 41 bp, Artificial Sequence
  Synthetic
ctaaaaggtgctttgacgcgcggcacatcctcagtagagcg

SEQ ID NO: 6634 - DNA, 40 bp, Artificial Sequence
  Synthetic
tggcccagctgatggctataccgtgtctgctgggcgtaag

SEQ ID NO: 6635 - DNA, 39 bp, Artificial Sequence
  Synthetic
tcacgcagatgtactccagtgccgtgcacggctccaaag

SEQ ID NO: 6636 - DNA, 41 bp, Artificial Sequence
  Synthetic
caggtcgggtacttgcatgcccagcatatgcgacaggaact

SEQ ID NO: 6637 - DNA, 42 bp, Artificial Sequence
  Synthetic
ctaccaccatccttggcatcgggcacagttagtctgacccca

SEQ ID NO: 6638 - DNA, 39 bp, Artificial Sequence
  Synthetic
caccgacgccctcatgacagtacgttgcagtcgatcacg

SEQ ID NO: 6639 - DNA, 40 bp, Artificial Sequence
  Synthetic
ccgtcaggctcagggcgtatctgcctcccaaaactcaaga

SEQ ID NO: 6640 - DNA, 40 bp, Artificial Sequence
  Synthetic
atacatcgccacctgcatgcaacctgccaagacccatgtg

SEQ ID NO: 6641 - DNA, 42 bp, Artificial Sequence
  Synthetic
ttctgggccaaacacatgtggatgttgatagtcctgcgaggt

SEQ ID NO: 6642 - DNA, 40 bp, Artificial Sequence
  Synthetic
tgtcgtcaacttgctgcctggacagaatggccgcgcagat

SEQ ID NO: 6643 - DNA, 38 bp, Artificial Sequence
  Synthetic
cgaaacccgcgccaaactttacctccgcgtactctgag

SEQ ID NO: 6644 - DNA, 35 bp, Artificial Sequence
  Synthetic
cgtttagcgcgggggtcatgccgatagctggctcg

SEQ ID NO: 6645 - DNA, 40 bp, Artificial Sequence
  Synthetic
cctgggcacggcctgattaccggttggtaatctggccttt

SEQ ID NO: 6646 - DNA, 40 bp, Artificial Sequence
  Synthetic
acctggagcctgagcaggtagaagaccaggaccccgagtc

SEQ ID NO: 6647 - DNA, 40 bp, Artificial Sequence
  Synthetic
cgcaaggctcctcaccatggagatcttgcagaatggggtg

SEQ ID NO: 6648 - DNA, 40 bp, Artificial Sequence
  Synthetic
tggattccagtattcccccgctggtccttcttttccgccc

SEQ ID NO: 6649 - DNA, 40 bp, Artificial Sequence
  Synthetic
aatcgcgcccacaatgctggggtcccctggctttctgaga

SEQ ID NO: 6650 - DNA, 40 bp, Artificial Sequence
  Synthetic
gggctgcctgggaaacagtttggatgatgtttcccagcca

SEQ ID NO: 6651 - DNA, 36 bp, Artificial Sequence
  Synthetic
ccacccctcagagcgtggaacgggagatgagggacg

SEQ ID NO: 6652 - DNA, 39 bp, Artificial Sequence
  Synthetic
cgcgattgatgcggatttgccgttccagcaccgttttgc

SEQ ID NO: 6653 - DNA, 40 bp, Artificial Sequence
  Synthetic
cgaggtgggcgtaacgcttgcaaagtccacgccaaaatgg

SEQ ID NO: 6654 - DNA, 39 bp, Artificial Sequence
  Synthetic
tcatgcccgggaagagtttgccggcttcgtcttcctgtc

SEQ ID NO: 6655 - DNA, 37 bp, Artificial Sequence
  Synthetic
gggcggacaatgccgtctgcgtcatgccgcctgaaac

SEQ ID NO: 6656 - DNA, 36 bp, Artificial Sequence
  Synthetic
cagcgtcagtccgaacgtcctcagtgccaccccgtc

SEQ ID NO: 6657 - DNA, 39 bp, Artificial Sequence
  Synthetic
gcgaaccgaaaacccaataccgagccccagtagcgttgg

SEQ ID NO: 6658 - DNA, 41 bp, Artificial Sequence
  Synthetic
gaccaatacatcggcggcatcgagtttggtgaagaagcgcg

SEQ ID NO: 6659 - DNA, 36 bp, Artificial Sequence
  Synthetic
gcaaaatcaccgtcgccgcctcgttggcgagtgcgg

SEQ ID NO: 6660 - DNA, 38 bp, Artificial Sequence
  Synthetic
gctcccaagccgaaacgtgatatcgcaagccgctttcg

SEQ ID NO: 6661 - DNA, 35 bp, Artificial Sequence
  Synthetic
gtgatgcggccgccgacttctatcgcgccgccaac

SEQ ID NO: 6662 - DNA, 37 bp, Artificial Sequence
  Synthetic
aaccgggaatcaggtcggtggcggtgtggcaggcgta

SEQ ID NO: 6663 - DNA, 35 bp, Artificial Sequence
  Synthetic
ggggtgtgcgtgccggaaattaccgccgaccgcac

SEQ ID NO: 6664 - DNA, 38 bp, Artificial Sequence
  Synthetic
ccgcccgcgacaatgtagttggcacgaacgcttggaag

SEQ ID NO: 6665 - DNA, 37 bp, Artificial Sequence
  Synthetic
gcgcttttgggcgaacagcgtaaggaagcgcgcgtgg

SEQ ID NO: 6666 - DNA, 36 bp, Artificial Sequence
  Synthetic
ggcagggaataccgcccgttacgtccgccagttcgc

SEQ ID NO: 6667 - DNA, 38 bp, Artificial Sequence
  Synthetic
ccgccctgcaagccgatgtcgtgcgtgatttgtccgaa

SEQ ID NO: 6668 - DNA, 42 bp, Artificial Sequence
  Synthetic
gcttcctgccatttgctgtcgggctggagaatgtacaaggcc

SEQ ID NO: 6669 - DNA, 36 bp, Artificial Sequence
  Synthetic
agtttcaccgccaccaacgcgcaaggactggcaccg

SEQ ID NO: 6670 - DNA, 39 bp, Artificial Sequence
  Synthetic
ttcgtcccaagccggacaccaaaaaccatgtgtcgtggc

SEQ ID NO: 6671 - DNA, 38 bp, Artificial Sequence
  Synthetic
ccgcgtttcgggcaactcggaatggtttgccgaacgcg

SEQ ID NO: 6672 - DNA, 36 bp, Artificial Sequence
  Synthetic
ggtacgcgccgtggatgacgacatcgggctgttgtc

SEQ ID NO: 6673 - DNA, 37 bp, Artificial Sequence
  Synthetic
ccgctttgccgtggaacagttcgtcagcctgtgtccg

SEQ ID NO: 6674 - DNA, 38 bp, Artificial Sequence
  Synthetic
tgcaggtggaggtagcgcgcaaaccgaagatgccgtct

SEQ ID NO: 6675 - DNA, 36 bp, Artificial Sequence
  Synthetic
tagagcagttcggcgtgtgctttctcgcgctcgccc

SEQ ID NO: 6676 - DNA, 42 bp, Artificial Sequence
  Synthetic
gccgccctaccgacttgataatgcgaagtgttttatgcgtgg

SEQ ID NO: 6677 - DNA, 37 bp, Artificial Sequence
  Synthetic
cgcgtgtcgcccaaaatgacttgcctccgccgaactc

SEQ ID NO: 6678 - DNA, 40 bp, Artificial Sequence
  Synthetic
ccaaaaacgcctcgaatcgtggatatgcggcgaaacgtgc

SEQ ID NO: 6679 - DNA, 39 bp, Artificial Sequence
  Synthetic
ttatgccgtctgtcgaacggcggcagtcatcgtcgcttc

SEQ ID NO: 6680 - DNA, 37 bp, Artificial Sequence
  Synthetic
ggcggagagtgcaccgtgttcaacgtcaacgatgccg

SEQ ID NO: 6681 - DNA, 40 bp, Artificial Sequence
  Synthetic
ttcgggccgatgaaggtaaagctgccgaaaacgccgattt

SEQ ID NO: 6682 - DNA, 40 bp, Artificial Sequence
  Synthetic
gattcgtcggcgagtttgacgtcaccgttgccgtgcattc

SEQ ID NO: 6683 - DNA, 37 bp, Artificial Sequence
  Synthetic
cgccggtggctttggagacgtgttggaagtgaacccg

SEQ ID NO: 6684 - DNA, 39 bp, Artificial Sequence
  Synthetic
acgtcttccaatgtcagcggcgtgtccaccgacttcgac

SEQ ID NO: 6685 - DNA, 39 bp, Artificial Sequence
  Synthetic
cgggtgtcgatgtcggcgaaagcctgcacgactatttgg

SEQ ID NO: 6686 - DNA, 36 bp, Artificial Sequence
  Synthetic
cgatgtgcgcgacagggaacagcgttcagacggcat

SEQ ID NO: 6687 - DNA, 35 bp, Artificial Sequence
  Synthetic
ggcgttgcccagttgcaggtgtccggactcgccac

SEQ ID NO: 6688 - DNA, 37 bp, Artificial Sequence
  Synthetic
cctgcgaaatgctggtcggattccgctgttgccggta

SEQ ID NO: 6689 - DNA, 40 bp, Artificial Sequence
  Synthetic
cgctcccttgcctacgatgcagagtttgtgcagcatacgg

SEQ ID NO: 6690 - DNA, 36 bp, Artificial Sequence
  Synthetic
gaccccagcttcaaagccgccctacccagccggcaa

SEQ ID NO: 6691 - DNA, 38 bp, Artificial Sequence
  Synthetic
gttccgaccagtggggcaactttttggttcaggcggcg

SEQ ID NO: 6692 - DNA, 37 bp, Artificial Sequence
  Synthetic
atcagccccctgcgtaccaaaacccaggcggcatcga

SEQ ID NO: 6693 - DNA, 40 bp, Artificial Sequence
  Synthetic
tcagtggtttgtcggcatggacttgatggctttgtcgcgc

SEQ ID NO: 6694 - DNA, 37 bp, Artificial Sequence
  Synthetic
ccgccgccatcgagcctttcttccgcctgcaaggacg

SEQ ID NO: 6695 - DNA, 38 bp, Artificial Sequence
  Synthetic
catggcagggcaggccgaaggaaaaatacggcggtccc

SEQ ID NO: 6696 - DNA, 39 bp, Artificial Sequence
  Synthetic
tcttcgaggctgacgaaggcgaattcgttaccgccgtgc

SEQ ID NO: 6697 - DNA, 38 bp, Artificial Sequence
  Synthetic
tcgatgctgtcgaacgcgccaacacatgaaccgccgca

SEQ ID NO: 6698 - DNA, 39 bp, Artificial Sequence
  Synthetic
gattcgtccgcctgatacacggggcggcgtgttgattgc

SEQ ID NO: 6699 - DNA, 35 bp, Artificial Sequence
  Synthetic
tgcggcgaggcgtgcattccgttgcgcatcgtagc

SEQ ID NO: 6700 - DNA, 37 bp, Artificial Sequence
  Synthetic
cgtccaaacgcgccatttcgcttcgcgcccgaccaac

SEQ ID NO: 6701 - DNA, 35 bp, Artificial Sequence
  Synthetic
tcgtgccacggcagcatgcgcaaaaccggccatcc

SEQ ID NO: 6702 - DNA, 38 bp, Artificial Sequence
  Synthetic
cgccacggcgtgttgtcgactatcaaggcggctgctcc

SEQ ID NO: 6703 - DNA, 40 bp, Artificial Sequence
  Synthetic
tgtttggtccgtcgggttcgggaacacgcccccttcagac

SEQ ID NO: 6704 - DNA, 37 bp, Artificial Sequence
  Synthetic
aacaaccagaatgaggcggcattgccgtaccgtccgg

SEQ ID NO: 6705 - DNA, 38 bp, Artificial Sequence
  Synthetic
gcggcaacatgcacgatacgacctcctgctgccggaaa

SEQ ID NO: 6706 - DNA, 37 bp, Artificial Sequence
  Synthetic
ccgtcagcggcaacagcacttttcgtccgcgcaactc

SEQ ID NO: 6707 - DNA, 38 bp, Artificial Sequence
  Synthetic
gccgccgtctgcatcagcatgctgtcgtggtatttccc

SEQ ID NO: 6708 - DNA, 39 bp, Artificial Sequence
  Synthetic
cggcacgcaaaacctgtacgcggcagcagcttttggatt

SEQ ID NO: 6709 - DNA, 40 bp, Artificial Sequence
  Synthetic
cgttgtgcattgaagggcgaaccgaactcaaaatgcccgc

SEQ ID NO: 6710 - DNA, 35 bp, Artificial Sequence
  Synthetic
cggcgacgggggaatttgcaaggcaaaggcgtgcg

SEQ ID NO: 6711 - DNA, 39 bp, Artificial Sequence
  Synthetic
cgccgtaacccatttccgcttcgcgcatggctcaacctc

SEQ ID NO: 6712 - DNA, 40 bp, Artificial Sequence
  Synthetic
caacacgctgttgggtatgggaccggtaaagcctgctacg

SEQ ID NO: 6713 - DNA, 35 bp, Artificial Sequence
  Synthetic
tttgccgtatccgggcggtaacgcttcgggcctgc

SEQ ID NO: 6714 - DNA, 36 bp, Artificial Sequence
  Synthetic
ggtggaacggaagctgctggatcacgccgcacatcg

SEQ ID NO: 6715 - DNA, 41 bp, Artificial Sequence
  Synthetic
ccgctgtcggcttcaaaatggtgatgctcgaccacagcctg

SEQ ID NO: 6716 - DNA, 36 bp, Artificial Sequence
  Synthetic
gtttgcgcgtcagctcgacaccgtacccgcgttacc

SEQ ID NO: 6717 - DNA, 39 bp, Artificial Sequence
  Synthetic
ttttccggcaggagcttgtcgcccaacgcatcgaagacg

SEQ ID NO: 6718 - DNA, 40 bp, Artificial Sequence
  Synthetic
gcgtgccgcagattttcatcgaaggcggtagaggtcggta

SEQ ID NO: 6719 - DNA, 42 bp, Artificial Sequence
  Synthetic
aagcctgcgccttttgcattcgcgtgccgtctgaaagttgat

SEQ ID NO: 6720 - DNA, 37 bp, Artificial Sequence
  Synthetic
aagtcggcgtagatgtgcccaaagcccatgcgctcgg

SEQ ID NO: 6721 - DNA, 42 bp, Artificial Sequence
  Synthetic
aaccctgaaatcgtcgaagcgcacccaaataaccttccctgc

SEQ ID NO: 6722 - DNA, 36 bp, Artificial Sequence
  Synthetic
gaaccggcgggcaggatgtaaaccgtcctgcgcgac

SEQ ID NO: 6723 - DNA, 39 bp, Artificial Sequence
  Synthetic
ccggcgatggtctgcctgaggcgacaacttcaaagccta

SEQ ID NO: 6724 - DNA, 39 bp, Artificial Sequence
  Synthetic
aaaggtcgatgacgcgcacgggcatcgccatgaaagacg

SEQ ID NO: 6725 - DNA, 38 bp, Artificial Sequence
  Synthetic
aatcggcaactgcggttcccccagatgtcgaagtcgcc

SEQ ID NO: 6726 - DNA, 39 bp, Artificial Sequence
  Synthetic
gctttcagacgacgtcaggttcccttttccaacgtatcc

SEQ ID NO: 6727 - DNA, 36 bp, Artificial Sequence
  Synthetic
gcaaggtcggcggcgctttattaccaatgcgccgcc

SEQ ID NO: 6728 - DNA, 39 bp, Artificial Sequence
  Synthetic
catgttgcgcgggatttctggtccattgctgctgccaaa

SEQ ID NO: 6729 - DNA, 35 bp, Artificial Sequence
  Synthetic
gggcatgaccgccgccatatcgaagccgccgacct

SEQ ID NO: 6730 - DNA, 40 bp, Artificial Sequence
  Synthetic
aacgtggtcgatgtggttgcagcccatctccgacacgacc

SEQ ID NO: 6731 - DNA, 36 bp, Artificial Sequence
  Synthetic
atgccgaacgtcccccagctcttcctgctcgccagc

SEQ ID NO: 6732 - DNA, 39 bp, Artificial Sequence
  Synthetic
aggcagtggagtcgaggatgtgccccgttaccgacaagt

SEQ ID NO: 6733 - DNA, 38 bp, Artificial Sequence
  Synthetic
gggttgccgccgaccaaaactgctgtctttaggcatcg

SEQ ID NO: 6734 - DNA, 39 bp, Artificial Sequence
  Synthetic
ttgatgccgacgacctgtccatcaatccgggcaattccg

SEQ ID NO: 6735 - DNA, 40 bp, Artificial Sequence
  Synthetic
gcttcgccgtcgccttgtttaaatcgccgttctgctttcg

SEQ ID NO: 6736 - DNA, 38 bp, Artificial Sequence
  Synthetic
ttcgcgcccaaccgttatttggtcgcgacggcaagcag

SEQ ID NO: 6737 - DNA, 37 bp, Artificial Sequence
  Synthetic
aaaaccctgcaccgcagtgatccggcaatctgcacgg

SEQ ID NO: 6738 - DNA, 35 bp, Artificial Sequence
  Synthetic
gtagcgcgctgatgcaggagccttgaccaccgcct

SEQ ID NO: 6739 - DNA, 38 bp, Artificial Sequence
  Synthetic
cgcaaggcaggccgtggttcggtaaaacgccgtgttcg

SEQ ID NO: 6740 - DNA, 39 bp, Artificial Sequence
  Synthetic
gggttcggacggcatctgtctgttttcgacattcgccgg

SEQ ID NO: 6741 - DNA, 38 bp, Artificial Sequence
  Synthetic
agccataagctgcccgtttcggctttgccgaccaccgc

SEQ ID NO: 6742 - DNA, 39 bp, Artificial Sequence
  Synthetic
gggtatggacggcagcaaggtgcggatttccttcagcct

SEQ ID NO: 6743 - DNA, 36 bp, Artificial Sequence
  Synthetic
tgctcctgctcgcccacgatagagcgtttgggcggc

SEQ ID NO: 6744 - DNA, 35 bp, Artificial Sequence
  Synthetic
agacggatgcgagggcgtacgacctgctccttgcc

SEQ ID NO: 6745 - DNA, 39 bp, Artificial Sequence
  Synthetic
gggtaccttccacgacgcgtaaatccccgaattcgcacc

SEQ ID NO: 6746 - DNA, 35 bp, Artificial Sequence
  Synthetic
ctgcgggcagttcgttggtttcgtccgcagcctcg

SEQ ID NO: 6747 - DNA, 39 bp, Artificial Sequence
  Synthetic
tttgggcgtgtcgtgtgttccacggcggacaatacagca

SEQ ID NO: 6748 - DNA, 38 bp, Artificial Sequence
  Synthetic
gcaaggtggcggctgtcgacaacggacaaaccactgcc

SEQ ID NO: 6749 - DNA, 36 bp, Artificial Sequence
  Synthetic
gccgctgcaagggcttttttgattgcaccgccgcag

SEQ ID NO: 6750 - DNA, 40 bp, Artificial Sequence
  Synthetic
tccgttgcggatgtggtggggcacgcaccaaaaaacctca

SEQ ID NO: 6751 - DNA, 41 bp, Artificial Sequence
  Synthetic
atgaggaagttgcagtgtcgggcctcacgacagaaaccgac

SEQ ID NO: 6752 - DNA, 37 bp, Artificial Sequence
  Synthetic
tgtgcaggctgtgtccgaagcgcatcccggcatcagc

SEQ ID NO: 6753 - DNA, 40 bp, Artificial Sequence
  Synthetic
ggtgcgttgttctgttcgccactcttggcacgcatcaatg

SEQ ID NO: 6754 - DNA, 38 bp, Artificial Sequence
  Synthetic
ggaggcggtcagtatgccgaagaggcttcagacggcat

SEQ ID NO: 6755 - DNA, 42 bp, Artificial Sequence
  Synthetic
tttccgcaggttcggctgtactatacttccgccgaaaccctt

SEQ ID NO: 6756 - DNA, 38 bp, Artificial Sequence
  Synthetic
aggctgtgttcgagttcggggttcaaagccgtcctgcc

SEQ ID NO: 6757 - DNA, 39 bp, Artificial Sequence
  Synthetic
gggaagcggccgatgtgttttgaacaccttcttccggca

SEQ ID NO: 6758 - DNA, 40 bp, Artificial Sequence
  Synthetic
gcttttcgcgtgatgccccgatggtcatgaaacgcaaagc

SEQ ID NO: 6759 - DNA, 38 bp, Artificial Sequence
  Synthetic
ggtgcaggcggggtggaaattgcgcctttttttgggca

SEQ ID NO: 6760 - DNA, 42 bp, Artificial Sequence
  Synthetic
ttgatggctttaggttttgtcgttaaaacgccattcgaaacg

SEQ ID NO: 6761 - DNA, 38 bp, Artificial Sequence
  Synthetic
caggttgcggctgccttcttctacatcctgcaagcccg

SEQ ID NO: 6762 - DNA, 39 bp, Artificial Sequence
  Synthetic
caggtgtcgccgctgacgaactcgttcccaaactcggat

SEQ ID NO: 6763 - DNA, 38 bp, Artificial Sequence
  Synthetic
agcgtgtgttttcggggttgacggttcgcaagccatcg

SEQ ID NO: 6764 - DNA, 39 bp, Artificial Sequence
  Synthetic
ccgacggtcagcgggatgacaccatcctgcacatcatcg

SEQ ID NO: 6765 - DNA, 36 bp, Artificial Sequence
  Synthetic
acgccatgtttttcggcggctcccgtcatcgcctcc

SEQ ID NO: 6766 - DNA, 37 bp, Artificial Sequence
  Synthetic
tggcactgcgttggacggggtcttccccgacctgaac

SEQ ID NO: 6767 - DNA, 34 bp, Artificial Sequence
  Synthetic
agcgcgtcggcatcggtatcccttgacgcggcag

SEQ ID NO: 6768 - DNA, 39 bp, Artificial Sequence
  Synthetic
aaccagtcgtcgcttttgcctttccaagccgttgacgca

SEQ ID NO: 6769 - DNA, 39 bp, Artificial Sequence
  Synthetic
ctcttgcgccgtcctgcctaccgtttaccgcaatatcgc

SEQ ID NO: 6770 - DNA, 36 bp, Artificial Sequence
  Synthetic
agcagggtggcggtcaacggcattaccgccgcattc

SEQ ID NO: 6771 - DNA, 37 bp, Artificial Sequence
  Synthetic
cgcctttgccgcgtgtttcagccaacctcctagagcc

SEQ ID NO: 6772 - DNA, 39 bp, Artificial Sequence
  Synthetic
gtttgcgacagtcggccatgatgctcgcctacgtcgaaa

SEQ ID NO: 6773 - DNA, 42 bp, Artificial Sequence
  Synthetic
ttcgacaatgccggtaatgcgttcatacggcatcgtcgaaac

SEQ ID NO: 6774 - DNA, 37 bp, Artificial Sequence
  Synthetic
gacgtgttcctcgggttgcagacgtcttccgggccga

SEQ ID NO: 6775 - DNA, 38 bp, Artificial Sequence
  Synthetic
agccttcaacggcactgcacgacaatttctcctgccgc

SEQ ID NO: 6776 - DNA, 40 bp, Artificial Sequence
  Synthetic
ccggcaaaatgcaggcaggcaactctggttcggctacacc

SEQ ID NO: 6777 - DNA, 36 bp, Artificial Sequence
  Synthetic
acgatgatgcccatcccgcgccccctccgtcaactt

SEQ ID NO: 6778 - DNA, 36 bp, Artificial Sequence
  Synthetic
ggagagggcggcgggtatcaacgtcctctcccgcct

SEQ ID NO: 6779 - DNA, 42 bp, Artificial Sequence
  Synthetic
tcgaaacagccttggatgtcgcttcccacttcacaacacccg

SEQ ID NO: 6780 - DNA, 38 bp, Artificial Sequence
  Synthetic
ttttggacacgctgccggaaccaagcccaagccctaat

SEQ ID NO: 6781 - DNA, 39 bp, Artificial Sequence
  Synthetic
gaacggattcggtttgcttggctcgggcatcagcaggac

SEQ ID NO: 6782 - DNA, 37 bp, Artificial Sequence
  Synthetic
ggtatgctgggcgcgtcgatcaccgacctcctcaacc

SEQ ID NO: 6783 - DNA, 41 bp, Artificial Sequence
  Synthetic
aagccacttcgataaaggcggccattcgcacaaagcatggg

SEQ ID NO: 6784 - DNA, 38 bp, Artificial Sequence
  Synthetic
tcggcaatctggaaatggtcgttttccaaccgctgccg

SEQ ID NO: 6785 - DNA, 36 bp, Artificial Sequence
  Synthetic
cacttctcccgcccccgaaatcatgcggcgacatgg

SEQ ID NO: 6786 - DNA, 38 bp, Artificial Sequence
  Synthetic
accgcatccgtgccgtattctttccctgatcgtgctgc

SEQ ID NO: 6787 - DNA, 34 bp, Artificial Sequence
  Synthetic
acaggcgcgcgagaaagacaaacgccgcgcacac

SEQ ID NO: 6788 - DNA, 34 bp, Artificial Sequence
  Synthetic
aaacaggtgcgccgacggcagcaacgccctgcct

SEQ ID NO: 6789 - DNA, 35 bp, Artificial Sequence
  Synthetic
tcctgtggcacggctaccctatccacaccggcggc

SEQ ID NO: 6790 - DNA, 35 bp, Artificial Sequence
  Synthetic
cgccgtgcggttgccgatactcctgcatacgcgcg

SEQ ID NO: 6791 - DNA, 34 bp, Artificial Sequence
  Synthetic
cccgaaggcagcgcgtttttcgggcgtggcttgg

SEQ ID NO: 6792 - DNA, 35 bp, Artificial Sequence
  Synthetic
agccgcccgcctcgttttggtgttgcggggtcacg

SEQ ID NO: 6793 - DNA, 42 bp, Artificial Sequence
  Synthetic
aggcgcacaaattcttcctcgggcgttttctttggcggattt

SEQ ID NO: 6794 - DNA, 35 bp, Artificial Sequence
  Synthetic
gcgatgtttgccgccgtcgcgcaccaccttttccg

SEQ ID NO: 6795 - DNA, 41 bp, Artificial Sequence
  Synthetic
ggtggttttcgtcgtggaggcgttgtttcaacacgacgcgg

SEQ ID NO: 6796 - DNA, 35 bp, Artificial Sequence
  Synthetic
ccggtgatgcggacggcttagccgtgggtgcttgc

SEQ ID NO: 6797 - DNA, 40 bp, Artificial Sequence
  Synthetic
tcgctgtcggtttgcgaaccttgccttccgtgatccttac

SEQ ID NO: 6798 - DNA, 38 bp, Artificial Sequence
  Synthetic
cgttttcggcggcggatttcgcaacggaaagccaaacg

SEQ ID NO: 6799 - DNA, 39 bp, Artificial Sequence
  Synthetic
gtctgtcgtcgaggcattccacggcgcataccagctttc

SEQ ID NO: 6800 - DNA, 40 bp, Artificial Sequence
  Synthetic
acgaaaacggccaagtcttgggcgatgccggggtaatcca

SEQ ID NO: 6801 - DNA, 44 bp, Artificial Sequence
  Synthetic
cctgttaacaagaaacggttttgccataacggggcattaaacct

SEQ ID NO: 6802 - DNA, 39 bp, Artificial Sequence
  Synthetic
cgactaccgttgctatgcgttccaacgtaccgatgattg

SEQ ID NO: 6803 - DNA, 35 bp, Artificial Sequence
  Synthetic
aattccgcgcgcgggcatgcaaccaccatcagccc

SEQ ID NO: 6804 - DNA, 35 bp, Artificial Sequence
  Synthetic
gccaaccatccgcttgccggtgtcgccgcacggat

SEQ ID NO: 6805 - DNA, 39 bp, Artificial Sequence
  Synthetic
gcactgtttgccgagcgcggcttgtcgatttcctgacgt

SEQ ID NO: 6806 - DNA, 39 bp, Artificial Sequence
  Synthetic
tgaagggcgatgtcccgcgttcttcgccttcttcctcca

SEQ ID NO: 6807 - DNA, 40 bp, Artificial Sequence
  Synthetic
ggctttggggcgacaaacagacggcggacgacggaaatcc

SEQ ID NO: 6808 - DNA, 37 bp, Artificial Sequence
  Synthetic
gccagcggctttccacaatgctgcaaaacgccttggc

SEQ ID NO: 6809 - DNA, 36 bp, Artificial Sequence
  Synthetic
aacgacgacgcgcaggtgggccggataaagggcgac

SEQ ID NO: 6810 - DNA, 38 bp, Artificial Sequence
  Synthetic
gtttgcccgaacgtgcggtccgcctttctcggtgtctg

SEQ ID NO: 6811 - DNA, 39 bp, Artificial Sequence
  Synthetic
gcagggcagtgtgtatccagtcgcctacctgttcggtct

SEQ ID NO: 6812 - DNA, 41 bp, Artificial Sequence
  Synthetic
aaacagtcatgccgatgccgaacaatacagcctgatgacgc

SEQ ID NO: 6813 - DNA, 41 bp, Artificial Sequence
  Synthetic
acgcatgatatttggctggcggggcaaccactttaaacgcc

SEQ ID NO: 6814 - DNA, 38 bp, Artificial Sequence
  Synthetic
cgccgtacacgaggtcttccggcccgaacacaaaccgc

SEQ ID NO: 6815 - DNA, 43 bp, Artificial Sequence
  Synthetic
aaccgtttacaccggaagatgtcttgggcaatcaattctttca

SEQ ID NO: 6816 - DNA, 39 bp, Artificial Sequence
  Synthetic
atggtgatgatgattgcgcccaatcggagtaagcggaaa

SEQ ID NO: 6817 - DNA, 44 bp, Artificial Sequence
  Synthetic
agaagtaacaggccgtctgaaaacatcgttactccaaaaacgta

SEQ ID NO: 6818 - DNA, 38 bp, Artificial Sequence
  Synthetic
tcatcgtcgaagaaagcggctcaatgcgttgcgtccga

SEQ ID NO: 6819 - DNA, 37 bp, Artificial Sequence
  Synthetic
gtagggcggcgaggttggttcatctactgcaccggcg

SEQ ID NO: 6820 - DNA, 41 bp, Artificial Sequence
  Synthetic
tccgagtccgaagcatcttgtgtgtctgcctccccgataat

SEQ ID NO: 6821 - DNA, 42 bp, Artificial Sequence
  Synthetic
tcgctgctcatcaggctaaggtcgtcttgccataggtacggc

SEQ ID NO: 6822 - DNA, 40 bp, Artificial Sequence
  Synthetic
gttctttacgtttttgtggggcttaccaggcatccaaacg

SEQ ID NO: 6823 - DNA, 39 bp, Artificial Sequence
  Synthetic
aggcgtggatttccgttaccgtttgccgcattgcccgac

SEQ ID NO: 6824 - DNA, 46 bp, Artificial Sequence
  Synthetic
gcatttttcggtatcggtgtaacggcgttttcggtatatatgcaaa

SEQ ID NO: 6825 - DNA, 39 bp, Artificial Sequence
  Synthetic
ggcgtggcgatgattgccgcgaatccccaaaccgcatta

SEQ ID NO: 6826 - DNA, 41 bp, Artificial Sequence
  Synthetic
taagccaagccgttgcaaccggcatagtgcttgcattgagc

SEQ ID NO: 6827 - DNA, 39 bp, Artificial Sequence
  Synthetic
acgtctggctttccattcgggtcaattcccgaagctcgc

SEQ ID NO: 6828 - DNA, 39 bp, Artificial Sequence
  Synthetic
cctaccgtttttctgcttgcgtggcacaaacagttgtcg

SEQ ID NO: 6829 - DNA, 40 bp, Artificial Sequence
  Synthetic
gcgtattgtctgtgcgcggattctcctgcaaggcattcat

SEQ ID NO: 6830 - DNA, 41 bp, Artificial Sequence
  Synthetic
cgaaaacacagcttccgaaccgagggacggtgcttctatgg

SEQ ID NO: 6831 - DNA, 41 bp, Artificial Sequence
  Synthetic
gcggcgaagatgaatgccaactcgaaggcgtaacgaagttg

SEQ ID NO: 6832 - DNA, 41 bp, Artificial Sequence
  Synthetic
tgcactgaagccgagtattccgactgtgcggtttcgtcaaa

SEQ ID NO: 6833 - DNA, 38 bp, Artificial Sequence
  Synthetic
gaccccgaacacgccaaaatctgccgtgatactgccgc

SEQ ID NO: 6834 - DNA, 40 bp, Artificial Sequence
  Synthetic
aagcccaatgggagaaatcgtggatttgggctttcatcaa

SEQ ID NO: 6835 - DNA, 37 bp, Artificial Sequence
  Synthetic
acgcttcgaccgtccaatcccaccggtcggattgcgc

SEQ ID NO: 6836 - DNA, 38 bp, Artificial Sequence
  Synthetic
ggcaacggcgtaaatcagtgccgcgatggacgaagccg

SEQ ID NO: 6837 - DNA, 35 bp, Artificial Sequence
  Synthetic
gacggtttcgcggctgtctcgccgacaaccccctt

SEQ ID NO: 6838 - DNA, 39 bp, Artificial Sequence
  Synthetic
ccagcccgcgatcctgatacacgacagcatatgcgtcgc

SEQ ID NO: 6839 - DNA, 39 bp, Artificial Sequence
  Synthetic
aggagtggtaaccatgccgacaatccaacgcggcctgac

SEQ ID NO: 6840 - DNA, 38 bp, Artificial Sequence
  Synthetic
gacttgttcgggcagccccacgccctgcttgtaccgat

SEQ ID NO: 6841 - DNA, 42 bp, Artificial Sequence
  Synthetic
ggcggttttgattttggagccggcgctgttgattttccttgc

SEQ ID NO: 6842 - DNA, 39 bp, Artificial Sequence
  Synthetic
acggtttatctgcccgccgaccatcaatgcgacaaagcg

SEQ ID NO: 6843 - DNA, 37 bp, Artificial Sequence
  Synthetic
gaacgcaggctgccgagcagctcgaaggcgacctcat

SEQ ID NO: 6844 - DNA, 35 bp, Artificial Sequence
  Synthetic
ggtgttgttcggcggcaaggacgaaaccgccgcac

SEQ ID NO: 6845 - DNA, 38 bp, Artificial Sequence
  Synthetic
cggctgccgtgtcggtaaatcacaggcctaggttacct

SEQ ID NO: 6846 - DNA, 36 bp, Artificial Sequence
  Synthetic
agagcggcatatcgggatgcaaccccgtcgtcagcg

SEQ ID NO: 6847 - DNA, 39 bp, Artificial Sequence
  Synthetic
tcgtcggcgtgtttaagcgctacaacactttcggcctgc

SEQ ID NO: 6848 - DNA, 36 bp, Artificial Sequence
  Synthetic
tttgcccgccgtcgaacgccgcttctgcatcttccg

SEQ ID NO: 6849 - DNA, 40 bp, Artificial Sequence
  Synthetic
gttgtcgtttcccccgaagccggccttcgacgtttttcac

SEQ ID NO: 6850 - DNA, 34 bp, Artificial Sequence
  Synthetic
gcatcggccctgcctacgaagcaaatcggcggcg

SEQ ID NO: 6851 - DNA, 40 bp, Artificial Sequence
  Synthetic
cgcgcgtcatatggtcgagcgcatcgagaaacagctccct

SEQ ID NO: 6852 - DNA, 36 bp, Artificial Sequence
  Synthetic
atctggtgatgggccgcccacttcgcgcaatacggc

SEQ ID NO: 6853 - DNA, 40 bp, Artificial Sequence
  Synthetic
gcgcgaactcgaaaaaccgcggcgcaatacttggtcaaac

SEQ ID NO: 6854 - DNA, 39 bp, Artificial Sequence
  Synthetic
tggtggaaggcttcgaacatcgcaccgttgccgaaaccg

SEQ ID NO: 6855 - DNA, 37 bp, Artificial Sequence
  Synthetic
ggccgggtttcgaccgtgtgcgttgccgaaaacaccc

SEQ ID NO: 6856 - DNA, 39 bp, Artificial Sequence
  Synthetic
gcccaattggaaaagggcagcggattgacggcgaaccag

SEQ ID NO: 6857 - DNA, 37 bp, Artificial Sequence
  Synthetic
ccggcatccgcgccttgttcaaacggctgagccttgc

SEQ ID NO: 6858 - DNA, 38 bp, Artificial Sequence
  Synthetic
accgtccgaccatcgtgtttgctggagcgtcccgaacc

SEQ ID NO: 6859 - DNA, 41 bp, Artificial Sequence
  Synthetic
gacgagttccacgtcgttcgccacgcttttttgtgtttgcc

SEQ ID NO: 6860 - DNA, 36 bp, Artificial Sequence
  Synthetic
ggatgttgggcgcgggcattacggacgcggcgaaac

SEQ ID NO: 6861 - DNA, 37 bp, Artificial Sequence
  Synthetic
gcgtgtcgggcaggtaggttcacccaaatcggcttgg

SEQ ID NO: 6862 - DNA, 38 bp, Artificial Sequence
  Synthetic
gtctgtgcccacatcggtctgaccgcgcccctgaactt

SEQ ID NO: 6863 - DNA, 38 bp, Artificial Sequence
  Synthetic
cgggaacggctctggcaaccggcgacttcgggggattt

SEQ ID NO: 6864 - DNA, 35 bp, Artificial Sequence
  Synthetic
gacaaaggcgtgctggcggtctgccgcaaagccgc

SEQ ID NO: 6865 - DNA, 40 bp, Artificial Sequence
  Synthetic
atacgcttagggtgtctgatcgaaaccatacgcccaagac

SEQ ID NO: 6866 - DNA, 37 bp, Artificial Sequence
  Synthetic
aagggttcgtccaaaagcaggaaacgccagcgcatcg

SEQ ID NO: 6867 - DNA, 42 bp, Artificial Sequence
  Synthetic
aacgttgtgaaacggtttgcgcgaaggaattgtcgggcgaat

SEQ ID NO: 6868 - DNA, 38 bp, Artificial Sequence
  Synthetic
ggagttgccgcgttggaagttggctggtgaaacccctg

SEQ ID NO: 6869 - DNA, 44 bp, Artificial Sequence
  Synthetic
ttctgcggatgtttttctccgtaattaatccgcttatccttgat

SEQ ID NO: 6870 - DNA, 36 bp, Artificial Sequence
  Synthetic
ggacagccggttccggtcacaggaacgcgccgtcaa

SEQ ID NO: 6871 - DNA, 40 bp, Artificial Sequence
  Synthetic
tcatcttgttgctgatggcggaaccaagaaagcagcgacg

SEQ ID NO: 6872 - DNA, 39 bp, Artificial Sequence
  Synthetic
cggcaaccggcttcttcttccttgagcgccgagatttgg

SEQ ID NO: 6873 - DNA, 36 bp, Artificial Sequence
  Synthetic
ctgacggcgcggcattccttggcggagaacatcggc

SEQ ID NO: 6874 - DNA, 38 bp, Artificial Sequence
  Synthetic
tgcgagatgctgggaacggaaaccggtttccttgtccc

SEQ ID NO: 6875 - DNA, 41 bp, Artificial Sequence
  Synthetic
gcgtgaaaccaagacattcggcagccttttgtccaaaccgc

SEQ ID NO: 6876 - DNA, 38 bp, Artificial Sequence
  Synthetic
accgttattggcggatttggcgccttatacgccgccgc

SEQ ID NO: 6877 - DNA, 42 bp, Artificial Sequence
  Synthetic
ttggacaacgccctgaaggttgcctgtcgttgtgataggcaa

SEQ ID NO: 6878 - DNA, 38 bp, Artificial Sequence
  Synthetic
ggctgaaatcaggcggcgcgccaagcccaaatccgtct

SEQ ID NO: 6879 - DNA, 38 bp, Artificial Sequence
  Synthetic
tcgccgtcgccgtcagctagcagggaaacgtctctgcc

SEQ ID NO: 6880 - DNA, 39 bp, Artificial Sequence
  Synthetic
agggcaattcgacgatgttgatacaggcttgcagaactt

SEQ ID NO: 6881 - DNA, 38 bp, Artificial Sequence
  Synthetic
gaagcgaggtcaggcggcatccgggattcgaccgtgtt

SEQ ID NO: 6882 - DNA, 41 bp, Artificial Sequence
  Synthetic
agccgataatcaggcgtgttgccaggcattacgcgcaacaa

SEQ ID NO: 6883 - DNA, 35 bp, Artificial Sequence
  Synthetic
ggcgatggcggacggtatgcttgccggcaaccagc

SEQ ID NO: 6884 - DNA, 39 bp, Artificial Sequence
  Synthetic
gcacatttttcggggcgcatacgcctgtcttgactttcg

SEQ ID NO: 6885 - DNA, 36 bp, Artificial Sequence
  Synthetic
gtgattccggctgttcgcggtcagaaccggccgcac

SEQ ID NO: 6886 - DNA, 35 bp, Artificial Sequence
  Synthetic
tgccgaagcagaagccgaaaagcgataccggggcg

SEQ ID NO: 6887 - DNA, 37 bp, Artificial Sequence
  Synthetic
gcctcctggccgccgattaacacgatgcggtctttgc

SEQ ID NO: 6888 - DNA, 37 bp, Artificial Sequence
  Synthetic
taaggcttcgctgcgccagatatcgcggcggtttcag

SEQ ID NO: 6889 - DNA, 37 bp, Artificial Sequence
  Synthetic
agcaggaagccgcacaagccaatcaccgcgccgaaac

SEQ ID NO: 6890 - DNA, 34 bp, Artificial Sequence
  Synthetic
cggcgcgcgggtcaaaatttcaccgcaccgacgg

SEQ ID NO: 6891 - DNA, 40 bp, Artificial Sequence
  Synthetic
gctgcatgaggacgctctatgacgcccgtttaccgtgaat

SEQ ID NO: 6892 - DNA, 36 bp, Artificial Sequence
  Synthetic
gcaggacggtcaaggcacacgggtagggcaggcgaa

SEQ ID NO: 6893 - DNA, 38 bp, Artificial Sequence
  Synthetic
tgctgacattgtgctacgtcgacgcccttcagttcggc

SEQ ID NO: 6894 - DNA, 39 bp, Artificial Sequence
  Synthetic
aagcatcaacggcttggaggcccgccactttgccgtttg

SEQ ID NO: 6895 - DNA, 38 bp, Artificial Sequence
  Synthetic
tggtggacacgcagaaaaaccgccgccttgccgttgac

SEQ ID NO: 6896 - DNA, 37 bp, Artificial Sequence
  Synthetic
cgccgccctgccttgtgaagcttacaaccgcgcaacc

SEQ ID NO: 6897 - DNA, 40 bp, Artificial Sequence
  Synthetic
acatcgggcatttcttcccagctgtccgaccttttggcgg

SEQ ID NO: 6898 - DNA, 39 bp, Artificial Sequence
  Synthetic
atacggctgcatcgcggtctgccgacaacgaagaaaacg

SEQ ID NO: 6899 - DNA, 35 bp, Artificial Sequence
  Synthetic
cggaacgcctcaaagccgccggcggacgatttgcg

SEQ ID NO: 6900 - DNA, 38 bp, Artificial Sequence
  Synthetic
gtcaaatcgtggtttgacgggcacaacgacggccagcc

SEQ ID NO: 6901 - DNA, 36 bp, Artificial Sequence
  Synthetic
aaaagccgggcgcaaatcagtcgggtctttggccgc

SEQ ID NO: 6902 - DNA, 39 bp, Artificial Sequence
  Synthetic
ccaaatgggcgaattggggcgcgcgtttgccctcgttct

SEQ ID NO: 6903 - DNA, 34 bp, Artificial Sequence
  Synthetic
gcggcggcggttctcaaaatgtcccagccgcctg

SEQ ID NO: 6904 - DNA, 34 bp, Artificial Sequence
  Synthetic
gcgcggcacttcgaccaatccccctgcccggttt

SEQ ID NO: 6905 - DNA, 35 bp, Artificial Sequence
  Synthetic
atgcgcgcggatgtttggcgcctggcgggttttgc

SEQ ID NO: 6906 - DNA, 36 bp, Artificial Sequence
  Synthetic
attgtccgaccatacgcccgtgctcagcacggggac

SEQ ID NO: 6907 - DNA, 44 bp, Artificial Sequence
  Synthetic
gagttcctgttgtcgctatttgcattttcaaatggtagggaagg

SEQ ID NO: 6908 - DNA, 44 bp, Artificial Sequence
  Synthetic
gcgaagagcggaaaatcaaacaccttgatttctttggaaatctc

SEQ ID NO: 6909 - DNA, 40 bp, Artificial Sequence
  Synthetic
tcccgggtagcagccttttttgcgcccaaatgctcaacca

SEQ ID NO: 6910 - DNA, 40 bp, Artificial Sequence
  Synthetic
aaatgccccgatggtgcaggtttacctccgaatgcgtctc

SEQ ID NO: 6911 - DNA, 40 bp, Artificial Sequence
  Synthetic
ctgttcggcagccgtttcacccgggcggcttgattttcct

SEQ ID NO: 6912 - DNA, 37 bp, Artificial Sequence
  Synthetic
gcgcgatgtccatccgcagccgaatttctgcccttcg

SEQ ID NO: 6913 - DNA, 35 bp, Artificial Sequence
  Synthetic
cccgccccgatcccttctatgctcgggcggtatcc

SEQ ID NO: 6914 - DNA, 35 bp, Artificial Sequence
  Synthetic
atttggccgatgcgctgcaaactgttccccgccgc

SEQ ID NO: 6915 - DNA, 40 bp, Artificial Sequence
  Synthetic
gttggcgatgacttcgttggtgtccgacgtgtatcagggc

SEQ ID NO: 6916 - DNA, 40 bp, Artificial Sequence
  Synthetic
cgcattaatgccgtttatgccagagaccgacaaaaatgcc

SEQ ID NO: 6917 - DNA, 41 bp, Artificial Sequence
  Synthetic
tggttttgccgatgtctgccggatcggtgaagtctgccttg

SEQ ID NO: 6918 - DNA, 35 bp, Artificial Sequence
  Synthetic
gcagtaccgcccagcaggacgacttggcttgggcg

SEQ ID NO: 6919 - DNA, 39 bp, Artificial Sequence
  Synthetic
ggtggtgcagcctgccgaacgcagcagttctttaccgta

SEQ ID NO: 6920 - DNA, 36 bp, Artificial Sequence
  Synthetic
tgtggacgacgtaaccgcgcatgcagcacgacagcg

SEQ ID NO: 6921 - DNA, 40 bp, Artificial Sequence
  Synthetic
tccgccaccaaaaacctgatgacgtaaatggcggacacgg

SEQ ID NO: 6922 - DNA, 38 bp, Artificial Sequence
  Synthetic
atttggacttcaaacgcggcagttcggcggggtacacg

SEQ ID NO: 6923 - DNA, 38 bp, Artificial Sequence
  Synthetic
tcaaaccataggccgcgccttgtcggcgtacaggatgg

SEQ ID NO: 6924 - DNA, 35 bp, Artificial Sequence
  Synthetic
cgaagctgacgttggcggcaccgtggcgatggtcg

SEQ ID NO: 6925 - DNA, 38 bp, Artificial Sequence
  Synthetic
ttgcccatgccgaccataatcggattgcctgcccgtgc

SEQ ID NO: 6926 - DNA, 40 bp, Artificial Sequence
  Synthetic
tcttcgggattggattcgccggtatcgaaagcggcagcgg

SEQ ID NO: 6927 - DNA, 38 bp, Artificial Sequence
  Synthetic
aatcgttgctgccggcatcgttcagaggaccgttcggc

SEQ ID NO: 6928 - DNA, 38 bp, Artificial Sequence
  Synthetic
agccgcagtggattaagaagggtgtcgagctgggtcgg

SEQ ID NO: 6929 - DNA, 36 bp, Artificial Sequence
  Synthetic
tgctccccgaacgcgctttggacggtatggacgggc

SEQ ID NO: 6930 - DNA, 38 bp, Artificial Sequence
  Synthetic
acataaagccggcggcaaacaactccgtcggcgaatgg

SEQ ID NO: 6931 - DNA, 39 bp, Artificial Sequence
  Synthetic
gagcaggcggtatggtcggcgatttccccaacagccacg

SEQ ID NO: 6932 - DNA, 41 bp, Artificial Sequence
  Synthetic
tccagcatcacatactcgaaagtcatgccaacgctatctgg

SEQ ID NO: 6933 - DNA, 39 bp, Artificial Sequence
  Synthetic
acgaagttttggtcgattgcccaagaaatgaacccgggt

SEQ ID NO: 6934 - DNA, 38 bp, Artificial Sequence
  Synthetic
gcaagggcgggttcggtaagcaagaaaccgtccgtacg

SEQ ID NO: 6935 - DNA, 38 bp, Artificial Sequence
  Synthetic
ggttttggcggcaggcgtataactacctcaacgccgca

SEQ ID NO: 6936 - DNA, 40 bp, Artificial Sequence
  Synthetic
tttggcggctttggatatcggaacaccgttcggatgttcg

SEQ ID NO: 6937 - DNA, 36 bp, Artificial Sequence
  Synthetic
aatcctgcatggcgagggtgacgcctcgacgccatc

SEQ ID NO: 6938 - DNA, 35 bp, Artificial Sequence
  Synthetic
ggcgagtacggcgacctgtaccgaagtcgccctgc

SEQ ID NO: 6939 - DNA, 40 bp, Artificial Sequence
  Synthetic
cgctttcatgcgcctgaccggctttatgtgcctgtttcgc

SEQ ID NO: 6940 - DNA, 37 bp, Artificial Sequence
  Synthetic
tccgccgcgccgcttttacaggatttggtgtcggagc

SEQ ID NO: 6941 - DNA, 35 bp, Artificial Sequence
  Synthetic
ggcccggggcgcatgattttcaacctgcgccaacg

SEQ ID NO: 6942 - DNA, 33 bp, Artificial Sequence
  Synthetic
ttgttcgaccgccgcgtcagcaaccgcctgacc

SEQ ID NO: 6943 - DNA, 37 bp, Artificial Sequence
  Synthetic
ggttcgatggcttcggatgccgccgatgcgcgtttgc

SEQ ID NO: 6944 - DNA, 36 bp, Artificial Sequence
  Synthetic
ggacgagccgttgacgagccgaacacgagccgcttg

SEQ ID NO: 6945 - DNA, 37 bp, Artificial Sequence
  Synthetic
caagcgcgcgcaggacgtaccgtatccagcggatccg

SEQ ID NO: 6946 - DNA, 36 bp, Artificial Sequence
  Synthetic
gcttcgccgaagcagacgggggcataccggcgtgct

SEQ ID NO: 6947 - DNA, 45 bp, Artificial Sequence
  Synthetic
aatttgcaggttatcactatgtgcagccagaatgaacaatctgat

SEQ ID NO: 6948 - DNA, 35 bp, Artificial Sequence
  Synthetic
ggcgaaaaaggcgctggcgtttcgggtggcgcagg

SEQ ID NO: 6949 - DNA, 37 bp, Artificial Sequence
  Synthetic
gacgttgtgcaaggtttccgggatggcgtgtgcggtc

SEQ ID NO: 6950 - DNA, 34 bp, Artificial Sequence
  Synthetic
cagtccgcacgccccaattttgcacggaggctgc

SEQ ID NO: 6951 - DNA, 37 bp, Artificial Sequence
  Synthetic
actttggtggcgacgacttcgtcccgtttcggcgtgc

SEQ ID NO: 6952 - DNA, 35 bp, Artificial Sequence
  Synthetic
gcgcccgaaatccccgtcagaaactcgctgcccgc

SEQ ID NO: 6953 - DNA, 39 bp, Artificial Sequence
  Synthetic
cgccatcgaagcctgcacgcgtgaaatcggtttcgtgtc

SEQ ID NO: 6954 - DNA, 39 bp, Artificial Sequence
  Synthetic
acctgaaagacctgttcggcacaccaggccagcaggatg

SEQ ID NO: 6955 - DNA, 40 bp, Artificial Sequence
  Synthetic
gcattggccgtcataccgctaggtcgagtgctttgacaaa

SEQ ID NO: 6956 - DNA, 39 bp, Artificial Sequence
  Synthetic
aaaaccgtgttggagctcggcttccaaatcggcatcggg

SEQ ID NO: 6957 - DNA, 42 bp, Artificial Sequence
  Synthetic
ccctgcgacggttttagacaggggggccgaatacttcttctc

SEQ ID NO: 6958 - DNA, 40 bp, Artificial Sequence
  Synthetic
cgatacgttcggggtggatgttttgccaacctcaaaccgc

SEQ ID NO: 6959 - DNA, 38 bp, Artificial Sequence
  Synthetic
ttgcgacgtatgcaccagctcacgctgacggacaaagc

SEQ ID NO: 6960 - DNA, 37 bp, Artificial Sequence
  Synthetic
gcgcaggcgatggtggtgtcaacgccgaaatcgtcgc

SEQ ID NO: 6961 - DNA, 44 bp, Artificial Sequence
  Synthetic
ttgctggaatctaaatcggctgcagacccttgttttttattccc

SEQ ID NO: 6962 - DNA, 38 bp, Artificial Sequence
  Synthetic
tgtgaatgtttcgccgcccgatcggctctccatcgacc

SEQ ID NO: 6963 - DNA, 38 bp, Artificial Sequence
  Synthetic
gggcgataatggcgcggaagtcttcacgcgaacatgcc

SEQ ID NO: 6964 - DNA, 40 bp, Artificial Sequence
  Synthetic
gcactttgccgccgatgttttcgaaccgcaagttacttgg

SEQ ID NO: 6965 - DNA, 36 bp, Artificial Sequence
  Synthetic
gcgaatcgccgcagacgatatggggcccgaacaagg

SEQ ID NO: 6966 - DNA, 39 bp, Artificial Sequence
  Synthetic
tattgcaggagttcggcagcttatgccgacagtttgccg

SEQ ID NO: 6967 - DNA, 36 bp, Artificial Sequence
  Synthetic
tccgcaccgcaaatcagggtgtgcggatgcggttga

SEQ ID NO: 6968 - DNA, 40 bp, Artificial Sequence
  Synthetic
acgaagcagtgctgatgctcactgttcgatcagccagacg

SEQ ID NO: 6969 - DNA, 36 bp, Artificial Sequence
  Synthetic
acagcctcgccaccaacgcacagcagcatcgcgatg

SEQ ID NO: 6970 - DNA, 38 bp, Artificial Sequence
  Synthetic
cgttggcgcggattttggcgaacacggcggaaacaggc

SEQ ID NO: 6971 - DNA, 38 bp, Artificial Sequence
  Synthetic
gccgtttcgacaaaggcggccacggatttgtgcagggc

SEQ ID NO: 6972 - DNA, 40 bp, Artificial Sequence
  Synthetic
aaacgccagcgacgaagtgcttccttcatcagcttggtcg

SEQ ID NO: 6973 - DNA, 39 bp, Artificial Sequence
  Synthetic
gcagcgaccaggaatggcgacgaacccttcagcgtgatg

SEQ ID NO: 6974 - DNA, 35 bp, Artificial Sequence
  Synthetic
agcccgttcatttgcgccacggcgtactcgtccgt

SEQ ID NO: 6975 - DNA, 40 bp, Artificial Sequence
  Synthetic
gcctgaacaatcaaaatggcgattgctgaccatcgtgaat

SEQ ID NO: 6976 - DNA, 41 bp, Artificial Sequence
  Synthetic
tatcggcttcactattggcagctgttcgttgctttgggatt

SEQ ID NO: 6977 - DNA, 40 bp, Artificial Sequence
  Synthetic
tgtacggcaaaggagacggctgtaatcgccgaaacggtct

SEQ ID NO: 6978 - DNA, 38 bp, Artificial Sequence
  Synthetic
cggcggcaagcgtctgaatgttggactactatccgcgt

SEQ ID NO: 6979 - DNA, 41 bp, Artificial Sequence
  Synthetic
accgtattcattgcaggtgccgatacagttgggcggtcaac

SEQ ID NO: 6980 - DNA, 38 bp, Artificial Sequence
  Synthetic
aaagccagttggacttcgccccgcaacagcggcattcc

SEQ ID NO: 6981 - DNA, 40 bp, Artificial Sequence
  Synthetic
acttctcggacgttccattcgggcttcgactccgttaccg

SEQ ID NO: 6982 - DNA, 36 bp, Artificial Sequence
  Synthetic
gtcggtcagcagcgccactactgaccccgcctttgg

SEQ ID NO: 6983 - DNA, 40 bp, Artificial Sequence
  Synthetic
acacgatggcgggtgcttcggtggttaaagtgtcagccgt

SEQ ID NO: 6984 - DNA, 38 bp, Artificial Sequence
  Synthetic
acagtaatgcgcttcagacggctttctgccccgccctc

SEQ ID NO: 6985 - DNA, 41 bp, Artificial Sequence
  Synthetic
gcaactgcgcgacgtattgtcttggaggcgatgatgaacag

SEQ ID NO: 6986 - DNA, 39 bp, Artificial Sequence
  Synthetic
cctgcttgccaacgtctttgccttcgtcgggggttttgc

SEQ ID NO: 6987 - DNA, 36 bp, Artificial Sequence
  Synthetic
gcaggattggcggggcatgcaatccgaccgaaaccg

SEQ ID NO: 6988 - DNA, 40 bp, Artificial Sequence
  Synthetic
ttcgccgtgggactttatccggctgtgcatcaaagccgcc

SEQ ID NO: 6989 - DNA, 38 bp, Artificial Sequence
  Synthetic
tttctgcgtcggtcattggggttccgagcacacccacc

SEQ ID NO: 6990 - DNA, 38 bp, Artificial Sequence
  Synthetic
ccccaaagccgaaatcgaaggcctcatcaggcgcgcct

SEQ ID NO: 6991 - DNA, 35 bp, Artificial Sequence
  Synthetic
ttcgcgggaatgacggtcgaagatctgccccccgg

SEQ ID NO: 6992 - DNA, 37 bp, Artificial Sequence
  Synthetic
ggtgcagcctgccttcgtagtcggtcaggaacacgtc

SEQ ID NO: 6993 - DNA, 39 bp, Artificial Sequence
  Synthetic
acgagttggtgtacttgccggaacgtccacccgaccaaa

SEQ ID NO: 6994 - DNA, 39 bp, Artificial Sequence
  Synthetic
tgtcgcggacaaaacgatggtccgactttcgccaaaggc

SEQ ID NO: 6995 - DNA, 40 bp, Artificial Sequence
  Synthetic
acgatttgcagttggcggcgagatacggcatatcgcaagg

SEQ ID NO: 6996 - DNA, 38 bp, Artificial Sequence
  Synthetic
cggctgcgtttggcgactacaactgttgcagctcgata

SEQ ID NO: 6997 - DNA, 37 bp, Artificial Sequence
  Synthetic
ttttccccgagcgcggcattcgaagccgccaatcagg

SEQ ID NO: 6998 - DNA, 39 bp, Artificial Sequence
  Synthetic
tcttcggcgatttcaaagccgttcccgtccgcatccttc

SEQ ID NO: 6999 - DNA, 40 bp, Artificial Sequence
  Synthetic
gggcattgtttgaccggtttcctttcgacccgagcattcg

SEQ ID NO: 7000 - DNA, 40 bp, Artificial Sequence
  Synthetic
gcttaagcccgcaacaaaaagacttggtcagtttgccttt

SEQ ID NO: 7001 - DNA, 39 bp, Artificial Sequence
  Synthetic
gaagtcggcggcgaattgctggatcatgcctttacccgg

SEQ ID NO: 7002 - DNA, 38 bp, Artificial Sequence
  Synthetic
ccaaatgcggatggtgcggagacggaagagcaggttgc

SEQ ID NO: 7003 - DNA, 45 bp, Artificial Sequence
  Synthetic
agtgactgggttatcttcggcttgtagtatcagaggataaagtgt

SEQ ID NO: 7004 - DNA, 39 bp, Artificial Sequence
  Synthetic
gttgagaagcgttgacggctatgcggatatgacctcagt

SEQ ID NO: 7005 - DNA, 42 bp, Artificial Sequence
  Synthetic
tgaaagaatgtccaggcgatttcgaatttcctgatgcaaagt

SEQ ID NO: 7006 - DNA, 44 bp, Artificial Sequence
  Synthetic
cccgatgttcgtgattacggaggtatttttgtgcgatagacatc

SEQ ID NO: 7007 - DNA, 46 bp, Artificial Sequence
  Synthetic
aatatttcacgggcaataacttcccaagcagatgaagtagtgattg

SEQ ID NO: 7008 - DNA, 43 bp, Artificial Sequence
  Synthetic
cgattgaggcttcatcgtttttagggcaatctcggtgctgaat

SEQ ID NO: 7009 - DNA, 43 bp, Artificial Sequence
  Synthetic
tggaattctaggcagaatctcttgccttgacccagagcagttg

SEQ ID NO: 7010 - DNA, 44 bp, Artificial Sequence
  Synthetic
tggcacaaattccatatccgaacatcaaaaagaggtatcggaaa

SEQ ID NO: 7011 - DNA, 35 bp, Artificial Sequence
  Synthetic
ctgcgcgacatccacaccccaggttggccgccaag

SEQ ID NO: 7012 - DNA, 34 bp, Artificial Sequence
  Synthetic
acatcgccaaaggacgcggattggcgcgcgtctg

SEQ ID NO: 7013 - DNA, 39 bp, Artificial Sequence
  Synthetic
ccgctttggatttggttgccgtcgaacccggaccgatac

SEQ ID NO: 7014 - DNA, 35 bp, Artificial Sequence
  Synthetic
gcatccgcttctccggcgaaccgccgagcatgacg

SEQ ID NO: 7015 - DNA, 39 bp, Artificial Sequence
  Synthetic
gttctgccgaccgctacttccttcgatgccttcggggac

SEQ ID NO: 7016 - DNA, 36 bp, Artificial Sequence
  Synthetic
gttcggtcaccgtcgggcaacacttcggcggtcagc

SEQ ID NO: 7017 - DNA, 33 bp, Artificial Sequence
  Synthetic
gttggatgcgcccgtcgatcaggcgcgcgcaat

SEQ ID NO: 7018 - DNA, 39 bp, Artificial Sequence
  Synthetic
cgtggcaaacatccaacccgaccgccgattcgatcatgg

SEQ ID NO: 7019 - DNA, 38 bp, Artificial Sequence
  Synthetic
gtctgtccctgcccggcaaacaattctttgcggcctgc

SEQ ID NO: 7020 - DNA, 38 bp, Artificial Sequence
  Synthetic
agcatcctcaaattcaccggcctaccttcgacggcggc

SEQ ID NO: 7021 - DNA, 34 bp, Artificial Sequence
  Synthetic
gccgacacgttggcgcaattcgcccaccacccga

SEQ ID NO: 7022 - DNA, 35 bp, Artificial Sequence
  Synthetic
tccaagacccaggcgagcatactcggcgtggcagg

SEQ ID NO: 7023 - DNA, 42 bp, Artificial Sequence
  Synthetic
atcgccaactcctgcgtcttcccgggtgtacagttcggtcag

SEQ ID NO: 7024 - DNA, 36 bp, Artificial Sequence
  Synthetic
cccctgcccaaaacgaccggtcggcaccgtcttacg

SEQ ID NO: 7025 - DNA, 42 bp, Artificial Sequence
  Synthetic
gatcgccgaaatcgattccccaggacagatgacggaagagga

SEQ ID NO: 7026 - DNA, 40 bp, Artificial Sequence
  Synthetic
cgcgtgccgccatatcttcgaccatcacccaaatgctcaa

SEQ ID NO: 7027 - DNA, 40 bp, Artificial Sequence
  Synthetic
gcgggatgattttttccgccaaacgttacccccttgtcgc

SEQ ID NO: 7028 - DNA, 38 bp, Artificial Sequence
  Synthetic
tcgttgagcaggcgcaatacgacgccaggccaccaaag

SEQ ID NO: 7029 - DNA, 42 bp, Artificial Sequence
  Synthetic
aagcccaaaaagtcggactggtggtcgatttcgttcaacagc

SEQ ID NO: 7030 - DNA, 34 bp, Artificial Sequence
  Synthetic
tacttgccaccgcgccctacgtgttcgggcgtgc

SEQ ID NO: 7031 - DNA, 41 bp, Artificial Sequence
  Synthetic
ctcgaggttgcaaaagtcgcctggaaatcggggtgcgaaca

SEQ ID NO: 7032 - DNA, 40 bp, Artificial Sequence
  Synthetic
ttgatgaccgcctgccagtagcacttgcgtccgaactgcc

SEQ ID NO: 7033 - DNA, 39 bp, Artificial Sequence
  Synthetic
gatggatgcccgattcgtgcgtatcccgtgcagcccaat

SEQ ID NO: 7034 - DNA, 39 bp, Artificial Sequence
  Synthetic
ttttcgcaatcgcattgaccgctcgaagcgggttttgcc

SEQ ID NO: 7035 - DNA, 35 bp, Artificial Sequence
  Synthetic
gccatcgttgccgccctgatacggcttcggggtcg

SEQ ID NO: 7036 - DNA, 37 bp, Artificial Sequence
  Synthetic
gcaccggtctcttccgattggccgtcctgccgggtat

SEQ ID NO: 7037 - DNA, 40 bp, Artificial Sequence
  Synthetic
tgctttccaacatcctccccctgaggttgagcagccaacg

SEQ ID NO: 7038 - DNA, 40 bp, Artificial Sequence
  Synthetic
cgcacacgctgccatatcctgacattggaacttcctgcgg

SEQ ID NO: 7039 - DNA, 38 bp, Artificial Sequence
  Synthetic
tgcccttcattgccgttggggagggcggtttcgtcagt

SEQ ID NO: 7040 - DNA, 39 bp, Artificial Sequence
  Synthetic
gcagaaagtcggcgaataccgggttcggcaggcaggttt

SEQ ID NO: 7041 - DNA, 40 bp, Artificial Sequence
  Synthetic
tccgcctgtaccgaaatcaacgccatacccaatacgccgg

SEQ ID NO: 7042 - DNA, 40 bp, Artificial Sequence
  Synthetic
cgaaaccgacgctcgcgtatcgtcttcgggattagccaat

SEQ ID NO: 7043 - DNA, 44 bp, Artificial Sequence
  Synthetic
ttttccagacggcattttttgttttggtcattttgctggaagag

SEQ ID NO: 7044 - DNA, 38 bp, Artificial Sequence
  Synthetic
catccgcacccagttgcgcggtttgtttgctgccgagg

SEQ ID NO: 7045 - DNA, 44 bp, Artificial Sequence
  Synthetic
gtcagacatcgggaaatgcttttttcaaaagcagattggacaaa

SEQ ID NO: 7046 - DNA, 38 bp, Artificial Sequence
  Synthetic
tgcaaaccgcgccgtatcagaattgcgcgcttgcttca

SEQ ID NO: 7047 - DNA, 37 bp, Artificial Sequence
  Synthetic
gcgaaccggcgcaagaactatacttcggggttgcggg

SEQ ID NO: 7048 - DNA, 39 bp, Artificial Sequence
  Synthetic
gttgccaagcctaagccgttgcgcaatcggcggattcgg

SEQ ID NO: 7049 - DNA, 40 bp, Artificial Sequence
  Synthetic
tggcggcttcgactgtttcgcctttatgcacgccaccttt

SEQ ID NO: 7050 - DNA, 41 bp, Artificial Sequence
  Synthetic
agcatccccatcatccacaaccggggaagtagaacacggct

SEQ ID NO: 7051 - DNA, 41 bp, Artificial Sequence
  Synthetic
tcgcttcgatcacttcgggacgcggaattgctgaaacagga

SEQ ID NO: 7052 - DNA, 39 bp, Artificial Sequence
  Synthetic
ggattgccggcgccgatgtccgatatgaagcggcggata

SEQ ID NO: 7053 - DNA, 34 bp, Artificial Sequence
  Synthetic
cgcgccgtccaagccttttggcgagggtcatcgc

SEQ ID NO: 7054 - DNA, 37 bp, Artificial Sequence
  Synthetic
ggcttggatttgccggactgtgcacgacctccggcaa

SEQ ID NO: 7055 - DNA, 36 bp, Artificial Sequence
  Synthetic
cgagggtgcgctccatctgccgaaatgggcgtcgtc

SEQ ID NO: 7056 - DNA, 38 bp, Artificial Sequence
  Synthetic
gtagcggtcgaagtcgtgcggacctggacatcctcgcc

SEQ ID NO: 7057 - DNA, 41 bp, Artificial Sequence
  Synthetic
cgggggaagtcggtcaggtagcctgttcaaccccttcgtcc

SEQ ID NO: 7058 - DNA, 38 bp, Artificial Sequence
  Synthetic
tttgaccagcagcgaagacaggtcggcttcggcgcaag

SEQ ID NO: 7059 - DNA, 39 bp, Artificial Sequence
  Synthetic
cacggtccgcgtgatttggtaatcggcaggggaaatgtg

SEQ ID NO: 7060 - DNA, 44 bp, Artificial Sequence
  Synthetic
acaggctggttactttgtttttttgccatcgtgaccaaactgac

SEQ ID NO: 7061 - DNA, 37 bp, Artificial Sequence
  Synthetic
ggtcggtatgcaatgcgtggtcgcgtgggctgtatgc

SEQ ID NO: 7062 - DNA, 37 bp, Artificial Sequence
  Synthetic
ccccgatagccgaaaagcagctaccgaagccctgcgc

SEQ ID NO: 7063 - DNA, 38 bp, Artificial Sequence
  Synthetic
ggacagcccgaacacacccgttttcgggaatcagggcg

SEQ ID NO: 7064 - DNA, 36 bp, Artificial Sequence
  Synthetic
ttgccggaacatggctgctagatgcctgcgccgtag

SEQ ID NO: 7065 - DNA, 38 bp, Artificial Sequence
  Synthetic
tgggcaacgaaggcgacggacaccagcatgtcgcaatg

SEQ ID NO: 7066 - DNA, 41 bp, Artificial Sequence
  Synthetic
ctacaccctctccgtcgtcccggctttgaaatggcggtaca

SEQ ID NO: 7067 - DNA, 36 bp, Artificial Sequence
  Synthetic
atatgtgccgtgccgcgctgccggtcgttgagttcg

SEQ ID NO: 7068 - DNA, 40 bp, Artificial Sequence
  Synthetic
aaaggggcgaagtttacaggcttcgcgttgttgtaggttt

SEQ ID NO: 7069 - DNA, 36 bp, Artificial Sequence
  Synthetic
ttggtttcgccgctcatggcaaagcccgcgccgaag

SEQ ID NO: 7070 - DNA, 36 bp, Artificial Sequence
  Synthetic
cgctcggcggcatccaaagaaagttacgaggccgcc

SEQ ID NO: 7071 - DNA, 35 bp, Artificial Sequence
  Synthetic
tcacaggcacacgtctgcgaaagcctcgaccgccc

SEQ ID NO: 7072 - DNA, 39 bp, Artificial Sequence
  Synthetic
cgtgggcttacctgccgctcgatgtaaacctcgggcagc

SEQ ID NO: 7073 - DNA, 40 bp, Artificial Sequence
  Synthetic
ttcagacggcattttcggcacaatttctggtggcggcttg

SEQ ID NO: 7074 - DNA, 41 bp, Artificial Sequence
  Synthetic
tacctcgccaaaaaactcggcaggcttggaggaattcgtgc

SEQ ID NO: 7075 - DNA, 41 bp, Artificial Sequence
  Synthetic
ggtcggtatggatgccttcctgagcccgtcaaagagtttgg

SEQ ID NO: 7076 - DNA, 42 bp, Artificial Sequence
  Synthetic
accaacaacagcaccttcctcgcgttctaggttcgggtatgc

SEQ ID NO: 7077 - DNA, 41 bp, Artificial Sequence
  Synthetic
atctggcgaaggaaatgcacgtgcgaaatactgtcgccgat

SEQ ID NO: 7078 - DNA, 41 bp, Artificial Sequence
  Synthetic
gcttgcccgattttgaaagccgggtgagttttgccagttgc

SEQ ID NO: 7079 - DNA, 36 bp, Artificial Sequence
  Synthetic
ccgcccgcccgattgtcaaaaggcagggcgatcagc

SEQ ID NO: 7080 - DNA, 42 bp, Artificial Sequence
  Synthetic
tcgagtacgccggtgattttgtgtccacggcttgaatatcga

SEQ ID NO: 7081 - DNA, 45 bp, Artificial Sequence
  Synthetic
aattcgactgctttttcggcgggataaaaatatgacgacacaaga

SEQ ID NO: 7082 - DNA, 42 bp, Artificial Sequence
  Synthetic
tccaacagttttgccacaccgtgtggaaaaacggtggacaga

SEQ ID NO: 7083 - DNA, 42 bp, Artificial Sequence
  Synthetic
agcccagtatgacaatttgctgtgctgattatctgccgtaaa

SEQ ID NO: 7084 - DNA, 40 bp, Artificial Sequence
  Synthetic
tgcccaagcacccaaatcatatttgttttgccgtgatgtg

SEQ ID NO: 7085 - DNA, 40 bp, Artificial Sequence
  Synthetic
cacgccaatgacgcgcaatctttcggattctttcgccagt

SEQ ID NO: 7086 - DNA, 39 bp, Artificial Sequence
  Synthetic
gcaaaattccgcgcattaagcatgattttcaggctgcct

SEQ ID NO: 7087 - DNA, 41 bp, Artificial Sequence
  Synthetic
gcctataccgaaaaatggcgcgaaaccattctgtgcgctcg

SEQ ID NO: 7088 - DNA, 38 bp, Artificial Sequence
  Synthetic
gtttgatgccgttttgtgcgtgattatttacgcggcgg

SEQ ID NO: 7089 - DNA, 38 bp, Artificial Sequence
  Synthetic
gcaaacaacaacactcgggcctgcccattgtgcatagg

SEQ ID NO: 7090 - DNA, 43 bp, Artificial Sequence
  Synthetic
cgaaatttttcatggtaaacgagcggataccgcaatggctttg

SEQ ID NO: 7091 - DNA, 39 bp, Artificial Sequence
  Synthetic
gtccgaagacggcggcttcacaacagccgaagccgtaag

SEQ ID NO: 7092 - DNA, 39 bp, Artificial Sequence
  Synthetic
ggtacgcaaccgaacagctctgttggctatgactgcccg

SEQ ID NO: 7093 - DNA, 47 bp, Artificial Sequence
  Synthetic
accgttcaaataaatcgctctacatgattagacccaacatgagtttg

SEQ ID NO: 7094 - DNA, 43 bp, Artificial Sequence
  Synthetic
ctgggcaaactggaaaaacggatatattatgctgacgcccaaa

SEQ ID NO: 7095 - DNA, 33 bp, Artificial Sequence
  Synthetic
cggcaaaggcgtgcacgtaatgcctgcgtcgcg

SEQ ID NO: 7096 - DNA, 36 bp, Artificial Sequence
  Synthetic
cgcctgcgcgttgtgaatcgccctgcaacactacgc

SEQ ID NO: 7097 - DNA, 41 bp, Artificial Sequence
  Synthetic
aaacggtttttctttggcttcggggataaaaccgcctacgc

SEQ ID NO: 7098 - DNA, 40 bp, Artificial Sequence
  Synthetic
gcggctgccgtacaatcaaaatgatatgtcgggcggcatc

SEQ ID NO: 7099 - DNA, 34 bp, Artificial Sequence
  Synthetic
gcatcagccttgccacgcttgcgcgtcggcttga

SEQ ID NO: 7100 - DNA, 40 bp, Artificial Sequence
  Synthetic
caggcagtgtcggtcatcctcactcttccagcctgccctc

SEQ ID NO: 7101 - DNA, 37 bp, Artificial Sequence
  Synthetic
tccaggcgtccccagttgtcatcacgcccaacctgac

SEQ ID NO: 7102 - DNA, 37 bp, Artificial Sequence
  Synthetic
acgttcgacggcggcttgtgcatcaaaagtcctgcgg

SEQ ID NO: 7103 - DNA, 39 bp, Artificial Sequence
  Synthetic
ttcagcttcggatggaaaaggacgttttttgctggcatc

SEQ ID NO: 7104 - DNA, 39 bp, Artificial Sequence
  Synthetic
catacggcgcatcgttggcggcgccggtttacaatcctt

SEQ ID NO: 7105 - DNA, 40 bp, Artificial Sequence
  Synthetic
cccgcctttccgacaacgagaacagtatgcccaactgcaa

SEQ ID NO: 7106 - DNA, 39 bp, Artificial Sequence
  Synthetic
tgtggcgaaaagctccatcggaatcgcccaagtgagctg

SEQ ID NO: 7107 - DNA, 38 bp, Artificial Sequence
  Synthetic
gggctgctggatgcgggtaaaagtcgccgaacggaaag

SEQ ID NO: 7108 - DNA, 37 bp, Artificial Sequence
  Synthetic
cgcccgccggtctgaaacatccagctcgaccatcagg

SEQ ID NO: 7109 - DNA, 41 bp, Artificial Sequence
  Synthetic
acggtggaacgtgggaacagggatagtttgggtactgccgc

SEQ ID NO: 7110 - DNA, 37 bp, Artificial Sequence
  Synthetic
aagcaacagcatccgccgcgcgtgatgtcgaaaccga

SEQ ID NO: 7111 - DNA, 39 bp, Artificial Sequence
  Synthetic
tccccgataccgatgccgtctgtaaacggcaggtgcatc

SEQ ID NO: 7112 - DNA, 39 bp, Artificial Sequence
  Synthetic
aaacggttgcccaaaccccgcaaccgaaccgtcattccc

SEQ ID NO: 7113 - DNA, 38 bp, Artificial Sequence
  Synthetic
tctgctcgccaaagtcaaagccacgcggatgtcgaggc

SEQ ID NO: 7114 - DNA, 40 bp, Artificial Sequence
  Synthetic
aacatctggcgcaaaaaaccggcggcatccaaagtgtcgg

SEQ ID NO: 7115 - DNA, 40 bp, Artificial Sequence
  Synthetic
cgaagtgttggacgcaccgctaaagagttgccgtcgatgg

SEQ ID NO: 7116 - DNA, 38 bp, Artificial Sequence
  Synthetic
ttttccacgcgtttgcccgggctgcggcaaagttgttg

SEQ ID NO: 7117 - DNA, 38 bp, Artificial Sequence
  Synthetic
cgacatccacggcaaagcgctgtggaaacgctcgtcgg

SEQ ID NO: 7118 - DNA, 37 bp, Artificial Sequence
  Synthetic
attcacacgcaaacccgcctgacaacacggcggaagg

SEQ ID NO: 7119 - DNA, 41 bp, Artificial Sequence
  Synthetic
agtgtccgccaacatattgcgcggcagtgacgacgatgacc

SEQ ID NO: 7120 - DNA, 39 bp, Artificial Sequence
  Synthetic
ccccgcccgtttcgccaaaggagaagtttaaccgccagg

SEQ ID NO: 7121 - DNA, 39 bp, Artificial Sequence
  Synthetic
accattgccgtctgcgacacggctttttgtggatgatgg

SEQ ID NO: 7122 - DNA, 37 bp, Artificial Sequence
  Synthetic
cgaaaccttaaaccccggcccgcgaggcggagaagct

SEQ ID NO: 7123 - DNA, 37 bp, Artificial Sequence
  Synthetic
tgtcaaaacgctccttcaggcgaacggttggcgcgtg

SEQ ID NO: 7124 - DNA, 34 bp, Artificial Sequence
  Synthetic
gcatccgcgccgaagagtcggcggcgttttggac

SEQ ID NO: 7125 - DNA, 35 bp, Artificial Sequence
  Synthetic
catctgcgccttgtccggcaggcggactggcggaa

SEQ ID NO: 7126 - DNA, 39 bp, Artificial Sequence
  Synthetic
cctgcggattcaataccggcaggaaacgtgcgcctgttg

SEQ ID NO: 7127 - DNA, 36 bp, Artificial Sequence
  Synthetic
cggccgattccgccaaaccggattatgcgccgggag

SEQ ID NO: 7128 - DNA, 39 bp, Artificial Sequence
  Synthetic
cccattccccgtttgccagcggaatcggccggtgagttt

SEQ ID NO: 7129 - DNA, 41 bp, Artificial Sequence
  Synthetic
gctgggcacgtcttccaaagccggcaaggcttatttgtcca

SEQ ID NO: 7130 - DNA, 34 bp, Artificial Sequence
  Synthetic
gccagttcgcgcgtggttttcggggcgcaacacc

SEQ ID NO: 7131 - DNA, 38 bp, Artificial Sequence
  Synthetic
gcctttggcggctttgcgttgggatttcatcggacagg

SEQ ID NO: 7132 - DNA, 34 bp, Artificial Sequence
  Synthetic
gtgtgcggcgcggatgtacggaaaaacgcgcggc

SEQ ID NO: 7133 - DNA, 37 bp, Artificial Sequence
  Synthetic
gcgtttttccagcgcgtcgacgaaatggcggcatacg

SEQ ID NO: 7134 - DNA, 40 bp, Artificial Sequence
  Synthetic
gatcctacacgccgcgaacctccgaaagctccttgtccgc

SEQ ID NO: 7135 - DNA, 42 bp, Artificial Sequence
  Synthetic
gactcggaagacgtcatccggcggtccagttgaagcagctga

SEQ ID NO: 7136 - DNA, 42 bp, Artificial Sequence
  Synthetic
aacttgaagcggcaatgagggccctgacgcagatagacgatg

SEQ ID NO: 7137 - DNA, 37 bp, Artificial Sequence
  Synthetic
cggctgtgcgtgaggtgctcaagtaatcccgcgtccc

SEQ ID NO: 7138 - DNA, 38 bp, Artificial Sequence
  Synthetic
tcaacgcctttcaccagctctcctccgcgatatagggt

SEQ ID NO: 7139 - DNA, 37 bp, Artificial Sequence
  Synthetic
gtccaccaccaagagcgcggccgacttggaagccttg

SEQ ID NO: 7140 - DNA, 38 bp, Artificial Sequence
  Synthetic
ggcgagcgtttgcggatgaatgccgaacggacaaaacc

SEQ ID NO: 7141 - DNA, 40 bp, Artificial Sequence
  Synthetic
atgtgtgccgaaaacaaccgcttgaggaagacggttgcga

SEQ ID NO: 7142 - DNA, 35 bp, Artificial Sequence
  Synthetic
cttccgtcctcgccgatcctgtggatgacggcggg

SEQ ID NO: 7143 - DNA, 35 bp, Artificial Sequence
  Synthetic
cgaagccctgcgcctcgaaaccgcccaagccttgc

SEQ ID NO: 7144 - DNA, 35 bp, Artificial Sequence
  Synthetic
tttgcagacgaccgcgtgctccgacaagcagcccg

SEQ ID NO: 7145 - DNA, 36 bp, Artificial Sequence
  Synthetic
aaatcctgtttgccgccgccttggggcgcaattcgg

SEQ ID NO: 7146 - DNA, 35 bp, Artificial Sequence
  Synthetic
tttggccttggctgccgatccgccgaaacagcttg

SEQ ID NO: 7147 - DNA, 38 bp, Artificial Sequence
  Synthetic
cgctacggcagccgcgaaagcggttgttggtggtttgc

SEQ ID NO: 7148 - DNA, 39 bp, Artificial Sequence
  Synthetic
tgccggtatggtttcaagacgaaagagcagacggagaag

SEQ ID NO: 7149 - DNA, 41 bp, Artificial Sequence
  Synthetic
cctctcgtactaggagcagccccgtgagacagtttggtccc

SEQ ID NO: 7150 - DNA, 36 bp, Artificial Sequence
  Synthetic
gcggggccctcgaaaacctccgcacggttaccaacc

SEQ ID NO: 7151 - DNA, 42 bp, Artificial Sequence
  Synthetic
agcacaaaaatcttgccgtcgcgcgattgacgtgattgtcga

SEQ ID NO: 7152 - DNA, 39 bp, Artificial Sequence
  Synthetic
gacgggcaaaggttcgcgtgttgaggttggacacggtaa

SEQ ID NO: 7153 - DNA, 41 bp, Artificial Sequence
  Synthetic
atctccatccacgacgtgggcgcatcgttgaccaattcagg

SEQ ID NO: 7154 - DNA, 41 bp, Artificial Sequence
  Synthetic
cggcaaataccaaacccccgtcgataggtgttgaagcccat

SEQ ID NO: 7155 - DNA, 39 bp, Artificial Sequence
  Synthetic
aatggccgccgccttcaccaggtcggacatatgcacgtc

SEQ ID NO: 7156 - DNA, 38 bp, Artificial Sequence
  Synthetic
ccctgccttgcgcgaccaacccaatgtcagcgtgttcg

SEQ ID NO: 7157 - DNA, 37 bp, Artificial Sequence
  Synthetic
tctcgctcgcgtccaaatctgatgccgccgatggagc

SEQ ID NO: 7158 - DNA, 36 bp, Artificial Sequence
  Synthetic
ccgtgggtatgtcgctcggctgcgttcgagcgaggc

SEQ ID NO: 7159 - DNA, 37 bp, Artificial Sequence
  Synthetic
caccgtcggtgcagtcttcatttggcgatgtggacgg

SEQ ID NO: 7160 - DNA, 39 bp, Artificial Sequence
  Synthetic
ctacgaagcccccgtcggagcccaatagctgaatacggt

SEQ ID NO: 7161 - DNA, 35 bp, Artificial Sequence
  Synthetic
cgttcaggctgcccgaacacttgtccgccgtcgtc

SEQ ID NO: 7162 - DNA, 40 bp, Artificial Sequence
  Synthetic
agaacaaatcaaacgcgcccgcctgcaggtagcggctgag

SEQ ID NO: 7163 - DNA, 36 bp, Artificial Sequence
  Synthetic
cgcaccccgtgggcacaatgcgcagggtcatggctt

SEQ ID NO: 7164 - DNA, 46 bp, Artificial Sequence
  Synthetic
catgcagatatgcagattctgacaaaggtttagatcagttttcgga

SEQ ID NO: 7165 - DNA, 40 bp, Artificial Sequence
  Synthetic
tatcgagttgcgccaccaaccccaaatattgcacgcccca

SEQ ID NO: 7166 - DNA, 40 bp, Artificial Sequence
  Synthetic
tcaaccaatccgtttacgcccataaagctgcggcccattt

SEQ ID NO: 7167 - DNA, 38 bp, Artificial Sequence
  Synthetic
ttttggacgaaccctccatcggtgagggtggcgagcag

SEQ ID NO: 7168 - DNA, 41 bp, Artificial Sequence
  Synthetic
gcgacggcgtgattaaagtcgaagacttcgcaggggacgta

SEQ ID NO: 7169 - DNA, 38 bp, Artificial Sequence
  Synthetic
acgccgtacgccgaaacaggccgatgaggttttcgagg

SEQ ID NO: 7170 - DNA, 36 bp, Artificial Sequence
  Synthetic
aacgcatcgtgccgcccatgacgaatggcaaaccgc

SEQ ID NO: 7171 - DNA, 40 bp, Artificial Sequence
  Synthetic
agctgcaactgctcggtaatgacgaatgccccgaaatgct

SEQ ID NO: 7172 - DNA, 38 bp, Artificial Sequence
  Synthetic
ccgccagattgccgcgtgttcgtcccctatgctttggc

SEQ ID NO: 7173 - DNA, 39 bp, Artificial Sequence
  Synthetic
tggggtctttttcggtcaggcatcgtcaaaccgctcgac

SEQ ID NO: 7174 - DNA, 42 bp, Artificial Sequence
  Synthetic
tgtccgtcgggattttggtgtcatgcgctcttctctgctttg

SEQ ID NO: 7175 - DNA, 39 bp, Artificial Sequence
  Synthetic
atgaccccgcttttgctggtagcgggtcaatacggtcag

SEQ ID NO: 7176 - DNA, 39 bp, Artificial Sequence
  Synthetic
cttggtcgagctgcttgccctttgactttggcggcatcg

SEQ ID NO: 7177 - DNA, 37 bp, Artificial Sequence
  Synthetic
caggttcaggcttggtcgcttcgggcatatcgagcgg

SEQ ID NO: 7178 - DNA, 38 bp, Artificial Sequence
  Synthetic
cgcgaaagagttgtccgacgaattccatacgcgcgccg

SEQ ID NO: 7179 - DNA, 40 bp, Artificial Sequence
  Synthetic
ctgcggaaaatgcggcaaagcgccgatgtcttccttacgc

SEQ ID NO: 7180 - DNA, 37 bp, Artificial Sequence
  Synthetic
ggcacgacacccgccgattttcgtcgtgttcggcctg

SEQ ID NO: 7181 - DNA, 40 bp, Artificial Sequence
  Synthetic
ctcgatgcgatggaaagccccgccattcccgcatcagggc

SEQ ID NO: 7182 - DNA, 40 bp, Artificial Sequence
  Synthetic
ccgtcctcgaagccgtcaggggttgttcgggtaggcgata

SEQ ID NO: 7183 - DNA, 38 bp, Artificial Sequence
  Synthetic
cactcggcgacaaaaaaggcatagggcttcgtcgagcg

SEQ ID NO: 7184 - DNA, 40 bp, Artificial Sequence
  Synthetic
gcgtatacaaccgctcgccctgccgtaaacttttgctcct

SEQ ID NO: 7185 - DNA, 40 bp, Artificial Sequence
  Synthetic
tcggttttctctgtgcggacacgttttgggttatgaggat

SEQ ID NO: 7186 - DNA, 35 bp, Artificial Sequence
  Synthetic
caaccggcgtggcgatgtaggacagggtgtgccag

SEQ ID NO: 7187 - DNA, 35 bp, Artificial Sequence
  Synthetic
cgcggccaaactcgttgcttacggtttcgcgcagg

SEQ ID NO: 7188 - DNA, 36 bp, Artificial Sequence
  Synthetic
atgagcgtggtcaaaggtcgccgctgcacgggcttt

SEQ ID NO: 7189 - DNA, 40 bp, Artificial Sequence
  Synthetic
tggcaatggcaggctttgagaccgatcatcgtgatgtcgg

SEQ ID NO: 7190 - DNA, 42 bp, Artificial Sequence
  Synthetic
cttgcccatgaaaaccacgtcgggttgagcacgatttggttc

SEQ ID NO: 7191 - DNA, 39 bp, Artificial Sequence
  Synthetic
gacaagcccccgcctaccagtagggcaggtaaacgtcga

SEQ ID NO: 7192 - DNA, 39 bp, Artificial Sequence
  Synthetic
aaccgtctgcaccgtaaatgttaaagatggtcgggttgc

SEQ ID NO: 7193 - DNA, 39 bp, Artificial Sequence
  Synthetic
tttccagtgcggcgagatacatcatccttgcaacaggtc

SEQ ID NO: 7194 - DNA, 37 bp, Artificial Sequence
  Synthetic
acatccgccgtggtgttgcatcccgttcaagttgccg

SEQ ID NO: 7195 - DNA, 45 bp, Artificial Sequence
  Synthetic
ttcatgcagtggcgttagcttaaaaaactgagcttcgagaattac

SEQ ID NO: 7196 - DNA, 38 bp, Artificial Sequence
  Synthetic
gtgcctctccaaacgccacgcctgacgaagcgacaacg

SEQ ID NO: 7197 - DNA, 40 bp, Artificial Sequence
  Synthetic
gtttgtcgtcaaaccgcgcgttgggcttcgtattgttggt

SEQ ID NO: 7198 - DNA, 37 bp, Artificial Sequence
  Synthetic
gaggcggaggtagagccggaatgttgggcggcgttcc

SEQ ID NO: 7199 - DNA, 36 bp, Artificial Sequence
  Synthetic
ttgccgccagttgcagcgcggaatgggagcagatgc

SEQ ID NO: 7200 - DNA, 38 bp, Artificial Sequence
  Synthetic
cgcatcgacgttgtcctttggtttcggcgggtgagagc

SEQ ID NO: 7201 - DNA, 36 bp, Artificial Sequence
  Synthetic
tgccgcacgcgcagaagctttcagttttgccgcttc

SEQ ID NO: 7202 - DNA, 38 bp, Artificial Sequence
  Synthetic
caagccgaaacacgagcgaaacggtgcggcaggtttcg

SEQ ID NO: 7203 - DNA, 34 bp, Artificial Sequence
  Synthetic
cgtgtccgcgcgtttgcaaccctgaccctgctcg

SEQ ID NO: 7204 - DNA, 39 bp, Artificial Sequence
  Synthetic
acggtgcgtttctgacttcgcgcaaaacctcgctcctgc

SEQ ID NO: 7205 - DNA, 40 bp, Artificial Sequence
  Synthetic
ccgtcctgccactcggtctccgccgaaaatcgtcttgaac

SEQ ID NO: 7206 - DNA, 36 bp, Artificial Sequence
  Synthetic
ctggtccgcatacagccgcacgtggtttcggggcaa

SEQ ID NO: 7207 - DNA, 39 bp, Artificial Sequence
  Synthetic
cgcgggcttggcgttatacggggtttcagcctgtcatcg

SEQ ID NO: 7208 - DNA, 40 bp, Artificial Sequence
  Synthetic
accgcaaaagacgacaaggtgtaccgattacgcccatccc

SEQ ID NO: 7209 - DNA, 32 bp, Artificial Sequence
  Synthetic
aaggcagccgcgcgatttcgccgcccgatacg

SEQ ID NO: 7210 - DNA, 39 bp, Artificial Sequence
  Synthetic
cgggcctataccgttgccgcttttgacggcagggagcaa

SEQ ID NO: 7211 - DNA, 40 bp, Artificial Sequence
  Synthetic
gcccactgcagatagggaccaaagtggtacgtgagctggg

SEQ ID NO: 7212 - DNA, 41 bp, Artificial Sequence
  Synthetic
aaaccataaaacgggttgccttcagaagttgaagcaggtaa

SEQ ID NO: 7213 - DNA, 41 bp, Artificial Sequence
  Synthetic
cagatcgaccgcttcctcgtgcggatattgtggaacgggaa

SEQ ID NO: 7214 - DNA, 42 bp, Artificial Sequence
  Synthetic
acaggcgaacaccaccaactacatgcgttcgacaccaatgtt

SEQ ID NO: 7215 - DNA, 40 bp, Artificial Sequence
  Synthetic
cggtagattgcccggaatgcgcgcctctcccttgtccaac

SEQ ID NO: 7216 - DNA, 37 bp, Artificial Sequence
  Synthetic
ccgccgacggccgaaaagttacaaaacaaccgccgcc

SEQ ID NO: 7217 - DNA, 39 bp, Artificial Sequence
  Synthetic
cgtatcgaccaaagcggcgtaagcgatgtacgaacccga

SEQ ID NO: 7218 - DNA, 41 bp, Artificial Sequence
  Synthetic
gcattcaaccgtttggacagcatccatttgtcggtactgcc

SEQ ID NO: 7219 - DNA, 40 bp, Artificial Sequence
  Synthetic
cgactttgtcggcaacaccttgtcgggcaaatcgagttcg

SEQ ID NO: 7220 - DNA, 39 bp, Artificial Sequence
  Synthetic
gccgaagcgatggcgatggccacaaagaaacgctcggat

SEQ ID NO: 7221 - DNA, 39 bp, Artificial Sequence
  Synthetic
caagtgccgggcaaacctccaatcggcaggatggatgca

SEQ ID NO: 7222 - DNA, 38 bp, Artificial Sequence
  Synthetic
cgaaagcaaagccgaactcgactgcacttcgcggcgaa

SEQ ID NO: 7223 - DNA, 36 bp, Artificial Sequence
  Synthetic
agaagccgtcttcccgctgcgcggttgacgaagggc

SEQ ID NO: 7224 - DNA, 39 bp, Artificial Sequence
  Synthetic
tctgccttcgcttctgccgcgcttcaggaacagcttctg

SEQ ID NO: 7225 - DNA, 38 bp, Artificial Sequence
  Synthetic
gagcgcggggttgcctttggtttggacgtttaccgcag

SEQ ID NO: 7226 - DNA, 40 bp, Artificial Sequence
  Synthetic
ctttgtcgcgggcgagtttggaactcttcctcgtcgaagg

SEQ ID NO: 7227 - DNA, 36 bp, Artificial Sequence
  Synthetic
tcgtcttcgcctttgaccggaaagccgtgctgctgc

SEQ ID NO: 7228 - DNA, 40 bp, Artificial Sequence
  Synthetic
cttggcagatatgtgtcgggctagccggtcaaagaacgtc

SEQ ID NO: 7229 - DNA, 41 bp, Artificial Sequence
  Synthetic
tcttcagccgccttcaaatccacgtgaaaactgtggcgttg

SEQ ID NO: 7230 - DNA, 36 bp, Artificial Sequence
  Synthetic
ggaggtgtggatgcggccttgaatcgggcggacacc

SEQ ID NO: 7231 - DNA, 36 bp, Artificial Sequence
  Synthetic
ggaagctgtccgagcccgtgtccgcacgcttatccc

SEQ ID NO: 7232 - DNA, 39 bp, Artificial Sequence
  Synthetic
ggcaagtgcgccgaaatggagcaaaatcagcacggaaac

SEQ ID NO: 7233 - DNA, 38 bp, Artificial Sequence
  Synthetic
gtcgccttcacatcgtgcacggcggctttggcttccgt

SEQ ID NO: 7234 - DNA, 39 bp, Artificial Sequence
  Synthetic
ggcaacgcggctgtcttccccgcattttggacacatgga

SEQ ID NO: 7235 - DNA, 36 bp, Artificial Sequence
  Synthetic
tttcaggcaggtcgggctgtgtttgccgggcagacg

SEQ ID NO: 7236 - DNA, 40 bp, Artificial Sequence
  Synthetic
cgattgcgatatacccggcggggtttggaatgggtgcgtt

SEQ ID NO: 7237 - DNA, 36 bp, Artificial Sequence
  Synthetic
cgtcgcataccaaacgcgcccgttcctgcccgctat

SEQ ID NO: 7238 - DNA, 37 bp, Artificial Sequence
  Synthetic
gaagcctgccgcgagattctccacgccgtaatacgcg

SEQ ID NO: 7239 - DNA, 40 bp, Artificial Sequence
  Synthetic
acgcaccacaacgacagtatggtgcagggcgtattgttgc

SEQ ID NO: 7240 - DNA, 36 bp, Artificial Sequence
  Synthetic
ttgggacgggcagaacgacctcggtttcccagccgc

SEQ ID NO: 7241 - DNA, 39 bp, Artificial Sequence
  Synthetic
ccgaaatgcctgcccataccgtccgcatccgcacatcaa

SEQ ID NO: 7242 - DNA, 40 bp, Artificial Sequence
  Synthetic
gtttgcctgtttgagcgcgtcgaagtattgctcgaccgtc

SEQ ID NO: 7243 - DNA, 36 bp, Artificial Sequence
  Synthetic
gacattgccgccgctcaagctcctgcccacgcttgc

SEQ ID NO: 7244 - DNA, 40 bp, Artificial Sequence
  Synthetic
gtaaccgccgcccaattcgtctttccaccgggcaggctat

SEQ ID NO: 7245 - DNA, 41 bp, Artificial Sequence
  Synthetic
gcaaacgaaatgccttgcgcctcgccgcagttgaaaatcga

SEQ ID NO: 7246 - DNA, 38 bp, Artificial Sequence
  Synthetic
ggcaggaacgaagtcggcagatatcggcttggcggttg

SEQ ID NO: 7247 - DNA, 39 bp, Artificial Sequence
  Synthetic
cgatttgctccgcgtgttgcgaaccccatatcggcgaag

SEQ ID NO: 7248 - DNA, 41 bp, Artificial Sequence
  Synthetic
caaccaggtcgaatacggcgggttgggtttgaacgacggag

SEQ ID NO: 7249 - DNA, 39 bp, Artificial Sequence
  Synthetic
cggatgtggcggatgacgggaaaccgaattggcgcaatt

SEQ ID NO: 7250 - DNA, 36 bp, Artificial Sequence
  Synthetic
ctgccgccatatccgggcattcggacgttttgccgc

SEQ ID NO: 7251 - DNA, 39 bp, Artificial Sequence
  Synthetic
aaacagctgatccgtgccgccgatttgaacgtccgctgg

SEQ ID NO: 7252 - DNA, 41 bp, Artificial Sequence
  Synthetic
caatgcatcccgctcggattgagcacaagctgtccgaacat

SEQ ID NO: 7253 - DNA, 40 bp, Artificial Sequence
  Synthetic
tacctgcccaagcaatacccgtggaacttgggtgtcgttg

SEQ ID NO: 7254 - DNA, 40 bp, Artificial Sequence
  Synthetic
cgcccacacgtgccaaatcatacgaccatccgttccaatg

SEQ ID NO: 7255 - DNA, 38 bp, Artificial Sequence
  Synthetic
tcgccccttatgacctcgactaatgccttcgaatgccc

SEQ ID NO: 7256 - DNA, 38 bp, Artificial Sequence
  Synthetic
gacaccgtgcgcgaagaaggtttgggcgtgagtttggc

SEQ ID NO: 7257 - DNA, 36 bp, Artificial Sequence
  Synthetic
cgctcgcccgccacaaactcttccaagtcgcgggac

SEQ ID NO: 7258 - DNA, 40 bp, Artificial Sequence
  Synthetic
ggtacgacttcgatgccgcgcgtttccttcctgaccaacc

SEQ ID NO: 7259 - DNA, 41 bp, Artificial Sequence
  Synthetic
aaccttggtcgcccataacggaacttgtccgccctgaaagg

SEQ ID NO: 7260 - DNA, 39 bp, Artificial Sequence
  Synthetic
ggccgaccgacagtttccagccttcggcaaacagggttt

SEQ ID NO: 7261 - DNA, 39 bp, Artificial Sequence
  Synthetic
ggcaagggcgaggatgatgagatcccatttggcgcaacc

SEQ ID NO: 7262 - DNA, 36 bp, Artificial Sequence
  Synthetic
ctctgcctgccctgctgctcgaaacgctggtgtccg

SEQ ID NO: 7263 - DNA, 40 bp, Artificial Sequence
  Synthetic
cgttaacaccgagcttgtcgcatgatgacggttgccaacc

SEQ ID NO: 7264 - DNA, 37 bp, Artificial Sequence
  Synthetic
cgaggttcgcaccgacttcggcgcaagagctgttggg

SEQ ID NO: 7265 - DNA, 40 bp, Artificial Sequence
  Synthetic
aagccgcacaagcctttccccattttttccagcagggcga

SEQ ID NO: 7266 - DNA, 40 bp, Artificial Sequence
  Synthetic
tgccgcgttgtcgtgaaaagcctgatgtgggacagctcgg

SEQ ID NO: 7267 - DNA, 41 bp, Artificial Sequence
  Synthetic
tcgtctttcaactgcgcttccacgagccggcttatgaggat

SEQ ID NO: 7268 - DNA, 39 bp, Artificial Sequence
  Synthetic
gcgtcgtggtttcagacgtgccacgggtttggcgggtac

SEQ ID NO: 7269 - DNA, 38 bp, Artificial Sequence
  Synthetic
ggacaggcgcggcgaaactagggtaatcaggtgcaggg

SEQ ID NO: 7270 - DNA, 35 bp, Artificial Sequence
  Synthetic
gcaccatcagcatcggggcaaaccctcgccccgct

SEQ ID NO: 7271 - DNA, 38 bp, Artificial Sequence
  Synthetic
cggcacgtcggcaaaacgggaaatcaacctcacgccgc

SEQ ID NO: 7272 - DNA, 39 bp, Artificial Sequence
  Synthetic
gctgtccgcccgagagttcaggatttgggtttggcaagt

SEQ ID NO: 7273 - DNA, 39 bp, Artificial Sequence
  Synthetic
cgcgacacgcctttttcctgtgaccatggaaatggcgga

SEQ ID NO: 7274 - DNA, 35 bp, Artificial Sequence
  Synthetic
ggcggggttgaggctgaacccggcggcgaaaaagc

SEQ ID NO: 7275 - DNA, 38 bp, Artificial Sequence
  Synthetic
cctcctgctgctgcaacaggcaaaccaagctgccgcag

SEQ ID NO: 7276 - DNA, 34 bp, Artificial Sequence
  Synthetic
actgtgccagttcgcgctctctggcgcgcaccaa

SEQ ID NO: 7277 - DNA, 35 bp, Artificial Sequence
  Synthetic
ggcaaaggtgcgggcggtatgccgaacgcctgcac

SEQ ID NO: 7278 - DNA, 42 bp, Artificial Sequence
  Synthetic
tgcgacaggatttgcgacaacggcctgaagcagcaacacatt

SEQ ID NO: 7279 - DNA, 39 bp, Artificial Sequence
  Synthetic
tcctgctgggtttggaaggccgtctgcccgaattggaag

SEQ ID NO: 7280 - DNA, 37 bp, Artificial Sequence
  Synthetic
ctttcggcgcgggggtttccgttttgtgcggcaaccg

SEQ ID NO: 7281 - DNA, 37 bp, Artificial Sequence
  Synthetic
ataccggcctgtccgtgacccattgcccatcgcgccg

SEQ ID NO: 7282 - DNA, 38 bp, Artificial Sequence
  Synthetic
ggcttcgtacagcttatcgcctgtcggcaagcgggttg

SEQ ID NO: 7283 - DNA, 39 bp, Artificial Sequence
  Synthetic
ccgacaatggcaagggcgtttcgtcaaaggggacaaacg

SEQ ID NO: 7284 - DNA, 38 bp, Artificial Sequence
  Synthetic
ccgccgtacaacgaatggctctcggaagggatgccgac

SEQ ID NO: 7285 - DNA, 37 bp, Artificial Sequence
  Synthetic
ccctcgccgctgattgacgtgtccgtagtcgcattgc

SEQ ID NO: 7286 - DNA, 38 bp, Artificial Sequence
  Synthetic
acggcgaaatcgaatgggtcaattcggtcagcggctcg

SEQ ID NO: 7287 - DNA, 38 bp, Artificial Sequence
  Synthetic
gcggcggatgctgttgctacggtttatcctcctcacga

SEQ ID NO: 7288 - DNA, 37 bp, Artificial Sequence
  Synthetic
cgccgtcgcggaatgggaagtctcgacctcaacggcg

SEQ ID NO: 7289 - DNA, 38 bp, Artificial Sequence
  Synthetic
agcggcacttccaatacgcgaaattcaccgccgaagcc

SEQ ID NO: 7290 - DNA, 38 bp, Artificial Sequence
  Synthetic
aggcgagtttgtaggcggtctgaaacacgccaatccgt

SEQ ID NO: 7291 - DNA, 36 bp, Artificial Sequence
  Synthetic
aacgcaccatggtcgggcgctgcacactggaagacg

SEQ ID NO: 7292 - DNA, 37 bp, Artificial Sequence
  Synthetic
agaaacaccgccgctccgacagcgtcttccccgaaat

SEQ ID NO: 7293 - DNA, 39 bp, Artificial Sequence
  Synthetic
cgtccacacgcccaacatcggtgtataacgtgccgctcg

SEQ ID NO: 7294 - DNA, 37 bp, Artificial Sequence
  Synthetic
gcgcggtaagccacgcctagcgacggtgcgaacgata

SEQ ID NO: 7295 - DNA, 39 bp, Artificial Sequence
  Synthetic
tgttgtcggtttagcagcaaggttcaggaaaggcattgc

SEQ ID NO: 7296 - DNA, 40 bp, Artificial Sequence
  Synthetic
gtttgaacacgattgaccgctagatgctttgatgtcggtt

SEQ ID NO: 7297 - DNA, 41 bp, Artificial Sequence
  Synthetic
ccacctacttacattttgcggttttctatccgccgtttgtc

SEQ ID NO: 7298 - DNA, 40 bp, Artificial Sequence
  Synthetic
ggtcgcgccattcagaaaactttcaaggatttccaaacgg

SEQ ID NO: 7299 - DNA, 38 bp, Artificial Sequence
  Synthetic
aaacagcccgaatcacaacctgttccaatgcttcggag

SEQ ID NO: 7300 - DNA, 40 bp, Artificial Sequence
  Synthetic
acacaaagcgagatgcccgacttcggtatctgcaatcggc

SEQ ID NO: 7301 - DNA, 45 bp, Artificial Sequence
  Synthetic
acgtgatgatgctaaatttttgcagaaaataggtaattgccaccg

SEQ ID NO: 7302 - DNA, 43 bp, Artificial Sequence
  Synthetic
ggtcgtcatgaagttttaatgcggcgtctgaaacaaccaacca

SEQ ID NO: 7303 - DNA, 44 bp, Artificial Sequence
  Synthetic
cggaagcgatgcacaatctggttaaatattgctgataagtgcca

SEQ ID NO: 7304 - DNA, 43 bp, Artificial Sequence
  Synthetic
tctgaaagatgatgatgagccaagcatcacatcggcaatcagt

SEQ ID NO: 7305 - DNA, 45 bp, Artificial Sequence
  Synthetic
tgcaactgacctgcaaattttctgacagaaagtgtgtaaaaactc

SEQ ID NO: 7306 - DNA, 43 bp, Artificial Sequence
  Synthetic
gtgcctgtcataatcgcttaatgcctgccataaataaaccgcg

SEQ ID NO: 7307 - DNA, 38 bp, Artificial Sequence
  Synthetic
cgttggaaacgttgtgcgacttaacgggcaactttcct

SEQ ID NO: 7308 - DNA, 39 bp, Artificial Sequence
  Synthetic
catagccagcagcgtccaagcccctggttttggcactgc

SEQ ID NO: 7309 - DNA, 37 bp, Artificial Sequence
  Synthetic
cggttggtcaggcgcacgttacgccgccgttccaaat

SEQ ID NO: 7310 - DNA, 40 bp, Artificial Sequence
  Synthetic
tcgcccaggtaagtctttggaaaggatgatgattgggagg

SEQ ID NO: 7311 - DNA, 38 bp, Artificial Sequence
  Synthetic
acattgacacacggcggcggcttcctcgttcggtatgg

SEQ ID NO: 7312 - DNA, 35 bp, Artificial Sequence
  Synthetic
ccgcagtttaccgccgcagctttccagcgtcaggc

SEQ ID NO: 7313 - DNA, 36 bp, Artificial Sequence
  Synthetic
tttcaccagcccctccgcgtggtcgcgcctttggtg

SEQ ID NO: 7314 - DNA, 38 bp, Artificial Sequence
  Synthetic
gctgggcagcgaatccttcctagcgttggacacccgag

SEQ ID NO: 7315 - DNA, 34 bp, Artificial Sequence
  Synthetic
gccgccggcaaattcccatacctgctcggctcgc

SEQ ID NO: 7316 - DNA, 35 bp, Artificial Sequence
  Synthetic
gcccgatgccgatgttgcgtcgccaaagccgtcgg

SEQ ID NO: 7317 - DNA, 34 bp, Artificial Sequence
  Synthetic
ggctgtgtgcgtcggcatatgatgtcggcgcgcc

SEQ ID NO: 7318 - DNA, 36 bp, Artificial Sequence
  Synthetic
ggcgcggtgcagggttttgttcgtccctgccagcgt

SEQ ID NO: 7319 - DNA, 38 bp, Artificial Sequence
  Synthetic
ctgttgggtaaacgtgccctgcctcgccgtcgaacgtc

SEQ ID NO: 7320 - DNA, 40 bp, Artificial Sequence
  Synthetic
acccgaaaaacagcacggcggggattgtcgtccaatttgc

SEQ ID NO: 7321 - DNA, 37 bp, Artificial Sequence
  Synthetic
gcaatcagcctttgcgtcggctggtgttgttggcggg

SEQ ID NO: 7322 - DNA, 36 bp, Artificial Sequence
  Synthetic
aagcgacagcatccgccggcgtgatgtcgaaaccga

SEQ ID NO: 7323 - DNA, 37 bp, Artificial Sequence
  Synthetic
acaccgatgccgtctgaacctccgcgcctgtaaacgg

SEQ ID NO: 7324 - DNA, 39 bp, Artificial Sequence
  Synthetic
ccacttccgtgggaatgacggtcagacggcatcggtgtc

SEQ ID NO: 7325 - DNA, 42 bp, Artificial Sequence
  Synthetic
cggcggataaatcgaattgcccctgactttgggcatgatggc

SEQ ID NO: 7326 - DNA, 40 bp, Artificial Sequence
  Synthetic
tccaaacgctcgcggatttcatcctgatgctgcccgaaga

SEQ ID NO: 7327 - DNA, 35 bp, Artificial Sequence
  Synthetic
gttcctgcgcggcgaggattgcatcccgttcgccc

SEQ ID NO: 7328 - DNA, 34 bp, Artificial Sequence
  Synthetic
tttacgcgttccgccgcctcgcctcggtcgccat

SEQ ID NO: 7329 - DNA, 37 bp, Artificial Sequence
  Synthetic
cgcgacgaaggcgggttttcagcgacgtatccgaagc

SEQ ID NO: 7330 - DNA, 41 bp, Artificial Sequence
  Synthetic
tgtacgttcccctgccagtgccgatgtccacctacatccgc

SEQ ID NO: 7331 - DNA, 39 bp, Artificial Sequence
  Synthetic
aggctcttcgtaaggcttcgcccacgcgcgttttgccac

SEQ ID NO: 7332 - DNA, 39 bp, Artificial Sequence
  Synthetic
ccccgaccacgcgctctttctgccacagacatcgtgttg

SEQ ID NO: 7333 - DNA, 37 bp, Artificial Sequence
  Synthetic
ccacgccacggaaatcacgcgatacctgcgtcggcac

SEQ ID NO: 7334 - DNA, 35 bp, Artificial Sequence
  Synthetic
aaaacggcggcgcaccacacaggaagcctaccgcc

SEQ ID NO: 7335 - DNA, 41 bp, Artificial Sequence
  Synthetic
cgtatttttggaagcggcggctgaagcgatccaaaaaggct

SEQ ID NO: 7336 - DNA, 42 bp, Artificial Sequence
  Synthetic
agagtgggtaagctggtagccgcgggtagtggcatttttgga

SEQ ID NO: 7337 - DNA, 37 bp, Artificial Sequence
  Synthetic
gacgccgatcaggaacacgcaggacttcacgcccctg

SEQ ID NO: 7338 - DNA, 42 bp, Artificial Sequence
  Synthetic
gcttgaacgcctcgatatccggtcgatattctggcgctcagt

SEQ ID NO: 7339 - DNA, 35 bp, Artificial Sequence
  Synthetic
gcactgcctgcccgcattgatgttcggcccgtgga

SEQ ID NO: 7340 - DNA, 34 bp, Artificial Sequence
  Synthetic
aaccggcagccaaagccacggccgccacaatgtc

SEQ ID NO: 7341 - DNA, 35 bp, Artificial Sequence
  Synthetic
gctgccgcgcccatcaatgtattcggttgcggcgg

SEQ ID NO: 7342 - DNA, 41 bp, Artificial Sequence
  Synthetic
aacggtagagcagggtttggaccattggaagaaaccgcgca

SEQ ID NO: 7343 - DNA, 37 bp, Artificial Sequence
  Synthetic
cggccgggtctgttgggatcgcacgggggaaatcctc

SEQ ID NO: 7344 - DNA, 40 bp, Artificial Sequence
  Synthetic
caggttgcccatcgggtaatttgggtttggaaaactttgt

SEQ ID NO: 7345 - DNA, 40 bp, Artificial Sequence
  Synthetic
cgccgaacatgacatgtcccagtggggcaaagtgtctctt

SEQ ID NO: 7346 - DNA, 39 bp, Artificial Sequence
  Synthetic
acctcgtcggctttgtcggcgagcagtcggatgcggaaa

SEQ ID NO: 7347 - DNA, 38 bp, Artificial Sequence
  Synthetic
cgtttgcttacgggcggatagggaatggaagcaggttt

SEQ ID NO: 7348 - DNA, 35 bp, Artificial Sequence
  Synthetic
acgcactgctttcgcccgaagtccccagcctgtcc

SEQ ID NO: 7349 - DNA, 39 bp, Artificial Sequence
  Synthetic
caaactctccgccatccatccgagttcgcccatcacgcg

SEQ ID NO: 7350 - DNA, 38 bp, Artificial Sequence
  Synthetic
agccgtcgatttctgccgctttgcgtcttgaggcaggg

SEQ ID NO: 7351 - DNA, 38 bp, Artificial Sequence
  Synthetic
agcctgattgccggttatgccagggcggaagtcgggat

SEQ ID NO: 7352 - DNA, 35 bp, Artificial Sequence
  Synthetic
aaagcccttgccaaacgcggcgttttgtccgccgg

SEQ ID NO: 7353 - DNA, 40 bp, Artificial Sequence
  Synthetic
ccgacttggacggtttgctgcgacgtggttcacaccggtg

SEQ ID NO: 7354 - DNA, 40 bp, Artificial Sequence
  Synthetic
cgcttggaaaacacccgcttcaatcagaagcggtagcgca

SEQ ID NO: 7355 - DNA, 36 bp, Artificial Sequence
  Synthetic
aaggcgcacgcaattccgctatagccgcccacgcct

SEQ ID NO: 7356 - DNA, 37 bp, Artificial Sequence
  Synthetic
tgggcggcagtgcgcaatgggatactgcaccagcgtc

SEQ ID NO: 7357 - DNA, 39 bp, Artificial Sequence
  Synthetic
cgcgccaagtccataccggcgccaaacttttcctcgtca

SEQ ID NO: 7358 - DNA, 36 bp, Artificial Sequence
  Synthetic
gtccgcaccatcctgtcgcatcgaacgccacgccct

SEQ ID NO: 7359 - DNA, 38 bp, Artificial Sequence
  Synthetic
tttcccgtccatccatcggcatggcttggcgcgtgatg

SEQ ID NO: 7360 - DNA, 38 bp, Artificial Sequence
  Synthetic
ctgcgcctgcggcaatttgaacccgaagttacccgcaa

SEQ ID NO: 7361 - DNA, 37 bp, Artificial Sequence
  Synthetic
gtgttgctgctggacgaaccgcgtcttccaacgcgcg

SEQ ID NO: 7362 - DNA, 40 bp, Artificial Sequence
  Synthetic
gcatggcgacaatctcgtcccggaacgtgaaacgggtgtc

SEQ ID NO: 7363 - DNA, 38 bp, Artificial Sequence
  Synthetic
attcggcgaacacatcatccggtgtcggtatggcggcg

SEQ ID NO: 7364 - DNA, 42 bp, Artificial Sequence
  Synthetic
atcttgatgtgtttgtgttcgacgagccgcacattatccaag

SEQ ID NO: 7365 - DNA, 35 bp, Artificial Sequence
  Synthetic
ctgcaccgcagcaggatgttttcggcggcggtttg

SEQ ID NO: 7366 - DNA, 39 bp, Artificial Sequence
  Synthetic
aacatcagcgtactcccccccggcatattgcccggccct

SEQ ID NO: 7367 - DNA, 42 bp, Artificial Sequence
  Synthetic
gcgtaaccacttccacatcggtgtccgttgtttttcgtcagg

SEQ ID NO: 7368 - DNA, 41 bp, Artificial Sequence
  Synthetic
gatgacggtccgttgcagtcgtcaaacgactgagccggata

SEQ ID NO: 7369 - DNA, 39 bp, Artificial Sequence
  Synthetic
ctggtgtggttggaagacggcttggccaaaccgataccg

SEQ ID NO: 7370 - DNA, 34 bp, Artificial Sequence
  Synthetic
gcgggcgcgttcgtgtatgcaggcagcgtgatgc

SEQ ID NO: 7371 - DNA, 38 bp, Artificial Sequence
  Synthetic
cgccattttgcgcccgatatgttgcaagggcagggtcg

SEQ ID NO: 7372 - DNA, 37 bp, Artificial Sequence
  Synthetic
accgacgcaggcatcgatgcaggttcacgctgatgcc

SEQ ID NO: 7373 - DNA, 37 bp, Artificial Sequence
  Synthetic
agcttcttcatctcgcgcgtggcctttgagccggtcg

SEQ ID NO: 7374 - DNA, 39 bp, Artificial Sequence
  Synthetic
atgggcatctaccggcgtgacaggctgtcaacgtagagc

SEQ ID NO: 7375 - DNA, 40 bp, Artificial Sequence
  Synthetic
cgacatcggcgatttcgtcctgacgacggcgagctggtat

SEQ ID NO: 7376 - DNA, 40 bp, Artificial Sequence
  Synthetic
ttccgacaccgcaatatgccccgaccatttctgcccttgc

SEQ ID NO: 7377 - DNA, 39 bp, Artificial Sequence
  Synthetic
atcggcgtattcgatcggggctgatgcgcgaatgggaca

SEQ ID NO: 7378 - DNA, 35 bp, Artificial Sequence
  Synthetic
tcttcggcggctttggcggtcgccctgcaactggg

SEQ ID NO: 7379 - DNA, 37 bp, Artificial Sequence
  Synthetic
cgcacgggattcagcggctgggcattcaggcggacaa

SEQ ID NO: 7380 - DNA, 38 bp, Artificial Sequence
  Synthetic
atgcgggcggaggattatgcccggcagggaagttaagc

SEQ ID NO: 7381 - DNA, 37 bp, Artificial Sequence
  Synthetic
agtgctgaacgacacgcgcgttcccagcatctcgcac

SEQ ID NO: 7382 - DNA, 41 bp, Artificial Sequence
  Synthetic
cgcgattgagcaagacgcaaattccgtcgtagtagctttcg

SEQ ID NO: 7383 - DNA, 36 bp, Artificial Sequence
  Synthetic
ggaggcggcggcgtataaggttcggacggcatcgcg

SEQ ID NO: 7384 - DNA, 36 bp, Artificial Sequence
  Synthetic
atccgccgtggtgttgccatcccgttcaagttgccg

SEQ ID NO: 7385 - DNA, 35 bp, Artificial Sequence
  Synthetic
acactgcctgggcaaagcgtgcccaggctttggcg

SEQ ID NO: 7386 - DNA, 35 bp, Artificial Sequence
  Synthetic
gcccgaaactgccgcaccttaccggccgccttcag

SEQ ID NO: 7387 - DNA, 42 bp, Artificial Sequence
  Synthetic
aactgacgggcattttgaatttgctgaaccttggttttgcct

SEQ ID NO: 7388 - DNA, 38 bp, Artificial Sequence
  Synthetic
ccagtccgacccactgcatctcaggcggctttcctgta

SEQ ID NO: 7389 - DNA, 40 bp, Artificial Sequence
  Synthetic
gggcggactgaatatccggtccggttacggtaatgctgcc

SEQ ID NO: 7390 - DNA, 38 bp, Artificial Sequence
  Synthetic
gcacaggcagtccgcgatcctgtattcgcgtacctgcg

SEQ ID NO: 7391 - DNA, 41 bp, Artificial Sequence
  Synthetic
ttcaaccgcgatgtgtccgtagacgcacaactgggatacgg

SEQ ID NO: 7392 - DNA, 38 bp, Artificial Sequence
  Synthetic
cggtacatcacgctgcgctgccgatgccgacatgatgc

SEQ ID NO: 7393 - DNA, 40 bp, Artificial Sequence
  Synthetic
cggtacgcggccttggtagagttcatcggtcaatccacca

SEQ ID NO: 7394 - DNA, 40 bp, Artificial Sequence
  Synthetic
ctgcaggggctcgagtacgccggcaaaaacgtccacttga

SEQ ID NO: 7395 - DNA, 38 bp, Artificial Sequence
  Synthetic
cagtcgtacatcgcaaacacgccgatacggaagcggcg

SEQ ID NO: 7396 - DNA, 38 bp, Artificial Sequence
  Synthetic
cccctcgctgccgttgactggcggatttggaagggaaa

SEQ ID NO: 7397 - DNA, 34 bp, Artificial Sequence
  Synthetic
cagcggcaaatcggcagcgcgtccgcatcgatgc

SEQ ID NO: 7398 - DNA, 43 bp, Artificial Sequence
  Synthetic
cgtaaaaaccggcggcaaacctgttctactttcaatttttcgc

SEQ ID NO: 7399 - DNA, 40 bp, Artificial Sequence
  Synthetic
tttccagcgcggatattctggccgatgtcttgaccgcgct

SEQ ID NO: 7400 - DNA, 40 bp, Artificial Sequence
  Synthetic
aggatggggtgcatacggtagccatcgagccgctggtcta

SEQ ID NO: 7401 - DNA, 41 bp, Artificial Sequence
  Synthetic
ccgatacggtttggagccgttttccgcataagctcggaagc

SEQ ID NO: 7402 - DNA, 37 bp, Artificial Sequence
  Synthetic
tggttcgcaccgctttacgaacgtggcgatgtccagc

SEQ ID NO: 7403 - DNA, 39 bp, Artificial Sequence
  Synthetic
gcgaccataccaaacacccattgatggagcaaaggttgt

SEQ ID NO: 7404 - DNA, 40 bp, Artificial Sequence
  Synthetic
ggcaaagcaaaaacccccgggtaggtcactgccaaacacc

SEQ ID NO: 7405 - DNA, 39 bp, Artificial Sequence
  Synthetic
tttgcctgacccactgcctggcacagtcggacatagacg

SEQ ID NO: 7406 - DNA, 40 bp, Artificial Sequence
  Synthetic
cgaaatgattaaggcgggcgcgaaatcgtgttccgccgcc

SEQ ID NO: 7407 - DNA, 39 bp, Artificial Sequence
  Synthetic
acgttttaaacctcccccgccgaaatcggtcagctgccg

SEQ ID NO: 7408 - DNA, 35 bp, Artificial Sequence
  Synthetic
gccaccctgcaatcgctcgttcgggcagccacagc

SEQ ID NO: 7409 - DNA, 39 bp, Artificial Sequence
  Synthetic
tgcccaagctgatttcgccctttgcgcgaggaaaacagg

SEQ ID NO: 7410 - DNA, 38 bp, Artificial Sequence
  Synthetic
tcatcgaaatcaccgtccccgatcggtgcggatgaggc

SEQ ID NO: 7411 - DNA, 43 bp, Artificial Sequence
  Synthetic
tcgaaataccccaatcggaaccccatagagctttctacggttt

SEQ ID NO: 7412 - DNA, 36 bp, Artificial Sequence
  Synthetic
gcggcagggttgggttcgacgtgttgggtttcgccg

SEQ ID NO: 7413 - DNA, 39 bp, Artificial Sequence
  Synthetic
gtttcgcgcgcctcttgcacaccagcgaagacatcaaca

SEQ ID NO: 7414 - DNA, 36 bp, Artificial Sequence
  Synthetic
aaccgacttcccggcaaacggtcatttcgggcggcg

SEQ ID NO: 7415 - DNA, 38 bp, Artificial Sequence
  Synthetic
gcgtggacggcttcttcaaaggatggcggcgacttggg

SEQ ID NO: 7416 - DNA, 35 bp, Artificial Sequence
  Synthetic
acggcggcgtttttgctgccgttgcgccaataccg

SEQ ID NO: 7417 - DNA, 40 bp, Artificial Sequence
  Synthetic
atgttgtcggcaagctcgcgcacaaaatcccgccctcaaa

SEQ ID NO: 7418 - DNA, 34 bp, Artificial Sequence
  Synthetic
ctttggcgggcgcggtttccgcattgctggcagc

SEQ ID NO: 7419 - DNA, 40 bp, Artificial Sequence
  Synthetic
ttccatacggacgttgtgcgcggcgaaaccctgacctaca

SEQ ID NO: 7420 - DNA, 38 bp, Artificial Sequence
  Synthetic
atcggaagcttgtgcggattcgttgcggcggaagaggc

SEQ ID NO: 7421 - DNA, 39 bp, Artificial Sequence
  Synthetic
acactgggcgagtttgacgactagtagtcgtgccggtcg

SEQ ID NO: 7422 - DNA, 39 bp, Artificial Sequence
  Synthetic
aaacctgcccgccgtcattcggattaaccctttgctcgg

SEQ ID NO: 7423 - DNA, 36 bp, Artificial Sequence
  Synthetic
cttgccgatatgcttgccgcgcccaagccgtgtacg

SEQ ID NO: 7424 - DNA, 34 bp, Artificial Sequence
  Synthetic
gctgctgcaacgcgggttcagccgtagcgttgcg

SEQ ID NO: 7425 - DNA, 37 bp, Artificial Sequence
  Synthetic
ggctgcctgccgacatcctgcatcggcaggcggattt

SEQ ID NO: 7426 - DNA, 40 bp, Artificial Sequence
  Synthetic
aaaaccctgcccatccccagcgatgacgcttttgccgttt

SEQ ID NO: 7427 - DNA, 42 bp, Artificial Sequence
  Synthetic
atgtcaaacgcctctcctccgcccaagaccatacgttcggcg

SEQ ID NO: 7428 - DNA, 37 bp, Artificial Sequence
  Synthetic
cggcgatgatggtgttttcggagggtttgcaggcgca

SEQ ID NO: 7429 - DNA, 37 bp, Artificial Sequence
  Synthetic
ggctggcgactctgctgcacggagagggtcagcgaag

SEQ ID NO: 7430 - DNA, 39 bp, Artificial Sequence
  Synthetic
cacgactgaaccgatgccgttggggttgggtgtggaaat

SEQ ID NO: 7431 - DNA, 39 bp, Artificial Sequence
  Synthetic
cgtcgatttcgcctgcggcacaacttgttcggcgttgac

SEQ ID NO: 7432 - DNA, 42 bp, Artificial Sequence
  Synthetic
ggtggtgtccgaaatgtttgcgccttcctcacgaccagactg

SEQ ID NO: 7433 - DNA, 40 bp, Artificial Sequence
  Synthetic
taatagaggcccgccgcaaagacgggtttcatcctgttgg

SEQ ID NO: 7434 - DNA, 39 bp, Artificial Sequence
  Synthetic
acggcatttgtcatcactggccctgctgtcgctgctggt

SEQ ID NO: 7435 - DNA, 40 bp, Artificial Sequence
  Synthetic
ttacccatcgcaccgacaaacacggcgtggaatggtcttt

SEQ ID NO: 7436 - DNA, 42 bp, Artificial Sequence
  Synthetic
ttgaggccgtctgaaacttcgcggtgaaaatggaagcggtca

SEQ ID NO: 7437 - DNA, 40 bp, Artificial Sequence
  Synthetic
cacgcagaaggtcagcaccataccgttaccgccaaaaacc

SEQ ID NO: 7438 - DNA, 37 bp, Artificial Sequence
  Synthetic
gcccatgtgctgcggttgtgaaagacgcgctggatgc

SEQ ID NO: 7439 - DNA, 38 bp, Artificial Sequence
  Synthetic
ggcggcggtatttatgtccgtcgatgccgaagccgtca

SEQ ID NO: 7440 - DNA, 39 bp, Artificial Sequence
  Synthetic
aaaaccgctcaaaccgcccttcgacaaatcaagcctcgg

SEQ ID NO: 7441 - DNA, 39 bp, Artificial Sequence
  Synthetic
ggtcaacgcaggcggttcgcttgagtccttgaaccagcg

SEQ ID NO: 7442 - DNA, 40 bp, Artificial Sequence
  Synthetic
ccaacacacccaagccacacaggggttttgaaggcggttt

SEQ ID NO: 7443 - DNA, 39 bp, Artificial Sequence
  Synthetic
attcggtgactacggctggatgcaggacaagcagggctg

SEQ ID NO: 7444 - DNA, 36 bp, Artificial Sequence
  Synthetic
caccaacctcaccggctcaatggattcccgcctgcg

SEQ ID NO: 7445 - DNA, 39 bp, Artificial Sequence
  Synthetic
gttccgccacaaacaactgggggtaacttggtgcagggc

SEQ ID NO: 7446 - DNA, 37 bp, Artificial Sequence
  Synthetic
ggcttcccaagtacaggcctctggtcttcgggcgagg

SEQ ID NO: 7447 - DNA, 38 bp, Artificial Sequence
  Synthetic
ggacgtgccgccgatgttatttccaccggattcaccaa

SEQ ID NO: 7448 - DNA, 37 bp, Artificial Sequence
  Synthetic
ccagaagcgtttgcctgtggcagcgccgatgcctacg

SEQ ID NO: 7449 - DNA, 38 bp, Artificial Sequence
  Synthetic
gagggtgaggatttcgtcgtggctgcaacttcgccccg

SEQ ID NO: 7450 - DNA, 37 bp, Artificial Sequence
  Synthetic
ggtcagacgctcgacggtgtaatcgccgccgtcaaag

SEQ ID NO: 7451 - DNA, 37 bp, Artificial Sequence
  Synthetic
gcgtgggcgtatccgtcgttcgcggtagatggtcagc

SEQ ID NO: 7452 - DNA, 35 bp, Artificial Sequence
  Synthetic
gcgcggcaggcatcattcggcgtgggggttgaact

SEQ ID NO: 7453 - DNA, 37 bp, Artificial Sequence
  Synthetic
agcgtgttcaatggcggcgccacttgtttgggcgtgc

SEQ ID NO: 7454 - DNA, 38 bp, Artificial Sequence
  Synthetic
gcacgctcgcgctcttggaggatgacttcgtcgagcga

SEQ ID NO: 7455 - DNA, 37 bp, Artificial Sequence
  Synthetic
gtgccgactgttttgccgacgaaaccgtccgccacgc

SEQ ID NO: 7456 - DNA, 39 bp, Artificial Sequence
  Synthetic
ttccgacaaaatccggctcacagtttgccgtatcgggcg

SEQ ID NO: 7457 - DNA, 35 bp, Artificial Sequence
  Synthetic
cgaagccgacgaacgcaaggttgcggacgcgcgtt

SEQ ID NO: 7458 - DNA, 36 bp, Artificial Sequence
  Synthetic
aaacagccgttgaccgcaacctgcacgttccgcgct

SEQ ID NO: 7459 - DNA, 38 bp, Artificial Sequence
  Synthetic
gacaaactccgcacgtccgcgtgcctgttcccgatgga

SEQ ID NO: 7460 - DNA, 39 bp, Artificial Sequence
  Synthetic
cggcacgcctttcagacgggagatacggtgcggattccg

SEQ ID NO: 7461 - DNA, 37 bp, Artificial Sequence
  Synthetic
cgaaagcagccacgtcgcctcgatgccgcggattacg

SEQ ID NO: 7462 - DNA, 41 bp, Artificial Sequence
  Synthetic
ctgaacgaaaaacgcgccgagaggacgacgttcacatccaa

SEQ ID NO: 7463 - DNA, 38 bp, Artificial Sequence
  Synthetic
acgtggccaaaccgcaccgttttccgctgtctgaacgg

SEQ ID NO: 7464 - DNA, 40 bp, Artificial Sequence
  Synthetic
catcgccacacccgttcagatcataaatcagtgcgtcgcc

SEQ ID NO: 7465 - DNA, 36 bp, Artificial Sequence
  Synthetic
accgcacaaaccggcggagcccatgccttcaatgcg

SEQ ID NO: 7466 - DNA, 35 bp, Artificial Sequence
  Synthetic
cgtgatcgacggaggtgcgacagcttcgggcaggg

SEQ ID NO: 7467 - DNA, 38 bp, Artificial Sequence
  Synthetic
ttggaaaactacgaaggcggcccaaacgtccgccgagc

SEQ ID NO: 7468 - DNA, 40 bp, Artificial Sequence
  Synthetic
cccgaacctcgattacgccggaggttttcagacggcatcg

SEQ ID NO: 7469 - DNA, 38 bp, Artificial Sequence
  Synthetic
atccgccctctttgctgcgccggcgtttatcaggtctt

SEQ ID NO: 7470 - DNA, 41 bp, Artificial Sequence
  Synthetic
gtcgtcgttttgcccacaccggacatgagtgcgaacatcct

SEQ ID NO: 7471 - DNA, 38 bp, Artificial Sequence
  Synthetic
gccattgccgccgccaaaagcatgaaacgccacatcag

SEQ ID NO: 7472 - DNA, 38 bp, Artificial Sequence
  Synthetic
aaaagccgcagccacctcgcatcatggaggggctgatg

SEQ ID NO: 7473 - DNA, 35 bp, Artificial Sequence
  Synthetic
tgctcgaccgccacttcacgttgatgagggcggcg

SEQ ID NO: 7474 - DNA, 39 bp, Artificial Sequence
  Synthetic
caggaaatttccgccctcgtcagttcgtgggcatccagc

SEQ ID NO: 7475 - DNA, 39 bp, Artificial Sequence
  Synthetic
caaacttgggactgaacccggctcagcatgggcatcggc

SEQ ID NO: 7476 - DNA, 35 bp, Artificial Sequence
  Synthetic
aggcgctcggcaaacacaatgcgccttcccagctc

SEQ ID NO: 7477 - DNA, 40 bp, Artificial Sequence
  Synthetic
gcgacacctacaacgacacacaagaaaccggtggcgtaca

SEQ ID NO: 7478 - DNA, 40 bp, Artificial Sequence
  Synthetic
atcgccgacaaaaccaccatcgaggtgtttgccgctttcg

SEQ ID NO: 7479 - DNA, 38 bp, Artificial Sequence
  Synthetic
ccgggcgcggtattctggagccgtatttggtggccatg

SEQ ID NO: 7480 - DNA, 39 bp, Artificial Sequence
  Synthetic
ggacgacgtacgcgccgaagcggtaaatcaagccctgtt

SEQ ID NO: 7481 - DNA, 38 bp, Artificial Sequence
  Synthetic
cgacggcggcgagattgtcgatcaaatcctgcaacacg

SEQ ID NO: 7482 - DNA, 43 bp, Artificial Sequence
  Synthetic
accaataccgtaaatagcctgaagttgcaggggtaaatatccc

SEQ ID NO: 7483 - DNA, 43 bp, Artificial Sequence
  Synthetic
aaatgtcttccactgtcaagcctgtctaagttgcatactcctg

SEQ ID NO: 7484 - DNA, 42 bp, Artificial Sequence
  Synthetic
cgacagcagctttgatttcaggatgcaaccaaatgacgttta

SEQ ID NO: 7485 - DNA, 39 bp, Artificial Sequence
  Synthetic
cgccgcatattttcagacggaatccccaagcaatcaatg

SEQ ID NO: 7486 - DNA, 35 bp, Artificial Sequence
  Synthetic
ccccttcagacggcatcgcatcggcgtgcctgtcg

SEQ ID NO: 7487 - DNA, 40 bp, Artificial Sequence
  Synthetic
gagttcgcggttttcaacgcgactttattgcgacccacgg

SEQ ID NO: 7488 - DNA, 40 bp, Artificial Sequence
  Synthetic
gtaaccagactgtacgggccgctgcaccacttggttgacg

SEQ ID NO: 7489 - DNA, 40 bp, Artificial Sequence
  Synthetic
gggaatcagaagcggtagcgctggaaaacacccgcttcaa

SEQ ID NO: 7490 - DNA, 38 bp, Artificial Sequence
  Synthetic
gccaggccggcggtaatcacaggttacgctggtggtcg

SEQ ID NO: 7491 - DNA, 37 bp, Artificial Sequence
  Synthetic
atatgccccgttccgtcggcgtatcggcgcggcttct

SEQ ID NO: 7492 - DNA, 37 bp, Artificial Sequence
  Synthetic
gcgcgtatcagcacggtgacccgaagacaacggcaac

SEQ ID NO: 7493 - DNA, 39 bp, Artificial Sequence
  Synthetic
tggtcgaaaccgccatttccgcggtgtcttccggcattt

SEQ ID NO: 7494 - DNA, 40 bp, Artificial Sequence
  Synthetic
cgctgaacgccaataccgcccaggtcttggaaatcggggt

SEQ ID NO: 7495 - DNA, 39 bp, Artificial Sequence
  Synthetic
cggcgcgtatccgtttgaaacctctttttccgcagccgc

SEQ ID NO: 7496 - DNA, 36 bp, Artificial Sequence
  Synthetic
acggcgttgaacgaagtcgatggtcgccggaatgca

SEQ ID NO: 7497 - DNA, 35 bp, Artificial Sequence
  Synthetic
gcgtgggcgtgaactaccggtctgccgcccattcg

SEQ ID NO: 7498 - DNA, 41 bp, Artificial Sequence
  Synthetic
aattgttggaatccggcttgtttgaccttttctcaggagca

SEQ ID NO: 7499 - DNA, 37 bp, Artificial Sequence
  Synthetic
cgcgcgggtcttggacgaatccatcaggacggcttgg

SEQ ID NO: 7500 - DNA, 37 bp, Artificial Sequence
  Synthetic
tttgaccaactcggcaagcggtgtttccctgcgcggc

SEQ ID NO: 7501 - DNA, 35 bp, Artificial Sequence
  Synthetic
gcaccagttcgcccgcgatgctcatcgccatcggc

SEQ ID NO: 7502 - DNA, 37 bp, Artificial Sequence
  Synthetic
cgcccgtggcttctttacggcttttggacgacggcgc

SEQ ID NO: 7503 - DNA, 41 bp, Artificial Sequence
  Synthetic
aacgccgccatttccatatcggggtattgccgtgccgtatt

SEQ ID NO: 7504 - DNA, 39 bp, Artificial Sequence
  Synthetic
gcacttctaactccccgcccatttgcattgcgaactgcc

SEQ ID NO: 7505 - DNA, 45 bp, Artificial Sequence
  Synthetic
tttgcaaaggtctcagaatgccgcatatctgaaaagtgtattccg

SEQ ID NO: 7506 - DNA, 41 bp, Artificial Sequence
  Synthetic
agcgtaccgaccgacaatccgcgtgcaaaaatatccgcacc

SEQ ID NO: 7507 - DNA, 37 bp, Artificial Sequence
  Synthetic
cgtattccccgccggagagaacggcggtcagcgattc

SEQ ID NO: 7508 - DNA, 36 bp, Artificial Sequence
  Synthetic
aatacgcgatgcagctcgccggtgttggcgtggagc

SEQ ID NO: 7509 - DNA, 39 bp, Artificial Sequence
  Synthetic
aagctcgccatgcccttcgcggttgtccaaatcgaccag

SEQ ID NO: 7510 - DNA, 41 bp, Artificial Sequence
  Synthetic
ttccaaatcatcctgccccaccgagtgcttcgtaggcgttg

SEQ ID NO: 7511 - DNA, 38 bp, Artificial Sequence
  Synthetic
tgagccgccttctcgacaaccgctgtgtcggagttggc

SEQ ID NO: 7512 - DNA, 36 bp, Artificial Sequence
  Synthetic
attccgccatgccgtccggcttcgacgatggtgcag

SEQ ID NO: 7513 - DNA, 40 bp, Artificial Sequence
  Synthetic
cggcgtaatcgtcggctcgcccagagtttggtttcgacgg

SEQ ID NO: 7514 - DNA, 40 bp, Artificial Sequence
  Synthetic
cgcataccgcagcgaaatgcaaggtggaactgtgcggtaa

SEQ ID NO: 7515 - DNA, 37 bp, Artificial Sequence
  Synthetic
gcagcagcggaacacaaagcagttgccgggcgatgag

SEQ ID NO: 7516 - DNA, 39 bp, Artificial Sequence
  Synthetic
cggttccctaaggcgcccacgcaggcagtacaaatggta

SEQ ID NO: 7517 - DNA, 39 bp, Artificial Sequence
  Synthetic
tgcagaccggcaagctgttattcttgtttgccgccttcg

SEQ ID NO: 7518 - DNA, 35 bp, Artificial Sequence
  Synthetic
gcgggcgaactcgacgcttatcgccaccatcgggc

SEQ ID NO: 7519 - DNA, 39 bp, Artificial Sequence
  Synthetic
atgattttggacatcggcccgaaccggcggctttaagca

SEQ ID NO: 7520 - DNA, 40 bp, Artificial Sequence
  Synthetic
ggttggcgcagaagctgtttgcactacttctcgctgcacg

SEQ ID NO: 7521 - DNA, 40 bp, Artificial Sequence
  Synthetic
agacgacctgattattgcccgctctaccacggcgcagaag

SEQ ID NO: 7522 - DNA, 40 bp, Artificial Sequence
  Synthetic
aagggtttccaacaggctgctgtctgttcgagttggcaca

SEQ ID NO: 7523 - DNA, 39 bp, Artificial Sequence
  Synthetic
cgccgacctgttcgcaaatcgacagtatctggcgcgcct

SEQ ID NO: 7524 - DNA, 43 bp, Artificial Sequence
  Synthetic
aaatgccgtctgaacacattgccataagccgcaatatcaagtt

SEQ ID NO: 7525 - DNA, 38 bp, Artificial Sequence
  Synthetic
cgggctgccgtttaccatagtttcaacagatacgccgc

SEQ ID NO: 7526 - DNA, 43 bp, Artificial Sequence
  Synthetic
gttcaagtttcggctattgcaaatgataaaccaaatctgcggt

SEQ ID NO: 7527 - DNA, 41 bp, Artificial Sequence
  Synthetic
ccgcaacacaagggtatgatttgaagtaaaggctgcaattg

SEQ ID NO: 7528 - DNA, 39 bp, Artificial Sequence
  Synthetic
ccgcagttttgccctgtcctgtaaaaacctgccccaccc

SEQ ID NO: 7529 - DNA, 37 bp, Artificial Sequence
  Synthetic
tatcgacatcgggcacgctggaagggacggcggaact

SEQ ID NO: 7530 - DNA, 38 bp, Artificial Sequence
  Synthetic
gtaatcctgccgccgagcgcgatttgggcatcggcaac

SEQ ID NO: 7531 - DNA, 35 bp, Artificial Sequence
  Synthetic
ccgggcaatacggcatcgccctacgggcacaacgc

SEQ ID NO: 7532 - DNA, 38 bp, Artificial Sequence
  Synthetic
gcatcgggcggcttgtgtagacatccgttcgctcgatt

SEQ ID NO: 7533 - DNA, 40 bp, Artificial Sequence
  Synthetic
cgagatagccttgcgcggtcgtgttcgacaccgtcaacat

SEQ ID NO: 7534 - DNA, 40 bp, Artificial Sequence
  Synthetic
ggtacagcccgaagcgcaaagcagtatgtttcctcggctg

SEQ ID NO: 7535 - DNA, 38 bp, Artificial Sequence
  Synthetic
ggcagaggtgcggattagcgcgacggcaaaatcgggac

SEQ ID NO: 7536 - DNA, 38 bp, Artificial Sequence
  Synthetic
ttttccggccttctgcgagaaaggtatgtgcgcgaccg

SEQ ID NO: 7537 - DNA, 35 bp, Artificial Sequence
  Synthetic
agatgaggaggcagcgggccttctccggcggttgc

SEQ ID NO: 7538 - DNA, 43 bp, Artificial Sequence
  Synthetic
ggcatattaacaacatcaaccctgcttgtagctgcaatgaacg

SEQ ID NO: 7539 - DNA, 39 bp, Artificial Sequence
  Synthetic
cgatggggaggtttggaagctagtctgccaccctatccg

SEQ ID NO: 7540 - DNA, 39 bp, Artificial Sequence
  Synthetic
cgtaacctacgccgcccagctctatgatggcgggcatag

SEQ ID NO: 7541 - DNA, 36 bp, Artificial Sequence
  Synthetic
cggcatcttgtccgacggccaacacaccgacagccc

SEQ ID NO: 7542 - DNA, 35 bp, Artificial Sequence
  Synthetic
ggtaggaacgggcggtggtgcgcgcaaaccgatga

SEQ ID NO: 7543 - DNA, 36 bp, Artificial Sequence
  Synthetic
gcggatgggggacgttgagcgacggcggcaaaatcg

SEQ ID NO: 7544 - DNA, 37 bp, Artificial Sequence
  Synthetic
gcaaaggcggcttgggcaaattgttttggggcgcggt

SEQ ID NO: 7545 - DNA, 38 bp, Artificial Sequence
  Synthetic
tgattaccgccgtctccgccatgcagggtggtgaaggg

SEQ ID NO: 7546 - DNA, 39 bp, Artificial Sequence
  Synthetic
ctatcacgcaccggtctgctggcgggattgacggtttcg

SEQ ID NO: 7547 - DNA, 42 bp, Artificial Sequence
  Synthetic
ggcaggcgtatgcgaaagatgtcaagttcgggcgtaaccatc

SEQ ID NO: 7548 - DNA, 38 bp, Artificial Sequence
  Synthetic
ccatgcccagtttgcggatgcgcccgccaaagttaccg

SEQ ID NO: 7549 - DNA, 38 bp, Artificial Sequence
  Synthetic
gccggaagcggcttggtacggcctgttccaaaacgatt

SEQ ID NO: 7550 - DNA, 38 bp, Artificial Sequence
  Synthetic
catcggcaagattttcggtcgcaattgctgctggcgcg

SEQ ID NO: 7551 - DNA, 38 bp, Artificial Sequence
  Synthetic
gcagcagatgccggcgcatacagccgccaatagccgtc

SEQ ID NO: 7552 - DNA, 38 bp, Artificial Sequence
  Synthetic
gcctgttgcggcacttgctgatttgcgtttccaaaccc

SEQ ID NO: 7553 - DNA, 37 bp, Artificial Sequence
  Synthetic
cgaagcggcgggattcggaacttgagccggctgttcc

SEQ ID NO: 7554 - DNA, 40 bp, Artificial Sequence
  Synthetic
ttgtcgaacactttgccgaagcaaccgtcatacgcgacac

SEQ ID NO: 7555 - DNA, 38 bp, Artificial Sequence
  Synthetic
aacaaccgtccgatttggtgcgcccgaatccgcgctca

SEQ ID NO: 7556 - DNA, 38 bp, Artificial Sequence
  Synthetic
gcaatacgccgtcaaaaccccacgggcttgggtttgcc

SEQ ID NO: 7557 - DNA, 36 bp, Artificial Sequence
  Synthetic
gacagggcgcggtcgagttcgccggtttgcgtttgg

SEQ ID NO: 7558 - DNA, 39 bp, Artificial Sequence
  Synthetic
gcggttttcgcgccgtagcagacctgcaagcccaatacg

SEQ ID NO: 7559 - DNA, 39 bp, Artificial Sequence
  Synthetic
tcatcgtgagcgtgttcagacgtgggcaggcagagcatt

SEQ ID NO: 7560 - DNA, 35 bp, Artificial Sequence
  Synthetic
ggcatgacggcggacagttgcccgccgtttcagac

SEQ ID NO: 7561 - DNA, 40 bp, Artificial Sequence
  Synthetic
atttcggcaatcgataccgccgctccttcatcttccgccg

SEQ ID NO: 7562 - DNA, 38 bp, Artificial Sequence
  Synthetic
gcaaacacgccgccgacatgtttggcgatgacggtaac

SEQ ID NO: 7563 - DNA, 39 bp, Artificial Sequence
  Synthetic
cgaactttccggcggtcagaaccggattcaggcacaggg

SEQ ID NO: 7564 - DNA, 40 bp, Artificial Sequence
  Synthetic
gtcgaattcgtcctgaccgaggggtcgactttgccggaac

SEQ ID NO: 7565 - DNA, 40 bp, Artificial Sequence
  Synthetic
gttggcgatgctggtggtggagtggaaaaggacgaaccga

SEQ ID NO: 7566 - DNA, 35 bp, Artificial Sequence
  Synthetic
ccgcgtccgattccacgcttatggtcgtgccgccc

SEQ ID NO: 7567 - DNA, 37 bp, Artificial Sequence
  Synthetic
ggttcgcccgcttccagcacatcgtcggctgcacaca

SEQ ID NO: 7568 - DNA, 34 bp, Artificial Sequence
  Synthetic
tggcagccctctcgcctgaatggcgcggcggtaa

SEQ ID NO: 7569 - DNA, 40 bp, Artificial Sequence
  Synthetic
accttggttgccgcgactttcagtttggcatcagggtctt

SEQ ID NO: 7570 - DNA, 36 bp, Artificial Sequence
  Synthetic
aacggcgtggcgcaaggtcattttgccccgatgcgg

SEQ ID NO: 7571 - DNA, 40 bp, Artificial Sequence
  Synthetic
tttggcagaggcgctcaaagatgcttctcaatccggcaac

SEQ ID NO: 7572 - DNA, 37 bp, Artificial Sequence
  Synthetic
ccggcatcggcgatctcatctaacccaagccgacgcg

SEQ ID NO: 7573 - DNA, 42 bp, Artificial Sequence
  Synthetic
gtgccgtagtggttttcgagcagccaaacgggttttccttac

SEQ ID NO: 7574 - DNA, 39 bp, Artificial Sequence
  Synthetic
ggaagggcggcttcttctgccctttatatacgcggccgg

SEQ ID NO: 7575 - DNA, 39 bp, Artificial Sequence
  Synthetic
atgcgctgaaaacacccccgatggcgtagaacggtgtga

SEQ ID NO: 7576 - DNA, 47 bp, Artificial Sequence
  Synthetic
ggcatcgggaacttaatcaggggtttcagaccttttcctaattcaat

SEQ ID NO: 7577 - DNA, 37 bp, Artificial Sequence
  Synthetic
gcccgaagatttggtgtgccgtttcctgccctgccgc

SEQ ID NO: 7578 - DNA, 38 bp, Artificial Sequence
  Synthetic
atgagtatcgtgctgcacggcgtcaggtgggcgcaacc

SEQ ID NO: 7579 - DNA, 35 bp, Artificial Sequence
  Synthetic
ggccagccgtccgcattcaactgggaggcaggctg

SEQ ID NO: 7580 - DNA, 40 bp, Artificial Sequence
  Synthetic
cgacaacgccctgagcaagggcttaagcggaattggtcgc

SEQ ID NO: 7581 - DNA, 38 bp, Artificial Sequence
  Synthetic
tcgtctttggcggcgtcggcgtgaaaacggttcggtaa

SEQ ID NO: 7582 - DNA, 36 bp, Artificial Sequence
  Synthetic
gcgaggtaggcggtcagcacgaacgcctgcacgaag

SEQ ID NO: 7583 - DNA, 37 bp, Artificial Sequence
  Synthetic
cgtcggtgttgacggcaatgccggcctcaaacgcctc

SEQ ID NO: 7584 - DNA, 36 bp, Artificial Sequence
  Synthetic
gccgccggcattgtcgatagcccttgtccgcatcag

SEQ ID NO: 7585 - DNA, 38 bp, Artificial Sequence
  Synthetic
cggaaggattgcaggcttttgggccgcacctgtccatg

SEQ ID NO: 7586 - DNA, 36 bp, Artificial Sequence
  Synthetic
tcaaacagagcccgacgtgggcggcagccaaaaccc

SEQ ID NO: 7587 - DNA, 36 bp, Artificial Sequence
  Synthetic
gcgtgaaggtcgccaaaggcccgccgttgtgcgaaa

SEQ ID NO: 7588 - DNA, 47 bp, Artificial Sequence
  Synthetic
cgttttcctgatgttccgtcttgataataaaaattctggcaaccatc

SEQ ID NO: 7589 - DNA, 37 bp, Artificial Sequence
  Synthetic
cgggctgtccgtccgtatcgaatcccgaacccgaccc

SEQ ID NO: 7590 - DNA, 37 bp, Artificial Sequence
  Synthetic
attcatcgcggcaggttgacggaacgacgccggcaac

SEQ ID NO: 7591 - DNA, 38 bp, Artificial Sequence
  Synthetic
caggcctcaacccatcctgcgttttcctggatggcggc

SEQ ID NO: 7592 - DNA, 38 bp, Artificial Sequence
  Synthetic
aagctccctgccgtggattttgactgacccgccgcttc

SEQ ID NO: 7593 - DNA, 38 bp, Artificial Sequence
  Synthetic
cggggacgcggatttcagacgcccttaccgcccatcaa

SEQ ID NO: 7594 - DNA, 39 bp, Artificial Sequence
  Synthetic
gttccgcgccgatgatgcgatcctcaactggtcgctcaa

SEQ ID NO: 7595 - DNA, 39 bp, Artificial Sequence
  Synthetic
tgatgttgacggcgcagtggcagcaccacaaaccagacc

SEQ ID NO: 7596 - DNA, 38 bp, Artificial Sequence
  Synthetic
gatgacgggcgcgacgtgtttggaaaaacaccgcccga

SEQ ID NO: 7597 - DNA, 38 bp, Artificial Sequence
  Synthetic
aaagacggcttcatgcgtgcgtcttccaaccctccgcc

SEQ ID NO: 7598 - DNA, 36 bp, Artificial Sequence
  Synthetic
gaagcccagtccgacgacgtaagctcgccgttgccg

SEQ ID NO: 7599 - DNA, 39 bp, Artificial Sequence
  Synthetic
cgtatggcgaggcggtcgacttgggctacctgcaccata

SEQ ID NO: 7600 - DNA, 38 bp, Artificial Sequence
  Synthetic
gcgaaattttgccgcctactgccatcttcgtcggcggc

SEQ ID NO: 7601 - DNA, 40 bp, Artificial Sequence
  Synthetic
gcctgcctgaaaggttcggacaccggtatggaaacactgc

SEQ ID NO: 7602 - DNA, 39 bp, Artificial Sequence
  Synthetic
gacgatgccgcgctgctgtatggttgccgagattgtcct

SEQ ID NO: 7603 - DNA, 36 bp, Artificial Sequence
  Synthetic
gtagccgcgtttgagggcgcaacaggcgcaaaacgg

SEQ ID NO: 7604 - DNA, 36 bp, Artificial Sequence
  Synthetic
tcgccttcggcatagggacactgcggcaagaccacc

SEQ ID NO: 7605 - DNA, 41 bp, Artificial Sequence
  Synthetic
cccgcgccggtaatcagaatcgttggaaaaaaccgtggacg

SEQ ID NO: 7606 - DNA, 41 bp, Artificial Sequence
  Synthetic
actttgccgagcatatagccgctgattttgggtctgccgac

SEQ ID NO: 7607 - DNA, 39 bp, Artificial Sequence
  Synthetic
cgcgaagggcagtacgtccgtcatgctgcccatcgtatt

SEQ ID NO: 7608 - DNA, 38 bp, Artificial Sequence
  Synthetic
atgccgtatcacgttccccctccgccgccaaagtcaga

SEQ ID NO: 7609 - DNA, 35 bp, Artificial Sequence
  Synthetic
gacgccgcctacgcactcaacggcattcacgcccg

SEQ ID NO: 7610 - DNA, 38 bp, Artificial Sequence
  Synthetic
acaccttggctcgttccaaaggcaataagacgggacat

SEQ ID NO: 7611 - DNA, 38 bp, Artificial Sequence
  Synthetic
atcaggtaggcaaacaccgccatgctgctggggcggta

SEQ ID NO: 7612 - DNA, 39 bp, Artificial Sequence
  Synthetic
ccaaggcgaggacggtgcaccccattttggagacaccct

SEQ ID NO: 7613 - DNA, 38 bp, Artificial Sequence
  Synthetic
cgtcatacaggcgcgggctgaacactggagcttcagcg

SEQ ID NO: 7614 - DNA, 37 bp, Artificial Sequence
  Synthetic
ttccgcgctgcaacacgctcatgcagtcggtcgtcag

SEQ ID NO: 7615 - DNA, 35 bp, Artificial Sequence
  Synthetic
ccgttaccggggttctgcgaccggctcgaaccagc

SEQ ID NO: 7616 - DNA, 39 bp, Artificial Sequence
  Synthetic
acctgaacgccttgtcctccaggtaaacacgacgcaggc

SEQ ID NO: 7617 - DNA, 35 bp, Artificial Sequence
  Synthetic
gttggcgggttggatgggcttccctctgaccggcc

SEQ ID NO: 7618 - DNA, 34 bp, Artificial Sequence
  Synthetic
gccgcatttcaaagcggcggcgcagtgccgaaca

SEQ ID NO: 7619 - DNA, 39 bp, Artificial Sequence
  Synthetic
cgaacctgccgatgccgtattgcatcggcaactcggcac

SEQ ID NO: 7620 - DNA, 35 bp, Artificial Sequence
  Synthetic
gtttgttggcggtaggcgcaagcggcatccgggac

SEQ ID NO: 7621 - DNA, 38 bp, Artificial Sequence
  Synthetic
cgcgcgttccgaacccaagatccgaaatacaccaccgc

SEQ ID NO: 7622 - DNA, 37 bp, Artificial Sequence
  Synthetic
gatgccggaaccgacaccgccgcatccgtttgaagcc

SEQ ID NO: 7623 - DNA, 40 bp, Artificial Sequence
  Synthetic
cgccttcaaaccccaagccggctttatacgggcagcatcg

SEQ ID NO: 7624 - DNA, 36 bp, Artificial Sequence
  Synthetic
gcgcggcgttcgtcttgtaccgaaccgatgaaaggc

SEQ ID NO: 7625 - DNA, 35 bp, Artificial Sequence
  Synthetic
gcggggaggccgtctgaattttgccgactgcgccg

SEQ ID NO: 7626 - DNA, 37 bp, Artificial Sequence
  Synthetic
cgctcttcaatcagcgtgcccgcgctacggcaaccct

SEQ ID NO: 7627 - DNA, 34 bp, Artificial Sequence
  Synthetic
ggcatgcgccgcattgtgtctgcggcggttttgc

SEQ ID NO: 7628 - DNA, 36 bp, Artificial Sequence
  Synthetic
tggcccggcgtgttttcccggcggtatagacggcag

SEQ ID NO: 7629 - DNA, 38 bp, Artificial Sequence
  Synthetic
cctgggctttgctgatgacgcgggtgcgtggcttttcg

SEQ ID NO: 7630 - DNA, 35 bp, Artificial Sequence
  Synthetic
ggcggccagcagcttgtctgctcaggcggaatggc

SEQ ID NO: 7631 - DNA, 35 bp, Artificial Sequence
  Synthetic
gttgcgcgcgtctgtggtgcaacgatgcctggagg

SEQ ID NO: 7632 - DNA, 42 bp, Artificial Sequence
  Synthetic
agtcatcgtcttcatcgtcgccttgccggtgctttgaatcag

SEQ ID NO: 7633 - DNA, 37 bp, Artificial Sequence
  Synthetic
ccagccgccgcctttcctttcggcgacaacctcttga

SEQ ID NO: 7634 - DNA, 35 bp, Artificial Sequence
  Synthetic
gccgtctgaacgcgaccgtcattcgaccagcgcgg

SEQ ID NO: 7635 - DNA, 41 bp, Artificial Sequence
  Synthetic
tcggtttgattcctaccggcgacaaaatacccaaggcggcg

SEQ ID NO: 7636 - DNA, 40 bp, Artificial Sequence
  Synthetic
cctgctgaaaaaagccgatgccttcgtcctgttgcagcag

SEQ ID NO: 7637 - DNA, 38 bp, Artificial Sequence
  Synthetic
gtcgccgtcagccattattgcccccaaacggtgcagtc

SEQ ID NO: 7638 - DNA, 39 bp, Artificial Sequence
  Synthetic
ttgccgcttctgatcgattgccagccgactgttcctgcc

SEQ ID NO: 7639 - DNA, 38 bp, Artificial Sequence
  Synthetic
taccgcgaacgcatgagggcccgaccgcttcatctgcg

SEQ ID NO: 7640 - DNA, 38 bp, Artificial Sequence
  Synthetic
agggcgcgggtcatatcggcggggcattaccgtcaact

SEQ ID NO: 7641 - DNA, 35 bp, Artificial Sequence
  Synthetic
ggcaatggcgacgcgttggcccatcggatcgaacg

SEQ ID NO: 7642 - DNA, 40 bp, Artificial Sequence
  Synthetic
ggcgaggaacatcgtctgcacaaatgtacgcccccatcaa

SEQ ID NO: 7643 - DNA, 38 bp, Artificial Sequence
  Synthetic
ggcgatgaaggcggcaagagccctgattgccattttcg

SEQ ID NO: 7644 - DNA, 36 bp, Artificial Sequence
  Synthetic
gcagccatggtgcgtccgaactcgcccggacaagtc

SEQ ID NO: 7645 - DNA, 41 bp, Artificial Sequence
  Synthetic
catgagttgtgccagttccgccgtccgccggaaattcgaca

SEQ ID NO: 7646 - DNA, 38 bp, Artificial Sequence
  Synthetic
tggagacaacatgtagcgcaccatatctcgcacacagc

SEQ ID NO: 7647 - DNA, 46 bp, Artificial Sequence
  Synthetic
gacagttggtgtcctaattgtaacaaatggcaaaagatgtagcaag

SEQ ID NO: 7648 - DNA, 46 bp, Artificial Sequence
  Synthetic
aaaggaggttattgtttgaggacactgaacattatggttttcagct

SEQ ID NO: 7649 - DNA, 48 bp, Artificial Sequence
  Synthetic
acagctgacgttaattagccacccccattgaatcattttagaaagttc

SEQ ID NO: 7650 - DNA, 45 bp, Artificial Sequence
  Synthetic
atcccttgcgaaatctaaatatgcagcaaattgatcagagcttgt

SEQ ID NO: 7651 - DNA, 44 bp, Artificial Sequence
  Synthetic
tttggagtgtgcattacaaaaatgacagacctcctagaagagct

SEQ ID NO: 7652 - DNA, 42 bp, Artificial Sequence
  Synthetic
aacctaaacttgggtcccctggtgtttcttcttgtgtaaccc

SEQ ID NO: 7653 - DNA, 42 bp, Artificial Sequence
  Synthetic
tattgcagtgattgatacaccaggacactgcgtctattgtgg

SEQ ID NO: 7654 - DNA, 43 bp, Artificial Sequence
  Synthetic
acaagacaggttttaaatgtcaccggtgtcaaaggcgggattt

SEQ ID NO: 7655 - DNA, 47 bp, Artificial Sequence
  Synthetic
accaccagcatttaatgtaaaagtgtctgttacaggatgatacacta

SEQ ID NO: 7656 - DNA, 44 bp, Artificial Sequence
  Synthetic
agtaggggttcaaattgatagaggtcgatccagtaaagggtgac

SEQ ID NO: 7657 - DNA, 43 bp, Artificial Sequence
  Synthetic
aaggagatagtttacctacagacccgaggagtaccatcagctg

SEQ ID NO: 7658 - DNA, 49 bp, Artificial Sequence
  Synthetic
acttgatgagtgggaattagcattttatctgtaagtatcttccaaaccc

SEQ ID NO: 7659 - DNA, 47 bp, Artificial Sequence
  Synthetic
gacctatgtgtaagtgaccaatagcaggaaacagaatgattcaacat

SEQ ID NO: 7660 - DNA, 50 bp, Artificial Sequence
  Synthetic
aaatcgaaacaaacaaatttgcagcgaaaatctgaatacatgaagcatac

SEQ ID NO: 7661 - DNA, 44 bp, Artificial Sequence
  Synthetic
cgagattggagtgacaaggagagtggatgtgtgtattctcagat

SEQ ID NO: 7662 - DNA, 39 bp, Artificial Sequence
  Synthetic
cggtccaaattcctgctgatgtattccctccccttcgtg

SEQ ID NO: 7663 - DNA, 43 bp, Artificial Sequence
  Synthetic
aaagtgggcacttggtgagaatgtctctacagttgtcaaagtc

SEQ ID NO: 7664 - DNA, 48 bp, Artificial Sequence
  Synthetic
aggaattacttcacagcagaggtatacccccttcattatatattctgt

SEQ ID NO: 7665 - DNA, 42 bp, Artificial Sequence
  Synthetic
gcatggagttttctctcactgacaggacacagtacttctccc

SEQ ID NO: 7666 - DNA, 43 bp, Artificial Sequence
  Synthetic
tgagaataaatcagaaacatggcccctgcagaccttcccaatg

SEQ ID NO: 7667 - DNA, 38 bp, Artificial Sequence
  Synthetic
agcgataggaggggatgctaggctagccccgctgctct

SEQ ID NO: 7668 - DNA, 37 bp, Artificial Sequence
  Synthetic
tgggatgctcctcccgattcctcccgccattcctggg

SEQ ID NO: 7669 - DNA, 38 bp, Artificial Sequence
  Synthetic
tccttcggatgcccaggtcgtttcctcttcgggtcggc

SEQ ID NO: 7670 - DNA, 36 bp, Artificial Sequence
  Synthetic
cgctcccctcgttccacctaagaatagccggcccgc

SEQ ID NO: 7671 - DNA, 39 bp, Artificial Sequence
  Synthetic
aaggcctcttcctaggtccggaaggatggagagggggct

SEQ ID NO: 7672 - DNA, 39 bp, Artificial Sequence
  Synthetic
agagaacgacccagaacgctacacactgtacctgcaaat

SEQ ID NO: 7673 - DNA, 42 bp, Artificial Sequence
  Synthetic
attggggccagaagaaaaacaaagccctgctatttcgtgaaa

SEQ ID NO: 7674 - DNA, 43 bp, Artificial Sequence
  Synthetic
ttggactatgaacaatttgacagcttcttgtccagcttgtctg

SEQ ID NO: 7675 - DNA, 43 bp, Artificial Sequence
  Synthetic
ggggtgtacagggtggttttcattgtctgtttcatcatctgat

SEQ ID NO: 7676 - DNA, 40 bp, Artificial Sequence
  Synthetic
actaggtagtcagaacagccctgtattctgctgactgtcg

SEQ ID NO: 7677 - DNA, 38 bp, Artificial Sequence
  Synthetic
ggaggacgcggacaaagaaatattttctcctggcacgc

SEQ ID NO: 7678 - DNA, 42 bp, Artificial Sequence
  Synthetic
acagaagcttggacaatgcgaacaatgtttaggttctgtcat

SEQ ID NO: 7679 - DNA, 39 bp, Artificial Sequence
  Synthetic
tggactttaaacaagaggcggaccacacacatgtacagc

SEQ ID NO: 7680 - DNA, 39 bp, Artificial Sequence
  Synthetic
ccactgtcaccacagctgccggcctccacttgtactgtg

SEQ ID NO: 7681 - DNA, 41 bp, Artificial Sequence
  Synthetic
acctacatttagtggtggcaatggatgtccaacacagcagg

SEQ ID NO: 7682 - DNA, 44 bp, Artificial Sequence
  Synthetic
cgcaaaggtactgtacgctatagttccactacgtgttttcatag

SEQ ID NO: 7683 - DNA, 47 bp, Artificial Sequence
  Synthetic
taccagttccaagatatgcctccgtaacattggtagtggaagtatta

SEQ ID NO: 7684 - DNA, 38 bp, Artificial Sequence
  Synthetic
tttcagatggctttgtggcgttgacaacccgagacaca

SEQ ID NO: 7685 - DNA, 39 bp, Artificial Sequence
  Synthetic
tggattgcctgatccacagtacttcaacaccaacacagg

SEQ ID NO: 7686 - DNA, 41 bp, Artificial Sequence
  Synthetic
gggattgcccccccttagaagtatcaatcatatcgccatcc

SEQ ID NO: 7687 - DNA, 38 bp, Artificial Sequence
  Synthetic
gggatgctatacccaccactagaagatgtagggggctc

SEQ ID NO: 7688 - DNA, 46 bp, Artificial Sequence
  Synthetic
acaactgtatgtaatgtaaaggcgtaacacataaccatgcatacat

SEQ ID NO: 7689 - DNA, 40 bp, Artificial Sequence
  Synthetic
ccaccttagtatgtaggcggcggggccatccaagtcaagc

SEQ ID NO: 7690 - DNA, 38 bp, Artificial Sequence
  Synthetic
ttgcgaggggatctgggagtgcgcaggtacaggacttg

SEQ ID NO: 7691 - DNA, 42 bp, Artificial Sequence
  Synthetic
tggagtcaactgggctactggtcaggccaaagatagcagaca

SEQ ID NO: 7692 - DNA, 40 bp, Artificial Sequence
  Synthetic
acacccttccaattggactggccacaggtcacaagagcgc

SEQ ID NO: 7693 - DNA, 43 bp, Artificial Sequence
  Synthetic
cgaggggatgtatggttaaattcaaatagtgcagtacgatggc

SEQ ID NO: 7694 - DNA, 39 bp, Artificial Sequence
  Synthetic
gtaccccacctgtggtacgtcctgtggctaggtctttca

SEQ ID NO: 7695 - DNA, 42 bp, Artificial Sequence
  Synthetic
tggagggctgacaataccaccttgagcaaagaagccaaaacg

SEQ ID NO: 7696 - DNA, 48 bp, Artificial Sequence
  Synthetic
gttagggcccatagaatgttggtcactaagaggaaaaacttaagaaca

SEQ ID NO: 7697 - DNA, 38 bp, Artificial Sequence
  Synthetic
cgccagatgggtgggccattgccacgttcagagagaca

SEQ ID NO: 7698 - DNA, 40 bp, Artificial Sequence
  Synthetic
gtcccttactcggtgctcttgcaccaatgaccccagtcgt

SEQ ID NO: 7699 - DNA, 43 bp, Artificial Sequence
  Synthetic
tcttacatgcaggagaagtatgaggtcgcgtgcatgtactttg

SEQ ID NO: 7700 - DNA, 48 bp, Artificial Sequence
  Synthetic
acatgccaacataactgagattcaatcttcagattttcctccttaatc

SEQ ID NO: 7701 - DNA, 38 bp, Artificial Sequence
  Synthetic
caacctgggttacctgcgatatgaaggttcggggttga

SEQ ID NO: 7702 - DNA, 43 bp, Artificial Sequence
  Synthetic
cctcatgcagctacaatccttgggattgtcaggtaaagtgact

SEQ ID NO: 7703 - DNA, 42 bp, Artificial Sequence
  Synthetic
gtctactccgcgttcaatccggccctgctgttgtcaaagcaa

SEQ ID NO: 7704 - DNA, 47 bp, Artificial Sequence
  Synthetic
ggactagtcttgtcgtcaattatggtgtgatctcccattttctcata

SEQ ID NO: 7705 - DNA, 40 bp, Artificial Sequence
  Synthetic
ccatgccgatgcccctgttgtgcacatccaattgcagtga

SEQ ID NO: 7706 - DNA, 39 bp, Artificial Sequence
  Synthetic
caactcgggccatcactagtgttctaagctccgcatccc

SEQ ID NO: 7707 - DNA, 41 bp, Artificial Sequence
  Synthetic
ttgcagaagtgtgtcgaggcaagacctcctcctttggaact

SEQ ID NO: 7708 - DNA, 42 bp, Artificial Sequence
  Synthetic
aactcagtgaccaacaccgagcgtcctccagcgtataactgc

SEQ ID NO: 7709 - DNA, 41 bp, Artificial Sequence
  Synthetic
tgcagacaaacaagcaatgcgttcttgtggtgcacccatca

SEQ ID NO: 7710 - DNA, 41 bp, Artificial Sequence
  Synthetic
gcatcattgctggtgtgcacggatctcagcgttggtgtagc

SEQ ID NO: 7711 - DNA, 43 bp, Artificial Sequence
  Synthetic
attgtgatgtttactccccggaacttctgcaatcttctctgtg

SEQ ID NO: 7712 - DNA, 40 bp, Artificial Sequence
  Synthetic
tggtctgaaggggatgacgtcctcctcacccacccgagac

SEQ ID NO: 7713 - DNA, 46 bp, Artificial Sequence
  Synthetic
gaattcaactcccccccaaacgatacactatctctgttatgtttct

SEQ ID NO: 7714 - DNA, 39 bp, Artificial Sequence
  Synthetic
tggggacatctgggtgacaaccaagggcaaattggtaac

SEQ ID NO: 7715 - DNA, 43 bp, Artificial Sequence
  Synthetic
aacgggggatgataaaaatgcaaatactatctacaagcctccc

SEQ ID NO: 7716 - DNA, 42 bp, Artificial Sequence
  Synthetic
atcctggtgtcagatgtgtcttgtttatatctacgatgggcc

SEQ ID NO: 7717 - DNA, 42 bp, Artificial Sequence
  Synthetic
aatgacgtgtggatgggaagatcaatgactttgaaggtttca

SEQ ID NO: 7718 - DNA, 38 bp, Artificial Sequence
  Synthetic
agaagtcagtggcgaggttttgatatcaggttgtgccc

SEQ ID NO: 7719 - DNA, 40 bp, Artificial Sequence
  Synthetic
ggacagctttcctttgtgtgcttagttaggtctgccatgg

SEQ ID NO: 7720 - DNA, 43 bp, Artificial Sequence
  Synthetic
ggaattccctggcgttttacagctctgatattgctttattgca

SEQ ID NO: 7721 - DNA, 49 bp, Artificial Sequence
  Synthetic
agctgatactcagataagtgtaccccacagcttttctattactacatct

SEQ ID NO: 7722 - DNA, 48 bp, Artificial Sequence
  Synthetic
ttgcttgttggcaatatatggatgtcaatagatacagcattaccatct

SEQ ID NO: 7723 - DNA, 40 bp, Artificial Sequence
  Synthetic
gaagcgtcgacgagctgcagcctgatggggctgatgatga

SEQ ID NO: 7724 - DNA, 47 bp, Artificial Sequence
  Synthetic
ctcttggaagagttcagcgactgaccttttaaaattaggatgaatgg

SEQ ID NO: 7725 - DNA, 38 bp, Artificial Sequence
  Synthetic
ccggaaggtgcaccaacaaatgggccttgtaactgatg

SEQ ID NO: 7726 - DNA, 50 bp, Artificial Sequence
  Synthetic
ttcaactacagaaacctcagtttgcttccaagtctactaaatctgactaa

SEQ ID NO: 7727 - DNA, 41 bp, Artificial Sequence
  Synthetic
atcctccagaacaaacagacgatctgaacctgtttgggatc

SEQ ID NO: 7728 - DNA, 43 bp, Artificial Sequence
  Synthetic
tggcctgatcttataaaaatggagctgctcccgttttgtgaaa

SEQ ID NO: 7729 - DNA, 40 bp, Artificial Sequence
  Synthetic
acaacatgtgcagacaaactgaagccagtaacaaaagcgg

SEQ ID NO: 7730 - DNA, 43 bp, Artificial Sequence
  Synthetic
aaatggaacgtgttaccctggaactaaaaagtgtcctgagttc

SEQ ID NO: 7731 - DNA, 45 bp, Artificial Sequence
  Synthetic
tgtggggcatacatcacccagtgtcgtttcttatgtacaaatttg

SEQ ID NO: 7732 - DNA, 41 bp, Artificial Sequence
  Synthetic
ggagggagccatggaagaatattgcactacacaattaccac

SEQ ID NO: 7733 - DNA, 46 bp, Artificial Sequence
  Synthetic
tggtttccagcattcaaatgatcaagccttttgagttgaatcccta

SEQ ID NO: 7734 - DNA, 43 bp, Artificial Sequence
  Synthetic
ctatataacaaggtgaagagggcacctcgaaacagcctttccc

SEQ ID NO: 7735 - DNA, 39 bp, Artificial Sequence
  Synthetic
aaacccgctcaatgcccggcactactcggctagcagtct

SEQ ID NO: 7736 - DNA, 36 bp, Artificial Sequence
  Synthetic
gcaggggccctaaattgggttccacggggttgcgac

SEQ ID NO: 7737 - DNA, 36 bp, Artificial Sequence
  Synthetic
cgagcttcggagcagtcacgaaggcagcccctcctg

SEQ ID NO: 7738 - DNA, 39 bp, Artificial Sequence
  Synthetic
gggcggtactgttggtcaaggtacgaactgcaactgccg

SEQ ID NO: 7739 - DNA, 40 bp, Artificial Sequence
  Synthetic
gatgacaagccgtattgctggcactggaccgcagacatcc

SEQ ID NO: 7740 - DNA, 39 bp, Artificial Sequence
  Synthetic
ggccaacaggcaacaacagcacccacatctggtgtaggt

SEQ ID NO: 7741 - DNA, 40 bp, Artificial Sequence
  Synthetic
cttcacacctacgcccgctcgccgtagaggtattgggtgt

SEQ ID NO: 7742 - DNA, 42 bp, Artificial Sequence
  Synthetic
gcttggcttggcatgtcaagggacggactaagagtagtggcc

SEQ ID NO: 7743 - DNA, 42 bp, Artificial Sequence
  Synthetic
cgtgacgctgtcatcatgctcacccagtatcccgaagaggat

SEQ ID NO: 7744 - DNA, 42 bp, Artificial Sequence
  Synthetic
ggagacgaaggtcatcacgtgggctgataccggaagaacagc

SEQ ID NO: 7745 - DNA, 42 bp, Artificial Sequence
  Synthetic
cggttctaagacccttgctggccccaccaggtctttgtctac

SEQ ID NO: 7746 - DNA, 38 bp, Artificial Sequence
  Synthetic
gtgtgcacgcggggtgttgtggtctccaggttttcgac

SEQ ID NO: 7747 - DNA, 39 bp, Artificial Sequence
  Synthetic
taggactgtcaccaccggagccgtcggcgaagaacttgc

SEQ ID NO: 7748 - DNA, 38 bp, Artificial Sequence
  Synthetic
agaggtctagacgtcgccgtgtcatgagcgcgtcagtg

SEQ ID NO: 7749 - DNA, 42 bp, Artificial Sequence
  Synthetic
accggtatgtttcgtctggggaactcacagagcaccacagag

SEQ ID NO: 7750 - DNA, 38 bp, Artificial Sequence
  Synthetic
gctgggggccgttcagaatggtctgcggacatgcaagc

SEQ ID NO: 7751 - DNA, 35 bp, Artificial Sequence
  Synthetic
tctaggagggtgggtggccaacgacgaacgcggtg

SEQ ID NO: 7752 - DNA, 39 bp, Artificial Sequence
  Synthetic
caggcgagggggctgtacagtatgattgccccgggaagc

SEQ ID NO: 7753 - DNA, 40 bp, Artificial Sequence
  Synthetic
catgccagaaggggtacaagggcagatatcgtcgctccgc

SEQ ID NO: 7754 - DNA, 40 bp, Artificial Sequence
  Synthetic
gaggattcaccgcttcgcgcccacggagaaagtaacctcc

SEQ ID NO: 7755 - DNA, 40 bp, Artificial Sequence
  Synthetic
acaaggccaccacccagatgcatgcactgtctccatagca

SEQ ID NO: 7756 - DNA, 40 bp, Artificial Sequence
  Synthetic
ttccgcggaggaaaaggaagcccggccatgacttgggaca

SEQ ID NO: 7757 - DNA, 41 bp, Artificial Sequence
  Synthetic
gctcatcaccccttgctctgctggcgtaataaggtgttgct

SEQ ID NO: 7758 - DNA, 42 bp, Artificial Sequence
  Synthetic
tcgctctctcgacaagaaagcctcggcaatggggtatcagag

SEQ ID NO: 7759 - DNA, 40 bp, Artificial Sequence
  Synthetic
gagagccaggggacacacgaggagtacctggtcatagcct

SEQ ID NO: 7760 - DNA, 42 bp, Artificial Sequence
  Synthetic
ctacagagccaggaacagctggagatccagcggagtaacaga

SEQ ID NO: 7761 - DNA, 40 bp, Artificial Sequence
  Synthetic
actgggcggtgaagacaaaacgggacaagtccagccggtc

SEQ ID NO: 7762 - DNA, 41 bp, Artificial Sequence
  Synthetic
cgagtaactcgtccctcttctgtgatgatcgactgcaacac

SEQ ID NO: 7763 - DNA, 39 bp, Artificial Sequence
  Synthetic
gcgtactgccccagcttgaaggccgtgattggtgcttaa

SEQ ID NO: 7764 - DNA, 44 bp, Artificial Sequence
  Synthetic
gtgttgaaaagaaaaagactgaggggagatgcaacagggtacac

SEQ ID NO: 7765 - DNA, 44 bp, Artificial Sequence
  Synthetic
ccatactggcattactggtgacacgactcagtatctcaaggaga

SEQ ID NO: 7766 - DNA, 39 bp, Artificial Sequence
  Synthetic
ccactgtgtggttttccctcatttgctgcatcaagtgtg

SEQ ID NO: 7767 - DNA, 44 bp, Artificial Sequence
  Synthetic
tgtacaacagacttctcagtggttaggcctgagtttttcaacag

SEQ ID NO: 7768 - DNA, 40 bp, Artificial Sequence
  Synthetic
gaagtcttcatcgctcaaagcagagtagttgcagctgctc

SEQ ID NO: 7769 - DNA, 45 bp, Artificial Sequence
  Synthetic
tactggctacaaacaatgtctttcgtcttctccaaaggttacacc

SEQ ID NO: 7770 - DNA, 43 bp, Artificial Sequence
  Synthetic
tgatgaaacctgtgaacatgagtaccaccaaattccagaggga

SEQ ID NO: 7771 - DNA, 39 bp, Artificial Sequence
  Synthetic
gaaacatggtggtggtgtagcccttttgcatggcaccat

SEQ ID NO: 7772 - DNA, 39 bp, Artificial Sequence
  Synthetic
gtgcagacggttcgtacacaccatgacaacctgctcata

SEQ ID NO: 7773 - DNA, 44 bp, Artificial Sequence
  Synthetic
ctagtggtgatatcacttgtgttgtgagagcatctcagtagtgc

SEQ ID NO: 7774 - DNA, 41 bp, Artificial Sequence
  Synthetic
cataatggcaaccatccaacgttagtcaacgatgccctctt

SEQ ID NO: 7775 - DNA, 45 bp, Artificial Sequence
  Synthetic
aagacatctgaggagcactttgtctgaataggaccaatctctgta

SEQ ID NO: 7776 - DNA, 44 bp, Artificial Sequence
  Synthetic
cttgatgagagttttcttggtaggtaccaccaacttgaggaaat

SEQ ID NO: 7777 - DNA, 42 bp, Artificial Sequence
  Synthetic
ttaacgggtgtagaagctgtgacacacacatggaatggaaac

SEQ ID NO: 7778 - DNA, 47 bp, Artificial Sequence
  Synthetic
aaggaaacatcttacactacaaccaattttggttcaatctctgtgta

SEQ ID NO: 7779 - DNA, 46 bp, Artificial Sequence
  Synthetic
agacactattcagcgagtttcaagaggttaatgtgccaaacaattg

SEQ ID NO: 7780 - DNA, 47 bp, Artificial Sequence
  Synthetic
aacacaagagttaggtcatgaggatcttaatggtaatgcttgtgttt

SEQ ID NO: 7781 - DNA, 44 bp, Artificial Sequence
  Synthetic
tgcagcatttgtttaagtggattaggaaatcgtcacctgaatgg

SEQ ID NO: 7782 - DNA, 44 bp, Artificial Sequence
  Synthetic
tggaagagctatgttcatatcatggttgcgcttatagcacatca

SEQ ID NO: 7783 - DNA, 43 bp, Artificial Sequence
  Synthetic
agtgttgctgtgaaaaatggcgggatgtctctcataggtcttt

SEQ ID NO: 7784 - DNA, 42 bp, Artificial Sequence
  Synthetic
tacagctcacagcgagttagcacacgaatgtagaaaggacac

SEQ ID NO: 7785 - DNA, 43 bp, Artificial Sequence
  Synthetic
aattcgtagtgctgccaagaagtgtctagttgtagcacaagtt

SEQ ID NO: 7786 - DNA, 40 bp, Artificial Sequence
  Synthetic
tttagccagcgtggtggttctgatagcagctactacaggg

SEQ ID NO: 7787 - DNA, 42 bp, Artificial Sequence
  Synthetic
cactcgttatgtgcttatggatggctaacagaaccctccagg

SEQ ID NO: 7788 - DNA, 43 bp, Artificial Sequence
  Synthetic
tattgccatattggtgacttgtgcactcaccaaaaacacgtct

SEQ ID NO: 7789 - DNA, 45 bp, Artificial Sequence
  Synthetic
agacactgttgccacttacacaccactgaaatacttgtacttgtt

SEQ ID NO: 7790 - DNA, 42 bp, Artificial Sequence
  Synthetic
aggaaaatggcattcccgtcagttccacaggttacttgtacc

SEQ ID NO: 7791 - DNA, 44 bp, Artificial Sequence
  Synthetic
atccaacctggtcaaacattttcacactgataaacaccagatgg

SEQ ID NO: 7792 - DNA, 43 bp, Artificial Sequence
  Synthetic
tgacatattgggacctctttctgcctttcaaagcagcacacat

SEQ ID NO: 7793 - DNA, 41 bp, Artificial Sequence
  Synthetic
gtttacgagaatgctttcttgcccaagcagcatagcacatg

SEQ ID NO: 7794 - DNA, 43 bp, Artificial Sequence
  Synthetic
gctagagctatagtgtttgtgtgtctgtaaggtgttgccagta

SEQ ID NO: 7795 - DNA, 44 bp, Artificial Sequence
  Synthetic
aaaccatgtatcaaggttgctactgtaccacagatgtgcacttt

SEQ ID NO: 7796 - DNA, 40 bp, Artificial Sequence
  Synthetic
gcgaggaaatgctcgataaccaagcggcatatgatggtaa

SEQ ID NO: 7797 - DNA, 45 bp, Artificial Sequence
  Synthetic
acaatgctcttcactatgcttaggcgcattgttgataatgttgtt

SEQ ID NO: 7798 - DNA, 43 bp, Artificial Sequence
  Synthetic
cggctggtaccacacaaacagaattgttatagtaggcaagtgc

SEQ ID NO: 7799 - DNA, 47 bp, Artificial Sequence
  Synthetic
ttcaactgtgctttccttctgtgtaggtaatccttatatgctttagc

SEQ ID NO: 7800 - DNA, 40 bp, Artificial Sequence
  Synthetic
agaaacacagtctgtaccgtctgactgcatcaagggttcg

SEQ ID NO: 7801 - DNA, 46 bp, Artificial Sequence
  Synthetic
cgtcagcgtctaactaaatacacattaccctcatcaaaatgacgta

SEQ ID NO: 7802 - DNA, 43 bp, Artificial Sequence
  Synthetic
aatcaggatcttaatgggaactggtcaataggaactccgcagc

SEQ ID NO: 7803 - DNA, 44 bp, Artificial Sequence
  Synthetic
tctactgtgtttccacctacaagtcaacaaaaggaacaccatct

SEQ ID NO: 7804 - DNA, 48 bp, Artificial Sequence
  Synthetic
agacttttatgactttgctgtgtctgaagtgttttagttcaacagaac

SEQ ID NO: 7805 - DNA, 41 bp, Artificial Sequence
  Synthetic
ttgaagtcaatagccgccactccgtaaaacttgcttgttcc

SEQ ID NO: 7806 - DNA, 42 bp, Artificial Sequence
  Synthetic
agtgtgcgcaagtattaagtgagatgatgttccacctggttt

SEQ ID NO: 7807 - DNA, 47 bp, Artificial Sequence
  Synthetic
tgtgtgctataacagtaactatgcgactgccttaaagttcttaatgc

SEQ ID NO: 7808 - DNA, 47 bp, Artificial Sequence
  Synthetic
acatgatgagcttactggccacgtgttatcattagttagcattacgg

SEQ ID NO: 7809 - DNA, 43 bp, Artificial Sequence
  Synthetic
aatgccccaggttgtgatgtgcaataatagctcatacctccta

SEQ ID NO: 7810 - DNA, 39 bp, Artificial Sequence
  Synthetic
tggtattgccactgtacgcgaacctcccatgaaagatgc

SEQ ID NO: 7811 - DNA, 43 bp, Artificial Sequence
  Synthetic
atgttgcaaattatcaaaaggtcggcttaccagtaccaggtgg

SEQ ID NO: 7812 - DNA, 41 bp, Artificial Sequence
  Synthetic
agacttcgtgcaaaacactacgcctttagtcagcaatgtgc

SEQ ID NO: 7813 - DNA, 49 bp, Artificial Sequence
  Synthetic
acagacctcaaataggcgttgtaaggagataaaaacagcttttctccaa

SEQ ID NO: 7814 - DNA, 46 bp, Artificial Sequence
  Synthetic
atgtggctacattacaagcagaaatgaagaccagtaatgatcttac

SEQ ID NO: 7815 - DNA, 41 bp, Artificial Sequence
  Synthetic
tagagggctgtcatgcaactcctgtagaaaatcctagctgg

SEQ ID NO: 7816 - DNA, 46 bp, Artificial Sequence
  Synthetic
tgaagtactttgtcaagattggacctgaagtagaaaagcaagttgc

SEQ ID NO: 7817 - DNA, 44 bp, Artificial Sequence
  Synthetic
ttgctgataagtttccagttcttcaattctacttcagcctgagg

SEQ ID NO: 7818 - DNA, 45 bp, Artificial Sequence
  Synthetic
atgtgaataagcatgcattccacagtaaaagaaaggcaattgctt

SEQ ID NO: 7819 - DNA, 43 bp, Artificial Sequence
  Synthetic
aaaggacactttgatggacacgacctttgtgtaaacagcatta

SEQ ID NO: 7820 - DNA, 46 bp, Artificial Sequence
  Synthetic
ttgatggtagagtggaaggacagtgttattaaaacaccattacggg

SEQ ID NO: 7821 - DNA, 41 bp, Artificial Sequence
  Synthetic
gctatgccttcgaacacatcgtaatgaagaccgccaagttg

SEQ ID NO: 7822 - DNA, 43 bp, Artificial Sequence
  Synthetic
gtaaggatggacatgttgaaaccttgttaggcatcgcaacacc

SEQ ID NO: 7823 - DNA, 43 bp, Artificial Sequence
  Synthetic
ctgtgcaacagtacatacggcctagggtcatacatatcgctaa

SEQ ID NO: 7824 - DNA, 45 bp, Artificial Sequence
  Synthetic
tggctataccatgcatgctaactggaagacaactggataggattt

SEQ ID NO: 7825 - DNA, 50 bp, Artificial Sequence
  Synthetic
tgcactttcgagtacatatctgatgctcgtaagtgtttaaaattacctga

SEQ ID NO: 7826 - DNA, 43 bp, Artificial Sequence
  Synthetic
aaatggtacaatcacagatgctgtcagagcatttgagttcagc

SEQ ID NO: 7827 - DNA, 45 bp, Artificial Sequence
  Synthetic
atgcagattcttttgtagtcaaggggcaataacaccagtttgtcc

SEQ ID NO: 7828 - DNA, 46 bp, Artificial Sequence
  Synthetic
tatggtttttacaccactactggcaccggtgcatttaaaagttcaa

SEQ ID NO: 7829 - DNA, 45 bp, Artificial Sequence
  Synthetic
tcaagatgttaactgcactgatgtcagtagaatatatgcgccaag

SEQ ID NO: 7830 - DNA, 44 bp, Artificial Sequence
  Synthetic
acagaagtaatgcctgtttctatgggtagaatctccgcagatgt

SEQ ID NO: 7831 - DNA, 43 bp, Artificial Sequence
  Synthetic
taatgctagagatctcatttgtgcgatcagtgagcagaggtgg

SEQ ID NO: 7832 - DNA, 43 bp, Artificial Sequence
  Synthetic
gcaagctgcaagacgttgttgctaagttgtttaacaagtgtgt

SEQ ID NO: 7833 - DNA, 41 bp, Artificial Sequence
  Synthetic
acatgtcacgtatgtgccatccgagggaagtatgctttgcc

SEQ ID NO: 7834 - DNA, 45 bp, Artificial Sequence
  Synthetic
catcaccagatgttgatcttggcttttgaatgttgacgacagaag

SEQ ID NO: 7835 - DNA, 43 bp, Artificial Sequence
  Synthetic
gtggttcttgctgcaagtttgtaatttgacacccttgagaact

SEQ ID NO: 7836 - DNA, 43 bp, Artificial Sequence
  Synthetic
attcacatcttttgcttgtcgctatcaaggcatagaggtacaa

SEQ ID NO: 7837 - DNA, 45 bp, Artificial Sequence
  Synthetic
cgaagtttactaccagcttgagttgtagcattttcaataccagtg

SEQ ID NO: 7838 - DNA, 44 bp, Artificial Sequence
  Synthetic
agtcacactagccatccttactgcacgttaacaatattgcagca

SEQ ID NO: 7839 - DNA, 45 bp, Artificial Sequence
  Synthetic
taaagcttgttttcctctggctcattaattctgtagacagcagca

SEQ ID NO: 7840 - DNA, 42 bp, Artificial Sequence
  Synthetic
actgtggctacatcacgaacgcgcaaaacctgaatcagtgcc

SEQ ID NO: 7841 - DNA, 40 bp, Artificial Sequence
  Synthetic
agtgtgttagaggtacgactgtttgccctcgtatgttcct

SEQ ID NO: 7842 - DNA, 44 bp, Artificial Sequence
  Synthetic
gcttgaagatccttgtaaggtacaacctttcctagagcacaaag

SEQ ID NO: 7843 - DNA, 39 bp, Artificial Sequence
  Synthetic
agcgccgaccccaaggtttactccttgccatgctgagtg

SEQ ID NO: 7844 - DNA, 40 bp, Artificial Sequence
  Synthetic
acaatgctgccaccgtgctatctgcgtagaagccttttgg

SEQ ID NO: 7845 - DNA, 41 bp, Artificial Sequence
  Synthetic
gctgaggcatctaaaaagccttgagtgacgttgtactgttt

SEQ ID NO: 7846 - DNA, 46 bp, Artificial Sequence
  Synthetic
aagcacattgacgcatacaaaaccagtctttttctttttgtccttt

SEQ ID NO: 7847 - DNA, 43 bp, Artificial Sequence
  Synthetic
tcaatgtgtaacattagggaggacttaccctcgatcgtactcc

SEQ ID NO: 7848 - DNA, 43 bp, Artificial Sequence
  Synthetic
accaataggtgacaatcatccagacatatcctcattgaccggg

SEQ ID NO: 7849 - DNA, 42 bp, Artificial Sequence
  Synthetic
ttgacaaggtgtgaagagccgcaaggttagccacattcaggg

SEQ ID NO: 7850 - DNA, 46 bp, Artificial Sequence
  Synthetic
gttgggacacactccacacaaagctgcgtctttaaaataattgatg

SEQ ID NO: 7851 - DNA, 44 bp, Artificial Sequence
  Synthetic
cagacagactaatacagataacccgacaccataagcaacaactg

SEQ ID NO: 7852 - DNA, 48 bp, Artificial Sequence
  Synthetic
ttaccattttctagggagatctggactgatgaaacttgctagaattac

SEQ ID NO: 7853 - DNA, 49 bp, Artificial Sequence
  Synthetic
ggtaacttacctatttatccccaccgtaaaataagggtagctgaattgt

SEQ ID NO: 7854 - DNA, 43 bp, Artificial Sequence
  Synthetic
taccagttatgttaacacctggatcaaacgctgatggggattg

SEQ ID NO: 7855 - DNA, 43 bp, Artificial Sequence
  Synthetic
ttagccactactctcataggagaacaaagcgcagactaccagt

SEQ ID NO: 7856 - DNA, 42 bp, Artificial Sequence
  Synthetic
agtccaccgcctcactagttggtgtagtgaatctaaaatggc

SEQ ID NO: 7857 - DNA, 42 bp, Artificial Sequence
  Synthetic
ttaaatgaagttcttgtggtgccatttccgcagcatccaatg

SEQ ID NO: 7858 - DNA, 43 bp, Artificial Sequence
  Synthetic
aaatgcatctgtgttctggcagctcataaaagggattgtgaat

SEQ ID NO: 7859 - DNA, 41 bp, Artificial Sequence
  Synthetic
ttgcctatcaacacacacactcaatctgagttgtggcctca

SEQ ID NO: 7860 - DNA, 46 bp, Artificial Sequence
  Synthetic
tccctaattgtgattgcactgaatgccaatcatgtgcagtaactct

SEQ ID NO: 7861 - DNA, 41 bp, Artificial Sequence
  Synthetic
ctgaggagcaagggttatctgacgaagcctacaccaaagac

SEQ ID NO: 7862 - DNA, 45 bp, Artificial Sequence
  Synthetic
ggctccagcttagctatgtacatcacgcttcagtaaatttcttga

SEQ ID NO: 7863 - DNA, 46 bp, Artificial Sequence
  Synthetic
ttgatgggtatgatcaacagagtgtcttcaccactaggattttgca

SEQ ID NO: 7864 - DNA, 45 bp, Artificial Sequence
  Synthetic
ttaccagcaatggcaagaaggttttgccatctaaaagatactctt

SEQ ID NO: 7865 - DNA, 41 bp, Artificial Sequence
  Synthetic
gggaacctaaacccaaaagcagacaaactcttcctctgggc

SEQ ID NO: 7866 - DNA, 46 bp, Artificial Sequence
  Synthetic
ccatgagggtgttaagctagagatctgatgtctttaaacttctcat

SEQ ID NO: 7867 - DNA, 46 bp, Artificial Sequence
  Synthetic
ttcttggtatacatgttggtggcaaataagatttgagaagcattgc

SEQ ID NO: 7868 - DNA, 41 bp, Artificial Sequence
  Synthetic
tggttcagcagtagggtgtgattctccatctagcatgagag

SEQ ID NO: 7869 - DNA, 42 bp, Artificial Sequence
  Synthetic
cgccactctttccttatacaccggtttttggtccatctgatg

SEQ ID NO: 7870 - DNA, 39 bp, Artificial Sequence
  Synthetic
tctgccattcgcattttgcacacccagaacaaagcaaat

SEQ ID NO: 7871 - DNA, 45 bp, Artificial Sequence
  Synthetic
agactctctaaattcaaatgtggcgaaaatggaaagcacttctgc

SEQ ID NO: 7872 - DNA, 47 bp, Artificial Sequence
  Synthetic
gtatgcaacaaatcatattgccacctgtttgctcagatttaacatct

SEQ ID NO: 7873 - DNA, 49 bp, Artificial Sequence
  Synthetic
actgggatgcagttagaaaagaaagcaaacctaaattagaatatccttc

SEQ ID NO: 7874 - DNA, 41 bp, Artificial Sequence
  Synthetic
ctagctcctcacggacttttttctatgtggtgttcgaggtg

SEQ ID NO: 7875 - DNA, 45 bp, Artificial Sequence
  Synthetic
aaacagaaacatcaaaggtgctagttgggtaaagtcacagtttct

SEQ ID NO: 7876 - DNA, 42 bp, Artificial Sequence
  Synthetic
gttccattagttgaaggtacccctttctccccctactcctgg

SEQ ID NO: 7877 - DNA, 42 bp, Artificial Sequence
  Synthetic
cctgaatttttggtacagccttcctacatctgggtcaaaggc

SEQ ID NO: 7878 - DNA, 50 bp, Artificial Sequence
  Synthetic
tgtaggtgatggactttttgtagcactcaactggtaaattatttggtagt

SEQ ID NO: 7879 - DNA, 43 bp, Artificial Sequence
  Synthetic
tggtctggagattaatagggctgcctgtagaaccaacacctaa

SEQ ID NO: 7880 - DNA, 48 bp, Artificial Sequence
  Synthetic
ttactcatgcaggaactataggtgagtctctagtatcatccacctttc

SEQ ID NO: 7881 - DNA, 41 bp, Artificial Sequence
  Synthetic
agttggcttttattcctcctgcggcacatagttgccaaaga

SEQ ID NO: 7882 - DNA, 43 bp, Artificial Sequence
  Synthetic
cccatggggttggtataaatacagagttgtccagatgtccagc

SEQ ID NO: 7883 - DNA, 42 bp, Artificial Sequence
  Synthetic
aatttgctggcttcagaagagtcgatttgttggctcctcctc

SEQ ID NO: 7884 - DNA, 46 bp, Artificial Sequence
  Synthetic
attgtggaagaagcagattgtgttgctttgttcaaataagtcatct

SEQ ID NO: 7885 - DNA, 41 bp, Artificial Sequence
  Synthetic
ggcagcagtacacatttctcctcaattccactgtcctgaaa

SEQ ID NO: 7886 - DNA, 48 bp, Artificial Sequence
  Synthetic
tcctagcactttatgaaaaaggagcctttctacttagttcccaatgtt

SEQ ID NO: 7887 - DNA, 40 bp, Artificial Sequence
  Synthetic
agaagtccttctccgctgaaacggtgaggattctctatgc

SEQ ID NO: 7888 - DNA, 40 bp, Artificial Sequence
  Synthetic
gcccactgcaccaactcctgattgtgcgacggaactgatc

SEQ ID NO: 7889 - DNA, 40 bp, Artificial Sequence
  Synthetic
tccctcagttgtgcctttgctccagtgtctgtaatgggaa

SEQ ID NO: 7890 - DNA, 44 bp, Artificial Sequence
  Synthetic
cccagacttcattagacagccttaatgtatatgtcacgtcatcg

SEQ ID NO: 7891 - DNA, 39 bp, Artificial Sequence
  Synthetic
tggtacaatttgcgcgggaacaggctgtaaatacgaccg

SEQ ID NO: 7892 - DNA, 48 bp, Artificial Sequence
  Synthetic
gctgaaaaattacactgttggttcggttttttatccattccaaagcag

SEQ ID NO: 7893 - DNA, 45 bp, Artificial Sequence
  Synthetic
tgaagcatttgaaatagcagaaggctcagggtttaggtacatgac

SEQ ID NO: 7894 - DNA, 43 bp, Artificial Sequence
  Synthetic
tgaatggaatgggaaagggagacaatgttgttttgcagctctt

SEQ ID NO: 7895 - DNA, 39 bp, Artificial Sequence
  Synthetic
gtggagaacgccagaatgctccaattccaccaaccattc

SEQ ID NO: 7896 - DNA, 40 bp, Artificial Sequence
  Synthetic
gatcaggagaatttggcgtcaaatgtgagtgagaccagca

SEQ ID NO: 7897 - DNA, 39 bp, Artificial Sequence
  Synthetic
tcctgagaggatcagtggccccatatccactggccacgg

SEQ ID NO: 7898 - DNA, 45 bp, Artificial Sequence
  Synthetic
cccaaggggacaactatctactagccattgtttccatgttctcat

SEQ ID NO: 7899 - DNA, 48 bp, Artificial Sequence
  Synthetic
ctgctggttttgaagtttataacgccaatcattaggtcttcttcgaaa

SEQ ID NO: 7900 - DNA, 45 bp, Artificial Sequence
  Synthetic
cctgggcttggaaaaacccagcatttggattttctaatagtacag

SEQ ID NO: 7901 - DNA, 45 bp, Artificial Sequence
  Synthetic
aatgacagttattcccatcgaagaaatttctttgacggtaacacc

SEQ ID NO: 7902 - DNA, 44 bp, Artificial Sequence
  Synthetic
ggaaattatcccgatacagaccgtattgaaaacaacctccgtct

SEQ ID NO: 7903 - DNA, 45 bp, Artificial Sequence
  Synthetic
cagtgtactaactgtcagcatgtgagactttcatggttgcagtac

SEQ ID NO: 7904 - DNA, 46 bp, Artificial Sequence
  Synthetic
tgatcccaatgttggtatggtagaaggtgtaatcaattctgtcaat

SEQ ID NO: 7905 - DNA, 46 bp, Artificial Sequence
  Synthetic
ttaaacctgttttggaagatgggaacctttaacaacttttgcttca

SEQ ID NO: 7906 - DNA, 47 bp, Artificial Sequence
  Synthetic
tcaggcgttgataaattaaccagagtgctgtaaaataggttccaagg

SEQ ID NO: 7907 - DNA, 48 bp, Artificial Sequence
  Synthetic
tcaagaaccttgacgttacctttacataaaagtacttcctatctgtgc

SEQ ID NO: 7908 - DNA, 42 bp, Artificial Sequence
  Synthetic
ccatgtgatgggccaattcactctgtcaagagttaacgaaat

SEQ ID NO: 7909 - DNA, 46 bp, Artificial Sequence
  Synthetic
atggttccttattcaaagatggggtcgtaaaatggaaactgaagca

SEQ ID NO: 7910 - DNA, 45 bp, Artificial Sequence
  Synthetic
atcaattaggagatgccacaacaagtttgagaggtaagataaggc

SEQ ID NO: 7911 - DNA, 41 bp, Artificial Sequence
  Synthetic
tgagagaggctagaacaacttccgacggtttagtggaggtc

SEQ ID NO: 7912 - DNA, 50 bp, Artificial Sequence
  Synthetic
aaggcagagttgatctcttaggagagattttattaacacccactacacta

SEQ ID NO: 7913 - DNA, 39 bp, Artificial Sequence
  Synthetic
tcatgtgatgcgataaccaccgggcgtctagttggacta

SEQ ID NO: 7914 - DNA, 45 bp, Artificial Sequence
  Synthetic
tttagctgataccggtcttaaaagtgcatgtaacacattcccaaa

SEQ ID NO: 7915 - DNA, 44 bp, Artificial Sequence
  Synthetic
gataccatgcttaaagatgggttgattcggctgttatacccatg

SEQ ID NO: 7916 - DNA, 41 bp, Artificial Sequence
  Synthetic
tcaaagatgaggggacagtaactataaaattgccgctgctc

SEQ ID NO: 7917 - DNA, 44 bp, Artificial Sequence
  Synthetic
tttgggtcacccgattggagcatttctgctaataaggtgactaa

SEQ ID NO: 7918 - DNA, 42 bp, Artificial Sequence
  Synthetic
tgacaaaggcacaaaagacttaactttttccaacaccgcgat

SEQ ID NO: 7919 - DNA, 40 bp, Artificial Sequence
  Synthetic
ctaactgtgtagcctgcttgcatttgcttttcggtgatgc

SEQ ID NO: 7920 - DNA, 46 bp, Artificial Sequence
  Synthetic
gacttgtccctttgatagaggtgcaccaatacatacaaagaccaaa

SEQ ID NO: 7921 - DNA, 50 bp, Artificial Sequence
  Synthetic
accggcttttttagaataaccaacacagttataattacatgcttaaaggc

SEQ ID NO: 7922 - DNA, 43 bp, Artificial Sequence
  Synthetic
tttgtcaacaaatttgggttcggtgttaataacgccaatagcc

SEQ ID NO: 7923 - DNA, 40 bp, Artificial Sequence
  Synthetic
aacggcaatcgcatgcttaggccttattttttgcagcaag

SEQ ID NO: 7924 - DNA, 47 bp, Artificial Sequence
  Synthetic
tggctcagaagctacaaaaacccgccattagtcaaaatataatccaa

SEQ ID NO: 7925 - DNA, 50 bp, Artificial Sequence
  Synthetic
aatcagatgctctttacgttgttgacaacttctttaaaatctacttcacc

SEQ ID NO: 7926 - DNA, 45 bp, Artificial Sequence
  Synthetic
attgacttactcagatggttcagacctgaactcacccttgtcaaa

SEQ ID NO: 7927 - DNA, 43 bp, Artificial Sequence
  Synthetic
caagctattcagtttgcttttgacctttggcatcttgacctgc

SEQ ID NO: 7928 - DNA, 44 bp, Artificial Sequence
  Synthetic
attaccctgttgaccaagcaaacacagattgtttgaaagactgg

SEQ ID NO: 7929 - DNA, 45 bp, Artificial Sequence
  Synthetic
acgtaaccctaaatcaaatgaacctaaaagtggtgtcatcaaaca

SEQ ID NO: 7930 - DNA, 46 bp, Artificial Sequence
  Synthetic
acgatcggttacagaaatcaagtcagtgtcaccgtattttacagta

SEQ ID NO: 7931 - DNA, 41 bp, Artificial Sequence
  Synthetic
tctgccacctctcaaccgactgttgggacatcagatggtgt

SEQ ID NO: 7932 - DNA, 39 bp, Artificial Sequence
  Synthetic
ggcttcaaccacaaacagcagcctggacggtaaccacta

SEQ ID NO: 7933 - DNA, 44 bp, Artificial Sequence
  Synthetic
tcatgttcatgtctcctttaatgctaaaaactcacgcctaaacg

SEQ ID NO: 7934 - DNA, 43 bp, Artificial Sequence
  Synthetic
aaggggtagatcagaaatcagctcgaataaggaaaacagctgc

SEQ ID NO: 7935 - DNA, 43 bp, Artificial Sequence
  Synthetic
tcgtttgattcacaagagaggaaagactgtttaccgagcgtat

SEQ ID NO: 7936 - DNA, 46 bp, Artificial Sequence
  Synthetic
tattgcttacctagaatcacacgacccacctgaatatcagtgactt

SEQ ID NO: 7937 - DNA, 45 bp, Artificial Sequence
  Synthetic
tcatcctaaagtgttttaccaggactgttttatggttgctgtagc

SEQ ID NO: 7938 - DNA, 43 bp, Artificial Sequence
  Synthetic
acaagaaaattgaggagtgtacaggtcaacaggtaccccaagg

SEQ ID NO: 7939 - DNA, 42 bp, Artificial Sequence
  Synthetic
ttgggggacaacagaagacttaagaatatggccgttgacaaa

SEQ ID NO: 7940 - DNA, 41 bp, Artificial Sequence
  Synthetic
gtgaaagccagttgacctatgttaaaatcagccgccttagt

SEQ ID NO: 7941 - DNA, 42 bp, Artificial Sequence
  Synthetic
gaacagcggaatgcacgtattaattgccaacaaatctctgta

SEQ ID NO: 7942 - DNA, 40 bp, Artificial Sequence
  Synthetic
ttttcggcggttcagaagttaaatctggtagggccgtaaa

SEQ ID NO: 7943 - DNA, 46 bp, Artificial Sequence
  Synthetic
agtcactttcattttagtgggatcatctcacaagtacctcaatcag

SEQ ID NO: 7944 - DNA, 44 bp, Artificial Sequence
  Synthetic
gcccaaggcagtaatcatttcaatcacttcacaggattcgtaaa

SEQ ID NO: 7945 - DNA, 41 bp, Artificial Sequence
  Synthetic
ttgtcctagttgtacgaggagagttcaatactggccaggct

SEQ ID NO: 7946 - DNA, 45 bp, Artificial Sequence
  Synthetic
tgaagtggttacagcattagaatcacctacagtagaaccaggaaa

SEQ ID NO: 7947 - DNA, 43 bp, Artificial Sequence
  Synthetic
acagaagtgaactcttgtcttgaactcgagtttgatgccacag

SEQ ID NO: 7948 - DNA, 47 bp, Artificial Sequence
  Synthetic
ttttggatcgtgaagtaacgcaaagacgtattcttaactgtcttgaa

SEQ ID NO: 7949 - DNA, 47 bp, Artificial Sequence
  Synthetic
caggctattgctgatgaattagacgaccagtctgtaaactagacaaa

SEQ ID NO: 7950 - DNA, 43 bp, Artificial Sequence
  Synthetic
tctttgactgctatgggagaagcacaggtgcttctaaggtaac

SEQ ID NO: 7951 - DNA, 47 bp, Artificial Sequence
  Synthetic
cgtaaacgtaaatcagaagcagctagttctaattgtgagaactgttt

SEQ ID NO: 7952 - DNA, 46 bp, Artificial Sequence
  Synthetic
ataacggctcctaaaaagctaccttgaaaacatcactcaattgtca

SEQ ID NO: 7953 - DNA, 43 bp, Artificial Sequence
  Synthetic
agcgttaatattgtcgatgtcattgaaagcccgagataatgcc

SEQ ID NO: 7954 - DNA, 40 bp, Artificial Sequence
  Synthetic
gcagtacttgctagccaacacgcatcctcatgaagtgtca

SEQ ID NO: 7955 - DNA, 44 bp, Artificial Sequence
  Synthetic
ctttcgaaatcgtatcatgtttcccacgtcctgaaaaggcaata

SEQ ID NO: 7956 - DNA, 43 bp, Artificial Sequence
  Synthetic
tgatggtgacgatgctggaccgacaacaaaatctttaagcaat

SEQ ID NO: 7957 - DNA, 43 bp, Artificial Sequence
  Synthetic
atgcattaaggattcaagataggcacaagattgctgacggctt

SEQ ID NO: 7958 - DNA, 46 bp, Artificial Sequence
  Synthetic
tcaagcggctctagaagtactagaatttcctctattccatttttcg

SEQ ID NO: 7959 - DNA, 48 bp, Artificial Sequence
  Synthetic
atttgctgttacatgtgattgatgcttaaaaccactttttcttgctca

SEQ ID NO: 7960 - DNA, 45 bp, Artificial Sequence
  Synthetic
tacacgtttgaccaagaaatagaggtcaagtctccattgctgttt

SEQ ID NO: 7961 - DNA, 44 bp, Artificial Sequence
  Synthetic
actgaccaaccatcttttgaggaccataagcttttccagacaaa

SEQ ID NO: 7962 - DNA, 48 bp, Artificial Sequence
  Synthetic
gctcttagccaaacattttctggttgtaaatcataaattctcgttggg

SEQ ID NO: 7963 - DNA, 50 bp, Artificial Sequence
  Synthetic
ttaccaggatttttatcaagtcggtccataaatatcaagatctgtctgtt

SEQ ID NO: 7964 - DNA, 44 bp, Artificial Sequence
  Synthetic
cagaagccttaaaagcagcgggaccatttttaattttgccaaag

SEQ ID NO: 7965 - DNA, 48 bp, Artificial Sequence
  Synthetic
tcttgctcaatcatgtatcagctcgaacattttcaaatatagtggcgg

SEQ ID NO: 7966 - DNA, 42 bp, Artificial Sequence
  Synthetic
attaccaatccagtagccattgagatcaatacggccatagcg

SEQ ID NO: 7967 - DNA, 45 bp, Artificial Sequence
  Synthetic
cccttcgcttagaattagcggataaagcttggtcaaaaaacttgg

SEQ ID NO: 7968 - DNA, 41 bp, Artificial Sequence
  Synthetic
acttgtctcaactgcatgatcctcgaattcttggcacagct

SEQ ID NO: 7969 - DNA, 42 bp, Artificial Sequence
  Synthetic
acgggttgctaaaatgtatgcggccgtaaactcctctttagg

SEQ ID NO: 7970 - DNA, 42 bp, Artificial Sequence
  Synthetic
catgaccatgcgaggcatcactttccttatataagcctctgg

SEQ ID NO: 7971 - DNA, 38 bp, Artificial Sequence
  Synthetic
tcatcgacgttggtggagaattcatcggtagcgcttac

SEQ ID NO: 7972 - DNA, 45 bp, Artificial Sequence
  Synthetic
tctaggcaatagagcacaagcatcaacccaaatattgttttttgg

SEQ ID NO: 7973 - DNA, 47 bp, Artificial Sequence
  Synthetic
ccagttgatgtgaggacttatggattctgttcttctttaaaggctcc

SEQ ID NO: 7974 - DNA, 41 bp, Artificial Sequence
  Synthetic
agctttttaacgaatttccgcctatcggtgggttttccttt

SEQ ID NO: 7975 - DNA, 48 bp, Artificial Sequence
  Synthetic
ggtcgtgtgaggcatgaaaaatgctccaaatagcaagatatcaatgtc

SEQ ID NO: 7976 - DNA, 42 bp, Artificial Sequence
  Synthetic
aatcactacgagctatcacgcacaaaacaagccaaggcatat

SEQ ID NO: 7977 - DNA, 41 bp, Artificial Sequence
  Synthetic
tatccgctaaggtgcttacccagccatatccctagctgaaa

SEQ ID NO: 7978 - DNA, 43 bp, Artificial Sequence
  Synthetic
atcggattggtggtgtggaatctgccacattaatcataaaacc

SEQ ID NO: 7979 - DNA, 45 bp, Artificial Sequence
  Synthetic
aagagccccacaaccacagagttaccaactttattagaacctgta

SEQ ID NO: 7980 - DNA, 40 bp, Artificial Sequence
  Synthetic
aagactagggcaagggaccatctgtcttgacaatgggtat

SEQ ID NO: 7981 - DNA, 40 bp, Artificial Sequence
  Synthetic
cgcccgcagactgtctgttgggggtctgtgtcttgtttgt

SEQ ID NO: 7982 - DNA, 43 bp, Artificial Sequence
  Synthetic
aaatggtaaccaaaaaggatcctgtgtgtaaaaaatgcggccg

SEQ ID NO: 7983 - DNA, 48 bp, Artificial Sequence
  Synthetic
ttttccatcatgagatttgaccactaacattgttacacatatgggata

SEQ ID NO: 7984 - DNA, 41 bp, Artificial Sequence
  Synthetic
aaatggcacctggtgtttgtgcaaagtcaagagcaagactc

SEQ ID NO: 7985 - DNA, 43 bp, Artificial Sequence
  Synthetic
catcactatttccaatttggacagcgtggtggttcaggtacag

SEQ ID NO: 7986 - DNA, 44 bp, Artificial Sequence
  Synthetic
gattggggcaaagtaatgacgttgagcttagagaggaagacttt

SEQ ID NO: 7987 - DNA, 48 bp, Artificial Sequence
  Synthetic
ctttgatcaagttggatttaggtgcctaaaagataagcgtcaagaagg

SEQ ID NO: 7988 - DNA, 44 bp, Artificial Sequence
  Synthetic
ggatacccgtgatgccaatattgatgttctggtgaaggaatgtt

SEQ ID NO: 7989 - DNA, 42 bp, Artificial Sequence
  Synthetic
accagcatcatttctccagagtacaaacaggtctcttgagaa

SEQ ID NO: 7990 - DNA, 48 bp, Artificial Sequence
  Synthetic
ttccagcaattttatagaggctgtccttatgaagaccaactgactttc

SEQ ID NO: 7991 - DNA, 39 bp, Artificial Sequence
  Synthetic
aaagggcttgtcctccatacaacgtgaccatcccagaaa

SEQ ID NO: 7992 - DNA, 40 bp, Artificial Sequence
  Synthetic
ggaaacgagcatagttgagcaaaccaaaccatcgaagttg

SEQ ID NO: 7993 - DNA, 43 bp, Artificial Sequence
  Synthetic
tggaatgttaatcaaagtgtcacgctcaatgtcggcaaccatg

SEQ ID NO: 7994 - DNA, 47 bp, Artificial Sequence
  Synthetic
acagactctgttaaaaaagcatcgtcttacagctcgtagacctatag

SEQ ID NO: 7995 - DNA, 44 bp, Artificial Sequence
  Synthetic
acacttgactttcaattgttcgaaacggtatgtctattgcagct

SEQ ID NO: 7996 - DNA, 47 bp, Artificial Sequence
  Synthetic
ttgctgtcatcataccaatacgatgctacggtactatatggggctaa

SEQ ID NO: 7997 - DNA, 42 bp, Artificial Sequence
  Synthetic
accactcgaatactagttacttgcatgggagcacagattgtc

SEQ ID NO: 7998 - DNA, 41 bp, Artificial Sequence
  Synthetic
caacctgtgttgttccttttgcctgctcaggttaagtcagc

SEQ ID NO: 7999 - DNA, 46 bp, Artificial Sequence
  Synthetic
gctttttgagcttgagtacgcatcaagaggatattttagaagcttg

SEQ ID NO: 8000 - DNA, 41 bp, Artificial Sequence
  Synthetic
atcaaccgtaacaaagttcaccagcaacgattactgacgct

SEQ ID NO: 8001 - DNA, 43 bp, Artificial Sequence
  Synthetic
agacattttttcgcccttaccagcatgctccatataaggctat

SEQ ID NO: 8002 - DNA, 40 bp, Artificial Sequence
  Synthetic
tgaccctggatgagtgaagcatcaatcatttggtggcaaa

SEQ ID NO: 8003 - DNA, 42 bp, Artificial Sequence
  Synthetic
ggtacagcacgccagatgatgatcaatcactcttacccattt

SEQ ID NO: 8004 - DNA, 45 bp, Artificial Sequence
  Synthetic
atggtcaccaaggataaccaattcagtacattgtgacagaacacc

SEQ ID NO: 8005 - DNA, 46 bp, Artificial Sequence
  Synthetic
tgtcatggtattcaatttcagcctcaacctgtttattggtcatggt

SEQ ID NO: 8006 - DNA, 41 bp, Artificial Sequence
  Synthetic
gattccttgcttagccaagactccttatgtacctggttggg

SEQ ID NO: 8007 - DNA, 43 bp, Artificial Sequence
  Synthetic
aactccttttaaacaaacttgcgaccacgagctttcgtccttt

SEQ ID NO: 8008 - DNA, 45 bp, Artificial Sequence
  Synthetic
ggctcagtcgtagaatcagattgttgatgaaagcaataaggagtt

SEQ ID NO: 8009 - DNA, 46 bp, Artificial Sequence
  Synthetic
actaagaagcaattgaatagcctgcagacttcttctcagtgtcatt

SEQ ID NO: 8010 - DNA, 38 bp, Artificial Sequence
  Synthetic
cccttgaccaacggaccatagataagcgtgaggtcggt

SEQ ID NO: 8011 - DNA, 42 bp, Artificial Sequence
  Synthetic
ctgtgttcggcatgggtacatgggttatgaaaatagcacatt

SEQ ID NO: 8012 - DNA, 41 bp, Artificial Sequence
  Synthetic
tctcaaatttcctacgcccgcgctgggttcagaacgtcgtg

SEQ ID NO: 8013 - DNA, 42 bp, Artificial Sequence
  Synthetic
cctgctcgagttgtagctctcgggttccctcagattggttgg

SEQ ID NO: 8014 - DNA, 41 bp, Artificial Sequence
  Synthetic
aagtcagcaccccttctcccggcctcaggtgatcgagagaa

SEQ ID NO: 8015 - DNA, 44 bp, Artificial Sequence
  Synthetic
ttccaatcgtccggtttagttagcgccaacaggttgatattcct

SEQ ID NO: 8016 - DNA, 45 bp, Artificial Sequence
  Synthetic
actcgactagtgagctattacgcgacaactaggatgttagcttag

SEQ ID NO: 8017 - DNA, 42 bp, Artificial Sequence
  Synthetic
cacctttccctcacggtactggggaccatctcccaaccctaa

SEQ ID NO: 8018 - DNA, 41 bp, Artificial Sequence
  Synthetic
gaaaggaggtgatccagccgcgatgattggggtgaagtcgt

SEQ ID NO: 8019 - DNA, 40 bp, Artificial Sequence
  Synthetic
catcggcttcggcattagctgacggactttctgaagaaga

SEQ ID NO: 8020 - DNA, 44 bp, Artificial Sequence
  Synthetic
tgctgttgagaagacttgtgattttcactaaattgatcgaccgc

SEQ ID NO: 8021 - DNA, 39 bp, Artificial Sequence
  Synthetic
tctgaaagggcttgacgaacttttgacgatctcactcgc

SEQ ID NO: 8022 - DNA, 44 bp, Artificial Sequence
  Synthetic
gatacgtcaaatgtaccaccaccggataagactgacaaggatga

SEQ ID NO: 8023 - DNA, 40 bp, Artificial Sequence
  Synthetic
ttgccttctgggttagcaatgaactcagcagtagcagttc

SEQ ID NO: 8024 - DNA, 38 bp, Artificial Sequence
  Synthetic
cttagcagacgctcgtgcaagaacatccagccgatagc

SEQ ID NO: 8025 - DNA, 39 bp, Artificial Sequence
  Synthetic
tagcgttgaagttgttgacgtgagctcatgcagaaatgc

SEQ ID NO: 8026 - DNA, 47 bp, Artificial Sequence
  Synthetic
atcaataggaccaatcaaactcaggtgtgtcagttttaactcacaaa

SEQ ID NO: 8027 - DNA, 44 bp, Artificial Sequence
  Synthetic
actgtcactggcttagattcatctgttcagcttagcaaccatga

SEQ ID NO: 8028 - DNA, 43 bp, Artificial Sequence
  Synthetic
attacgaatagtggcgctactagaaactcatgaaccagtaggg

SEQ ID NO: 8029 - DNA, 47 bp, Artificial Sequence
  Synthetic
acttctcatcaatggcttacctatgtcaatgcattgatgattctgag

SEQ ID NO: 8030 - DNA, 43 bp, Artificial Sequence
  Synthetic
aaaagcactaattctccttcgtccttatagccagacttgcggt

SEQ ID NO: 8031 - DNA, 45 bp, Artificial Sequence
  Synthetic
tggtcaccaccattcaaaaactctttggagtgtcataactttcca

SEQ ID NO: 8032 - DNA, 45 bp, Artificial Sequence
  Synthetic
atgtctccatcaatacaccgttaaaactcaacttgaaagcctaga

SEQ ID NO: 8033 - DNA, 48 bp, Artificial Sequence
  Synthetic
ctatcactgaaaatgacaatgcgtcagtcttctagatttttggtcatt

SEQ ID NO: 8034 - DNA, 49 bp, Artificial Sequence
  Synthetic
aaacctcagcacattattcaagctccgtaatgttttctactttcaaaga

SEQ ID NO: 8035 - DNA, 46 bp, Artificial Sequence
  Synthetic
ttgcatctgtacaggtctatagtgacatctgataacccaacctcac

SEQ ID NO: 8036 - DNA, 40 bp, Artificial Sequence
  Synthetic
gctatggctgactcactagcttcataggctttgggttctt

SEQ ID NO: 8037 - DNA, 44 bp, Artificial Sequence
  Synthetic
cttaaaagggcactaggaaaggaaacaaaaccgtcaaagcgata

SEQ ID NO: 8038 - DNA, 44 bp, Artificial Sequence
  Synthetic
attggcgaacttttccaaatggttctttaagggttgctagcttt

SEQ ID NO: 8039 - DNA, 41 bp, Artificial Sequence
  Synthetic
ccttgcccataaagccaagattgtcaatcgtgtctttgttg

SEQ ID NO: 8040 - DNA, 43 bp, Artificial Sequence
  Synthetic
atccgtcgctttatgttgtaattgtgaacatggctatgcggtg

SEQ ID NO: 8041 - DNA, 43 bp, Artificial Sequence
  Synthetic
ggacaaccgtttttttaaaaggttggttgggattcgggattgg

SEQ ID NO: 8042 - DNA, 43 bp, Artificial Sequence
  Synthetic
cctttgccaaacacgagcaatcggtatagataaagtccacgta

SEQ ID NO: 8043 - DNA, 43 bp, Artificial Sequence
  Synthetic
gtatgagatggctgaggtcaagggaaaacagcctgatagtctg

SEQ ID NO: 8044 - DNA, 46 bp, Artificial Sequence
  Synthetic
aaaagtcccgctaatgaatcccgcaaaacatataccttacacaaag

SEQ ID NO: 8045 - DNA, 47 bp, Artificial Sequence
  Synthetic
atcaactcctgattgattacctgtttacgctcaaaatggtatttcag

SEQ ID NO: 8046 - DNA, 46 bp, Artificial Sequence
  Synthetic
cctgctaagtcgggattgaagtctaacgtatatggctatacactag

SEQ ID NO: 8047 - DNA, 43 bp, Artificial Sequence
  Synthetic
ccacctaaagctacccccaactatggtaaaacatttgggttag

SEQ ID NO: 8048 - DNA, 40 bp, Artificial Sequence
  Synthetic
attcacacgaccaatcagacctacggtagctctgctcaag

SEQ ID NO: 8049 - DNA, 41 bp, Artificial Sequence
  Synthetic
gtggtacgcccctacctgtcgagaggggagaagagctcaac

SEQ ID NO: 8050 - DNA, 36 bp, Artificial Sequence
  Synthetic
cagggcgccctgctactgacataatgccggcagcgt

SEQ ID NO: 8051 - DNA, 40 bp, Artificial Sequence
  Synthetic
gggtttataccacccgcgcttatgtgactatcaggcgccc

SEQ ID NO: 8052 - DNA, 38 bp, Artificial Sequence
  Synthetic
tacaccccttacccgaaggccaatgcccgcccgcacta

SEQ ID NO: 8053 - DNA, 40 bp, Artificial Sequence
  Synthetic
cggtggttgtggcctcctatttatgccttgcgtccgaatc

SEQ ID NO: 8054 - DNA, 41 bp, Artificial Sequence
  Synthetic
tgcttcgatcgtgaatacgcctacatcctttacgcacagcc

SEQ ID NO: 8055 - DNA, 38 bp, Artificial Sequence
  Synthetic
tctcacggacgccttccatcacagccagttttgcgccg

SEQ ID NO: 8056 - DNA, 37 bp, Artificial Sequence
  Synthetic
ggggccgatttccccgaggtaagaagcccgcagaccc

SEQ ID NO: 8057 - DNA, 39 bp, Artificial Sequence
  Synthetic
cggccaacgcccaacacaacgtcgaaggcctctggaaag

SEQ ID NO: 8058 - DNA, 41 bp, Artificial Sequence
  Synthetic
tataggcaggagacggctgctcttcgggagggacttggtat

SEQ ID NO: 8059 - DNA, 41 bp, Artificial Sequence
  Synthetic
ggtttccctgttatgaccccgcaatcaccagcctcttgccc

SEQ ID NO: 8060 - DNA, 38 bp, Artificial Sequence
  Synthetic
cgatgcccccgagatgtgtgttcgaggtggtcatcccg

SEQ ID NO: 8061 - DNA, 39 bp, Artificial Sequence
  Synthetic
tcgaggtgcgagctgtggtgggtgtaaagcttaccctgc

SEQ ID NO: 8062 - DNA, 40 bp, Artificial Sequence
  Synthetic
agcttgccgaattggttgaggcagttgagaaccgcagtgc

SEQ ID NO: 8063 - DNA, 38 bp, Artificial Sequence
  Synthetic
ggtgttgcaggctccccaagtagcagtgtaccgggctc

SEQ ID NO: 8064 - DNA, 39 bp, Artificial Sequence
  Synthetic
gcttgctagtcgcctgtggtcgagagcctccccaggaac

SEQ ID NO: 8065 - DNA, 41 bp, Artificial Sequence
  Synthetic
tgcggtcgcaggtttgaaagcggccaggtgtactccttcag

SEQ ID NO: 8066 - DNA, 39 bp, Artificial Sequence
  Synthetic
ctctccaccatgcccccacttgtcgggtacgacggcaac

SEQ ID NO: 8067 - DNA, 38 bp, Artificial Sequence
  Synthetic
ttccatcacttccaccgacgtgacgacgagctctgcgg

SEQ ID NO: 8068 - DNA, 40 bp, Artificial Sequence
  Synthetic
tgacccctggtaacacgaacacttgatcttgtgcggggct

SEQ ID NO: 8069 - DNA, 42 bp, Artificial Sequence
  Synthetic
gcccagtcgcagagtgctatggaatgattgtcgcctcctcag

SEQ ID NO: 8070 - DNA, 44 bp, Artificial Sequence
  Synthetic
tctgtgggtctggtgggatgagcatagtagtataggtagaaaca

SEQ ID NO: 8071 - DNA, 46 bp, Artificial Sequence
  Synthetic
tttctgtgtctaagcactggtgggaacaccacttaaatatcaatgt

SEQ ID NO: 8072 - DNA, 50 bp, Artificial Sequence
  Synthetic
tgattatgtcattgcattgactggtgggtctatcagaaaaaggtaaaatt

SEQ ID NO: 8073 - DNA, 42 bp, Artificial Sequence
  Synthetic
ttctgagagttggagtgttggtaaagtttcttagcaggtgtg

SEQ ID NO: 8074 - DNA, 46 bp, Artificial Sequence
  Synthetic
actggtgttattgacattagtgctaccaaggtttattgtttgtcaa

SEQ ID NO: 8075 - DNA, 47 bp, Artificial Sequence
  Synthetic
acaagcttttttctatagtggtggtatcaccagtaaaaacaggatca

SEQ ID NO: 8076 - DNA, 48 bp, Artificial Sequence
  Synthetic
ttctgcattgataattgtggtgagcggttattactctgcaagatagca

SEQ ID NO: 8077 - DNA, 48 bp, Artificial Sequence
  Synthetic
tgaaactgtctgtagtgtcgcataaccactaataactacatatggaac

SEQ ID NO: 8078 - DNA, 48 bp, Artificial Sequence
  Synthetic
tgatgaagagggtggttatgatgtcattactaataggccattgtgaaa

SEQ ID NO: 8079 - DNA, 46 bp, Artificial Sequence
  Synthetic
agcttgttagtatgaaaggtactggaagcatcaatgtcaataggtg

SEQ ID NO: 8080 - DNA, 42 bp, Artificial Sequence
  Synthetic
tttgactttgttgtcaatgctgctaatagcacgtgcaacacc

SEQ ID NO: 8081 - DNA, 47 bp, Artificial Sequence
  Synthetic
aacttgtgttattgccaatgttccaagtcaaacttgaaagaagcttt

SEQ ID NO: 8082 - DNA, 45 bp, Artificial Sequence
  Synthetic
gaagttgactgggttgctttttacgctttacatccaaagaagcaa

SEQ ID NO: 8083 - DNA, 44 bp, Artificial Sequence
  Synthetic
gtgatgttggtttttgtccacaccaacacgtccattaacaaact

SEQ ID NO: 8084 - DNA, 49 bp, Artificial Sequence
  Synthetic
tgtcctatagttgttggtgtttcaggagtctttcctaccaaatatacat

SEQ ID NO: 8085 - DNA, 47 bp, Artificial Sequence
  Synthetic
tgatgacggttacatttgtggtggatgaactaaagattgagagtaca

SEQ ID NO: 8086 - DNA, 45 bp, Artificial Sequence
  Synthetic
agctacaattccaccttacaatctgtctctcaacacaaccagatg

SEQ ID NO: 8087 - DNA, 44 bp, Artificial Sequence
  Synthetic
cataatggtgtcttcttgggagttaccttaatacgcaacacaga

SEQ ID NO: 8088 - DNA, 39 bp, Artificial Sequence
  Synthetic
tgcaagttgagagtgccaacgcagcatacaaaaaggcaa

SEQ ID NO: 8089 - DNA, 40 bp, Artificial Sequence
  Synthetic
tgcaccacatggaccttttggtcaccaccaataccaagta

SEQ ID NO: 8090 - DNA, 44 bp, Artificial Sequence
  Synthetic
cgcaaagtctgaatttgatcatgagtgagtagcagcttgttcag

SEQ ID NO: 8091 - DNA, 47 bp, Artificial Sequence
  Synthetic
tgaaactttgacatggcctcttatcgcttaagtttaccaggcataat

SEQ ID NO: 8092 - DNA, 45 bp, Artificial Sequence
  Synthetic
ttaactgcttgtgctttttctgttgtgcaccatgtttaacagctt

SEQ ID NO: 8093 - DNA, 45 bp, Artificial Sequence
  Synthetic
gggtgtgcttgtgaccgtaccttgctcgtttaaataagaaatgtc

SEQ ID NO: 8094 - DNA, 45 bp, Artificial Sequence
  Synthetic
tacttggaaagatggcagagtcagcatagaccaagtccatcatag

SEQ ID NO: 8095 - DNA, 45 bp, Artificial Sequence
  Synthetic
tgctctatgcgatgcgatggcttggttatctaatgttaaaacacc

SEQ ID NO: 8096 - DNA, 42 bp, Artificial Sequence
  Synthetic
actgaacttttgcaatttgtcaccttgatcaacgagtgctgg

SEQ ID NO: 8097 - DNA, 45 bp, Artificial Sequence
  Synthetic
agaactgttggtggtgtttctcatgtttttgatggtattgtcttg

SEQ ID NO: 8098 - DNA, 44 bp, Artificial Sequence
  Synthetic
tggcacaagttttaacagaagttgttcgtaccacctggcttaaa

SEQ ID NO: 8099 - DNA, 46 bp, Artificial Sequence
  Synthetic
atttgccttacccagatcctagttgtcttaacaacatcatcaacaa

SEQ ID NO: 8100 - DNA, 44 bp, Artificial Sequence
  Synthetic
ttgtggttcacaaactgtacttcgacatgatcatatgcgcattt

SEQ ID NO: 8101 - DNA, 45 bp, Artificial Sequence
  Synthetic
gtcagtgatgcatatgctaatttggggaggaccctgtattgtagt

SEQ ID NO: 8102 - DNA, 45 bp, Artificial Sequence
  Synthetic
tgttcctttacaggttggtttttcagacacacaaccttcagtttg

SEQ ID NO: 8103 - DNA, 38 bp, Artificial Sequence
  Synthetic
ttgagccaaaaccaccacactaacagcatcaccagagg

SEQ ID NO: 8104 - DNA, 46 bp, Artificial Sequence
  Synthetic
tggtcaacttgatggtctttgttacacaattgaaaattctggatac

SEQ ID NO: 8105 - DNA, 46 bp, Artificial Sequence
  Synthetic
aattgtttgcaaaacgaaaaatgggacaacaccgagatttttgaga

SEQ ID NO: 8106 - DNA, 44 bp, Artificial Sequence
  Synthetic
taaccacttgtccactttttatccaggcatagcataaccacact

SEQ ID NO: 8107 - DNA, 48 bp, Artificial Sequence
  Synthetic
cacctggtacaactgttttaaaacgtgcatcactaacataatcattga

SEQ ID NO: 8108 - DNA, 41 bp, Artificial Sequence
  Synthetic
gttacgggtttattgccaactcaagaaaccattggctgagt

SEQ ID NO: 8109 - DNA, 43 bp, Artificial Sequence
  Synthetic
ttcctgtgtttttagtgttgtcaacacacggccattatgtgtg

SEQ ID NO: 8110 - DNA, 47 bp, Artificial Sequence
  Synthetic
atcaaccactccgtttaacttgttggcattaaaataaacaaaaccag

SEQ ID NO: 8111 - DNA, 48 bp, Artificial Sequence
  Synthetic
gcacttttgtgggtattttaccaccccattaatataaaactggccagt

SEQ ID NO: 8112 - DNA, 44 bp, Artificial Sequence
  Synthetic
atgttgcactccccatttattatcacaccaaaagatgcagttgc

SEQ ID NO: 8113 - DNA, 46 bp, Artificial Sequence
  Synthetic
atcaacaaagcattattggtgccgtaactgtagtaagttttgcaag

SEQ ID NO: 8114 - DNA, 50 bp, Artificial Sequence
  Synthetic
aagttgttacatctggtttgggtactagaaagacctttagtacaagactt

SEQ ID NO: 8115 - DNA, 44 bp, Artificial Sequence
  Synthetic
atgaccggcttgattcaattcaaaaacaaatgcattcaaagctg

SEQ ID NO: 8116 - DNA, 45 bp, Artificial Sequence
  Synthetic
aatggtgtctttcgtgtaacttccgcacaaaatcagacaaaacag

SEQ ID NO: 8117 - DNA, 41 bp, Artificial Sequence
  Synthetic
ctacaggttgttgtggttgttgcccacaatcacaacagcct

SEQ ID NO: 8118 - DNA, 46 bp, Artificial Sequence
  Synthetic
atgtccatttacgtaactggaacttgcaacacaactataaaaagcg

SEQ ID NO: 8119 - DNA, 43 bp, Artificial Sequence
  Synthetic
cacttcttagtggtgtacttcttgtactgacccacttgaacac

SEQ ID NO: 8120 - DNA, 43 bp, Artificial Sequence
  Synthetic
tcctccttcattttacatgcctctaagattcctgggaatgacc

SEQ ID NO: 8121 - DNA, 44 bp, Artificial Sequence
  Synthetic
tttggaaccaaagttctctattgctgagcgatcctcaaactcaa

SEQ ID NO: 8122 - DNA, 42 bp, Artificial Sequence
  Synthetic
agttcttctggtacttccactccttatcagccctgggttgag

SEQ ID NO: 8123 - DNA, 49 bp, Artificial Sequence
  Synthetic
agtgggtgataatgttcagattaccaggttcttattatccttagctaca

SEQ ID NO: 8124 - DNA, 45 bp, Artificial Sequence
  Synthetic
ttggacagacctttattgcaaattgttttcagcaacactcagttt

SEQ ID NO: 8125 - DNA, 43 bp, Artificial Sequence
  Synthetic
atctgatttattagacgaggcgcgattcttgcttgtggaacaa

SEQ ID NO: 8126 - DNA, 44 bp, Artificial Sequence
  Synthetic
tgtggagattgggttttggcagcaataattcttttacactgtca

SEQ ID NO: 8127 - DNA, 42 bp, Artificial Sequence
  Synthetic
acaactttggagtggattgcacgggactttcggaatctaact

SEQ ID NO: 8128 - DNA, 44 bp, Artificial Sequence
  Synthetic
aatggggtaatgagaattggattgcctttgccttctcctgtgag

SEQ ID NO: 8129 - DNA, 45 bp, Artificial Sequence
  Synthetic
taaccctgataatcagacaaggcacatcgtccccattttgataat

SEQ ID NO: 8130 - DNA, 41 bp, Artificial Sequence
  Synthetic
tcgacgtccatcgactacaccgtctttgtcggacctgcgag

SEQ ID NO: 8131 - DNA, 43 bp, Artificial Sequence
  Synthetic
agagagttgctttgcccagaacttccattaattttaagaccca

SEQ ID NO: 8132 - DNA, 42 bp, Artificial Sequence
  Synthetic
aatattgcaatatggcagtctgggttcttcctccagagcctc

SEQ ID NO: 8133 - DNA, 46 bp, Artificial Sequence
  Synthetic
tgcaggttattgcagaaattcaccagattctccttcatttgttgaa

SEQ ID NO: 8134 - DNA, 43 bp, Artificial Sequence
  Synthetic
ttaaacttaggccttgaaacagacatcagcaattggtgtgctg

SEQ ID NO: 8135 - DNA, 41 bp, Artificial Sequence
  Synthetic
ctgagcaagcccacattttcgctgaacttttgccaaggcgg

SEQ ID NO: 8136 - DNA, 49 bp, Artificial Sequence
  Synthetic
taggtgacacagcatttatacaaggggtgtttctaaagagataacttct

SEQ ID NO: 8137 - DNA, 46 bp, Artificial Sequence
  Synthetic
atctgaacgtctactgctggtcacttttggtatagttacagtttga

SEQ ID NO: 8138 - DNA, 42 bp, Artificial Sequence
  Synthetic
tactgcttttgatgcaaaacagacagtgttcacctgaagcag

SEQ ID NO: 8139 - DNA, 43 bp, Artificial Sequence
  Synthetic
atcagaatgaaccatgaagcctatgatacatttgctcgcgacg

SEQ ID NO: 8140 - DNA, 45 bp, Artificial Sequence
  Synthetic
ccagaataatggcatttgctggatcctctggtattatctccaact

SEQ ID NO: 8141 - DNA, 43 bp, Artificial Sequence
  Synthetic
aatccctacccctaaaatctgtttgcgggtgcggtgttaatag

SEQ ID NO: 8142 - DNA, 38 bp, Artificial Sequence
  Synthetic
cgcggttaggacttgtttcagttttaggtgcttggcag

SEQ ID NO: 8143 - DNA, 42 bp, Artificial Sequence
  Synthetic
tttgtgtgaaacctgtgctgctccatcagtacctttgtgatc

SEQ ID NO: 8144 - DNA, 44 bp, Artificial Sequence
  Synthetic
ggaattgttccaccaacaggaaagttgtgaaggactctgaaagt

SEQ ID NO: 8145 - DNA, 41 bp, Artificial Sequence
  Synthetic
ctgatgttacggagagtcaaaccgaagtaccaagtcgcctc

SEQ ID NO: 8146 - DNA, 49 bp, Artificial Sequence
  Synthetic
acaaacacaagtagggcaaacagaatctgtatgttcattatcataagcc

SEQ ID NO: 8147 - DNA, 45 bp, Artificial Sequence
  Synthetic
acgatgcaacgtcacaatgttgatataggattaccatctaatgca

SEQ ID NO: 8148 - DNA, 42 bp, Artificial Sequence
  Synthetic
tttcactatgctcgacaaaatggtagctgccagtgtaggtat

SEQ ID NO: 8149 - DNA, 40 bp, Artificial Sequence
  Synthetic
atctggtggaaggcttggatatatcctccaactcgaacac

SEQ ID NO: 8150 - DNA, 42 bp, Artificial Sequence
  Synthetic
gggtgacccaaaatgaaggccttaatgaaggtgaatcaacac

SEQ ID NO: 8151 - DNA, 42 bp, Artificial Sequence
  Synthetic
tgtagcagagaccgattttaccaaaatcgagtaggacgttcc

SEQ ID NO: 8152 - DNA, 42 bp, Artificial Sequence
  Synthetic
acaacagacaaaatgtgggctttcacatccaaccataaacac

SEQ ID NO: 8153 - DNA, 49 bp, Artificial Sequence
  Synthetic
atccagactacattaaaatggcgcccttctggaaaaaaagaataaggaa

SEQ ID NO: 8154 - DNA, 40 bp, Artificial Sequence
  Synthetic
gtggttctctcgtatccacagagttttgaccttgggcctg

SEQ ID NO: 8155 - DNA, 42 bp, Artificial Sequence
  Synthetic
aacatctcagacaagttgtagcatcagaaaatcagcagctgc

SEQ ID NO: 8156 - DNA, 42 bp, Artificial Sequence
  Synthetic
actttgaagcaggaattctggagtctgtgtaggcggtcttga

SEQ ID NO: 8157 - DNA, 43 bp, Artificial Sequence
  Synthetic
actgtgtgaaaaatccctcaactagtggggttggagggtaatc

SEQ ID NO: 8158 - DNA, 43 bp, Artificial Sequence
  Synthetic
aatggagacaagtccttatcaactccaacaagccctccattct

SEQ ID NO: 8159 - DNA, 48 bp, Artificial Sequence
  Synthetic
tatcccaatttggtcaagagcacctactcaagagataaagttcttccg

SEQ ID NO: 8160 - DNA, 42 bp, Artificial Sequence
  Synthetic
tttcccttttccctttcctattcctaagaaccctgaacctgc

SEQ ID NO: 8161 - DNA, 45 bp, Artificial Sequence
  Synthetic
tctctttgatcttccacaaggggtatccaaggcatctcttcatag

SEQ ID NO: 8162 - DNA, 44 bp, Artificial Sequence
  Synthetic
agtgactggtgcttcttattttacttgatccaacctcagctgta

SEQ ID NO: 8163 - DNA, 43 bp, Artificial Sequence
  Synthetic
tcaagttcagataaaccctacaccttcaccaggaaccatagca

SEQ ID NO: 8164 - DNA, 49 bp, Artificial Sequence
  Synthetic
aatattgggacaggaacttcagctctccaaatctgtaaatctagctaaa

SEQ ID NO: 8165 - DNA, 45 bp, Artificial Sequence
  Synthetic
cttggacatctattccaactttggcgttgaccaactgagtctgaa

SEQ ID NO: 8166 - DNA, 46 bp, Artificial Sequence
  Synthetic
tttctggaatcacattaaagcaagctgcactcctgtaatatccatt

SEQ ID NO: 8167 - DNA, 42 bp, Artificial Sequence
  Synthetic
ttgcttcccatgtcagagtgaaggagcaaaacattccaagtt

SEQ ID NO: 8168 - DNA, 46 bp, Artificial Sequence
  Synthetic
ttgaggatccagttttagcaaagaatgatgtatgtctggattctcc

SEQ ID NO: 8169 - DNA, 42 bp, Artificial Sequence
  Synthetic
tagagggcctttagatctgacaatacctactggagtgaacca

SEQ ID NO: 8170 - DNA, 42 bp, Artificial Sequence
  Synthetic
agaagttgggaaacaaagactcaagggggtggaagtacttca

SEQ ID NO: 8171 - DNA, 42 bp, Artificial Sequence
  Synthetic
caggcagaagtgtgtggactcaatctaatcagtctcccagta

SEQ ID NO: 8172 - DNA, 44 bp, Artificial Sequence
  Synthetic
tggtcagatttttgtcagttagtgtcctacccttctcctcaaga

SEQ ID NO: 8173 - DNA, 38 bp, Artificial Sequence
  Synthetic
gcagttggcattcttggagtttgcgggagaaatgctta

SEQ ID NO: 8174 - DNA, 43 bp, Artificial Sequence
  Synthetic
gagagaagaatggatgtgtgagatgacaagcagccaatcatct

SEQ ID NO: 8175 - DNA, 45 bp, Artificial Sequence
  Synthetic
tccatgttgctggaggaaattctttggaacatttcttgagtaacc

SEQ ID NO: 8176 - DNA, 47 bp, Artificial Sequence
  Synthetic
agaaccagaggattataaagaggctctaactgagtcttacccactat

SEQ ID NO: 8177 - DNA, 45 bp, Artificial Sequence
  Synthetic
ggagttcatccaagattggctcagaacaattttccatcatgacag

SEQ ID NO: 8178 - DNA, 47 bp, Artificial Sequence
  Synthetic
tgctattggcatagatcctgatagacatctccgaatcttatcattgt

SEQ ID NO: 8179 - DNA, 41 bp, Artificial Sequence
  Synthetic
ggcaccatgcagtaccaaacacttcaatttggtcattcgtg

SEQ ID NO: 8180 - DNA, 42 bp, Artificial Sequence
  Synthetic
cctacagcaactgttacccttatgttaaactccagtgtgccg

SEQ ID NO: 8181 - DNA, 42 bp, Artificial Sequence
  Synthetic
cgggtacggacaatgaccaagagactgtgattcttcctgatg

SEQ ID NO: 8182 - DNA, 42 bp, Artificial Sequence
  Synthetic
atgagatcagatgcacccattggttgtcattgggaatgcttc

SEQ ID NO: 8183 - DNA, 39 bp, Artificial Sequence
  Synthetic
ttgggagggaatggtagacggtgtcctgttccctcagaa

SEQ ID NO: 8184 - DNA, 43 bp, Artificial Sequence
  Synthetic
ttcttgtggccctggagaacagtttgttcatttctgagtcagt

SEQ ID NO: 8185 - DNA, 43 bp, Artificial Sequence
  Synthetic
atggatttcctttgccatatcatgtcaggcccacatgatgaac

SEQ ID NO: 8186 - DNA, 42 bp, Artificial Sequence
  Synthetic
aaagacagtgcagcaacttagaaacaggctaacaacaggtct

SEQ ID NO: 8187 - DNA, 44 bp, Artificial Sequence
  Synthetic
aatctcgcagtggcagtttacaaataatctaacagtcgcaaaca

SEQ ID NO: 8188 - DNA, 42 bp, Artificial Sequence
  Synthetic
cattgtgacgaagagttgacagatccacctctgctactgtag

SEQ ID NO: 8189 - DNA, 48 bp, Artificial Sequence
  Synthetic
aattggttttctcttgaagcagactttcttcaaacagcttttccaaat

SEQ ID NO: 8190 - DNA, 42 bp, Artificial Sequence
  Synthetic
cctcgtttggaagcaataccttgtcctgttccataaatagcc

SEQ ID NO: 8191 - DNA, 44 bp, Artificial Sequence
  Synthetic
actgggtcgtaactgcatatgggtaacagttgcttacatccttc

SEQ ID NO: 8192 - DNA, 46 bp, Artificial Sequence
  Synthetic
caaggtaatacacgcataggtagagttccctctgatcttctgaaac

SEQ ID NO: 8193 - DNA, 46 bp, Artificial Sequence
  Synthetic
ccaaattttaaagtatggcagcacccctttgcctgtactaataccc

SEQ ID NO: 8194 - DNA, 39 bp, Artificial Sequence
  Synthetic
tgtccctcttacagacacaggcctcagcaatggtctcaa

SEQ ID NO: 8195 - DNA, 42 bp, Artificial Sequence
  Synthetic
taagcactattgacacagaaccctagcatccccagaatgttc

SEQ ID NO: 8196 - DNA, 39 bp, Artificial Sequence
  Synthetic
tgtcaacaacgggtaaggtctgtaggagtccgtgctttg

SEQ ID NO: 8197 - DNA, 43 bp, Artificial Sequence
  Synthetic
gatcctaacagatttgctctagctgaacagcccataccaaacg

SEQ ID NO: 8198 - DNA, 48 bp, Artificial Sequence
  Synthetic
ccttaccttgtgtagaaaatcctcccatgtccccatcttcaataatag

SEQ ID NO: 8199 - DNA, 49 bp, Artificial Sequence
  Synthetic
tgggtcagtaggagacagtattcccagcctttaaataataatggttgtc

SEQ ID NO: 8200 - DNA, 47 bp, Artificial Sequence
  Synthetic
ttaagcaacatgagtgcgactctttctattattattggttcacacgg

SEQ ID NO: 8201 - DNA, 42 bp, Artificial Sequence
  Synthetic
gtggggacatttgggtgacgaattgataacacttgccaggat

SEQ ID NO: 8202 - DNA, 44 bp, Artificial Sequence
  Synthetic
ctggggatgataaaaatgcaactgaccaatactgtccataagcc

SEQ ID NO: 8203 - DNA, 43 bp, Artificial Sequence
  Synthetic
tcctgacgtcagatgtatctgcatatgtctatgacgggcctat

SEQ ID NO: 8204 - DNA, 44 bp, Artificial Sequence
  Synthetic
agaacgatcagcaaggatttacgcgatttggaattaggtgtgga

SEQ ID NO: 8205 - DNA, 39 bp, Artificial Sequence
  Synthetic
ttccacgcgacagatccgtctaggatcacgagccaaggg

SEQ ID NO: 8206 - DNA, 36 bp, Artificial Sequence
  Synthetic
acagagctggtcctgacggatgggcgcgtctctctg

SEQ ID NO: 8207 - DNA, 38 bp, Artificial Sequence
  Synthetic
gctgatcctaacggaaggaggcatgcgccacacggagg

SEQ ID NO: 8208 - DNA, 36 bp, Artificial Sequence
  Synthetic
cctcccacgcgcgcctataaactgtgccctgttgcg

SEQ ID NO: 8209 - DNA, 37 bp, Artificial Sequence
  Synthetic
acaagacgagggctgcaacgctggtccggcagctcta

SEQ ID NO: 8210 - DNA, 38 bp, Artificial Sequence
  Synthetic
cggaggagagagaacggccgtacaccctctctcgcgcc

SEQ ID NO: 8211 - DNA, 38 bp, Artificial Sequence
  Synthetic
ggccaaggcaacggcacgatgacgacgtcctggctttc

SEQ ID NO: 8212 - DNA, 38 bp, Artificial Sequence
  Synthetic
cgatacagcgcgtcgtcgaactgctggtcggagagtgc

SEQ ID NO: 8213 - DNA, 43 bp, Artificial Sequence
  Synthetic
gttctcggacgggtcccttaatacttacttgagtgatggagtt

SEQ ID NO: 8214 - DNA, 47 bp, Artificial Sequence
  Synthetic
gcacgttgtctatccaatcgtaaagacctattctttgtattgggaaa

SEQ ID NO: 8215 - DNA, 41 bp, Artificial Sequence
  Synthetic
cgctttcctccgcatgtacaatgttgttcaacattcgcaag

SEQ ID NO: 8216 - DNA, 45 bp, Artificial Sequence
  Synthetic
ttttacacagtgtcgaaatcaccaaccggcttaactatacagttt

SEQ ID NO: 8217 - DNA, 40 bp, Artificial Sequence
  Synthetic
aacctgacctcgataaagcacttctcggcagtttgtttca

SEQ ID NO: 8218 - DNA, 42 bp, Artificial Sequence
  Synthetic
aatgacaaaacgtgctctctctggtgactatgagcagaccga

SEQ ID NO: 8219 - DNA, 46 bp, Artificial Sequence
  Synthetic
gttgcctgagttttcggtattcgaagttaacctgtgtttttaacga

SEQ ID NO: 8220 - DNA, 45 bp, Artificial Sequence
  Synthetic
ggttttgaagaagaagatgggatgttcaacgcctggaaaaaaatt

SEQ ID NO: 8221 - DNA, 43 bp, Artificial Sequence
  Synthetic
aacgattggattttcaaagtttccattggagaccgttgaacat

SEQ ID NO: 8222 - DNA, 44 bp, Artificial Sequence
  Synthetic
cgaaaatagttccgcctgtttctactcagaatacggtagcattt

SEQ ID NO: 8223 - DNA, 43 bp, Artificial Sequence
  Synthetic
ggtcaagcgaagataacattctttctaacgtagtgttgccgga

SEQ ID NO: 8224 - DNA, 42 bp, Artificial Sequence
  Synthetic
cattcgactcacatcattgaagcttaactttttcaccacgcc

SEQ ID NO: 8225 - DNA, 45 bp, Artificial Sequence
  Synthetic
aggttagattcggaaaccatagctagtgcaagttaagcagtttac

SEQ ID NO: 8226 - DNA, 39 bp, Artificial Sequence
  Synthetic
ggctccgcccatgatttcattaaaaaaacggccaacctc

SEQ ID NO: 8227 - DNA, 40 bp, Artificial Sequence
  Synthetic
gagtcgcttctagactcgcctgtttgagctgaagatggtg

SEQ ID NO: 8228 - DNA, 41 bp, Artificial Sequence
  Synthetic
tatgggcgcaaagtgctgtaaggtgttttcggttttcttac

SEQ ID NO: 8229 - DNA, 42 bp, Artificial Sequence
  Synthetic
ttggaagcatacgtttgtggcgtaagataacaggtaccgtgt

SEQ ID NO: 8230 - DNA, 44 bp, Artificial Sequence
  Synthetic
tttgcttttactgcagagcgtaatacctgtttataaactccgaa

SEQ ID NO: 8231 - DNA, 39 bp, Artificial Sequence
  Synthetic
tcggagagcgttgtggattgtgaaatgctacacggacac

SEQ ID NO: 8232 - DNA, 39 bp, Artificial Sequence
  Synthetic
acgacgtgctgcaaggccggcccgtctttagaaagagcg

SEQ ID NO: 8233 - DNA, 41 bp, Artificial Sequence
  Synthetic
cagaccgctgctggacgaacttggagagaaacgcgaaggga

SEQ ID NO: 8234 - DNA, 38 bp, Artificial Sequence
  Synthetic
acatctgttcgacgtgatcgcctctgacacaggccgcc

SEQ ID NO: 8235 - DNA, 42 bp, Artificial Sequence
  Synthetic
ttgggtggtcttgactttggcggacagatcttgccggtatcg

SEQ ID NO: 8236 - DNA, 41 bp, Artificial Sequence
  Synthetic
ccctcttccctttaaccccacgcaccctgtgtgtgactgtc

SEQ ID NO: 8237 - DNA, 43 bp, Artificial Sequence
  Synthetic
acaaagggattggctgatgattacagttccatgctattcccca

SEQ ID NO: 8238 - DNA, 47 bp, Artificial Sequence
  Synthetic
aactgaggaatatatctgttccagctgtctatgtaacttctcatccc

SEQ ID NO: 8239 - DNA, 44 bp, Artificial Sequence
  Synthetic
taatgcctttctcctcatgtctgatcttggactttccttcagtc

SEQ ID NO: 8240 - DNA, 50 bp, Artificial Sequence
  Synthetic
agaagtagcaatagatgacgaaacgactctacatttattgggtattttgg

SEQ ID NO: 8241 - DNA, 46 bp, Artificial Sequence
  Synthetic
tttgtgagtggaagagaaaaaccttggattttgtttgtaccattca

SEQ ID NO: 8242 - DNA, 46 bp, Artificial Sequence
  Synthetic
ggaaggcaaactagtaaaagggtccataatgcatcaaacatttggt

SEQ ID NO: 8243 - DNA, 45 bp, Artificial Sequence
  Synthetic
agaagacaagcataacgggaaacgcaatgttacatttacccaaat

SEQ ID NO: 8244 - DNA, 46 bp, Artificial Sequence
  Synthetic
tcatcgattatgaggagctaagagaggggaatatctcaaacctttc

SEQ ID NO: 8245 - DNA, 43 bp, Artificial Sequence
  Synthetic
tgcagatgcatatgtttttgtggtattgctatttccggcttga

SEQ ID NO: 8246 - DNA, 48 bp, Artificial Sequence
  Synthetic
attgcaatacaacttgtcaaacaccatgtatattctgaaatgggaggc

SEQ ID NO: 8247 - DNA, 46 bp, Artificial Sequence
  Synthetic
caccatcaaaatgagcaggggtctttgttagtaatctcgtcaatgg

SEQ ID NO: 8248 - DNA, 39 bp, Artificial Sequence
  Synthetic
cctacaagcgccaggagggtggagatagagccggccttg

SEQ ID NO: 8249 - DNA, 38 bp, Artificial Sequence
  Synthetic
ctcggagtcccagcgcgtttctgtcgctgcgttccatg

SEQ ID NO: 8250 - DNA, 36 bp, Artificial Sequence
  Synthetic
cacctccctgtggcgcatcagagcaggagcaggctc

SEQ ID NO: 8251 - DNA, 39 bp, Artificial Sequence
  Synthetic
tatccgtcctccctgggcacgatctggccctcaggtgac

SEQ ID NO: 8252 - DNA, 35 bp, Artificial Sequence
  Synthetic
ccgtccaccgtccctctcaggcgttcgggggactt

SEQ ID NO: 8253 - DNA, 42 bp, Artificial Sequence
  Synthetic
gaagacctagagctgccggacccacgtcgaacagatgtctga

SEQ ID NO: 8254 - DNA, 40 bp, Artificial Sequence
  Synthetic
gtgattctgggaaacgtgcccagacgatcacccaagccgt

SEQ ID NO: 8255 - DNA, 37 bp, Artificial Sequence
  Synthetic
gccctcctgggtacggcaactctcgtgccgttgcctt

SEQ ID NO: 8256 - DNA, 39 bp, Artificial Sequence
  Synthetic
gccgtgcttccagagaccgagtttaacggcgtgttcgac

SEQ ID NO: 8257 - DNA, 38 bp, Artificial Sequence
  Synthetic
caactcggcctgcgtgatcccgtgggggcagaactgag

SEQ ID NO: 8258 - DNA, 38 bp, Artificial Sequence
  Synthetic
aagccatgacggtacacagggtaagatacggcgtcctg

SEQ ID NO: 8259 - DNA, 47 bp, Artificial Sequence
  Synthetic
ttaaccgtttcttctgccagttaggcttatgctatatgaacagactg

SEQ ID NO: 8260 - DNA, 42 bp, Artificial Sequence
  Synthetic
tctccgaacatgatcagaactcgtgtttaagggggttcgttt

SEQ ID NO: 8261 - DNA, 42 bp, Artificial Sequence
  Synthetic
acgaaaacttttaacttcgacggaaatcttacttgtcgggcg

SEQ ID NO: 8262 - DNA, 39 bp, Artificial Sequence
  Synthetic
actgcaaatcgttccgtcgtggtctcgacttcgtgaatg

SEQ ID NO: 8263 - DNA, 43 bp, Artificial Sequence
  Synthetic
agcaaagcaataacgaaccttgttctcgttttttgctgtgaaa

SEQ ID NO: 8264 - DNA, 39 bp, Artificial Sequence
  Synthetic
tatcgtcgagctgtacagacgtatcgtcctccgcaagtt

SEQ ID NO: 8265 - DNA, 45 bp, Artificial Sequence
  Synthetic
taccttcaaaaatacgtaaacccctctgtaacagggagaagtttg

SEQ ID NO: 8266 - DNA, 42 bp, Artificial Sequence
  Synthetic
acaaacttgcaagcctgagctttcatttgctcttccatatgt

SEQ ID NO: 8267 - DNA, 39 bp, Artificial Sequence
  Synthetic
ggtaggtcgcgacttgttgattacttgtccaaaggtcga

SEQ ID NO: 8268 - DNA, 43 bp, Artificial Sequence
  Synthetic
caaccctgatgtaataaattccgtgatccaaccgcagattgtc

SEQ ID NO: 8269 - DNA, 42 bp, Artificial Sequence
  Synthetic
tcgggagaaaatagatcaagggctaattcggtttttaggcgc

SEQ ID NO: 8270 - DNA, 47 bp, Artificial Sequence
  Synthetic
taattcgcttaagattggcagtggaagttttgtagatatgggcttag

SEQ ID NO: 8271 - DNA, 39 bp, Artificial Sequence
  Synthetic
cgtctgttgttaggaccggtttagtcgttggtgtcccat

SEQ ID NO: 8272 - DNA, 49 bp, Artificial Sequence
  Synthetic
tcttcgcatacgtaagaaactacgcttttttaatgaagctgaacaactc

SEQ ID NO: 8273 - DNA, 43 bp, Artificial Sequence
  Synthetic
gcaaagcataaattcttctggcgttttcagttcaaacgcagac

SEQ ID NO: 8274 - DNA, 46 bp, Artificial Sequence
  Synthetic
tcatggttccgtcttccaagtcgttagtaaatataacagtaggaga

SEQ ID NO: 8275 - DNA, 42 bp, Artificial Sequence
  Synthetic
ccagatccgggttatagcgacaaagatctacactctttgctc

SEQ ID NO: 8276 - DNA, 42 bp, Artificial Sequence
  Synthetic
ctctctcctgtgtcgatcgcaataaacttatgctgaaccgag

SEQ ID NO: 8277 - DNA, 38 bp, Artificial Sequence
  Synthetic
atgtgtgacgtccgcatcattaacgacgttgtccacca

SEQ ID NO: 8278 - DNA, 38 bp, Artificial Sequence
  Synthetic
tgctcctacaagcgccaggatagagccggccttggaac

SEQ ID NO: 8279 - DNA, 37 bp, Artificial Sequence
  Synthetic
ggtggccgtgtacgcacctcgtcactcgaggaaacgc

SEQ ID NO: 8280 - DNA, 40 bp, Artificial Sequence
  Synthetic
atcgaccgactcctgctatccgggtgactccgcagactgg

SEQ ID NO: 8281 - DNA, 35 bp, Artificial Sequence
  Synthetic
gcggttctgccagggcgttagggtgacgacggacc

SEQ ID NO: 8282 - DNA, 36 bp, Artificial Sequence
  Synthetic
gggaccccgtggcgtatgatcgttccgcacatacgc

SEQ ID NO: 8283 - DNA, 38 bp, Artificial Sequence
  Synthetic
acattccatggggccaaagaatacaactggcaagtgca

SEQ ID NO: 8284 - DNA, 48 bp, Artificial Sequence
  Synthetic
ttaaatacggactgaaaggagggccgatattcttccctcatagacttt

SEQ ID NO: 8285 - DNA, 42 bp, Artificial Sequence
  Synthetic
ctccgccgagatcaaaagtccttgtttcccaacaagagtggc

SEQ ID NO: 8286 - DNA, 46 bp, Artificial Sequence
  Synthetic
aggcgatcatggaaaagaacatagtagcccttagtagtatcaaggt

SEQ ID NO: 8287 - DNA, 43 bp, Artificial Sequence
  Synthetic
gggagaccttcactacctccagaatttctgtcccaattgctct

SEQ ID NO: 8288 - DNA, 40 bp, Artificial Sequence
  Synthetic
ggccactatgtctgcacgttttgcactggtcacataattc

SEQ ID NO: 8289 - DNA, 44 bp, Artificial Sequence
  Synthetic
agaagtgagaataagatgctgcaacaatgtggttggttttttcc

SEQ ID NO: 8290 - DNA, 42 bp, Artificial Sequence
  Synthetic
cacgcaacaggacttgcaagcagtgacaaaatacacaatgtg

SEQ ID NO: 8291 - DNA, 43 bp, Artificial Sequence
  Synthetic
atgtggggtctgggtgttcacatcttctgaaactacatcacct

SEQ ID NO: 8292 - DNA, 46 bp, Artificial Sequence
  Synthetic
caggtggtagagctgtttaaatgccactccaaaaagttccttaaac

SEQ ID NO: 8293 - DNA, 49 bp, Artificial Sequence
  Synthetic
gcttgccaaaatgttaaatgtaccagaactttgtaatttaggtggttgt

SEQ ID NO: 8294 - DNA, 50 bp, Artificial Sequence
  Synthetic
tgcacaaatagcagatatagatgcacacaatctctaacatatttagcttg

SEQ ID NO: 8295 - DNA, 41 bp, Artificial Sequence
  Synthetic
gcaaacagctacagcaccatatgcccatttgtcttgctgta

SEQ ID NO: 8296 - DNA, 46 bp, Artificial Sequence
  Synthetic
tacaggacacaagtcaagaactatgttctactgtctttcctccttt

SEQ ID NO: 8297 - DNA, 45 bp, Artificial Sequence
  Synthetic
gcacgctcgcctgatattgaacttccagttgtattataggtgtag

SEQ ID NO: 8298 - DNA, 45 bp, Artificial Sequence
  Synthetic
aaccccatatttactgatccttcgggatacgaccactagcctcta

SEQ ID NO: 8299 - DNA, 47 bp, Artificial Sequence
  Synthetic
tcaccttctatacctgccatatctgtctgaaatagtatgcaggattc

SEQ ID NO: 8300 - DNA, 45 bp, Artificial Sequence
  Synthetic
tacgcttgcccgaccctaatggtttcagaattaaataaagacgtg

SEQ ID NO: 8301 - DNA, 46 bp, Artificial Sequence
  Synthetic
acaccgtgcaatgcttctaaatcactttttaattctagtacaggac

SEQ ID NO: 8302 - DNA, 44 bp, Artificial Sequence
  Synthetic
tgtgtgtgatactcccttgcaacaacacatacatacattccaga

SEQ ID NO: 8303 - DNA, 49 bp, Artificial Sequence
  Synthetic
atacgcttccaaacttgcttttaggccaaactgctattagctaaatgtt

SEQ ID NO: 8304 - DNA, 40 bp, Artificial Sequence
  Synthetic
cattgcaccagctatgtgaagtgaacacacagccaagttg

SEQ ID NO: 8305 - DNA, 47 bp, Artificial Sequence
  Synthetic
taaggtgctacagatgtcaacatcccgtttcttatagtcacagtgta

SEQ ID NO: 8306 - DNA, 42 bp, Artificial Sequence
  Synthetic
ctcagaggatgaggatgaggatgatgttgttcgtcccgtcta

SEQ ID NO: 8307 - DNA, 41 bp, Artificial Sequence
  Synthetic
gtaatcagcaaacagtgtgccgccggcacttctgtatcaat

SEQ ID NO: 8308 - DNA, 42 bp, Artificial Sequence
  Synthetic
tgccactgcaacaaatacaagatacaatatagcttggcctgc

SEQ ID NO: 8309 - DNA, 47 bp, Artificial Sequence
  Synthetic
gcatttgacaatgaagtaaccgatgtgtgcattactgtctacatctg

SEQ ID NO: 8310 - DNA, 46 bp, Artificial Sequence
  Synthetic
cctaaggtatcaaggggtcgagacaattatgttttggtgtaccttg

SEQ ID NO: 8311 - DNA, 42 bp, Artificial Sequence
  Synthetic
atttggataacgacgaagacaagggaattttctcctggcacg

SEQ ID NO: 8312 - DNA, 40 bp, Artificial Sequence
  Synthetic
acaaactttaaagacgaggccatcccatatgcacttccca

SEQ ID NO: 8313 - DNA, 41 bp, Artificial Sequence
  Synthetic
actgactccaccacacagtccattccttgcgacacactctg

SEQ ID NO: 8314 - DNA, 44 bp, Artificial Sequence
  Synthetic
agatgaaacccaacgccaaaaattgtaccagtgatacactaggg

SEQ ID NO: 8315 - DNA, 38 bp, Artificial Sequence
  Synthetic
tttgctgctttgtgtgcctgaaacacagaggcagactg

SEQ ID NO: 8316 - DNA, 42 bp, Artificial Sequence
  Synthetic
ccaacatctggggttcatagttatattgcctgtaccctgaac

SEQ ID NO: 8317 - DNA, 42 bp, Artificial Sequence
  Synthetic
agacattgtggctttacacagaccgcctactaaaacgcacac

SEQ ID NO: 8318 - DNA, 43 bp, Artificial Sequence
  Synthetic
acgtaggcgtcgtaaacgtattctaggaggcagataaaccttg

SEQ ID NO: 8319 - DNA, 41 bp, Artificial Sequence
  Synthetic
acagatatgtgaaaagtgcagctgtgggtcctgcttttcag

SEQ ID NO: 8320 - DNA, 41 bp, Artificial Sequence
  Synthetic
ctgcataccttagtgcttttgggagaacgtatgctgcaagc

SEQ ID NO: 8321 - DNA, 39 bp, Artificial Sequence
  Synthetic
ggcaactctccaggttgtctgcatatcaacatcaaccgg

SEQ ID NO: 8322 - DNA, 40 bp, Artificial Sequence
  Synthetic
ctgcctgcgcacctctcatgggactcaaagtgagcacacg

SEQ ID NO: 8323 - DNA, 46 bp, Artificial Sequence
  Synthetic
tgtggctattcagacaggattatgcgcatttgctacatcttgagat

SEQ ID NO: 8324 - DNA, 40 bp, Artificial Sequence
  Synthetic
aactccaggatctgggcaattctaccagggtagtgcacaa

SEQ ID NO: 8325 - DNA, 43 bp, Artificial Sequence
  Synthetic
acaactttaattggggagattgcaaaactaaatcgcagactgc

SEQ ID NO: 8326 - DNA, 47 bp, Artificial Sequence
  Synthetic
tctcttgttgtaccatgggtgacatggagtatttattatctgcagtt

SEQ ID NO: 8327 - DNA, 47 bp, Artificial Sequence
  Synthetic
tggaaaatcacactacaggaaatggggttatttctgagtcaaacctg

SEQ ID NO: 8328 - DNA, 46 bp, Artificial Sequence
  Synthetic
ggacagccatttcctagattttcttttgtctccatcatatccatca

SEQ ID NO: 8329 - DNA, 50 bp, Artificial Sequence
  Synthetic
aggaacaaggcataactgattacatgttctttaacactatctacaaaacc

SEQ ID NO: 8330 - DNA, 48 bp, Artificial Sequence
  Synthetic
aaaagttttgcaaatggacccaattatttcttaagccatgaatcagac

SEQ ID NO: 8331 - DNA, 39 bp, Artificial Sequence
  Synthetic
ggtggtggatgtcatgtctgctatagctggtggtggtgg

SEQ ID NO: 8332 - DNA, 44 bp, Artificial Sequence
  Synthetic
aacgatttatgagtcaaaaggttggaatagttgtaccactcccg

SEQ ID NO: 8333 - DNA, 44 bp, Artificial Sequence
  Synthetic
tatgcgaaaaacttgattgttgtgtctctccaagtacctctcac

SEQ ID NO: 8334 - DNA, 50 bp, Artificial Sequence
  Synthetic
agatgatgaagttgatgcagaagagccacagttacttgattattgtacaa

SEQ ID NO: 8335 - DNA, 48 bp, Artificial Sequence
  Synthetic
acaggtaacaactagtggattttcatctctactctttgcactcttaaa

SEQ ID NO: 8336 - DNA, 44 bp, Artificial Sequence
  Synthetic
aaatgcgtaatatgtcaatggcagaccctctgttttacaacgat

SEQ ID NO: 8337 - DNA, 48 bp, Artificial Sequence
  Synthetic
agatgtaaaagcagaacaatcgttgtgttaggaaactgtatacattgt

SEQ ID NO: 8338 - DNA, 47 bp, Artificial Sequence
  Synthetic
atttggaggcttaaagacacaagtttaaaacagtattttggctctgt

SEQ ID NO: 8339 - DNA, 40 bp, Artificial Sequence
  Synthetic
aaccttcgacgacgacaaggagtccgtcgtttggctcctc

SEQ ID NO: 8340 - DNA, 43 bp, Artificial Sequence
  Synthetic
gaggagctatataaacaatgtgccagcccatgtatcaccttct

SEQ ID NO: 8341 - DNA, 45 bp, Artificial Sequence
  Synthetic
cagatgagtctgcagtactagatgtccacatctaaagcaaaccgt

SEQ ID NO: 8342 - DNA, 43 bp, Artificial Sequence
  Synthetic
accttcctattttacaaccgataccaattgtagctcgctcacc

SEQ ID NO: 8343 - DNA, 45 bp, Artificial Sequence
  Synthetic
ttcagatgacttttacttgcatcctacagccatctgcaaaaaatt

SEQ ID NO: 8344 - DNA, 44 bp, Artificial Sequence
  Synthetic
gaggacgatactggtgatcacatgaacacttgattctgtttagg

SEQ ID NO: 8345 - DNA, 38 bp, Artificial Sequence
  Synthetic
caacaccgagtggctcactgtctttgcaaccaaaacgg

SEQ ID NO: 8346 - DNA, 43 bp, Artificial Sequence
  Synthetic
ttctgggacgttgatttaacagagaaatcgtctgcccaaagac

SEQ ID NO: 8347 - DNA, 41 bp, Artificial Sequence
  Synthetic
ggctgcctgcccctctttgagcacacgagactcttcacacc

SEQ ID NO: 8348 - DNA, 39 bp, Artificial Sequence
  Synthetic
tactgtttgacaccatgggcgtgagttttcatgcgagcc

SEQ ID NO: 8349 - DNA, 50 bp, Artificial Sequence
  Synthetic
aggcttaaacaaattactatcgggacagtatagagtttagtgtatcttgt

SEQ ID NO: 8350 - DNA, 43 bp, Artificial Sequence
  Synthetic
accatcatgcattgggtaggtgaattttgtggcattacattgg

SEQ ID NO: 8351 - DNA, 50 bp, Artificial Sequence
  Synthetic
aacatcactatattcccacaccagcggtacacaattaatgtatggtacaa

SEQ ID NO: 8352 - DNA, 47 bp, Artificial Sequence
  Synthetic
tggatctcaacaatttctcacaactgacactaaagtctggtagaaga

SEQ ID NO: 8353 - DNA, 49 bp, Artificial Sequence
  Synthetic
actttgcaaattggtcaggtagtatctgtactaaagctatcacaaacac

SEQ ID NO: 8354 - DNA, 38 bp, Artificial Sequence
  Synthetic
ccaacccagtggtccacaacatggtggttgaagatgcc

SEQ ID NO: 8355 - DNA, 44 bp, Artificial Sequence
  Synthetic
tttgacatggaagttactgttgtcaccaggtggtacaaacatga

SEQ ID NO: 8356 - DNA, 46 bp, Artificial Sequence
  Synthetic
tgctgtgtatggtatcacatctacagtgtcttccatagctctgaag

SEQ ID NO: 8357 - DNA, 38 bp, Artificial Sequence
  Synthetic
aaactgcaggcccaagtgattaagtgcgcattcctgta

SEQ ID NO: 8358 - DNA, 45 bp, Artificial Sequence
  Synthetic
tggtatcagatagaggaaacctgttacaatgtccttcaccaatca

SEQ ID NO: 8359 - DNA, 47 bp, Artificial Sequence
  Synthetic
ggtttcactgacacacttaaagaccgccatttaactacctttgaagt

SEQ ID NO: 8360 - DNA, 38 bp, Artificial Sequence
  Synthetic
ccaagccgacaaggtgatggatgccaatccactcaagg

SEQ ID NO: 8361 - DNA, 41 bp, Artificial Sequence
  Synthetic
atggatgatctgggccaaaacgacaccatctgacagaacat

SEQ ID NO: 8362 - DNA, 44 bp, Artificial Sequence
  Synthetic
tcaagtaggcttgctagatactgcgtggtggcttactacagttc

SEQ ID NO: 8363 - DNA, 44 bp, Artificial Sequence
  Synthetic
agaccctaaagtcattcaatactgctcaattgagccatggactg

SEQ ID NO: 8364 - DNA, 44 bp, Artificial Sequence
  Synthetic
ccttgcaaggtcctgaacatggtaatgatatggcagtttcttct

SEQ ID NO: 8365 - DNA, 49 bp, Artificial Sequence
  Synthetic
atacatgtgggtggaaatggtaggtcagcaaaatatttcctaagtagtg

SEQ ID NO: 8366 - DNA, 43 bp, Artificial Sequence
  Synthetic
tgaatgagtacatagaaacagccggttctgggttgatgtcaag

SEQ ID NO: 8367 - DNA, 43 bp, Artificial Sequence
  Synthetic
actttcctaaaggatgaactccgctccacaatcctggtcttac

SEQ ID NO: 8368 - DNA, 42 bp, Artificial Sequence
  Synthetic
agatggagaactcattgcttttgacgctttaaaccacactgg

SEQ ID NO: 8369 - DNA, 44 bp, Artificial Sequence
  Synthetic
atgagtcaatcagatggactaaggaacaaacacaacgaatggac

SEQ ID NO: 8370 - DNA, 43 bp, Artificial Sequence
  Synthetic
aaccctgctctcagaatgaaatgttctcttgtctgctgtgatt

SEQ ID NO: 8371 - DNA, 48 bp, Artificial Sequence
  Synthetic
caagtacagtccattatccaaaggtcatgttttaacctttcaaccttc

SEQ ID NO: 8372 - DNA, 44 bp, Artificial Sequence
  Synthetic
gtaaaattgctcctttaatggtggcgaaatctggttttgcggac

SEQ ID NO: 8373 - DNA, 43 bp, Artificial Sequence
  Synthetic
ggcggagagcaacagctatccttactatcaactgaatcagcct

SEQ ID NO: 8374 - DNA, 46 bp, Artificial Sequence
  Synthetic
cacttccaaaaagatgcaaaagtgccatccccatgacattgtcaat

SEQ ID NO: 8375 - DNA, 41 bp, Artificial Sequence
  Synthetic
cagggaacagagaagttgacaatcaggaccgttgatttccc

SEQ ID NO: 8376 - DNA, 40 bp, Artificial Sequence
  Synthetic
ggaaacggccgattttcccacttacttgcaaccgcccaaa

SEQ ID NO: 8377 - DNA, 44 bp, Artificial Sequence
  Synthetic
ggtgtttatgttacacatcagctgaggcactcaagagtagtctc

SEQ ID NO: 8378 - DNA, 41 bp, Artificial Sequence
  Synthetic
atgattcttcaggctgacatagctaggtataggcggcagag

SEQ ID NO: 8379 - DNA, 43 bp, Artificial Sequence
  Synthetic
ggagacccaaatgcttcctgcttactgtaaataaagctgaagc

SEQ ID NO: 8380 - DNA, 39 bp, Artificial Sequence
  Synthetic
ccaggaactaggcgcagctgccttgcatgcgtcacacat

SEQ ID NO: 8381 - DNA, 48 bp, Artificial Sequence
  Synthetic
actggtttggaactcctctatctctttcaaattcctcgctataatcct

SEQ ID NO: 8382 - DNA, 41 bp, Artificial Sequence
  Synthetic
gcttttacagccagcagcgtcgcctccctcatttcttcctc

SEQ ID NO: 8383 - DNA, 41 bp, Artificial Sequence
  Synthetic
aacatgcctgctacatctcgggaggctgacttgtccagagt

SEQ ID NO: 8384 - DNA, 42 bp, Artificial Sequence
  Synthetic
ctgctcttccctagaaacgggcgtgcagccctttaccacatt

SEQ ID NO: 8385 - DNA, 40 bp, Artificial Sequence
  Synthetic
acgatgagaccaagtccagggtgctgcatcctggtgtgtc

SEQ ID NO: 8386 - DNA, 37 bp, Artificial Sequence
  Synthetic
gaccatgacctacgcgaccgttgtcatggcggctgcg

SEQ ID NO: 8387 - DNA, 40 bp, Artificial Sequence
  Synthetic
ggggtggaggtagcaccactcccctgctatgactggatca

SEQ ID NO: 8388 - DNA, 42 bp, Artificial Sequence
  Synthetic
ggaccaccaggacaatgtagccgcattcccttccaagttgca

SEQ ID NO: 8389 - DNA, 38 bp, Artificial Sequence
  Synthetic
gggccgtagatgaccccgagacggcagttgcatctcct

SEQ ID NO: 8390 - DNA, 39 bp, Artificial Sequence
  Synthetic
ttgggacgactgcgactgtaggaggacatgacgctggcc

SEQ ID NO: 8391 - DNA, 36 bp, Artificial Sequence
  Synthetic
tttgggcgcgagaaagaccgtgcgagaccgtctgcg

SEQ ID NO: 8392 - DNA, 41 bp, Artificial Sequence
  Synthetic
cgtccacgccaagacaaaggaggaccccctggtggaaaacg

SEQ ID NO: 8393 - DNA, 41 bp, Artificial Sequence
  Synthetic
ccctgccgcaatgctttttaggtgccaccaagcttgacaat

SEQ ID NO: 8394 - DNA, 37 bp, Artificial Sequence
  Synthetic
ccagcctcggttatgcagggactaacgagcccctgcg

SEQ ID NO: 8395 - DNA, 36 bp, Artificial Sequence
  Synthetic
acaactcatgcgagggtgccctttcgcgccgagcag

SEQ ID NO: 8396 - DNA, 38 bp, Artificial Sequence
  Synthetic
gaggtgtgcgtcagggcaaatgcgacgactcggacttt

SEQ ID NO: 8397 - DNA, 40 bp, Artificial Sequence
  Synthetic
aagctcctcgtaggtgaggtccttcaggagtgggcactgg

SEQ ID NO: 8398 - DNA, 42 bp, Artificial Sequence
  Synthetic
accagcatgaaggggacaagctgcggctctttgttacctacg

SEQ ID NO: 8399 - DNA, 38 bp, Artificial Sequence
  Synthetic
gccctggctggtggttttcatctccgtcctcgaggagc

SEQ ID NO: 8400 - DNA, 38 bp, Artificial Sequence
  Synthetic
gcgtcattgacggcggcctctaccaggacaactcgggc

SEQ ID NO: 8401 - DNA, 36 bp, Artificial Sequence
  Synthetic
cgcaggcgctgaaaaaggtagtgcgccgctggatca

SEQ ID NO: 8402 - DNA, 38 bp, Artificial Sequence
  Synthetic
cgggagacggtcgacgaagccaccgaaaccatgcgtcg

SEQ ID NO: 8403 - DNA, 42 bp, Artificial Sequence
  Synthetic
aggaaagcgtctagccaatcgccgcaattctaacagcgtcca

SEQ ID NO: 8404 - DNA, 39 bp, Artificial Sequence
  Synthetic
cgacgcgctcggcaaggattgttgacatggacgacttcc

SEQ ID NO: 8405 - DNA, 38 bp, Artificial Sequence
  Synthetic
gtagccgtagaggtagcgggactctggaaccgcgtccg

SEQ ID NO: 8406 - DNA, 37 bp, Artificial Sequence
  Synthetic
ggctaaagccgcgactaacgtggcggctatcgggctt

SEQ ID NO: 8407 - DNA, 37 bp, Artificial Sequence
  Synthetic
gcatcccgtcctgcgccaaatttgtacagcgccggcg

SEQ ID NO: 8408 - DNA, 35 bp, Artificial Sequence
  Synthetic
tgattgcgcgcgaggaggttgcacgatggcctccg

SEQ ID NO: 8409 - DNA, 36 bp, Artificial Sequence
  Synthetic
cgcatggcgctcaaggtgcacggccttgtggatgcg

SEQ ID NO: 8410 - DNA, 34 bp, Artificial Sequence
  Synthetic
taagggcggcgctgcaaagttgcatcgcggcctc

SEQ ID NO: 8411 - DNA, 37 bp, Artificial Sequence
  Synthetic
acgaacgtgcagtccaacctgtgaaccgctcgcgctg

SEQ ID NO: 8412 - DNA, 39 bp, Artificial Sequence
  Synthetic
cggtcaacggtgagcagcttggtgaagggtgcgatcagc

SEQ ID NO: 8413 - DNA, 37 bp, Artificial Sequence
  Synthetic
cactgtcggccgaggaagaaagccccctcctgcatca

SEQ ID NO: 8414 - DNA, 39 bp, Artificial Sequence
  Synthetic
ccgccagggttctacacgggcccacagaaacccgtcgtt

SEQ ID NO: 8415 - DNA, 37 bp, Artificial Sequence
  Synthetic
gcctggtgtgggacgacgatcccgcccaagtccaaca

SEQ ID NO: 8416 - DNA, 41 bp, Artificial Sequence
  Synthetic
accctggaggttccgtttgtgcaatgctgtttctgccctcc

SEQ ID NO: 8417 - DNA, 40 bp, Artificial Sequence
  Synthetic
gatgccgggggtctacacctacggctctcggtgaagtcca

SEQ ID NO: 8418 - DNA, 43 bp, Artificial Sequence
  Synthetic
gcaagaggagatagcagtgtcccaatctctagctccttctcag

SEQ ID NO: 8419 - DNA, 42 bp, Artificial Sequence
  Synthetic
tcagcaactaccccgtggttggggcgagatcgttgtaaaagc

SEQ ID NO: 8420 - DNA, 39 bp, Artificial Sequence
  Synthetic
cgcgtgctctccagtcgcatgttattgctgggcgagatg

SEQ ID NO: 8421 - DNA, 35 bp, Artificial Sequence
  Synthetic
aactacacccccgcccccttagtcgcgcgcgtcag

SEQ ID NO: 8422 - DNA, 37 bp, Artificial Sequence
  Synthetic
cgtgtactgggtgcgcgagatcagggacgaggaggac

SEQ ID NO: 8423 - DNA, 40 bp, Artificial Sequence
  Synthetic
cggcacggcggtggtgtttaatagctacgcttgctcctga

SEQ ID NO: 8424 - DNA, 37 bp, Artificial Sequence
  Synthetic
aaatggatgtggagcccgaggtccacggtctgcacgc

SEQ ID NO: 8425 - DNA, 40 bp, Artificial Sequence
  Synthetic
ccaggaggcgaagatggggctggaaggatgcaacacgtag

SEQ ID NO: 8426 - DNA, 36 bp, Artificial Sequence
  Synthetic
caggagaggcatggcaggcaggaacccgccactcag

SEQ ID NO: 8427 - DNA, 38 bp, Artificial Sequence
  Synthetic
gaacgggggcgccttcaatttaggtccggagcgttgag

SEQ ID NO: 8428 - DNA, 37 bp, Artificial Sequence
  Synthetic
cctgacgcggaggagacgaaagggcctcctcgtacga

SEQ ID NO: 8429 - DNA, 40 bp, Artificial Sequence
  Synthetic
gagcacgctgcacagtatcgtcttaatagcatcggcggcg

SEQ ID NO: 8430 - DNA, 39 bp, Artificial Sequence
  Synthetic
cacccacgatgtgaccacggagatccacgggcacaaagc

SEQ ID NO: 8431 - DNA, 43 bp, Artificial Sequence
  Synthetic
aagggtctgcaaattggtgttgttcgtttgcatagataggctc

SEQ ID NO: 8432 - DNA, 39 bp, Artificial Sequence
  Synthetic
gaactctgcggtggacagttttccacaccgtgattctca

SEQ ID NO: 8433 - DNA, 42 bp, Artificial Sequence
  Synthetic
cctacgagtacatgaacgggcgcgccaatgttaacgtaagcg

SEQ ID NO: 8434 - DNA, 35 bp, Artificial Sequence
  Synthetic
gcgcctccgtccgctttgatgtgcgccatggggaa

SEQ ID NO: 8435 - DNA, 40 bp, Artificial Sequence
  Synthetic
aacgtggcccaatgcaacatggccctggtagccaatgttg

SEQ ID NO: 8436 - DNA, 35 bp, Artificial Sequence
  Synthetic
cagccctaccccgccaacttgggtgacggagggca

SEQ ID NO: 8437 - DNA, 35 bp, Artificial Sequence
  Synthetic
ggcaacgccaccacctaagctcgcgcacaatggcc

SEQ ID NO: 8438 - DNA, 40 bp, Artificial Sequence
  Synthetic
ttcgagtacgaggccatgttgctgctcgaggctgagacag

SEQ ID NO: 8439 - DNA, 38 bp, Artificial Sequence
  Synthetic
tccggcgcaaccaggaggaagcgaaagtagggggagtg

SEQ ID NO: 8440 - DNA, 38 bp, Artificial Sequence
  Synthetic
gtctcgctccacatgcgccgcggtcccaactgcgattt

SEQ ID NO: 8441 - DNA, 40 bp, Artificial Sequence
  Synthetic
ctgcttaaaagcttgctgggccttagcgggaaaagctgcg

SEQ ID NO: 8442 - DNA, 35 bp, Artificial Sequence
  Synthetic
tggccttccacctcggcaaactgggagtgcaccgg

SEQ ID NO: 8443 - DNA, 40 bp, Artificial Sequence
  Synthetic
tggtatccatgcccttctcccatctgaacgtgtgcaaccc

SEQ ID NO: 8444 - DNA, 36 bp, Artificial Sequence
  Synthetic
ccggagcccacccgctgataaaaggagcccctcgcc

SEQ ID NO: 8445 - DNA, 41 bp, Artificial Sequence
  Synthetic
acagaaggaaaccaacgctgggagcagcacatcctcctgtc

SEQ ID NO: 8446 - DNA, 40 bp, Artificial Sequence
  Synthetic
ctcacccattttgcctaccccggatccatgatgcgacgca

SEQ ID NO: 8447 - DNA, 39 bp, Artificial Sequence
  Synthetic
cgtggagctaaccaacctggtcagcacagtctgccccag

SEQ ID NO: 8448 - DNA, 39 bp, Artificial Sequence
  Synthetic
gccttggacctggccgaaatctcataaagtcgggcagcc

SEQ ID NO: 8449 - DNA, 35 bp, Artificial Sequence
  Synthetic
gccactgccgctgcaacctggagctgggggttgca

SEQ ID NO: 8450 - DNA, 40 bp, Artificial Sequence
  Synthetic
ctcgcccaattgcacgccatccaggtagacccctttaccc

SEQ ID NO: 8451 - DNA, 40 bp, Artificial Sequence
  Synthetic
gggatcgagtaaagggtgacggtgtgggccctccatgatc

SEQ ID NO: 8452 - DNA, 40 bp, Artificial Sequence
  Synthetic
aaatcggtctctgcgctcgcgctgcagctgatcttcgttt

SEQ ID NO: 8453 - DNA, 40 bp, Artificial Sequence
  Synthetic
gtccgcccagacccgacttaagttgtatgcctttgcctcg

SEQ ID NO: 8454 - DNA, 40 bp, Artificial Sequence
  Synthetic
taccccgacgagttcataccgattcagtcgtagccgtcga

SEQ ID NO: 8455 - DNA, 41 bp, Artificial Sequence
  Synthetic
atccagtgtcgtcataatcgcaaaagttcacctgttcctgg

SEQ ID NO: 8456 - DNA, 44 bp, Artificial Sequence
  Synthetic
ggggtgtactgtcatgccactactgtacatataacactcctctc

SEQ ID NO: 8457 - DNA, 42 bp, Artificial Sequence
  Synthetic
ctgctggtaggggctctaatgagcaatttttccttctgctca

SEQ ID NO: 8458 - DNA, 48 bp, Artificial Sequence
  Synthetic
taatgctgacaagtctcatgaaaggtctacttttcccttactgtcatg

SEQ ID NO: 8459 - DNA, 43 bp, Artificial Sequence
  Synthetic
atcaacaaataaccttcagccaacattgccatttggaggtcca

SEQ ID NO: 8460 - DNA, 43 bp, Artificial Sequence
  Synthetic
acaagttgcagaaactgatcaaaacatcactcccaccacgatt

SEQ ID NO: 8461 - DNA, 42 bp, Artificial Sequence
  Synthetic
ttgctgcaaagccagaaaaaaatcggctgaggattcccgatt

SEQ ID NO: 8462 - DNA, 42 bp, Artificial Sequence
  Synthetic
tcctgcagcttatcgactggtgtgtattcgggactgtggtga

SEQ ID NO: 8463 - DNA, 38 bp, Artificial Sequence
  Synthetic
ctggaactctgttggggcataactgatttctgcgggga

SEQ ID NO: 8464 - DNA, 41 bp, Artificial Sequence
  Synthetic
cgaaaccagcggctgtatccagcaaagggtcttaaggaggg

SEQ ID NO: 8465 - DNA, 46 bp, Artificial Sequence
  Synthetic
tggaaatgtctcactcaaggttggcaaaggtggttcagtattaact

SEQ ID NO: 8466 - DNA, 44 bp, Artificial Sequence
  Synthetic
agaagataaacgcaccctatggaatcctgatcaattctgcaatt

SEQ ID NO: 8467 - DNA, 41 bp, Artificial Sequence
  Synthetic
ggaaagccacatcaaccagcgtattcacatccagtttcctg

SEQ ID NO: 8468 - DNA, 38 bp, Artificial Sequence
  Synthetic
gtgcgggaactggacttgggaatcaccgacccccgttt

SEQ ID NO: 8469 - DNA, 42 bp, Artificial Sequence
  Synthetic
atgttgggaatgatggaacccacagtgtgtttataaggggca

SEQ ID NO: 8470 - DNA, 45 bp, Artificial Sequence
  Synthetic
tggaaactcttgcagcaggggcagattatcataatgtaagttctg

SEQ ID NO: 8471 - DNA, 40 bp, Artificial Sequence
  Synthetic
gcggaggcaggattggaagaacctgcgtgacttgcacttt

SEQ ID NO: 8472 - DNA, 42 bp, Artificial Sequence
  Synthetic
tccgcacatgtggaaaagctgtttctattatgaaggtttgcc

SEQ ID NO: 8473 - DNA, 45 bp, Artificial Sequence
  Synthetic
atcctgtaaatacgtcactaggacctctactaaccatgcttcagc

SEQ ID NO: 8474 - DNA, 40 bp, Artificial Sequence
  Synthetic
actgggttagtatgcccgtgtgtactcgttcctactggat

SEQ ID NO: 8475 - DNA, 41 bp, Artificial Sequence
  Synthetic
aatgacggaaggtgtaaaaacccggaagtgtgtttgcgaaa

SEQ ID NO: 8476 - DNA, 42 bp, Artificial Sequence
  Synthetic
agtctggcggaggagcaattatagggcctaatgtgaagacag

SEQ ID NO: 8477 - DNA, 49 bp, Artificial Sequence
  Synthetic
agttcaagtttggatagtgttggtgcttctaatctattgaagaatcctt

SEQ ID NO: 8478 - DNA, 42 bp, Artificial Sequence
  Synthetic
caatgggcgttgctgtggtaccatgtccaaatatgttcttcc

SEQ ID NO: 8479 - DNA, 43 bp, Artificial Sequence
  Synthetic
aatgacagcaatgaaagatggatgatcttctgcaccacgaatc

SEQ ID NO: 8480 - DNA, 44 bp, Artificial Sequence
  Synthetic
tgatgatgctacagcggctgcttctattgtccaagtatcctgtt

SEQ ID NO: 8481 - DNA, 39 bp, Artificial Sequence
  Synthetic
acagaagctggctccatggtatatcgtcggctttgcatg

SEQ ID NO: 8482 - DNA, 42 bp, Artificial Sequence
  Synthetic
aaggtatacacagggcctctagtgcccatattctcaggtaga

SEQ ID NO: 8483 - DNA, 38 bp, Artificial Sequence
  Synthetic
tccagagcttgaagatgccgttacgcttgatggtcgtc

SEQ ID NO: 8484 - DNA, 44 bp, Artificial Sequence
  Synthetic
cactccaaagaacaaccacaacctggactttttgtgttgttgtt

SEQ ID NO: 8485 - DNA, 43 bp, Artificial Sequence
  Synthetic
aaagacaaggtttgacccctctctctcttatcaagtcaggctt

SEQ ID NO: 8486 - DNA, 45 bp, Artificial Sequence
  Synthetic
cctctcaaaacaggtcctgacaatctcctaccttgactattctga

SEQ ID NO: 8487 - DNA, 44 bp, Artificial Sequence
  Synthetic
tctactaccatggtccagccgctagagctactttattggcatta

SEQ ID NO: 8488 - DNA, 43 bp, Artificial Sequence
  Synthetic
tatcagtgaatctgctggttacactaacggggaggattccttt

SEQ ID NO: 8489 - DNA, 43 bp, Artificial Sequence
  Synthetic
ccacatatgaatctagtcatctgggttggaacacagcatcgac

SEQ ID NO: 8490 - DNA, 48 bp, Artificial Sequence
  Synthetic
aagcagagagaaaaacaacaacacattgcttttgttcttgtttgtgat

SEQ ID NO: 8491 - DNA, 42 bp, Artificial Sequence
  Synthetic
tgtcattggtaccatagcactaggtcagctaatgcaatgccc

SEQ ID NO: 8492 - DNA, 50 bp, Artificial Sequence
  Synthetic
aagggaactgtgatagatgttgattcctggtatttctgataaaattggta

SEQ ID NO: 8493 - DNA, 46 bp, Artificial Sequence
  Synthetic
ttgacctataccaattgcggtttcccttttattggcatatagttct

SEQ ID NO: 8494 - DNA, 46 bp, Artificial Sequence
  Synthetic
aacctataaggcaacagcatccccaatatgaactatttgttttccc

SEQ ID NO: 8495 - DNA, 50 bp, Artificial Sequence
  Synthetic
tctcattattacctggaccaagtctgataatgaaggtagtctaacacatc

SEQ ID NO: 8496 - DNA, 43 bp, Artificial Sequence
  Synthetic
acaaggggttatcagttatgctccccttcactcgagtagtctg

SEQ ID NO: 8497 - DNA, 43 bp, Artificial Sequence
  Synthetic
gtggcttaacaactccgctctgattaacattggtacatctgtt

SEQ ID NO: 8498 - DNA, 43 bp, Artificial Sequence
  Synthetic
ccaacctgcaaataggatcattagagacaggacttcatgaggc

SEQ ID NO: 8499 - DNA, 50 bp, Artificial Sequence
  Synthetic
tcaacatgctaagactcaagaatgtgagtgatacatgatgtagtagtgta

SEQ ID NO: 8500 - DNA, 49 bp, Artificial Sequence
  Synthetic
agagttactcagactggatatcccatcagagactgaaaaaatggatctt

SEQ ID NO: 8501 - DNA, 49 bp, Artificial Sequence
  Synthetic
gaattatgggagcttatcgactcttagtgataaaggttctagtagtgat

SEQ ID NO: 8502 - DNA, 45 bp, Artificial Sequence
  Synthetic
tggtaaagggagaaattgacctactatcttggaacacctgagaca

SEQ ID NO: 8503 - DNA, 44 bp, Artificial Sequence
  Synthetic
gtgacatccagagttcctgtcagtgatttcttcatagacgtgag

SEQ ID NO: 8504 - DNA, 46 bp, Artificial Sequence
  Synthetic
ttgtcagaaatataggtgatccagcacctgctttgatgaatctctt

SEQ ID NO: 8505 - DNA, 45 bp, Artificial Sequence
  Synthetic
agaaactccagacccgttagaatttacatatttctgagccttcaa

SEQ ID NO: 8506 - DNA, 46 bp, Artificial Sequence
  Synthetic
ttgaagttactcacccctgtatcggtagcagtatctctcaatctgt

SEQ ID NO: 8507 - DNA, 46 bp, Artificial Sequence
  Synthetic
aaagacacatcacatgcagtccccagaatcgtttgaatattttagg

SEQ ID NO: 8508 - DNA, 43 bp, Artificial Sequence
  Synthetic
ctgctgaggttcaacacaatatacccccttaacccccagaagg

SEQ ID NO: 8509 - DNA, 39 bp, Artificial Sequence
  Synthetic
atctcggagaaggtgcaggtgttcatgcagggtcctaat

SEQ ID NO: 8510 - DNA, 41 bp, Artificial Sequence
  Synthetic
ccatacagccatgggacaggattgatgtgttctgttgactg

SEQ ID NO: 8511 - DNA, 39 bp, Artificial Sequence
  Synthetic
gtcgtcagacctatgactggatatagtgttggctagcgc

SEQ ID NO: 8512 - DNA, 50 bp, Artificial Sequence
  Synthetic
aaatggtcacacaacgaacaataggttatcagatagcttctcttgttcaa

SEQ ID NO: 8513 - DNA, 46 bp, Artificial Sequence
  Synthetic
atgactaattcacaagacacagagcctcattccatttggtgttgtc

SEQ ID NO: 8514 - DNA, 45 bp, Artificial Sequence
  Synthetic
gcatgaagctccgaacacaaggttgattcattaaagtatttcagg

SEQ ID NO: 8515 - DNA, 40 bp, Artificial Sequence
  Synthetic
ccaatcctctgatgacttcgccctgcttgtattccctcat

SEQ ID NO: 8516 - DNA, 40 bp, Artificial Sequence
  Synthetic
atgagcattggggtaacagtgagttgaagagccatttggg

SEQ ID NO: 8517 - DNA, 45 bp, Artificial Sequence
  Synthetic
gtaatcccctgaatccatttgtcacattaccacagcattgtttac

SEQ ID NO: 8518 - DNA, 38 bp, Artificial Sequence
  Synthetic
tcgtacaggagaccagttggaatccgagccctagacac

SEQ ID NO: 8519 - DNA, 44 bp, Artificial Sequence
  Synthetic
aggactacgaggtggactttgagcaattcttctgttgttaattc

SEQ ID NO: 8520 - DNA, 40 bp, Artificial Sequence
  Synthetic
atacggtgccatgcatgcagcgcctgtacctgatgctcct

SEQ ID NO: 8521 - DNA, 40 bp, Artificial Sequence
  Synthetic
ttgttgaacaagcacagcaggctgcaccaccagcctaact

SEQ ID NO: 8522 - DNA, 43 bp, Artificial Sequence
  Synthetic
agtgataagtcaatatgtggggacttttacagcctctgccaca

SEQ ID NO: 8523 - DNA, 40 bp, Artificial Sequence
  Synthetic
ccaccaaagattagaagcgcacgtttcgccatacacctcg

SEQ ID NO: 8524 - DNA, 44 bp, Artificial Sequence
  Synthetic
ccttcttggccagtaactgccatgcttacacattgtaattgcat

SEQ ID NO: 8525 - DNA, 44 bp, Artificial Sequence
  Synthetic
tgagcctactaaattttctgggaggaccaaaaatggctgcttga

SEQ ID NO: 8526 - DNA, 42 bp, Artificial Sequence
  Synthetic
gcaacaagcttgaggaccaaataacattgcattttccaaacg

SEQ ID NO: 8527 - DNA, 42 bp, Artificial Sequence
  Synthetic
tgtggaatacgcagccacaacaaatttaactgttagtctgcg

SEQ ID NO: 8528 - DNA, 43 bp, Artificial Sequence
  Synthetic
acatgcaagtgttgtggtatatggacatatgagcagcagtgta

SEQ ID NO: 8529 - DNA, 40 bp, Artificial Sequence
  Synthetic
gtggatattggccctgtgtccctagagggatcggcagcac

SEQ ID NO: 8530 - DNA, 40 bp, Artificial Sequence
  Synthetic
accttgccggccatgtcatttgtgcattgggatttcctca

SEQ ID NO: 8531 - DNA, 42 bp, Artificial Sequence
  Synthetic
atgctgaccctgaggtgttggagccctgtactgtaagtgtgg

SEQ ID NO: 8532 - DNA, 41 bp, Artificial Sequence
  Synthetic
cgtcgtaaacgtgtaccctattctataccttgccgtcacca

SEQ ID NO: 8533 - DNA, 40 bp, Artificial Sequence
  Synthetic
tatccccaaggtgtctggctattagggtcaggaagctgta

SEQ ID NO: 8534 - DNA, 43 bp, Artificial Sequence
  Synthetic
gtttacgcagggaacaaatgttttaataagagtcaggcagtgc

SEQ ID NO: 8535 - DNA, 43 bp, Artificial Sequence
  Synthetic
aattgtttgtaaccgttgtggatacgggggatgtagcagtaca

SEQ ID NO: 8536 - DNA, 41 bp, Artificial Sequence
  Synthetic
gcccaaggaggatcgctatggtggaaaacttgtctcgtaaa

SEQ ID NO: 8537 - DNA, 43 bp, Artificial Sequence
  Synthetic
gttgttttgtattgtgctgtactggtcatacaaaccaggcacc

SEQ ID NO: 8538 - DNA, 42 bp, Artificial Sequence
  Synthetic
gttccttgtgttcgggtagccacaacaaaaaaggcgggagac

SEQ ID NO: 8539 - DNA, 44 bp, Artificial Sequence
  Synthetic
tttgtgctgactactttcccttaaagtttcctggctagaaaagt

SEQ ID NO: 8540 - DNA, 41 bp, Artificial Sequence
  Synthetic
aacatgtttacaaggtgggacgtgggtttggacaggacttt

SEQ ID NO: 8541 - DNA, 40 bp, Artificial Sequence
  Synthetic
acctccaacaaagcctgaagaggctgttcacagttggtat

SEQ ID NO: 8542 - DNA, 37 bp, Artificial Sequence
  Synthetic
aacctgactcacgctcagggcatgggggatgcggagg

SEQ ID NO: 8543 - DNA, 38 bp, Artificial Sequence
  Synthetic
cgaccgcgccattccattggtaggggccaatgggaggc

SEQ ID NO: 8544 - DNA, 41 bp, Artificial Sequence
  Synthetic
atcacccgaaaactagaggacattgactttcaaacaacccg

SEQ ID NO: 8545 - DNA, 42 bp, Artificial Sequence
  Synthetic
agttggcctaactcaccaaaaacttctaagtaagcgccccaa

SEQ ID NO: 8546 - DNA, 35 bp, Artificial Sequence
  Synthetic
tgcgtggtctccggtgcctacccgctgaacccacc

SEQ ID NO: 8547 - DNA, 38 bp, Artificial Sequence
  Synthetic
tgggtgggtgtacgtaggttccattcagcggccccgtg

SEQ ID NO: 8548 - DNA, 41 bp, Artificial Sequence
  Synthetic
gagatgctgctgtgtgaggcagccccaccttatcgttcaag

SEQ ID NO: 8549 - DNA, 40 bp, Artificial Sequence
  Synthetic
tggaagcctgctcagggatttcccgccttctgccatggta

SEQ ID NO: 8550 - DNA, 38 bp, Artificial Sequence
  Synthetic
acgtgggctgggcggatctgccccccttggtagatgtt

SEQ ID NO: 8551 - DNA, 40 bp, Artificial Sequence
  Synthetic
tctcccggattcactgccatctgtttcgggcgaacgtgag

SEQ ID NO: 8552 - DNA, 42 bp, Artificial Sequence
  Synthetic
ctcttcgcctacgcacaagtggctacggatcatgctctcacc

SEQ ID NO: 8553 - DNA, 37 bp, Artificial Sequence
  Synthetic
accagtgtcgccagtgcctcaggagaacgcattcggc

SEQ ID NO: 8554 - DNA, 39 bp, Artificial Sequence
  Synthetic
ccgagctcgggactctggtacccgttcccttttcagcgc

SEQ ID NO: 8555 - DNA, 40 bp, Artificial Sequence
  Synthetic
actggatgtgggcaaaggatgtacttatggcagcctttgt

SEQ ID NO: 8556 - DNA, 36 bp, Artificial Sequence
  Synthetic
tggcgatctgggagttggcggtccggacggccttga

SEQ ID NO: 8557 - DNA, 40 bp, Artificial Sequence
  Synthetic
tagaggctgccgatgcctgaggtcacatctcacgcatacg

SEQ ID NO: 8558 - DNA, 37 bp, Artificial Sequence
  Synthetic
atgggagaggcaccactctgtatacccccacacggcg

SEQ ID NO: 8559 - DNA, 36 bp, Artificial Sequence
  Synthetic
gcaatgccagcgcggggtatgcaggagtggacgctg

SEQ ID NO: 8560 - DNA, 39 bp, Artificial Sequence
  Synthetic
tcgggcgaagagcttccggcgttgaatctctacacggca

SEQ ID NO: 8561 - DNA, 37 bp, Artificial Sequence
  Synthetic
cggacagtgtcgcgctgcacgctggcaattgacctgc

SEQ ID NO: 8562 - DNA, 35 bp, Artificial Sequence
  Synthetic
gcgctgggcggttgaggttggctcctcagggtgct

SEQ ID NO: 8563 - DNA, 39 bp, Artificial Sequence
  Synthetic
ccctggctgaactcaccgacagcccccagttggattccg

SEQ ID NO: 8564 - DNA, 38 bp, Artificial Sequence
  Synthetic
ggccaccatcccgtgacaggcgtccccgtggatacctg

SEQ ID NO: 8565 - DNA, 40 bp, Artificial Sequence
  Synthetic
ggtatccacacggagcaggcccgctattacaatgttggcg

SEQ ID NO: 8566 - DNA, 39 bp, Artificial Sequence
  Synthetic
ctccagcggcccaaagggacggaattggagtctccggat

SEQ ID NO: 8567 - DNA, 39 bp, Artificial Sequence
  Synthetic
accagccaccagacgagcacggactggtccatgtgttcc

SEQ ID NO: 8568 - DNA, 40 bp, Artificial Sequence
  Synthetic
cggttgaaggagcccacgttattccaagcaggggtttagc

SEQ ID NO: 8569 - DNA, 41 bp, Artificial Sequence
  Synthetic
cgtcgcctataccgcatctgcgctttggagaacccctttgg

SEQ ID NO: 8570 - DNA, 38 bp, Artificial Sequence
  Synthetic
agagacacaagcccccccggggcgccattactcgaatg

SEQ ID NO: 8571 - DNA, 36 bp, Artificial Sequence
  Synthetic
cgcaccgtagcccgcgaaatgcagtgtcccaacccg

SEQ ID NO: 8572 - DNA, 36 bp, Artificial Sequence
  Synthetic
gcagcactacgtggcgggaacgccatgcttgggtca

SEQ ID NO: 8573 - DNA, 39 bp, Artificial Sequence
  Synthetic
aaaagctcagggcatccgcgcagtcgaacagggtgttgg

SEQ ID NO: 8574 - DNA, 41 bp, Artificial Sequence
  Synthetic
atcctgctgctcctgctcatccgagcagcagcaggatgagc

SEQ ID NO: 8575 - DNA, 42 bp, Artificial Sequence
  Synthetic
cggtggaggtaaaggtgttgcgagtcctactttaccggtggc

SEQ ID NO: 8576 - DNA, 42 bp, Artificial Sequence
  Synthetic
gtgtacctggggcacctcaaccaacccgctcgaacttatggt

SEQ ID NO: 8577 - DNA, 42 bp, Artificial Sequence
  Synthetic
atctggatcccttgacctcggctggaggtccttcccttcaac

SEQ ID NO: 8578 - DNA, 36 bp, Artificial Sequence
  Synthetic
ttccttgcaggcgaagaggctaactggcgccgtggc

SEQ ID NO: 8579 - DNA, 35 bp, Artificial Sequence
  Synthetic
gacgagtgcagcaccaggtaacaggctggcgtggg

SEQ ID NO: 8580 - DNA, 34 bp, Artificial Sequence
  Synthetic
accgcgttgtcggagctgtgagcccacggacgga

SEQ ID NO: 8581 - DNA, 43 bp, Artificial Sequence
  Synthetic
agctagaggatttgcgattgctatatgtcagcctctgataacg

SEQ ID NO: 8582 - DNA, 38 bp, Artificial Sequence
  Synthetic
agacgctgactctagtgtgccctcctcctcggtcccgt

SEQ ID NO: 8583 - DNA, 40 bp, Artificial Sequence
  Synthetic
ccggtggaggatcaggaggacctgactgtggagtgtgtac

SEQ ID NO: 8584 - DNA, 48 bp, Artificial Sequence
  Synthetic
atggattgttagacagacgttggtaggtcatatgcatactgtaccata

SEQ ID NO: 8585 - DNA, 41 bp, Artificial Sequence
  Synthetic
agtgttctatggacctgcagactaggaactgcaacaagctc

SEQ ID NO: 8586 - DNA, 48 bp, Artificial Sequence
  Synthetic
gaggaggacagatggaaatatttgcgcaaaaggaaatggattcttaaa

SEQ ID NO: 8587 - DNA, 41 bp, Artificial Sequence
  Synthetic
aggccatagaggtacagctggccatgcctccgtgctatagg

SEQ ID NO: 8588 - DNA, 37 bp, Artificial Sequence
  Synthetic
gtatccccagtcccagccccacaacgcttgggtgggc

SEQ ID NO: 8589 - DNA, 47 bp, Artificial Sequence
  Synthetic
gatagcattgccagggtatatgtcttgaaatgtattggaccatatgt

SEQ ID NO: 8590 - DNA, 42 bp, Artificial Sequence
  Synthetic
cacacctaacacccccacttgcagcaaatacaaaaaaaacac

SEQ ID NO: 8591 - DNA, 42 bp, Artificial Sequence
  Synthetic
gccgtcttggatatcacccccttggctcagtgtatagtgggt

SEQ ID NO: 8592 - DNA, 38 bp, Artificial Sequence
  Synthetic
ttgatgagttacccgccgcctagatgcggaggtggcag

SEQ ID NO: 8593 - DNA, 40 bp, Artificial Sequence
  Synthetic
atgtctatgtcacgcggactaacccacagtgagaagccta

SEQ ID NO: 8594 - DNA, 43 bp, Artificial Sequence
  Synthetic
atcctgattatctgaagatggctgcatttgttccctacgcagc

SEQ ID NO: 8595 - DNA, 40 bp, Artificial Sequence
  Synthetic
atggatccccagttgttagaggctgtaaactggcagacgg

SEQ ID NO: 8596 - DNA, 38 bp, Artificial Sequence
  Synthetic
cttgtgtgtagcccccagttttaagctgggttggcaac

SEQ ID NO: 8597 - DNA, 47 bp, Artificial Sequence
  Synthetic
ccttcaattggcagatctaaaacgaggactcaaagctaatactgaat

SEQ ID NO: 8598 - DNA, 43 bp, Artificial Sequence
  Synthetic
gccagggtgtgtaaggagttccaaatgattctttaaactttgc

SEQ ID NO: 8599 - DNA, 42 bp, Artificial Sequence
  Synthetic
tgcatgttggcagttcatggaactgaaatgtcattaccatct

SEQ ID NO: 8600 - DNA, 46 bp, Artificial Sequence
  Synthetic
agcaaaacaagctataatgatggccttttctctgccaaattcagaa

SEQ ID NO: 8601 - DNA, 41 bp, Artificial Sequence
  Synthetic
gacgagggggaagtcgaaggaccgatatctgcgttttccgt

SEQ ID NO: 8602 - DNA, 38 bp, Artificial Sequence
  Synthetic
tggcatagggacaggcaaagcacttccacctcccaaag

SEQ ID NO: 8603 - DNA, 44 bp, Artificial Sequence
  Synthetic
gtagtggtagtaatactcctgcagtgctgcacttctagtactgc

SEQ ID NO: 8604 - DNA, 47 bp, Artificial Sequence
  Synthetic
aactagaaagaccaaggttctctgatagttcctaatctgctaagcct

SEQ ID NO: 8605 - DNA, 46 bp, Artificial Sequence
  Synthetic
attaccagcaataataacaccaggctcattggaagcaaaatcatct

SEQ ID NO: 8606 - DNA, 44 bp, Artificial Sequence
  Synthetic
gtagtgatcgccttctaacagttgagccttagtcctactgtcag

SEQ ID NO: 8607 - DNA, 47 bp, Artificial Sequence
  Synthetic
tttcagggtagtactgatagcagactactattaaaagctgggtttgt

SEQ ID NO: 8608 - DNA, 44 bp, Artificial Sequence
  Synthetic
gtttacagcacgataggtcctcatcaaaatatcaggccacttac

SEQ ID NO: 8609 - DNA, 45 bp, Artificial Sequence
  Synthetic
gtttactttcctactcctagtggctgtaagggcgatttaggatca

SEQ ID NO: 8610 - DNA, 50 bp, Artificial Sequence
  Synthetic
attgtctcagacatctcttggaaggggttattcctttgtttaacaatcct

SEQ ID NO: 8611 - DNA, 40 bp, Artificial Sequence
  Synthetic
gtgtgttactgactcacagggtcaaaagcagggtggagtg

SEQ ID NO: 8612 - DNA, 45 bp, Artificial Sequence
  Synthetic
ggatactttagagcgccttgtacagggagaattacccctcattct

SEQ ID NO: 8613 - DNA, 45 bp, Artificial Sequence
  Synthetic
tagacgatgatgtggatgaagttgattcacagtcctcagttaact

SEQ ID NO: 8614 - DNA, 39 bp, Artificial Sequence
  Synthetic
gagccgagctctgaaaccaagtaaaagcaagcgacatgc

SEQ ID NO: 8615 - DNA, 48 bp, Artificial Sequence
  Synthetic
agcagactcatttgatctatcacaatctgaatcttctgtaaatccatt

SEQ ID NO: 8616 - DNA, 41 bp, Artificial Sequence
  Synthetic
actgctgcagaagttggaagcatgtaagtcgcgagagaccc

SEQ ID NO: 8617 - DNA, 44 bp, Artificial Sequence
  Synthetic
aaaagggtgtacgtattgctttggacgtcttttattggcttgca

SEQ ID NO: 8618 - DNA, 38 bp, Artificial Sequence
  Synthetic
tgggcttggcattggaacagctacagtgccacctagtg

SEQ ID NO: 8619 - DNA, 39 bp, Artificial Sequence
  Synthetic
tatcagaggtcacaggggttggctatcagcagtaccacc

SEQ ID NO: 8620 - DNA, 48 bp, Artificial Sequence
  Synthetic
actcatgtgggttatacagaagacatcttctaattcaaattcactcct

SEQ ID NO: 8621 - DNA, 47 bp, Artificial Sequence
  Synthetic
atgatttggcagagattggggaggcctatttaaaattcttacatcag

SEQ ID NO: 8622 - DNA, 49 bp, Artificial Sequence
  Synthetic
cctgatggagttctggtagatgaccgttttctttttcgagaatacaaac

SEQ ID NO: 8623 - DNA, 48 bp, Artificial Sequence
  Synthetic
ttaagcacagaccaaaataccgtttctaaataccctgaattgattacc

SEQ ID NO: 8624 - DNA, 47 bp, Artificial Sequence
  Synthetic
atggattaatcagtgaccaaaaggacaattgattttgtttgggatca

SEQ ID NO: 8625 - DNA, 41 bp, Artificial Sequence
  Synthetic
ttgactagcagcgaatcaaacatatttgcaccctgagctct

SEQ ID NO: 8626 - DNA, 44 bp, Artificial Sequence
  Synthetic
tctgcatttttgttaccccaccgatatgttttgaagtgccaaat

SEQ ID NO: 8627 - DNA, 50 bp, Artificial Sequence
  Synthetic
atcactatatgtgtcagcctcattggatgaaaattttagcaatacatccg

SEQ ID NO: 8628 - DNA, 44 bp, Artificial Sequence
  Synthetic
actcagctcccttgataataagagaagcaaagtgtctgcattct

SEQ ID NO: 8629 - DNA, 49 bp, Artificial Sequence
  Synthetic
aatggacatatatcggagttgatgggcttctccatattttattttgacc

SEQ ID NO: 8630 - DNA, 39 bp, Artificial Sequence
  Synthetic
cactgaagagtgcacatgcggtctctacaggcacattct

SEQ ID NO: 8631 - DNA, 40 bp, Artificial Sequence
  Synthetic
ggcatcaaaggaggattcgtcctcgttcgggagtaccatc

SEQ ID NO: 8632 - DNA, 41 bp, Artificial Sequence
  Synthetic
acagccatttactgtttgatgggtatcaacgcctgtgacag

SEQ ID NO: 8633 - DNA, 47 bp, Artificial Sequence
  Synthetic
aacagatatacatgtaaccgcttgctcctgtctgtattctttccaag

SEQ ID NO: 8634 - DNA, 39 bp, Artificial Sequence
  Synthetic
attgacctgcaatgctacgaggcctccaactcttgttca

SEQ ID NO: 8635 - DNA, 41 bp, Artificial Sequence
  Synthetic
gtgtcgtgaagaaattcggaatgtcgctacacccttctttg

SEQ ID NO: 8636 - DNA, 45 bp, Artificial Sequence
  Synthetic
cggagcaagtacaaaagttaaaacggtgggctaagttgttgaact

SEQ ID NO: 8637 - DNA, 45 bp, Artificial Sequence
  Synthetic
acaatgggcctatgatagcgatcactatttgccattttagcataa

SEQ ID NO: 8638 - DNA, 41 bp, Artificial Sequence
  Synthetic
aattagagctcagtgacccagaattgaaacgagcgttgagt

SEQ ID NO: 8639 - DNA, 42 bp, Artificial Sequence
  Synthetic
tggcagtatctgaaaccaaagcggagacttttgcaagctttg

SEQ ID NO: 8640 - DNA, 41 bp, Artificial Sequence
  Synthetic
gttaccttcgctgatgatgctggttgttaatgcggacttca

SEQ ID NO: 8641 - DNA, 37 bp, Artificial Sequence
  Synthetic
caccagcaccacagcaaccactgtggctgtggctgtg

SEQ ID NO: 8642 - DNA, 41 bp, Artificial Sequence
  Synthetic
caacctccagagattccagccctacttctccctcccctccc

SEQ ID NO: 8643 - DNA, 47 bp, Artificial Sequence
  Synthetic
gatcctccagtaatacttttgcgacgcttcttatctctgtatctgta

SEQ ID NO: 8644 - DNA, 42 bp, Artificial Sequence
  Synthetic
tagaggaacctacaccaccaagctacagcttgtgtgatgttg

SEQ ID NO: 8645 - DNA, 41 bp, Artificial Sequence
  Synthetic
gctgtagaagaacctccagacagtaaagagggcggcttaat

SEQ ID NO: 8646 - DNA, 44 bp, Artificial Sequence
  Synthetic
gatgctactattgtccaaggccggcagttcctgaacatttaaat

SEQ ID NO: 8647 - DNA, 48 bp, Artificial Sequence
  Synthetic
atcctgaacgaaggaattatccagagaattattacagttggcaaatcg

SEQ ID NO: 8648 - DNA, 47 bp, Artificial Sequence
  Synthetic
acattcagaggacagacatctactcaaaatatggatgtcctacagtt

SEQ ID NO: 8649 - DNA, 49 bp, Artificial Sequence
  Synthetic
acaacaggacatccattgtttaacatcctgtctatcatctttagaagtt

SEQ ID NO: 8650 - DNA, 42 bp, Artificial Sequence
  Synthetic
attacctgcagcaagtcaacagacggtagggaaatagatgga

SEQ ID NO: 8651 - DNA, 43 bp, Artificial Sequence
  Synthetic
cagaaaaactgtctttggatttggagttgtagcccagcttgaa

SEQ ID NO: 8652 - DNA, 45 bp, Artificial Sequence
  Synthetic
tttcagtgtgattttcaatcggctctccttcttccgtaaaagctc

SEQ ID NO: 8653 - DNA, 47 bp, Artificial Sequence
  Synthetic
tttcctgggaaaataaaagtggtgccttcttgcattgatttcctttc

SEQ ID NO: 8654 - DNA, 46 bp, Artificial Sequence
  Synthetic
gctggtacaacaattctatttctgctgctcattacaaaagccttct

SEQ ID NO: 8655 - DNA, 43 bp, Artificial Sequence
  Synthetic
attgtcaccttatagagttgacagcaccacagaaagcctgact

SEQ ID NO: 8656 - DNA, 41 bp, Artificial Sequence
  Synthetic
tgctcttagtcctcgtttggattttgctgctgattgttctg

SEQ ID NO: 8657 - DNA, 39 bp, Artificial Sequence
  Synthetic
atctgaacagtggacgtttgcaaacagtttctgggtggc

SEQ ID NO: 8658 - DNA, 43 bp, Artificial Sequence
  Synthetic
tgacaatgaacaaattttgccctttcctcttgggtgtcagaaa

SEQ ID NO: 8659 - DNA, 41 bp, Artificial Sequence
  Synthetic
cacaccactgagcctagtttgacaaacacattgacatcagc

SEQ ID NO: 8660 - DNA, 42 bp, Artificial Sequence
  Synthetic
atcccgcctttgatgctgatgtcctccatttgaccttgtgct

SEQ ID NO: 8661 - DNA, 47 bp, Artificial Sequence
  Synthetic
tctcagttcattaccaatgcttcagaaggtccaataggtatagtagg

SEQ ID NO: 8662 - DNA, 44 bp, Artificial Sequence
  Synthetic
atacattcgcctatacaagatggctgtagcaaaattaactgccc

SEQ ID NO: 8663 - DNA, 45 bp, Artificial Sequence
  Synthetic
aggatgtgaatggtgatcacagacctaaatttaagtctggtggtg

SEQ ID NO: 8664 - DNA, 41 bp, Artificial Sequence
  Synthetic
tcaacagaagccacctgcagctgacaaatcaactgtccaaa

SEQ ID NO: 8665 - DNA, 41 bp, Artificial Sequence
  Synthetic
tttcagcaactattggtttccgatgaaaattctcccggcag

SEQ ID NO: 8666 - DNA, 47 bp, Artificial Sequence
  Synthetic
atgcccaagttacagaggattcaggctgttaatatactttcgcttta

SEQ ID NO: 8667 - DNA, 46 bp, Artificial Sequence
  Synthetic
tctaacaatgcggtggttgaaaattttagcaagaataacagctctt

SEQ ID NO: 8668 - DNA, 48 bp, Artificial Sequence
  Synthetic
gaactttcaaagatggtacaatgggtctgctaataatgcatagtgaaa

SEQ ID NO: 8669 - DNA, 43 bp, Artificial Sequence
  Synthetic
cttccgcgacatggtttatcggaacctttcactaagaggacat

SEQ ID NO: 8670 - DNA, 42 bp, Artificial Sequence
  Synthetic
tggtggaggaacagtttctaggcttggttttggaagggattc

SEQ ID NO: 8671 - DNA, 46 bp, Artificial Sequence
  Synthetic
tgagcatcctgcagtaataaatgttggcaaagtttgtacatcaagt

SEQ ID NO: 8672 - DNA, 40 bp, Artificial Sequence
  Synthetic
ttttacagtgagaccgaaagcgtgcatagaagccctttgg

SEQ ID NO: 8673 - DNA, 50 bp, Artificial Sequence
  Synthetic
ttaccagaacaaaatgaaaacagggcctacaataaatatctgagtttgct

SEQ ID NO: 8674 - DNA, 46 bp, Artificial Sequence
  Synthetic
agatgctgtttgtaaatggcctggcaaagaaaaacaattcattacc

SEQ ID NO: 8675 - DNA, 43 bp, Artificial Sequence
  Synthetic
tcgcatataaatgtgatgaacccaggtggaggaacaaaagcta

SEQ ID NO: 8676 - DNA, 44 bp, Artificial Sequence
  Synthetic
ggtcaaattccttttccccaccatgtttggaatgatactgacag

SEQ ID NO: 8677 - DNA, 44 bp, Artificial Sequence
  Synthetic
cgcttttgttgctggctgtcaatcttaaacacattccataaccg

SEQ ID NO: 8678 - DNA, 39 bp, Artificial Sequence
  Synthetic
tagagggcattggagagggtaatagtaggttcctggccc

SEQ ID NO: 8679 - DNA, 43 bp, Artificial Sequence
  Synthetic
gctcgaagaattatcattcgtttgctagtgggatctgccatgg

SEQ ID NO: 8680 - DNA, 43 bp, Artificial Sequence
  Synthetic
gtagtgagctgggtaaagatggcggcccttgtattactctgta

SEQ ID NO: 8681 - DNA, 45 bp, Artificial Sequence
  Synthetic
tggtacagtgggcatatgataatgactaacgccaattctgcatat

SEQ ID NO: 8682 - DNA, 42 bp, Artificial Sequence
  Synthetic
ggcccagcagaaagttccatccgggctcgaggtactagcaac

SEQ ID NO: 8683 - DNA, 46 bp, Artificial Sequence
  Synthetic
aaaaggtcctgcaaatcccctagctagcatatttctgattacatct

SEQ ID NO: 8684 - DNA, 43 bp, Artificial Sequence
  Synthetic
acgcgtattacctgaagggacggtggtcctatagggtctatag

SEQ ID NO: 8685 - DNA, 46 bp, Artificial Sequence
  Synthetic
atatatctcctgcacaaccagcctaatgtgaaccaattgatatggt

SEQ ID NO: 8686 - DNA, 38 bp, Artificial Sequence
  Synthetic
cagtgccacggctaacacaaagttgttggcacctgttg

SEQ ID NO: 8687 - DNA, 41 bp, Artificial Sequence
  Synthetic
accttcattaggggaacattgggaatctcctggctgtttgg

SEQ ID NO: 8688 - DNA, 46 bp, Artificial Sequence
  Synthetic
tacggtgaccaggtatttttctttgtctagcccaaaaatgtctagc

SEQ ID NO: 8689 - DNA, 45 bp, Artificial Sequence
  Synthetic
tcaaactggtttactggagcgttcacagttttctttcttacagta

SEQ ID NO: 8690 - DNA, 41 bp, Artificial Sequence
  Synthetic
atccggacctcatgccagataaaagagtaaagccgtccaaa

SEQ ID NO: 8691 - DNA, 41 bp, Artificial Sequence
  Synthetic
tgactgactcaaacgttcttggaccgttttcgttgcaagta

SEQ ID NO: 8692 - DNA, 40 bp, Artificial Sequence
  Synthetic
gatcgccagaatgcaactgatctcccaattccatcaatca

SEQ ID NO: 8693 - DNA, 42 bp, Artificial Sequence
  Synthetic
tcagttgctcacaaatcttgcccctctttttcgaagtcgtac

SEQ ID NO: 8694 - DNA, 42 bp, Artificial Sequence
  Synthetic
aaaagtatctccgcgggggatgttctcatttgaagcaatttg

SEQ ID NO: 8695 - DNA, 40 bp, Artificial Sequence
  Synthetic
aatacggagggaaggacttcagggttttgcaccttccatc

SEQ ID NO: 8696 - DNA, 44 bp, Artificial Sequence
  Synthetic
aatttgaaaatacaggcgagcgccgatgtttcttgtacctcaca

SEQ ID NO: 8697 - DNA, 41 bp, Artificial Sequence
  Synthetic
gagcaattgaacagctcagaggattgtctagcttgctgtgg

SEQ ID NO: 8698 - DNA, 43 bp, Artificial Sequence
  Synthetic
aaaacgaaagtatttaggcagtccgttttactccttcccggca

SEQ ID NO: 8699 - DNA, 39 bp, Artificial Sequence
  Synthetic
acgccaccacagcaaatacaaacacagctttgcctgtac

SEQ ID NO: 8700 - DNA, 45 bp, Artificial Sequence
  Synthetic
aacagatgacagtgacattgcactgtgcattactatctacatctg

SEQ ID NO: 8701 - DNA, 41 bp, Artificial Sequence
  Synthetic
ttttacgaggcacaccaaaacaactttcctgtgtttggtgg

SEQ ID NO: 8702 - DNA, 41 bp, Artificial Sequence
  Synthetic
attgtcccgactctgtgtctagcgacaacagtttcaacagg

SEQ ID NO: 8703 - DNA, 40 bp, Artificial Sequence
  Synthetic
tttgtgtgcctgtgtgtctgaacaggtagaaaacaacgag

SEQ ID NO: 8704 - DNA, 39 bp, Artificial Sequence
  Synthetic
gtgtactatggtcgcccaccacgtttgatacagctgagt

SEQ ID NO: 8705 - DNA, 45 bp, Artificial Sequence
  Synthetic
tccacaaactggggaggtatctcataactatgtacaccagatgtg

SEQ ID NO: 8706 - DNA, 42 bp, Artificial Sequence
  Synthetic
ttgtggctttacacagacctgccaagcctactaaaacgcaca

SEQ ID NO: 8707 - DNA, 43 bp, Artificial Sequence
  Synthetic
aacatgttccctattttcttgcagaggtgtaggaggcaggtaa

SEQ ID NO: 8708 - DNA, 41 bp, Artificial Sequence
  Synthetic
ttcccaaggtgtctgcatttcaacttattgggatcgggcaa

SEQ ID NO: 8709 - DNA, 48 bp, Artificial Sequence
  Synthetic
catgactatatctgcaaccacacaaacatactgtttaatttggcttga

SEQ ID NO: 8710 - DNA, 43 bp, Artificial Sequence
  Synthetic
aaaagccttgctataacctgtcaattagctagtgggtcctctt

SEQ ID NO: 8711 - DNA, 45 bp, Artificial Sequence
  Synthetic
cggcggtgattgtttgtgtccatacaaaaacatacattcatgcac

SEQ ID NO: 8712 - DNA, 41 bp, Artificial Sequence
  Synthetic
tggttgttgcacaccactgtgcataaaatggacactactgt

SEQ ID NO: 8713 - DNA, 43 bp, Artificial Sequence
  Synthetic
tgcaaacatctgcaacacaatgaagacacatagttggctacca

SEQ ID NO: 8714 - DNA, 42 bp, Artificial Sequence
  Synthetic
aacggccatacaagctaccaacagtccaattctatttcatgt

SEQ ID NO: 8715 - DNA, 44 bp, Artificial Sequence
  Synthetic
ctcagaggatgaggatgaaacagacattctgtaccaggcttgct

SEQ ID NO: 8716 - DNA, 39 bp, Artificial Sequence
  Synthetic
ggaggtgttcgggatggtttattgcatcccctgttttcc

SEQ ID NO: 8717 - DNA, 48 bp, Artificial Sequence
  Synthetic
aatggtacagtgggcatttgataatcctcagatgctaataatgcatat

SEQ ID NO: 8718 - DNA, 49 bp, Artificial Sequence
  Synthetic
aatgcattagatggcaatcctatgtgatgttattagtaatggaggacat

SEQ ID NO: 8719 - DNA, 42 bp, Artificial Sequence
  Synthetic
acaaagacgtggtcaaaactagattgcacagtgtctccatca

SEQ ID NO: 8720 - DNA, 47 bp, Artificial Sequence
  Synthetic
tccaaagggcataatgcaattgaattctgtgttatagcttgattcat

SEQ ID NO: 8721 - DNA, 44 bp, Artificial Sequence
  Synthetic
atggtagcattggggtattttttggcacatatcctgtacgaccc

SEQ ID NO: 8722 - DNA, 45 bp, Artificial Sequence
  Synthetic
aacaacatctgtggacagtacaccagatacttgtgtagtgtcact

SEQ ID NO: 8723 - DNA, 45 bp, Artificial Sequence
  Synthetic
gctagaaaaactggcatacgtgtcacttctagtaaacatagtggc

SEQ ID NO: 8724 - DNA, 47 bp, Artificial Sequence
  Synthetic
gacctactgaggcaaaggtataccgttacatactcttcagtgcttac

SEQ ID NO: 8725 - DNA, 41 bp, Artificial Sequence
  Synthetic
gcacaccatgtggtacccaagtggtgttctttaattcaagc

SEQ ID NO: 8726 - DNA, 41 bp, Artificial Sequence
  Synthetic
aggtactgtaggcgatgctattccacaactggatggcgatg

SEQ ID NO: 8727 - DNA, 41 bp, Artificial Sequence
  Synthetic
aacatgttttggtctgtttgtgcaatccaagttgcctgcag

SEQ ID NO: 8728 - DNA, 42 bp, Artificial Sequence
  Synthetic
aagaacgttactgttacacatgccatcgcagagcttcccatt

SEQ ID NO: 8729 - DNA, 41 bp, Artificial Sequence
  Synthetic
gttacccaggggatttcaacgaaatggtttgttctgctcaa

SEQ ID NO: 8730 - DNA, 40 bp, Artificial Sequence
  Synthetic
gatgcggcagagcagacaaatgatgttccaacggaaatgt

SEQ ID NO: 8731 - DNA, 46 bp, Artificial Sequence
  Synthetic
agtgaattggaatatggtaactgcatggcatactagagtttatcgc

SEQ ID NO: 8732 - DNA, 43 bp, Artificial Sequence
  Synthetic
ggtaccaccatagcaatgagcagtgactccatctattgccttt

SEQ ID NO: 8733 - DNA, 45 bp, Artificial Sequence
  Synthetic
ttcatgactcaaatgtcaagaacctcctttgcattatccctaagc

SEQ ID NO: 8734 - DNA, 46 bp, Artificial Sequence
  Synthetic
actgtcaatttattcaacagtggcgaaagatagaccagctaccatg

SEQ ID NO: 8735 - DNA, 39 bp, Artificial Sequence
  Synthetic
gagaacgccagaatgccactcgtccaattccaccaatca

SEQ ID NO: 8736 - DNA, 42 bp, Artificial Sequence
  Synthetic
taaacggaaagtggatgagagaacccattattagcttggcgc

SEQ ID NO: 8737 - DNA, 44 bp, Artificial Sequence
  Synthetic
ggtcaggatgatcaaacgtggaattcttgtttttcgtccattct

SEQ ID NO: 8738 - DNA, 45 bp, Artificial Sequence
  Synthetic
ggaagctttccactagaggagttcacttgattccatagtctccat

SEQ ID NO: 8739 - DNA, 38 bp, Artificial Sequence
  Synthetic
cagcaggacgagcaagctttaggttttgtgacactgcc

SEQ ID NO: 8740 - DNA, 40 bp, Artificial Sequence
  Synthetic
agttgcgtgtatcgtcccaacctagtccactgtcctcaaa

SEQ ID NO: 8741 - DNA, 48 bp, Artificial Sequence
  Synthetic
ttcagttttatgctgcaaaatgtcggtacatgcaatacattacacaat

SEQ ID NO: 8742 - DNA, 49 bp, Artificial Sequence
  Synthetic
agggctaatagatgatgcaacatttagtccattcctcatatatacatcc

SEQ ID NO: 8743 - DNA, 38 bp, Artificial Sequence
  Synthetic
accgtttcgatgctgtgcaacatctatgtctgtgcggc

SEQ ID NO: 8744 - DNA, 43 bp, Artificial Sequence
  Synthetic
acgttatggaccgctatttattaccctgcagatacctgtccac

SEQ ID NO: 8745 - DNA, 43 bp, Artificial Sequence
  Synthetic
aagacgaggctagggatccggtttcattctatacctccaacat

SEQ ID NO: 8746 - DNA, 44 bp, Artificial Sequence
  Synthetic
gctggtgctgaggtgtttgttgtctaaaggtatagattcaccta

SEQ ID NO: 8747 - DNA, 41 bp, Artificial Sequence
  Synthetic
gcatctgctaacattaatggcaggggccaacaagtgtatga

SEQ ID NO: 8748 - DNA, 45 bp, Artificial Sequence
  Synthetic
atttgcatccaagtcacagacgctgcaaaacattaaaaaccagac

SEQ ID NO: 8749 - DNA, 40 bp, Artificial Sequence
  Synthetic
caccccttgtaaaggtgaacacgacaggtgcctttaggag

SEQ ID NO: 8750 - DNA, 47 bp, Artificial Sequence
  Synthetic
gtccttagcatctagtgactccccataatacagcattattagcaccc

SEQ ID NO: 8751 - DNA, 43 bp, Artificial Sequence
  Synthetic
ttttgggtggttgatttatcagacaaaaagcgcctaccaagag

SEQ ID NO: 8752 - DNA, 43 bp, Artificial Sequence
  Synthetic
gtattactcatgtgttttgcaacgtactgtaaaagcaccgctc

SEQ ID NO: 8753 - DNA, 20 bp, Artificial Sequence
  Synthetic
atctttgtcacccgatttgg

SEQ ID NO: 8754 - DNA, 25 bp, Artificial Sequence
  Synthetic
tgcagtagctttatacttttttcag

SEQ ID NO: 8755 - DNA, 23 bp, Artificial Sequence
  Synthetic
taattagatttttgaagggcagt

SEQ ID NO: 8756 - DNA, 25 bp, Artificial Sequence
  Synthetic
gactattgaatctttatgaaagtgg

SEQ ID NO: 8757 - DNA, 20 bp, Artificial Sequence
  Synthetic
atacctagctcacacaggcc

SEQ ID NO: 8758 - DNA, 19 bp, Artificial Sequence
  Synthetic
aggagaaccaacgtccacc

SEQ ID NO: 8759 - DNA, 19 bp, Artificial Sequence
  Synthetic
caactgtgtttagatgggc

SEQ ID NO: 8760 - DNA, 24 bp, Artificial Sequence
  Synthetic
atacactttatacaacccgtgtag

SEQ ID NO: 8761 - DNA, 21 bp, Artificial Sequence
  Synthetic
cgcgcaattttatttggctat

SEQ ID NO: 8762 - DNA, 25 bp, Artificial Sequence
  Synthetic
ctgcacatttttattatgatgtgtc

SEQ ID NO: 8763 - DNA, 19 bp, Artificial Sequence
  Synthetic
cctgaaaaggaacgtttgg

SEQ ID NO: 8764 - DNA, 23 bp, Artificial Sequence
  Synthetic
tattccagacatatgttagccag

SEQ ID NO: 8765 - DNA, 25 bp, Artificial Sequence
  Synthetic
cagataccttttatctaaagcaact

SEQ ID NO: 8766 - DNA, 22 bp, Artificial Sequence
  Synthetic
ctatgtgagcaataatctgact

SEQ ID NO: 8767 - DNA, 22 bp, Artificial Sequence
  Synthetic
ggattgtgcagaaaaaattgac

SEQ ID NO: 8768 - DNA, 21 bp, Artificial Sequence
  Synthetic
cagagcaagtgttagattcac

SEQ ID NO: 8769 - DNA, 25 bp, Artificial Sequence
  Synthetic
catatctaacctaatagatgatgga

SEQ ID NO: 8770 - DNA, 22 bp, Artificial Sequence
  Synthetic
gcatagtagattacagtgcttt

SEQ ID NO: 8771 - DNA, 20 bp, Artificial Sequence
  Synthetic
actacaagggactcctccac

SEQ ID NO: 8772 - DNA, 19 bp, Artificial Sequence
  Synthetic
agaggaggaagggaattgg

SEQ ID NO: 8773 - DNA, 25 bp, Artificial Sequence
  Synthetic
gttaagtagtgtgatatatcttggt

SEQ ID NO: 8774 - DNA, 25 bp, Artificial Sequence
  Synthetic
ggtcctatagaaactccttctatag

SEQ ID NO: 8775 - DNA, 25 bp, Artificial Sequence
  Synthetic
cttcagatatcaatgtttttgtgga

SEQ ID NO: 8776 - DNA, 19 bp, Artificial Sequence
  Synthetic
gatttgaaaatcccgcctt

SEQ ID NO: 8777 - DNA, 23 bp, Artificial Sequence
  Synthetic
gtatcttacccacaacaaaatgt

SEQ ID NO: 8778 - DNA, 23 bp, Artificial Sequence
  Synthetic
acggatgaatatgttaaaggaac

SEQ ID NO: 8779 - DNA, 24 bp, Artificial Sequence
  Synthetic
ctggacatcctttgtataacaaac

SEQ ID NO: 8780 - DNA, 20 bp, Artificial Sequence
  Synthetic
ccatttgaaccaacatctga

SEQ ID NO: 8781 - DNA, 18 bp, Artificial Sequence
  Synthetic
cccttacggggcgacact

SEQ ID NO: 8782 - DNA, 19 bp, Artificial Sequence
  Synthetic
tgcaccatgagcacgaatc

SEQ ID NO: 8783 - DNA, 15 bp, Artificial Sequence
  Synthetic
gcaccgctcgcgaaa

SEQ ID NO: 8784 - DNA, 18 bp, Artificial Sequence
  Synthetic
tcaccaatgactgcccca

SEQ ID NO: 8785 - DNA, 17 bp, Artificial Sequence
  Synthetic
ttcgatctacccgggcc

SEQ ID NO: 8786 - DNA, 18 bp, Artificial Sequence
  Synthetic
acatcaaccggaccgctt

SEQ ID NO: 8787 - DNA, 18 bp, Artificial Sequence
  Synthetic
cgcaaggcagttggtttg

SEQ ID NO: 8788 - DNA, 19 bp, Artificial Sequence
  Synthetic
acataggctcgatgcagcg

SEQ ID NO: 8789 - DNA, 18 bp, Artificial Sequence
  Synthetic
gatctgcgcctgcctttg

SEQ ID NO: 8790 - DNA, 20 bp, Artificial Sequence
  Synthetic
ttagttaccttgggaccgca

SEQ ID NO: 8791 - DNA, 17 bp, Artificial Sequence
  Synthetic
gccgcgctgctcactat

SEQ ID NO: 8792 - DNA, 17 bp, Artificial Sequence
  Synthetic
gacccgcggtctcatct

SEQ ID NO: 8793 - DNA, 20 bp, Artificial Sequence
  Synthetic
tcttaggaggaagggtgacg

SEQ ID NO: 8794 - DNA, 18 bp, Artificial Sequence
  Synthetic
gccagggctacaaagtgc

SEQ ID NO: 8795 - DNA, 18 bp, Artificial Sequence
  Synthetic
ccaccccaacatcgagga

SEQ ID NO: 8796 - DNA, 18 bp, Artificial Sequence
  Synthetic
gtggcggttacccagact

SEQ ID NO: 8797 - DNA, 18 bp, Artificial Sequence
  Synthetic
cgtggccgcatattgcat

SEQ ID NO: 8798 - DNA, 20 bp, Artificial Sequence
  Synthetic
tacctagctgggctatccac

SEQ ID NO: 8799 - DNA, 19 bp, Artificial Sequence
  Synthetic
ggtccctagcacagaggat

SEQ ID NO: 8800 - DNA, 18 bp, Artificial Sequence
  Synthetic
gaggtgtgggactgggtt

SEQ ID NO: 8801 - DNA, 19 bp, Artificial Sequence
  Synthetic
cggagtacgtcgagatcct

SEQ ID NO: 8802 - DNA, 20 bp, Artificial Sequence
  Synthetic
gtggagaattggaaggaccc

SEQ ID NO: 8803 - DNA, 20 bp, Artificial Sequence
  Synthetic
tctcagtagaggaagctgct

SEQ ID NO: 8804 - DNA, 19 bp, Artificial Sequence
  Synthetic
gtccaaacggactcccatg

SEQ ID NO: 8805 - DNA, 20 bp, Artificial Sequence
  Synthetic
tgacgtgctacatcaaagcc

SEQ ID NO: 8806 - DNA, 16 bp, Artificial Sequence
  Synthetic
gggcagggctcgcata

SEQ ID NO: 8807 - DNA, 21 bp, Artificial Sequence
  Synthetic
tggcacatgaaatactgattg

SEQ ID NO: 8808 - DNA, 19 bp, Artificial Sequence
  Synthetic
gcgacatgctgaataaagc

SEQ ID NO: 8809 - DNA, 20 bp, Artificial Sequence
  Synthetic
atacaggcagcaatttcaac

SEQ ID NO: 8810 - DNA, 20 bp, Artificial Sequence
  Synthetic
aattggattgtgttctggag

SEQ ID NO: 8811 - DNA, 25 bp, Artificial Sequence
  Synthetic
tcagaggatttgtattagtagttga

SEQ ID NO: 8812 - DNA, 25 bp, Artificial Sequence
  Synthetic
ggatttgtatctaattttgcaatgg

SEQ ID NO: 8813 - DNA, 22 bp, Artificial Sequence
  Synthetic
gctatgggaaaacactaaagga

SEQ ID NO: 8814 - DNA, 21 bp, Artificial Sequence
  Synthetic
ggaactcatagttggagaacc

SEQ ID NO: 8815 - DNA, 21 bp, Artificial Sequence
  Synthetic
caggggttataccatagacaa

SEQ ID NO: 8816 - DNA, 18 bp, Artificial Sequence
  Synthetic
ggatggctccttggaaat

SEQ ID NO: 8817 - DNA, 22 bp, Artificial Sequence
  Synthetic
gtaaaccatcattcttcaggaa

SEQ ID NO: 8818 - DNA, 21 bp, Artificial Sequence
  Synthetic
gaatggaattctcttggaccc

SEQ ID NO: 8819 - DNA, 21 bp, Artificial Sequence
  Synthetic
atcggagaaattggtcttagc

SEQ ID NO: 8820 - DNA, 25 bp, Artificial Sequence
  Synthetic
aaacttgacagaagataaaaatggg

SEQ ID NO: 8821 - DNA, 20 bp, Artificial Sequence
  Synthetic
catagttcaaatggagcctg

SEQ ID NO: 8822 - DNA, 23 bp, Artificial Sequence
  Synthetic
tatagcggcattagtaataacca

SEQ ID NO: 8823 - DNA, 25 bp, Artificial Sequence
  Synthetic
ttctaccatatattgaacaacccaa

SEQ ID NO: 8824 - DNA, 25 bp, Artificial Sequence
  Synthetic
ttaagtgaaatactaggaatgcttc

SEQ ID NO: 8825 - DNA, 25 bp, Artificial Sequence
  Synthetic
tgatagtgacaatgatctatcactt

SEQ ID NO: 8826 - DNA, 18 bp, Artificial Sequence
  Synthetic
ggtgcccatgttccaatc

SEQ ID NO: 8827 - DNA, 25 bp, Artificial Sequence
  Synthetic
catcagtgtcagaaataaagatctg

SEQ ID NO: 8828 - DNA, 21 bp, Artificial Sequence
  Synthetic
ccatcataatcaccaaccctc

SEQ ID NO: 8829 - DNA, 23 bp, Artificial Sequence
  Synthetic
ttaagactaacaataacgttggg

SEQ ID NO: 8830 - DNA, 22 bp, Artificial Sequence
  Synthetic
caacaacaaccaaaatacaacc

SEQ ID NO: 8831 - DNA, 20 bp, Artificial Sequence
  Synthetic
tcaacaccaccaaaacaaac

SEQ ID NO: 8832 - DNA, 22 bp, Artificial Sequence
  Synthetic
cgtattattgcaaaaagccatg

SEQ ID NO: 8833 - DNA, 20 bp, Artificial Sequence
  Synthetic
ctgtatctaaggtcctgcac

SEQ ID NO: 8834 - DNA, 22 bp, Artificial Sequence
  Synthetic
ctatgtacaaccaacacaaagg

SEQ ID NO: 8835 - DNA, 22 bp, Artificial Sequence
  Synthetic
tgttatcattaattgccgttgg

SEQ ID NO: 8836 - DNA, 24 bp, Artificial Sequence
  Synthetic
taagtctatggataaaagcatcga

SEQ ID NO: 8837 - DNA, 25 bp, Artificial Sequence
  Synthetic
gaatgtgatttatacaactgtgtag

SEQ ID NO: 8838 - DNA, 23 bp, Artificial Sequence
  Synthetic
tctgagagacaagctaaaattac

SEQ ID NO: 8839 - DNA, 25 bp, Artificial Sequence
  Synthetic
ggtgtatgcatctatagataacaag

SEQ ID NO: 8840 - DNA, 18 bp, Artificial Sequence
  Synthetic
ggcgacactccaccatga

SEQ ID NO: 8841 - DNA, 19 bp, Artificial Sequence
  Synthetic
tgcaccatgagcacgaatc

SEQ ID NO: 8842 - DNA, 19 bp, Artificial Sequence
  Synthetic
cgtaggtcgcgcaatttgg

SEQ ID NO: 8843 - DNA, 20 bp, Artificial Sequence
  Synthetic
cgagtattgtgtacgaggcg

SEQ ID NO: 8844 - DNA, 19 bp, Artificial Sequence
  Synthetic
ataacgggtcatcgcatgg

SEQ ID NO: 8845 - DNA, 18 bp, Artificial Sequence
  Synthetic
gctggttagcagggctct

SEQ ID NO: 8846 - DNA, 18 bp, Artificial Sequence
  Synthetic
tacctacagctggggtgc

SEQ ID NO: 8847 - DNA, 18 bp, Artificial Sequence
  Synthetic
gtacgtgggaggggtcga

SEQ ID NO: 8848 - DNA, 20 bp, Artificial Sequence
  Synthetic
actcatatcccaagcggagg

SEQ ID NO: 8849 - DNA, 19 bp, Artificial Sequence
  Synthetic
cgcgatgccgtcatcttac

SEQ ID NO: 8850 - DNA, 20 bp, Artificial Sequence
  Synthetic
aaccatctcacccctcttcg

SEQ ID NO: 8851 - DNA, 19 bp, Artificial Sequence
  Synthetic
ggtgaggtccagatcgtgt

SEQ ID NO: 8852 - DNA, 16 bp, Artificial Sequence
  Synthetic
gggggtccgctgttgt

SEQ ID NO: 8853 - DNA, 18 bp, Artificial Sequence
  Synthetic
aaggcccatggggttgat

SEQ ID NO: 8854 - DNA, 18 bp, Artificial Sequence
  Synthetic
caaggctatccccctcga

SEQ ID NO: 8855 - DNA, 18 bp, Artificial Sequence
  Synthetic
tctccaggactcaacgcc

SEQ ID NO: 8856 - DNA, 16 bp, Artificial Sequence
  Synthetic
caagccaccgtgtgcg

SEQ ID NO: 8857 - DNA, 20 bp, Artificial Sequence
  Synthetic
tgacagggaggttctctacc

SEQ ID NO: 8858 - DNA, 19 bp, Artificial Sequence
  Synthetic
actggccaaaccctcctct

SEQ ID NO: 8859 - DNA, 16 bp, Artificial Sequence
  Synthetic
cgagggggcagtgcaa

SEQ ID NO: 8860 - DNA, 18 bp, Artificial Sequence
  Synthetic
tataggggggtctggcga

SEQ ID NO: 8861 - DNA, 20 bp, Artificial Sequence
  Synthetic
ttcacagaattggacggggt

SEQ ID NO: 8862 - DNA, 19 bp, Artificial Sequence
  Synthetic
aggctaacctcctgtggag

SEQ ID NO: 8863 - DNA, 20 bp, Artificial Sequence
  Synthetic
gtggtcctcaccgaatcaac

SEQ ID NO: 8864 - DNA, 20 bp, Artificial Sequence
  Synthetic
aaaaactgcccatcaacgca

SEQ ID NO: 8865 - DNA, 20 bp, Artificial Sequence
  Synthetic
gacactaccatcatggccaa

SEQ ID NO: 8866 - DNA, 19 bp, Artificial Sequence
  Synthetic
gacatccgtacggaggagg

SEQ ID NO: 8867 - DNA, 18 bp, Artificial Sequence
  Synthetic
gaccccccacaaccagaa

SEQ ID NO: 8868 - DNA, 20 bp, Artificial Sequence
  Synthetic
gcctgctactccatagaacc

SEQ ID NO: 8869 - DNA, 22 bp, Artificial Sequence
  Synthetic
aggtactgatccaaaatggaag

SEQ ID NO: 8870 - DNA, 21 bp, Artificial Sequence
  Synthetic
ttgaaataatcgaagggaggg

SEQ ID NO: 8871 - DNA, 21 bp, Artificial Sequence
  Synthetic
atgaaaaaggcataaacccca

SEQ ID NO: 8872 - DNA, 19 bp, Artificial Sequence
  Synthetic
gaattcaacaaggcatgcg

SEQ ID NO: 8873 - DNA, 21 bp, Artificial Sequence
  Synthetic
aaggaagacggaaaactaacc

SEQ ID NO: 8874 - DNA, 18 bp, Artificial Sequence
  Synthetic
gcatggaaatgaggcgat

SEQ ID NO: 8875 - DNA, 21 bp, Artificial Sequence
  Synthetic
gcgatacctaactgacatgac

SEQ ID NO: 8876 - DNA, 20 bp, Artificial Sequence
  Synthetic
ttgaggatgtcaaaaatgca

SEQ ID NO: 8877 - DNA, 25 bp, Artificial Sequence
  Synthetic
catgatttataaaataagggaggga

SEQ ID NO: 8878 - DNA, 19 bp, Artificial Sequence
  Synthetic
tacattgctggaagccata

SEQ ID NO: 8879 - DNA, 18 bp, Artificial Sequence
  Synthetic
acctgtgcttcacgacta

SEQ ID NO: 8880 - DNA, 20 bp, Artificial Sequence
  Synthetic
agatgtagaggcagtgcaac

SEQ ID NO: 8881 - DNA, 22 bp, Artificial Sequence
  Synthetic
ccaaaatagctatgctagacga

SEQ ID NO: 8882 - DNA, 25 bp, Artificial Sequence
  Synthetic
ggaaatcattctttaaaaggtcatg

SEQ ID NO: 8883 - DNA, 18 bp, Artificial Sequence
  Synthetic
cacttgctgtgtcaaagg

SEQ ID NO: 8884 - DNA, 18 bp, Artificial Sequence
  Synthetic
atggggagggatggacta

SEQ ID NO: 8885 - DNA, 18 bp, Artificial Sequence
  Synthetic
cgttacagcaagtgcctg

SEQ ID NO: 8886 - DNA, 18 bp, Artificial Sequence
  Synthetic
taactgcctcatcgccat

SEQ ID NO: 8887 - DNA, 25 bp, Artificial Sequence
  Synthetic
gtgatatggtagatataggatttgg

SEQ ID NO: 8888 - DNA, 23 bp, Artificial Sequence
  Synthetic
cttgacagttctatttatgctgc

SEQ ID NO: 8889 - DNA, 23 bp, Artificial Sequence
  Synthetic
ttatgtaccataacccttacagc

SEQ ID NO: 8890 - DNA, 19 bp, Artificial Sequence
  Synthetic
ggctcgcatctctccttca

SEQ ID NO: 8891 - DNA, 17 bp, Artificial Sequence
  Synthetic
cgactgactgccggctt

SEQ ID NO: 8892 - DNA, 20 bp, Artificial Sequence
  Synthetic
agaaacaccggtctggatct

SEQ ID NO: 8893 - DNA, 20 bp, Artificial Sequence
  Synthetic
aagcaagaagtctcccaagc

SEQ ID NO: 8894 - DNA, 20 bp, Artificial Sequence
  Synthetic
tgtccaagccaacaatccac

SEQ ID NO: 8895 - DNA, 20 bp, Artificial Sequence
  Synthetic
ctaggagatatgttgcgggc

SEQ ID NO: 8896 - DNA, 20 bp, Artificial Sequence
  Synthetic
taccaaaaacaactgggcca

SEQ ID NO: 8897 - DNA, 18 bp, Artificial Sequence
  Synthetic
gcaacacttggtccggaa

SEQ ID NO: 8898 - DNA, 20 bp, Artificial Sequence
  Synthetic
cccacagcagtgtaactacg

SEQ ID NO: 8899 - DNA, 20 bp, Artificial Sequence
  Synthetic
tatgatgcagtccccaaggt

SEQ ID NO: 8900 - DNA, 20 bp, Artificial Sequence
  Synthetic
aggggctattatgctgaccc

SEQ ID NO: 8901 - DNA, 20 bp, Artificial Sequence
  Synthetic
cattaccttcggacccttgc

SEQ ID NO: 8902 - DNA, 20 bp, Artificial Sequence
  Synthetic
gctatttcctctttgctcca

SEQ ID NO: 8903 - DNA, 20 bp, Artificial Sequence
  Synthetic
tcctggtcttaatagccgcc

SEQ ID NO: 8904 - DNA, 18 bp, Artificial Sequence
  Synthetic
cttccagttctgccccct

SEQ ID NO: 8905 - DNA, 19 bp, Artificial Sequence
  Synthetic
gcggaggctattattcagc

SEQ ID NO: 8906 - DNA, 20 bp, Artificial Sequence
  Synthetic
agctatagtctcctccccct

SEQ ID NO: 8907 - DNA, 18 bp, Artificial Sequence
  Synthetic
cgcgtcagatacccccat

SEQ ID NO: 8908 - DNA, 16 bp, Artificial Sequence
  Synthetic
gcgaagtcagcggcct

SEQ ID NO: 8909 - DNA, 20 bp, Artificial Sequence
  Synthetic
agcacagtttcctcctcctc

SEQ ID NO: 8910 - DNA, 18 bp, Artificial Sequence
  Synthetic
ctactggccacctgtcca

SEQ ID NO: 8911 - DNA, 18 bp, Artificial Sequence
  Synthetic
cttccgttccactcaacc

SEQ ID NO: 8912 - DNA, 18 bp, Artificial Sequence
  Synthetic
gaaggtcagggcccagaa

SEQ ID NO: 8913 - DNA, 18 bp, Artificial Sequence
  Synthetic
catggcacgcatacggct

SEQ ID NO: 8914 - DNA, 25 bp, Artificial Sequence
  Synthetic
tatggaaagaataaaagaactacgg

SEQ ID NO: 8915 - DNA, 20 bp, Artificial Sequence
  Synthetic
gagtaaaatgagtgatgccg

SEQ ID NO: 8916 - DNA, 23 bp, Artificial Sequence
  Synthetic
gtaatcatggaagttgttttccc

SEQ ID NO: 8917 - DNA, 23 bp, Artificial Sequence
  Synthetic
aagtgaggaatgatgatgttgat

SEQ ID NO: 8918 - DNA, 20 bp, Artificial Sequence
  Synthetic
gcgggttcacatttaagaga

SEQ ID NO: 8919 - DNA, 22 bp, Artificial Sequence
  Synthetic
gcatgataaaagcagttagagg

SEQ ID NO: 8920 - DNA, 19 bp, Artificial Sequence
  Synthetic
gagagggtagtggtaagca

SEQ ID NO: 8921 - DNA, 20 bp, Artificial Sequence
  Synthetic
tggaatttgagccatttcag

SEQ ID NO: 8922 - DNA, 21 bp, Artificial Sequence
  Synthetic
caacaagaccactaagagact

SEQ ID NO: 8923 - DNA, 19 bp, Artificial Sequence
  Synthetic
cgttacctaaccgacatga

SEQ ID NO: 8924 - DNA, 21 bp, Artificial Sequence
  Synthetic
gaaatttcaccattgccttct

SEQ ID NO: 8925 - DNA, 24 bp, Artificial Sequence
  Synthetic
ccgactctacttttcctaaaaatt

SEQ ID NO: 8926 - DNA, 19 bp, Artificial Sequence
  Synthetic
cagactgtgttctagaggc

SEQ ID NO: 8927 - DNA, 22 bp, Artificial Sequence
  Synthetic
gataacaacccactttcaaaga

SEQ ID NO: 8928 - DNA, 25 bp, Artificial Sequence
  Synthetic
tcgtatactttgttgaaactttagc

SEQ ID NO: 8929 - DNA, 18 bp, Artificial Sequence
  Synthetic
aaacatcctgagcatggc

SEQ ID NO: 8930 - DNA, 22 bp, Artificial Sequence
  Synthetic
agtctcgatactgaatcttgga

SEQ ID NO: 8931 - DNA, 18 bp, Artificial Sequence
  Synthetic
ctacccagctttggagtg

SEQ ID NO: 8932 - DNA, 16 bp, Artificial Sequence
  Synthetic
gcgacttcgacgccga

SEQ ID NO: 8933 - DNA, 16 bp, Artificial Sequence
  Synthetic
ggcgtcagcacctggt

SEQ ID NO: 8934 - DNA, 16 bp, Artificial Sequence
  Synthetic
catgctacggctcggc

SEQ ID NO: 8935 - DNA, 20 bp, Artificial Sequence
  Synthetic
cccaaggataaacgtccctg

SEQ ID NO: 8936 - DNA, 19 bp, Artificial Sequence
  Synthetic
cccaggaccagcctacgag

SEQ ID NO: 8937 - DNA, 21 bp, Artificial Sequence
  Synthetic
acactacgtcttatacagctt

SEQ ID NO: 8938 - DNA, 18 bp, Artificial Sequence
  Synthetic
cgacgtccctgattccct

SEQ ID NO: 8939 - DNA, 18 bp, Artificial Sequence
  Synthetic
tcgaggaggacgagtggc

SEQ ID NO: 8940 - DNA, 18 bp, Artificial Sequence
  Synthetic
cccctccggatccaccat

SEQ ID NO: 8941 - DNA, 18 bp, Artificial Sequence
  Synthetic
ttacacaacgacgccagc

SEQ ID NO: 8942 - DNA, 16 bp, Artificial Sequence
  Synthetic
ccgacgtgcacgacct

SEQ ID NO: 8943 - DNA, 16 bp, Artificial Sequence
  Synthetic
tgcgaggaggacgagc

SEQ ID NO: 8944 - DNA, 18 bp, Artificial Sequence
  Synthetic
cctgacctccctctgcca

SEQ ID NO: 8945 - DNA, 19 bp, Artificial Sequence
  Synthetic
tgagtccttgagtgacggt

SEQ ID NO: 8946 - DNA, 16 bp, Artificial Sequence
  Synthetic
cgcagcaagtgaccgc

SEQ ID NO: 8947 - DNA, 19 bp, Artificial Sequence
  Synthetic
gcttaaccaacgacgaggt

SEQ ID NO: 8948 - DNA, 18 bp, Artificial Sequence
  Synthetic
tgtcctcggtgaagcgaa

SEQ ID NO: 8949 - DNA, 18 bp, Artificial Sequence
  Synthetic
gatgagttcgcgctcctc

SEQ ID NO: 8950 - DNA, 19 bp, Artificial Sequence
  Synthetic
attctccccctccgtctcg

SEQ ID NO: 8951 - DNA, 18 bp, Artificial Sequence
  Synthetic
agttcggcttcttgctcg

SEQ ID NO: 8952 - DNA, 17 bp, Artificial Sequence
  Synthetic
actatcgtctgccggcg

SEQ ID NO: 8953 - DNA, 16 bp, Artificial Sequence
  Synthetic
gtgctgcaaccgctca

SEQ ID NO: 8954 - DNA, 17 bp, Artificial Sequence
  Synthetic
tccttctgtcaccgcgt

SEQ ID NO: 8955 - DNA, 16 bp, Artificial Sequence
  Synthetic
gggctggccttggtca

SEQ ID NO: 8956 - DNA, 18 bp, Artificial Sequence
  Synthetic
caaaggcgatgggttccg

SEQ ID NO: 8957 - DNA, 17 bp, Artificial Sequence
  Synthetic
ctgcagacggctgtgtc

SEQ ID NO: 8958 - DNA, 19 bp, Artificial Sequence
  Synthetic
ctgctcgagatgttgaccc

SEQ ID NO: 8959 - DNA, 16 bp, Artificial Sequence
  Synthetic
gcaacagccgcgacgt

SEQ ID NO: 8960 - DNA, 17 bp, Artificial Sequence
  Synthetic
gcgaacaccctccacgt

SEQ ID NO: 8961 - DNA, 18 bp, Artificial Sequence
  Synthetic
ccgacaggctctccacgt

SEQ ID NO: 8962 - DNA, 20 bp, Artificial Sequence
  Synthetic
ggaattttcccttcgcggat

SEQ ID NO: 8963 - DNA, 16 bp, Artificial Sequence
  Synthetic
acgtgggagcgcacct

SEQ ID NO: 8964 - DNA, 19 bp, Artificial Sequence
  Synthetic
ttcatcttcgcacgcgatg

SEQ ID NO: 8965 - DNA, 20 bp, Artificial Sequence
  Synthetic
acgcgtgttgttacccactt

SEQ ID NO: 8966 - DNA, 19 bp, Artificial Sequence
  Synthetic
gcgacggcgaactaaccag

SEQ ID NO: 8967 - DNA, 15 bp, Artificial Sequence
  Synthetic
gtcgcgcgccaacat

SEQ ID NO: 8968 - DNA, 19 bp, Artificial Sequence
  Synthetic
ccacgtcgttttggatcgc

SEQ ID NO: 8969 - DNA, 16 bp, Artificial Sequence
  Synthetic
ctcgaacacggtgccg

SEQ ID NO: 8970 - DNA, 16 bp, Artificial Sequence
  Synthetic
ccgtgtgcaagccagc

SEQ ID NO: 8971 - DNA, 16 bp, Artificial Sequence
  Synthetic
cgcaaaaacacgccgc

SEQ ID NO: 8972 - DNA, 18 bp, Artificial Sequence
  Synthetic
gaatgtcgtcagccaggc

SEQ ID NO: 8973 - DNA, 18 bp, Artificial Sequence
  Synthetic
tgcacgaacagctggacc

SEQ ID NO: 8974 - DNA, 20 bp, Artificial Sequence
  Synthetic
aggtcaatacggactacgcg

SEQ ID NO: 8975 - DNA, 16 bp, Artificial Sequence
  Synthetic
cgactccgcatgacgc

SEQ ID NO: 8976 - DNA, 16 bp, Artificial Sequence
  Synthetic
tctcgcggcccttcaa

SEQ ID NO: 8977 - DNA, 17 bp, Artificial Sequence
  Synthetic
tgatccgcacagctccg

SEQ ID NO: 8978 - DNA, 18 bp, Artificial Sequence
  Synthetic
ggcctcatcaccagcatc

SEQ ID NO: 8979 - DNA, 16 bp, Artificial Sequence
  Synthetic
gctcggcgctgacact

SEQ ID NO: 8980 - DNA, 20 bp, Artificial Sequence
  Synthetic
cgagatgctctccaccatcc

SEQ ID NO: 8981 - DNA, 16 bp, Artificial Sequence
  Synthetic
caacgcgacgagcagc

SEQ ID NO: 8982 - DNA, 16 bp, Artificial Sequence
  Synthetic
gcacggtgcgctggat

SEQ ID NO: 8983 - DNA, 18 bp, Artificial Sequence
  Synthetic
cctgctgcacaatgtggc

SEQ ID NO: 8984 - DNA, 16 bp, Artificial Sequence
  Synthetic
cgaagagacggcgcag

SEQ ID NO: 8985 - DNA, 16 bp, Artificial Sequence
  Synthetic
ccaacgacgtcgacgc

SEQ ID NO: 8986 - DNA, 16 bp, Artificial Sequence
  Synthetic
accgctcgtaccagcc

SEQ ID NO: 8987 - DNA, 18 bp, Artificial Sequence
  Synthetic
cccctcctcctcgtctca

SEQ ID NO: 8988 - DNA, 19 bp, Artificial Sequence
  Synthetic
cggatcttcggctacctcg

SEQ ID NO: 8989 - DNA, 17 bp, Artificial Sequence
  Synthetic
ccacctcgggctcaaac

SEQ ID NO: 8990 - DNA, 16 bp, Artificial Sequence
  Synthetic
ggacggcgcagattgc

SEQ ID NO: 8991 - DNA, 16 bp, Artificial Sequence
  Synthetic
gcgcacgttcacctcg

SEQ ID NO: 8992 - DNA, 18 bp, Artificial Sequence
  Synthetic
tgttgatgatgcgacgcc

SEQ ID NO: 8993 - DNA, 16 bp, Artificial Sequence
  Synthetic
ctcctgcaacgcggca

SEQ ID NO: 8994 - DNA, 16 bp, Artificial Sequence
  Synthetic
cgtcgcggctgctctt

SEQ ID NO: 8995 - DNA, 16 bp, Artificial Sequence
  Synthetic
gcacaacgccgccaga

SEQ ID NO: 8996 - DNA, 17 bp, Artificial Sequence
  Synthetic
tttcgtgagcaccccgc

SEQ ID NO: 8997 - DNA, 16 bp, Artificial Sequence
  Synthetic
cggaccaccaaaggcg

SEQ ID NO: 8998 - DNA, 18 bp, Artificial Sequence
  Synthetic
acgcgttttccacccttt

SEQ ID NO: 8999 - DNA, 18 bp, Artificial Sequence
  Synthetic
gcgcattaccaccgagtc

SEQ ID NO: 9000 - DNA, 19 bp, Artificial Sequence
  Synthetic
ggttcctccagccaatcga

SEQ ID NO: 9001 - DNA, 18 bp, Artificial Sequence
  Synthetic
gctcgtcccggtaatcga

SEQ ID NO: 9002 - DNA, 16 bp, Artificial Sequence
  Synthetic
tcggtcagggcctcgt

SEQ ID NO: 9003 - DNA, 17 bp, Artificial Sequence
  Synthetic
cagctcggtggaaagcc

SEQ ID NO: 9004 - DNA, 16 bp, Artificial Sequence
  Synthetic
ccgaggaaacgggggt

SEQ ID NO: 9005 - DNA, 16 bp, Artificial Sequence
  Synthetic
gtgtggggacgacgct

SEQ ID NO: 9006 - DNA, 19 bp, Artificial Sequence
  Synthetic
tgtctgctagtcgcctacg

SEQ ID NO: 9007 - DNA, 16 bp, Artificial Sequence
  Synthetic
gcgactcgcccgatct

SEQ ID NO: 9008 - DNA, 20 bp, Artificial Sequence
  Synthetic
tgattggcgcaagtaaagga

SEQ ID NO: 9009 - DNA, 16 bp, Artificial Sequence
  Synthetic
ggctttctcgcccgct

SEQ ID NO: 9010 - DNA, 16 bp, Artificial Sequence
  Synthetic
cttccagcgtcgccgt

SEQ ID NO: 9011 - DNA, 17 bp, Artificial Sequence
  Synthetic
ggcacgtcactttgcgg

SEQ ID NO: 9012 - DNA, 18 bp, Artificial Sequence
  Synthetic
atgggagcgttacgacgg

SEQ ID NO: 9013 - DNA, 17 bp, Artificial Sequence
  Synthetic
gtgccacgaggggatga

SEQ ID NO: 9014 - DNA, 20 bp, Artificial Sequence
  Synthetic
tgagagtccaaaacccacgg

SEQ ID NO: 9015 - DNA, 16 bp, Artificial Sequence
  Synthetic
ctaacgggcacgcggt

SEQ ID NO: 9016 - DNA, 20 bp, Artificial Sequence
  Synthetic
tcgtgcggagatttgttctc

SEQ ID NO: 9017 - DNA, 18 bp, Artificial Sequence
  Synthetic
agacgtcgggctctttcc

SEQ ID NO: 9018 - DNA, 19 bp, Artificial Sequence
  Synthetic
gttcagcatcttgagcggc

SEQ ID NO: 9019 - DNA, 20 bp, Artificial Sequence
  Synthetic
aagcttacagtcttgcggtt

SEQ ID NO: 9020 - DNA, 18 bp, Artificial Sequence
  Synthetic
aaggcccgtaaaagcggc

SEQ ID NO: 9021 - DNA, 16 bp, Artificial Sequence
  Synthetic
gagaggcgcgccgaaa

SEQ ID NO: 9022 - DNA, 16 bp, Artificial Sequence
  Synthetic
ccagccgcatcagcag

SEQ ID NO: 9023 - DNA, 15 bp, Artificial Sequence
  Synthetic
aggtggcgtcgcgaa

SEQ ID NO: 9024 - DNA, 15 bp, Artificial Sequence
  Synthetic
tgacgttgcgccgct

SEQ ID NO: 9025 - DNA, 18 bp, Artificial Sequence
  Synthetic
ggccactacctgtacgcc

SEQ ID NO: 9026 - DNA, 20 bp, Artificial Sequence
  Synthetic
cgcggtaaaaatgcggtatg

SEQ ID NO: 9027 - DNA, 19 bp, Artificial Sequence
  Synthetic
ggcctcgaacatctcctcg

SEQ ID NO: 9028 - DNA, 17 bp, Artificial Sequence
  Synthetic
ttgcggctctctaccgt

SEQ ID NO: 9029 - DNA, 18 bp, Artificial Sequence
  Synthetic
cgctgctctacgtgcacc

SEQ ID NO: 9030 - DNA, 17 bp, Artificial Sequence
  Synthetic
aggacgtcgcggctatc

SEQ ID NO: 9031 - DNA, 18 bp, Artificial Sequence
  Synthetic
ggtacggggagagatggc

SEQ ID NO: 9032 - DNA, 16 bp, Artificial Sequence
  Synthetic
cgcggcccatgaggta

SEQ ID NO: 9033 - DNA, 18 bp, Artificial Sequence
  Synthetic
catgttggccgtcttgcg

SEQ ID NO: 9034 - DNA, 18 bp, Artificial Sequence
  Synthetic
cttggaactggtcgcgtc

SEQ ID NO: 9035 - DNA, 19 bp, Artificial Sequence
  Synthetic
acgaagctctctatccggt

SEQ ID NO: 9036 - DNA, 17 bp, Artificial Sequence
  Synthetic
gttgtagtcgcggtggc

SEQ ID NO: 9037 - DNA, 18 bp, Artificial Sequence
  Synthetic
cgtagcgctcctggatct

SEQ ID NO: 9038 - DNA, 16 bp, Artificial Sequence
  Synthetic
ggcgccgtcactcgtt

SEQ ID NO: 9039 - DNA, 18 bp, Artificial Sequence
  Synthetic
ttttccgcatgcgttcga

SEQ ID NO: 9040 - DNA, 16 bp, Artificial Sequence
  Synthetic
actgctcgcaccgtct

SEQ ID NO: 9041 - DNA, 16 bp, Artificial Sequence
  Synthetic
gcggtctggacgaggt

SEQ ID NO: 9042 - DNA, 15 bp, Artificial Sequence
  Synthetic
ttcggcgcaccacca

SEQ ID NO: 9043 - DNA, 16 bp, Artificial Sequence
  Synthetic
ctctgggtcgccaggt

SEQ ID NO: 9044 - DNA, 16 bp, Artificial Sequence
  Synthetic
tttggaggccgcaccg

SEQ ID NO: 9045 - DNA, 20 bp, Artificial Sequence
  Synthetic
attgcgtcgcggttactacg

SEQ ID NO: 9046 - DNA, 18 bp, Artificial Sequence
  Synthetic
cggactgtggtcgactgt

SEQ ID NO: 9047 - DNA, 20 bp, Artificial Sequence
  Synthetic
tccacgcatgaaataacggt

SEQ ID NO: 9048 - DNA, 16 bp, Artificial Sequence
  Synthetic
ctgcggtactcggcca

SEQ ID NO: 9049 - DNA, 16 bp, Artificial Sequence
  Synthetic
ttgagctcgtggcggc

SEQ ID NO: 9050 - DNA, 16 bp, Artificial Sequence
  Synthetic
gctctggcgcaacgag

SEQ ID NO: 9051 - DNA, 17 bp, Artificial Sequence
  Synthetic
gcacgaggagaccacca

SEQ ID NO: 9052 - DNA, 17 bp, Artificial Sequence
  Synthetic
gtcatcgacgagtgcgg

SEQ ID NO: 9053 - DNA, 18 bp, Artificial Sequence
  Synthetic
cggattcttctcagggcg

SEQ ID NO: 9054 - DNA, 18 bp, Artificial Sequence
  Synthetic
cgtcaagccacctagcct

SEQ ID NO: 9055 - DNA, 19 bp, Artificial Sequence
  Synthetic
tgtcagatcagctcgcaga

SEQ ID NO: 9056 - DNA, 16 bp, Artificial Sequence
  Synthetic
atgcgctcgggttcct

SEQ ID NO: 9057 - DNA, 16 bp, Artificial Sequence
  Synthetic
tcccggcgctctgaca

SEQ ID NO: 9058 - DNA, 16 bp, Artificial Sequence
  Synthetic
cggcacaggtcgtcca

SEQ ID NO: 9059 - DNA, 16 bp, Artificial Sequence
  Synthetic
gactttctcggcggcg

SEQ ID NO: 9060 - DNA, 19 bp, Artificial Sequence
  Synthetic
tgacggtgttactcgtggt

SEQ ID NO: 9061 - DNA, 17 bp, Artificial Sequence
  Synthetic
ctttcttggtggcgccc

SEQ ID NO: 9062 - DNA, 16 bp, Artificial Sequence
  Synthetic
acggcgcttgtggtgc

SEQ ID NO: 9063 - DNA, 20 bp, Artificial Sequence
  Synthetic
acgacaggatcagacagacg

SEQ ID NO: 9064 - DNA, 18 bp, Artificial Sequence
  Synthetic
ttccatctgcgtcagcgg

SEQ ID NO: 9065 - DNA, 19 bp, Artificial Sequence
  Synthetic
atactgtcccagtcgcgac

SEQ ID NO: 9066 - DNA, 21 bp, Artificial Sequence
  Synthetic
taccgtgatgtaaaaacaaca

SEQ ID NO: 9067 - DNA, 20 bp, Artificial Sequence
  Synthetic
ctttttccttgtttgacggt

SEQ ID NO: 9068 - DNA, 18 bp, Artificial Sequence
  Synthetic
cggtacatcccgcagtcg

SEQ ID NO: 9069 - DNA, 19 bp, Artificial Sequence
  Synthetic
cgtgggaacgacagaaacg

SEQ ID NO: 9070 - DNA, 18 bp, Artificial Sequence
  Synthetic
ggtgaccgtcctctgtcc

SEQ ID NO: 9071 - DNA, 17 bp, Artificial Sequence
  Synthetic
ccattctggcagcagcg

SEQ ID NO: 9072 - DNA, 20 bp, Artificial Sequence
  Synthetic
ggacacgagagtcccacctt

SEQ ID NO: 9073 - DNA, 19 bp, Artificial Sequence
  Synthetic
gccaacgtcgaatgctacg

SEQ ID NO: 9074 - DNA, 16 bp, Artificial Sequence
  Synthetic
cctgggcgctgctgtt

SEQ ID NO: 9075 - DNA, 17 bp, Artificial Sequence
  Synthetic
caagtcccaggcggcta

SEQ ID NO: 9076 - DNA, 17 bp, Artificial Sequence
  Synthetic
aggggagcaacaaccgt

SEQ ID NO: 9077 - DNA, 15 bp, Artificial Sequence
  Synthetic
tcgcgccgcagagtt

SEQ ID NO: 9078 - DNA, 18 bp, Artificial Sequence
  Synthetic
ggccgttggagaattggt

SEQ ID NO: 9079 - DNA, 19 bp, Artificial Sequence
  Synthetic
agacggtgttcgatggaga

SEQ ID NO: 9080 - DNA, 16 bp, Artificial Sequence
  Synthetic
cacacggcccggaatg

SEQ ID NO: 9081 - DNA, 18 bp, Artificial Sequence
  Synthetic
agcacagttgacgaccac

SEQ ID NO: 9082 - DNA, 20 bp, Artificial Sequence
  Synthetic
aatttgggtcttttcacgcg

SEQ ID NO: 9083 - DNA, 18 bp, Artificial Sequence
  Synthetic
gttgcccgacatcctccc

SEQ ID NO: 9084 - DNA, 20 bp, Artificial Sequence
  Synthetic
ctttccgtaccgggatttcc

SEQ ID NO: 9085 - DNA, 20 bp, Artificial Sequence
  Synthetic
aacgtcaagagtcacgtcag

SEQ ID NO: 9086 - DNA, 20 bp, Artificial Sequence
  Synthetic
cacatcaacagaaaaccgag

SEQ ID NO: 9087 - DNA, 17 bp, Artificial Sequence
  Synthetic
tcgttaccccaggtgcc

SEQ ID NO: 9088 - DNA, 19 bp, Artificial Sequence
  Synthetic
cggaatcgtataccgggca

SEQ ID NO: 9089 - DNA, 16 bp, Artificial Sequence
  Synthetic
gttcccaagccacgcc

SEQ ID NO: 9090 - DNA, 16 bp, Artificial Sequence
  Synthetic
cgcgcccagaaccaac

SEQ ID NO: 9091 - DNA, 16 bp, Artificial Sequence
  Synthetic
ccacgcggcaacagtc

SEQ ID NO: 9092 - DNA, 16 bp, Artificial Sequence
  Synthetic
gggatgtgcgccagga

SEQ ID NO: 9093 - DNA, 17 bp, Artificial Sequence
  Synthetic
tgttgccgctgtcgaac

SEQ ID NO: 9094 - DNA, 16 bp, Artificial Sequence
  Synthetic
gcgctggccacgatca

SEQ ID NO: 9095 - DNA, 16 bp, Artificial Sequence
  Synthetic
gccataccgccagcct

SEQ ID NO: 9096 - DNA, 18 bp, Artificial Sequence
  Synthetic
cgcacaacgtcaccacta

SEQ ID NO: 9097 - DNA, 18 bp, Artificial Sequence
  Synthetic
tcccatctggtcgggttc

SEQ ID NO: 9098 - DNA, 16 bp, Artificial Sequence
  Synthetic
ggcggccagagaacgt

SEQ ID NO: 9099 - DNA, 18 bp, Artificial Sequence
  Synthetic
tttagcatttcggcgcgg

SEQ ID NO: 9100 - DNA, 19 bp, Artificial Sequence
  Synthetic
atggcgtccaggtgtatga

SEQ ID NO: 9101 - DNA, 18 bp, Artificial Sequence
  Synthetic
gtccagcagttggtcgcg

SEQ ID NO: 9102 - DNA, 20 bp, Artificial Sequence
  Synthetic
aaatcccgcaacacttgtcg

SEQ ID NO: 9103 - DNA, 19 bp, Artificial Sequence
  Synthetic
cgtgaagagccctcatcca

SEQ ID NO: 9104 - DNA, 18 bp, Artificial Sequence
  Synthetic
ggtcacacgctgcagttc

SEQ ID NO: 9105 - DNA, 16 bp, Artificial Sequence
  Synthetic
ccttctcgcgggccta

SEQ ID NO: 9106 - DNA, 20 bp, Artificial Sequence
  Synthetic
ttctacgggtatctgcagct

SEQ ID NO: 9107 - DNA, 16 bp, Artificial Sequence
  Synthetic
gcagacacgcacctgg

SEQ ID NO: 9108 - DNA, 16 bp, Artificial Sequence
  Synthetic
gcgcaccctcctaggt

SEQ ID NO: 9109 - DNA, 22 bp, Artificial Sequence
  Synthetic
aggtactgatccaaaatggaag

SEQ ID NO: 9110 - DNA, 20 bp, Artificial Sequence
  Synthetic
aattgaaggaagagaccgag

SEQ ID NO: 9111 - DNA, 25 bp, Artificial Sequence
  Synthetic
aagaataaaaaccagactattcacc

SEQ ID NO: 9112 - DNA, 23 bp, Artificial Sequence
  Synthetic
cccaaaaacaaagaacatgaaga

SEQ ID NO: 9113 - DNA, 21 bp, Artificial Sequence
  Synthetic
caacaaggcatgtgaattgac

SEQ ID NO: 9114 - DNA, 21 bp, Artificial Sequence
  Synthetic
aaggaagacaaacctgtatgg

SEQ ID NO: 9115 - DNA, 18 bp, Artificial Sequence
  Synthetic
ggggatggaaatgagacg

SEQ ID NO: 9116 - DNA, 18 bp, Artificial Sequence
  Synthetic
cgtctcaaggcaccaaac

SEQ ID NO: 9117 - DNA, 21 bp, Artificial Sequence
  Synthetic
aaaggaccctaagaaaactgg

SEQ ID NO: 9118 - DNA, 18 bp, Artificial Sequence
  Synthetic
gggatagggacaatggtg

SEQ ID NO: 9119 - DNA, 20 bp, Artificial Sequence
  Synthetic
accttagggtctcaagtttc

SEQ ID NO: 9120 - DNA, 20 bp, Artificial Sequence
  Synthetic
tttagacgccattttacacg

SEQ ID NO: 9121 - DNA, 19 bp, Artificial Sequence
  Synthetic
tctgccagctcattttcac

SEQ ID NO: 9122 - DNA, 20 bp, Artificial Sequence
  Synthetic
tattgggggcgaatgtatgc

SEQ ID NO: 9123 - DNA, 18 bp, Artificial Sequence
  Synthetic
cctcacccccgaaactag

SEQ ID NO: 9124 - DNA, 21 bp, Artificial Sequence
  Synthetic
ggtgttgctttgaatagttca

SEQ ID NO: 9125 - DNA, 19 bp, Artificial Sequence
  Synthetic
gcgagaaatcccacctgag

SEQ ID NO: 9126 - DNA, 18 bp, Artificial Sequence
  Synthetic
ggttagagccatgggagg

SEQ ID NO: 9127 - DNA, 23 bp, Artificial Sequence
  Synthetic
aactgtctgtaaaaaagtgtttg

SEQ ID NO: 9128 - DNA, 18 bp, Artificial Sequence
  Synthetic
gcggggtatgtttagacc

SEQ ID NO: 9129 - DNA, 20 bp, Artificial Sequence
  Synthetic
ccaggttaccatattgggcc

SEQ ID NO: 9130 - DNA, 23 bp, Artificial Sequence
  Synthetic
tgatacttgttttttctgacatg

SEQ ID NO: 9131 - DNA, 22 bp, Artificial Sequence
  Synthetic
cgaggtgacatgatatgaagtt

SEQ ID NO: 9132 - DNA, 20 bp, Artificial Sequence
  Synthetic
agatgggggaatcatgtcca

SEQ ID NO: 9133 - DNA, 19 bp, Artificial Sequence
  Synthetic
ccataggcatgtggtccag

SEQ ID NO: 9134 - DNA, 23 bp, Artificial Sequence
  Synthetic
ggcaaggtagcattttaacataa

SEQ ID NO: 9135 - DNA, 20 bp, Artificial Sequence
  Synthetic
acaaaaagactgtcagtgtc

SEQ ID NO: 9136 - DNA, 19 bp, Artificial Sequence
  Synthetic
cacaattttctggtggtgg

SEQ ID NO: 9137 - DNA, 18 bp, Artificial Sequence
  Synthetic
tttgtccctatcggcccg

SEQ ID NO: 9138 - DNA, 20 bp, Artificial Sequence
  Synthetic
taattttccagcgccacctg

SEQ ID NO: 9139 - DNA, 25 bp, Artificial Sequence
  Synthetic
ctcctttttttttccatagttcttg

SEQ ID NO: 9140 - DNA, 19 bp, Artificial Sequence
  Synthetic
gattgggaagggcaaaagt

SEQ ID NO: 9141 - DNA, 22 bp, Artificial Sequence
  Synthetic
aagatcagtagctaaggaggtt

SEQ ID NO: 9142 - DNA, 20 bp, Artificial Sequence
  Synthetic
caccagttggaagaatggct

SEQ ID NO: 9143 - DNA, 20 bp, Artificial Sequence
  Synthetic
tcgtcctcttcctcttctgc

SEQ ID NO: 9144 - DNA, 18 bp, Artificial Sequence
  Synthetic
tgagcccggggactaacc

SEQ ID NO: 9145 - DNA, 22 bp, Artificial Sequence
  Synthetic
cctgtcttaaaatctcctgaac

SEQ ID NO: 9146 - DNA, 20 bp, Artificial Sequence
  Synthetic
tttcttcctcgaccacaggt

SEQ ID NO: 9147 - DNA, 21 bp, Artificial Sequence
  Synthetic
ctttcaagaaaggcatctagc

SEQ ID NO: 9148 - DNA, 23 bp, Artificial Sequence
  Synthetic
gttgtaataaagctaaatctgcc

SEQ ID NO: 9149 - DNA, 18 bp, Artificial Sequence
  Synthetic
cagcacctggagcgagat

SEQ ID NO: 9150 - DNA, 20 bp, Artificial Sequence
  Synthetic
aaagttggtaagcgactccc

SEQ ID NO: 9151 - DNA, 16 bp, Artificial Sequence
  Synthetic
cgattgggcgcccact

SEQ ID NO: 9152 - DNA, 23 bp, Artificial Sequence
  Synthetic
aaaaagctttaataaccatgtgc

SEQ ID NO: 9153 - DNA, 20 bp, Artificial Sequence
  Synthetic
catagcttacaaagggcgct

SEQ ID NO: 9154 - DNA, 19 bp, Artificial Sequence
  Synthetic
ttttcggccattttggaag

SEQ ID NO: 9155 - DNA, 23 bp, Artificial Sequence
  Synthetic
gtggtcaggaagattatacaaac

SEQ ID NO: 9156 - DNA, 18 bp, Artificial Sequence
  Synthetic
gtccttctacgcttccaa

SEQ ID NO: 9157 - DNA, 20 bp, Artificial Sequence
  Synthetic
aacatatgcacaagagcggc

SEQ ID NO: 9158 - DNA, 25 bp, Artificial Sequence
  Synthetic
gtagtgcaaaataatgactattccc

SEQ ID NO: 9159 - DNA, 19 bp, Artificial Sequence
  Synthetic
gtaggaagacagcatggag

SEQ ID NO: 9160 - DNA, 22 bp, Artificial Sequence
  Synthetic
aggatcaaaacactgtaagagg

SEQ ID NO: 9161 - DNA, 20 bp, Artificial Sequence
  Synthetic
tgtccattttggtttcgcca

SEQ ID NO: 9162 - DNA, 16 bp, Artificial Sequence
  Synthetic
tcgccggcgtagacca

SEQ ID NO: 9163 - DNA, 20 bp, Artificial Sequence
  Synthetic
atggcccatcggataacctt

SEQ ID NO: 9164 - DNA, 18 bp, Artificial Sequence
  Synthetic
cggaagaaaagcgtggaa

SEQ ID NO: 9165 - DNA, 20 bp, Artificial Sequence
  Synthetic
tacatccttccattgtgccc

SEQ ID NO: 9166 - DNA, 20 bp, Artificial Sequence
  Synthetic
attgccaaccgtttagagcc

SEQ ID NO: 9167 - DNA, 20 bp, Artificial Sequence
  Synthetic
tcccatctgtgtatacgcct

SEQ ID NO: 9168 - DNA, 20 bp, Artificial Sequence
  Synthetic
acctactcctacaaggctcg

SEQ ID NO: 9169 - DNA, 18 bp, Artificial Sequence
  Synthetic
caaccaacgaacacggag

SEQ ID NO: 9170 - DNA, 21 bp, Artificial Sequence
  Synthetic
tgcaagacagaaatacagagc

SEQ ID NO: 9171 - DNA, 22 bp, Artificial Sequence
  Synthetic
taatttgcaggctaatttgtgg

SEQ ID NO: 9172 - DNA, 20 bp, Artificial Sequence
  Synthetic
gccatcagaaatttgttgct

SEQ ID NO: 9173 - DNA, 25 bp, Artificial Sequence
  Synthetic
ttactcgcctaaaaactaaagaaac

SEQ ID NO: 9174 - DNA, 21 bp, Artificial Sequence
  Synthetic
ctttagaaactttcagcccat

SEQ ID NO: 9175 - DNA, 19 bp, Artificial Sequence
  Synthetic
cgggtaacgctaccaccta

SEQ ID NO: 9176 - DNA, 18 bp, Artificial Sequence
  Synthetic
cactaaagaccgatgcgt

SEQ ID NO: 9177 - DNA, 20 bp, Artificial Sequence
  Synthetic
aaatcaaatggctcttcgcg

SEQ ID NO: 9178 - DNA, 19 bp, Artificial Sequence
  Synthetic
tgtttaaacattcgcagcg

SEQ ID NO: 9179 - DNA, 20 bp, Artificial Sequence
  Synthetic
tccaccaaatgctctttgcg

SEQ ID NO: 9180 - DNA, 23 bp, Artificial Sequence
  Synthetic
tacttttccattagcatagccat

SEQ ID NO: 9181 - DNA, 18 bp, Artificial Sequence
  Synthetic
gctacggctgtcatggag

SEQ ID NO: 9182 - DNA, 20 bp, Artificial Sequence
  Synthetic
aaatcctcgccttaacttct

SEQ ID NO: 9183 - DNA, 19 bp, Artificial Sequence
  Synthetic
ccggcagtaaatcttccgc

SEQ ID NO: 9184 - DNA, 18 bp, Artificial Sequence
  Synthetic
cagagattacgtgcgaga

SEQ ID NO: 9185 - DNA, 18 bp, Artificial Sequence
  Synthetic
accgttctttggtttgca

SEQ ID NO: 9186 - DNA, 18 bp, Artificial Sequence
  Synthetic
ccttgatccccaaaccgg

SEQ ID NO: 9187 - DNA, 20 bp, Artificial Sequence
  Synthetic
aatctcagaaagccaaccgt

SEQ ID NO: 9188 - DNA, 18 bp, Artificial Sequence
  Synthetic
agcagcaacaaggaaagt

SEQ ID NO: 9189 - DNA, 20 bp, Artificial Sequence
  Synthetic
atgaattggttaagcgccgg

SEQ ID NO: 9190 - DNA, 25 bp, Artificial Sequence
  Synthetic
ggaattgatacacacctcattaaat

SEQ ID NO: 9191 - DNA, 23 bp, Artificial Sequence
  Synthetic
aaactacacaaagaaaacatcac

SEQ ID NO: 9192 - DNA, 22 bp, Artificial Sequence
  Synthetic
tcgcagctcttattttattcct

SEQ ID NO: 9193 - DNA, 24 bp, Artificial Sequence
  Synthetic
aatgcatcattacttcaaagtacc

SEQ ID NO: 9194 - DNA, 22 bp, Artificial Sequence
  Synthetic
cagcctttatttatctgtgctg

SEQ ID NO: 9195 - DNA, 23 bp, Artificial Sequence
  Synthetic
ctgggtttatggaattatgtctg

SEQ ID NO: 9196 - DNA, 24 bp, Artificial Sequence
  Synthetic
gagttaattgatttacaaaccgtg

SEQ ID NO: 9197 - DNA, 23 bp, Artificial Sequence
  Synthetic
ttaccggaaatctgaaaatacat

SEQ ID NO: 9198 - DNA, 19 bp, Artificial Sequence
  Synthetic
ttacactcaagctagggga

SEQ ID NO: 9199 - DNA, 20 bp, Artificial Sequence
  Synthetic
tctcaccactgaaactccct

SEQ ID NO: 9200 - DNA, 23 bp, Artificial Sequence
  Synthetic
gtaacaagaataggggatggttt

SEQ ID NO: 9201 - DNA, 22 bp, Artificial Sequence
  Synthetic
taagtttagtgggtgttaaggg

SEQ ID NO: 9202 - DNA, 21 bp, Artificial Sequence
  Synthetic
tttaacattcatgtggtcagg

SEQ ID NO: 9203 - DNA, 19 bp, Artificial Sequence
  Synthetic
tgatggaaacgaatccctc

SEQ ID NO: 9204 - DNA, 20 bp, Artificial Sequence
  Synthetic
gttaacaacctcccgatacc

SEQ ID NO: 9205 - DNA, 19 bp, Artificial Sequence
  Synthetic
aggaatgcctcttacctca

SEQ ID NO: 9206 - DNA, 19 bp, Artificial Sequence
  Synthetic
cgacttacaggaggaggag

SEQ ID NO: 9207 - DNA, 22 bp, Artificial Sequence
  Synthetic
aaaagtctggatcttcaaacac

SEQ ID NO: 9208 - DNA, 20 bp, Artificial Sequence
  Synthetic
cctcaaaatctaagccatgc

SEQ ID NO: 9209 - DNA, 22 bp, Artificial Sequence
  Synthetic
aggaatatcaactgctatgtgc

SEQ ID NO: 9210 - DNA, 20 bp, Artificial Sequence
  Synthetic
aacggtcaagcacttctgtt

SEQ ID NO: 9211 - DNA, 19 bp, Artificial Sequence
  Synthetic
ataaggatgcggcaagctc

SEQ ID NO: 9212 - DNA, 20 bp, Artificial Sequence
  Synthetic
tggccaaaacatgttccacc

SEQ ID NO: 9213 - DNA, 19 bp, Artificial Sequence
  Synthetic
acaaaccctaccaatcacc

SEQ ID NO: 9214 - DNA, 18 bp, Artificial Sequence
  Synthetic
acgttgtgtgggatttgg

SEQ ID NO: 9215 - DNA, 24 bp, Artificial Sequence
  Synthetic
gacattgattgaaacgagatatgt

SEQ ID NO: 9216 - DNA, 18 bp, Artificial Sequence
  Synthetic
gatggagccgagaacagt

SEQ ID NO: 9217 - DNA, 25 bp, Artificial Sequence
  Synthetic
cccaaaacatattcaatatgacatc

SEQ ID NO: 9218 - DNA, 19 bp, Artificial Sequence
  Synthetic
tagcagacaaggtgactca

SEQ ID NO: 9219 - DNA, 22 bp, Artificial Sequence
  Synthetic
cacctgatcccaaatactttga

SEQ ID NO: 9220 - DNA, 21 bp, Artificial Sequence
  Synthetic
gccaggaaaagaaaaacagaa

SEQ ID NO: 9221 - DNA, 18 bp, Artificial Sequence
  Synthetic
aatacccacacatgccca

SEQ ID NO: 9222 - DNA, 20 bp, Artificial Sequence
  Synthetic
caaggtacaagatgttggtc

SEQ ID NO: 9223 - DNA, 21 bp, Artificial Sequence
  Synthetic
agctcctgcaaaaataaaagc

SEQ ID NO: 9224 - DNA, 23 bp, Artificial Sequence
  Synthetic
ctgaaaattgtagcatatggtga

SEQ ID NO: 9225 - DNA, 24 bp, Artificial Sequence
  Synthetic
cggaagagatacatataaaaaggg

SEQ ID NO: 9226 - DNA, 20 bp, Artificial Sequence
  Synthetic
ccacggttgcagatcttaat

SEQ ID NO: 9227 - DNA, 19 bp, Artificial Sequence
  Synthetic
gaaagctgacgttttgctg

SEQ ID NO: 9228 - DNA, 21 bp, Artificial Sequence
  Synthetic
gaggattgtgacaatgcacta

SEQ ID NO: 9229 - DNA, 23 bp, Artificial Sequence
  Synthetic
aaactgtacaaaagttgatgtgt

SEQ ID NO: 9230 - DNA, 21 bp, Artificial Sequence
  Synthetic
aaaagcttggcagacaattag

SEQ ID NO: 9231 - DNA, 25 bp, Artificial Sequence
  Synthetic
tatgatggcttatactttacagacc

SEQ ID NO: 9232 - DNA, 20 bp, Artificial Sequence
  Synthetic
ggaggaaaccgaggaaatcc

SEQ ID NO: 9233 - DNA, 18 bp, Artificial Sequence
  Synthetic
agctagggatccgcctat

SEQ ID NO: 9234 - DNA, 25 bp, Artificial Sequence
  Synthetic
gttccaaatctttatgcaaaatgtc

SEQ ID NO: 9235 - DNA, 22 bp, Artificial Sequence
  Synthetic
ctagtggtactttagtaaggcc

SEQ ID NO: 9236 - DNA, 19 bp, Artificial Sequence
  Synthetic
caatcatatctggcgagga

SEQ ID NO: 9237 - DNA, 22 bp, Artificial Sequence
  Synthetic
tagaaagccctccaaaaactag

SEQ ID NO: 9238 - DNA, 18 bp, Artificial Sequence
  Synthetic
ctatagggcgtccaaggt

SEQ ID NO: 9239 - DNA, 20 bp, Artificial Sequence
  Synthetic
gtgaaagatgtacaggaacc

SEQ ID NO: 9240 - DNA, 19 bp, Artificial Sequence
  Synthetic
tagtgctcctttggatgtc

SEQ ID NO: 9241 - DNA, 21 bp, Artificial Sequence
  Synthetic
tctaactgcagatgttatggc

SEQ ID NO: 9242 - DNA, 21 bp, Artificial Sequence
  Synthetic
tgcaaacgtgtatgtatctgt

SEQ ID NO: 9243 - DNA, 17 bp, Artificial Sequence
  Synthetic
attacccaggcagccga

SEQ ID NO: 9244 - DNA, 24 bp, Artificial Sequence
  Synthetic
caagcacaaattttccttaaatcc

SEQ ID NO: 9245 - DNA, 21 bp, Artificial Sequence
  Synthetic
tgcaatatgctagaagactgc

SEQ ID NO: 9246 - DNA, 20 bp, Artificial Sequence
  Synthetic
ggatacgtacgcaacagagc

SEQ ID NO: 9247 - DNA, 22 bp, Artificial Sequence
  Synthetic
cagaagcagaggattatggaaa

SEQ ID NO: 9248 - DNA, 20 bp, Artificial Sequence
  Synthetic
ggtaaaaccaacaggaaacg

SEQ ID NO: 9249 - DNA, 23 bp, Artificial Sequence
  Synthetic
tcaaaaattgttgaaactgtagc

SEQ ID NO: 9250 - DNA, 24 bp, Artificial Sequence
  Synthetic
gtatgttctttgatggagaatttg

SEQ ID NO: 9251 - DNA, 21 bp, Artificial Sequence
  Synthetic
ttcagaactagagcaaacaga

SEQ ID NO: 9252 - DNA, 23 bp, Artificial Sequence
  Synthetic
cgaaaacggttgtatataaacca

SEQ ID NO: 9253 - DNA, 18 bp, Artificial Sequence
  Synthetic
gcggctatccatatgcag

SEQ ID NO: 9254 - DNA, 21 bp, Artificial Sequence
  Synthetic
atggaagacatgttaccctaa

SEQ ID NO: 9255 - DNA, 19 bp, Artificial Sequence
  Synthetic
aagacctaacaacgatggc

SEQ ID NO: 9256 - DNA, 18 bp, Artificial Sequence
  Synthetic
cgactgtgcaggacctaa

SEQ ID NO: 9257 - DNA, 19 bp, Artificial Sequence
  Synthetic
gtcaggaaaaggacacagg

SEQ ID NO: 9258 - DNA, 21 bp, Artificial Sequence
  Synthetic
aacagttattgaacacgggtt

SEQ ID NO: 9259 - DNA, 25 bp, Artificial Sequence
  Synthetic
agtgtatgaactgtcaaatacaaac

SEQ ID NO: 9260 - DNA, 20 bp, Artificial Sequence
  Synthetic
gtagtgccaccattaaaggt

SEQ ID NO: 9261 - DNA, 18 bp, Artificial Sequence
  Synthetic
ctaggaaacgagcacgag

SEQ ID NO: 9262 - DNA, 18 bp, Artificial Sequence
  Synthetic
tcctcaaaggcaccacat

SEQ ID NO: 9263 - DNA, 24 bp, Artificial Sequence
  Synthetic
gcatttgttgtatgttttgttagc

SEQ ID NO: 9264 - DNA, 23 bp, Artificial Sequence
  Synthetic
attcctttagatacttttgtggt

SEQ ID NO: 9265 - DNA, 25 bp, Artificial Sequence
  Synthetic
cagatacatatttaacttccacacc

SEQ ID NO: 9266 - DNA, 19 bp, Artificial Sequence
  Synthetic
gcgacagcacagtatatgt

SEQ ID NO: 9267 - DNA, 21 bp, Artificial Sequence
  Synthetic
ccgcccttagaacttattacc

SEQ ID NO: 9268 - DNA, 24 bp, Artificial Sequence
  Synthetic
gtctgtagggagtagtatatatgt

SEQ ID NO: 9269 - DNA, 18 bp, Artificial Sequence
  Synthetic
caggtacacattgccctg

SEQ ID NO: 9270 - DNA, 18 bp, Artificial Sequence
  Synthetic
aagcgtctagccatggcg

SEQ ID NO: 9271 - DNA, 19 bp, Artificial Sequence
  Synthetic
caaacgtaacaccaaccgc

SEQ ID NO: 9272 - DNA, 20 bp, Artificial Sequence
  Synthetic
catcgataccctaacctgcg

SEQ ID NO: 9273 - DNA, 20 bp, Artificial Sequence
  Synthetic
cacatcatgcaccttccagg

SEQ ID NO: 9274 - DNA, 20 bp, Artificial Sequence
  Synthetic
tgaactggagtccaacaacc

SEQ ID NO: 9275 - DNA, 20 bp, Artificial Sequence
  Synthetic
actgggttcttggctagctt

SEQ ID NO: 9276 - DNA, 18 bp, Artificial Sequence
  Synthetic
tggggggagaacgagact

SEQ ID NO: 9277 - DNA, 18 bp, Artificial Sequence
  Synthetic
cggcggtatagagcatcg

SEQ ID NO: 9278 - DNA, 18 bp, Artificial Sequence
  Synthetic
ggtgcccaaggcttctgg

SEQ ID NO: 9279 - DNA, 19 bp, Artificial Sequence
  Synthetic
ggggattgtggtggatcca

SEQ ID NO: 9280 - DNA, 18 bp, Artificial Sequence
  Synthetic
gtggccctagagccagtt

SEQ ID NO: 9281 - DNA, 18 bp, Artificial Sequence
  Synthetic
ctggcagggacaccaatg

SEQ ID NO: 9282 - DNA, 16 bp, Artificial Sequence
  Synthetic
ggaggtccgctgctgt

SEQ ID NO: 9283 - DNA, 18 bp, Artificial Sequence
  Synthetic
ggccacactgggttttgg

SEQ ID NO: 9284 - DNA, 20 bp, Artificial Sequence
  Synthetic
tccaacatagaggaggtcgc

SEQ ID NO: 9285 - DNA, 20 bp, Artificial Sequence
  Synthetic
gacttcagcttggaccccac

SEQ ID NO: 9286 - DNA, 20 bp, Artificial Sequence
  Synthetic
ttcctatcccagaccaagca

SEQ ID NO: 9287 - DNA, 19 bp, Artificial Sequence
  Synthetic
ctgtctttcagtgggcagc

SEQ ID NO: 9288 - DNA, 20 bp, Artificial Sequence
  Synthetic
atctcgctggactgtctact

SEQ ID NO: 9289 - DNA, 20 bp, Artificial Sequence
  Synthetic
ttggtaaatttgctcccggc

SEQ ID NO: 9290 - DNA, 18 bp, Artificial Sequence
  Synthetic
gggattgggtcttgcacg

SEQ ID NO: 9291 - DNA, 20 bp, Artificial Sequence
  Synthetic
ttccattatgtcaccggggt

SEQ ID NO: 9292 - DNA, 19 bp, Artificial Sequence
  Synthetic
gagattggctcgagggtca

SEQ ID NO: 9293 - DNA, 20 bp, Artificial Sequence
  Synthetic
cacctcttaccgagacgtgg

SEQ ID NO: 9294 - DNA, 18 bp, Artificial Sequence
  Synthetic
ggtgacccggacttgaca

SEQ ID NO: 9295 - DNA, 20 bp, Artificial Sequence
  Synthetic
ttaccacagaggaagcttgc

SEQ ID NO: 9296 - DNA, 20 bp, Artificial Sequence
  Synthetic
atggcttccaatactcccca

SEQ ID NO: 9297 - DNA, 20 bp, Artificial Sequence
  Synthetic
tgacgtgctatctcaaagcc

SEQ ID NO: 9298 - DNA, 19 bp, Artificial Sequence
  Synthetic
cttatcgcccagggaggta

SEQ ID NO: 9299 - DNA, 19 bp, Artificial Sequence
  Synthetic
cgatccagtggttgtaagg

SEQ ID NO: 9300 - DNA, 23 bp, Artificial Sequence
  Synthetic
tcaatggacccatctaagtttac

SEQ ID NO: 9301 - DNA, 23 bp, Artificial Sequence
  Synthetic
cttctgtctgtaggttttacaca

SEQ ID NO: 9302 - DNA, 21 bp, Artificial Sequence
  Synthetic
acgcatacaaaagatgaggtt

SEQ ID NO: 9303 - DNA, 18 bp, Artificial Sequence
  Synthetic
tccacaggacaggagaga

SEQ ID NO: 9304 - DNA, 21 bp, Artificial Sequence
  Synthetic
gtgcatgtccagattttaagc

SEQ ID NO: 9305 - DNA, 19 bp, Artificial Sequence
  Synthetic
tcaagcaatttggtggtcc

SEQ ID NO: 9306 - DNA, 22 bp, Artificial Sequence
  Synthetic
caaaactcttgtcaagatcaga

SEQ ID NO: 9307 - DNA, 24 bp, Artificial Sequence
  Synthetic
cctatccaaatagagatttagcaa

SEQ ID NO: 9308 - DNA, 18 bp, Artificial Sequence
  Synthetic
ctgcggtgggattttgag

SEQ ID NO: 9309 - DNA, 23 bp, Artificial Sequence
  Synthetic
tttcagctttagtgatcatttgc

SEQ ID NO: 9310 - DNA, 23 bp, Artificial Sequence
  Synthetic
aaaagtaaacaaagaactgaacc

SEQ ID NO: 9311 - DNA, 20 bp, Artificial Sequence
  Synthetic
tcaaatggtttcttcagtgg

SEQ ID NO: 9312 - DNA, 18 bp, Artificial Sequence
  Synthetic
tggatgccactttggtag

SEQ ID NO: 9313 - DNA, 24 bp, Artificial Sequence
  Synthetic
tagagaaacaaggccaagtaatag

SEQ ID NO: 9314 - DNA, 25 bp, Artificial Sequence
  Synthetic
taaggatgaattaagaagtgttgac

SEQ ID NO: 9315 - DNA, 22 bp, Artificial Sequence
  Synthetic
cttacggtgatgatttgattgt

SEQ ID NO: 9316 - DNA, 20 bp, Artificial Sequence
  Synthetic
aagtcaatggctgagtcacc

SEQ ID NO: 9317 - DNA, 19 bp, Artificial Sequence
  Synthetic
gccacccgaacattcaacc

SEQ ID NO: 9318 - DNA, 18 bp, Artificial Sequence
  Synthetic
gacgtcctcgaagcctga

SEQ ID NO: 9319 - DNA, 18 bp, Artificial Sequence
  Synthetic
cagtgggggcagtgtcat

SEQ ID NO: 9320 - DNA, 19 bp, Artificial Sequence
  Synthetic
tgatccaaagtgggctgtg

SEQ ID NO: 9321 - DNA, 20 bp, Artificial Sequence
  Synthetic
atggagactctcttccctac

SEQ ID NO: 9322 - DNA, 23 bp, Artificial Sequence
  Synthetic
tattgtgtgaagaatcattgtca

SEQ ID NO: 9323 - DNA, 18 bp, Artificial Sequence
  Synthetic
tgcagcacttagtccaag

SEQ ID NO: 9324 - DNA, 18 bp, Artificial Sequence
  Synthetic
gtgagccaccaaaatgca

SEQ ID NO: 9325 - DNA, 21 bp, Artificial Sequence
  Synthetic
gggaaagtcgtatttctgttt

SEQ ID NO: 9326 - DNA, 20 bp, Artificial Sequence
  Synthetic
atcttcccttctgttgccag

SEQ ID NO: 9327 - DNA, 22 bp, Artificial Sequence
  Synthetic
ccagtaagagaagaagaagagg

SEQ ID NO: 9328 - DNA, 21 bp, Artificial Sequence
  Synthetic
tgggagagtattggtagcttt

SEQ ID NO: 9329 - DNA, 20 bp, Artificial Sequence
  Synthetic
cgttgttgaaggtgtttggg

SEQ ID NO: 9330 - DNA, 23 bp, Artificial Sequence
  Synthetic
ttgtaaatccagcttttaatggt

SEQ ID NO: 9331 - DNA, 19 bp, Artificial Sequence
  Synthetic
tttacaaatcccgcctttg

SEQ ID NO: 9332 - DNA, 18 bp, Artificial Sequence
  Synthetic
ggttggcactactggtca

SEQ ID NO: 9333 - DNA, 19 bp, Artificial Sequence
  Synthetic
ggacatgtgcgatattggg

SEQ ID NO: 9334 - DNA, 24 bp, Artificial Sequence
  Synthetic
tttagaacctgataacaatacacc

SEQ ID NO: 9335 - DNA, 18 bp, Artificial Sequence
  Synthetic
tacccccctctgaaaagc

SEQ ID NO: 9336 - DNA, 24 bp, Artificial Sequence
  Synthetic
ctaggtaagtacagtaaccgttat

SEQ ID NO: 9337 - DNA, 20 bp, Artificial Sequence
  Synthetic
ttaaggctcctggcatcact

SEQ ID NO: 9338 - DNA, 20 bp, Artificial Sequence
  Synthetic
tgccttgaaattggtgccca

SEQ ID NO: 9339 - DNA, 20 bp, Artificial Sequence
  Synthetic
atgtcaccatctgatgtcgc

SEQ ID NO: 9340 - DNA, 18 bp, Artificial Sequence
  Synthetic
cctctcgtcattgagcgg

SEQ ID NO: 9341 - DNA, 18 bp, Artificial Sequence
  Synthetic
ttgctgctcccgcctaat

SEQ ID NO: 9342 - DNA, 18 bp, Artificial Sequence
  Synthetic
ggccgtcagttggagttc

SEQ ID NO: 9343 - DNA, 19 bp, Artificial Sequence
  Synthetic
gaggcctatgaggggtctg

SEQ ID NO: 9344 - DNA, 19 bp, Artificial Sequence
  Synthetic
agactaatggcccagagcg

SEQ ID NO: 9345 - DNA, 16 bp, Artificial Sequence
  Synthetic
tggtgagccggctcct

SEQ ID NO: 9346 - DNA, 18 bp, Artificial Sequence
  Synthetic
cttttgtgatgcgcgacg

SEQ ID NO: 9347 - DNA, 18 bp, Artificial Sequence
  Synthetic
gcttgctgccagatggtt

SEQ ID NO: 9348 - DNA, 17 bp, Artificial Sequence
  Synthetic
ttgcgtaatgcctggcg

SEQ ID NO: 9349 - DNA, 18 bp, Artificial Sequence
  Synthetic
atgtgacccatcgctgcc

SEQ ID NO: 9350 - DNA, 18 bp, Artificial Sequence
  Synthetic
ccgagctcatgccattgt

SEQ ID NO: 9351 - DNA, 18 bp, Artificial Sequence
  Synthetic
gccattggccacgtacag

SEQ ID NO: 9352 - DNA, 20 bp, Artificial Sequence
  Synthetic
ttgtatgcaggtgttgtggt

SEQ ID NO: 9353 - DNA, 16 bp, Artificial Sequence
  Synthetic
ccttcgcccccgatgt

SEQ ID NO: 9354 - DNA, 16 bp, Artificial Sequence
  Synthetic
ccctcgggctgttgga

SEQ ID NO: 9355 - DNA, 19 bp, Artificial Sequence
  Synthetic
ccccttttctgtcctccga

SEQ ID NO: 9356 - DNA, 20 bp, Artificial Sequence
  Synthetic
aggtactactaaagccgggt

SEQ ID NO: 9357 - DNA, 18 bp, Artificial Sequence
  Synthetic
ttcagagggtccaaatcg

SEQ ID NO: 9358 - DNA, 19 bp, Artificial Sequence
  Synthetic
catcgccggttttacaaag

SEQ ID NO: 9359 - DNA, 23 bp, Artificial Sequence
  Synthetic
ccttagcgtgtgtaaatatctca

SEQ ID NO: 9360 - DNA, 19 bp, Artificial Sequence
  Synthetic
tacattaccaagcgaaggt

SEQ ID NO: 9361 - DNA, 21 bp, Artificial Sequence
  Synthetic
cccgaattttttttattgcct

SEQ ID NO: 9362 - DNA, 19 bp, Artificial Sequence
  Synthetic
tcttacaaacaatcccccg

SEQ ID NO: 9363 - DNA, 21 bp, Artificial Sequence
  Synthetic
agttcgacatacagtagatgc

SEQ ID NO: 9364 - DNA, 21 bp, Artificial Sequence
  Synthetic
gcaaaactggtgatacttagt

SEQ ID NO: 9365 - DNA, 22 bp, Artificial Sequence
  Synthetic
gccgactaacaattatacttgt

SEQ ID NO: 9366 - DNA, 19 bp, Artificial Sequence
  Synthetic
acaacggaatctgatcgta

SEQ ID NO: 9367 - DNA, 21 bp, Artificial Sequence
  Synthetic
tgtgtaaaggtagacaactga

SEQ ID NO: 9368 - DNA, 20 bp, Artificial Sequence
  Synthetic
tcacctaaaaacctgactca

SEQ ID NO: 9369 - DNA, 16 bp, Artificial Sequence
  Synthetic
ccccgtggtgtccgaa

SEQ ID NO: 9370 - DNA, 18 bp, Artificial Sequence
  Synthetic
ctcgtccacaaagtcggc

SEQ ID NO: 9371 - DNA, 16 bp, Artificial Sequence
  Synthetic
gccgctctcacagcct

SEQ ID NO: 9372 - DNA, 17 bp, Artificial Sequence
  Synthetic
ggcagggccaaaaacgc

SEQ ID NO: 9373 - DNA, 20 bp, Artificial Sequence
  Synthetic
cgagagcgtcagtattaagc

SEQ ID NO: 9374 - DNA, 20 bp, Artificial Sequence
  Synthetic
ataaaagacaccaaggaagc

SEQ ID NO: 9375 - DNA, 22 bp, Artificial Sequence
  Synthetic
gccatgcaaatgttaaaagaga

SEQ ID NO: 9376 - DNA, 22 bp, Artificial Sequence
  Synthetic
tagaccggttctataaaactct

SEQ ID NO: 9377 - DNA, 25 bp, Artificial Sequence
  Synthetic
accatacctagtataaacaatgaga

SEQ ID NO: 9378 - DNA, 22 bp, Artificial Sequence
  Synthetic
ttcctttggatgggttatgaac

SEQ ID NO: 9379 - DNA, 25 bp, Artificial Sequence
  Synthetic
gagccatttaaaaatctgaaaacag

SEQ ID NO: 9380 - DNA, 25 bp, Artificial Sequence
  Synthetic
gaacaagtagataaattagtcagtg

SEQ ID NO: 9381 - DNA, 21 bp, Artificial Sequence
  Synthetic
tatcctggtagcagttcatgt

SEQ ID NO: 9382 - DNA, 25 bp, Artificial Sequence
  Synthetic
gtaaaacaccatatgtatgtttcag

SEQ ID NO: 9383 - DNA, 25 bp, Artificial Sequence
  Synthetic
attactttgactgtttttcagactc

SEQ ID NO: 9384 - DNA, 20 bp, Artificial Sequence
  Synthetic
ttttcctaggatttggctcc

SEQ ID NO: 9385 - DNA, 18 bp, Artificial Sequence
  Synthetic
catgctccttgggatgtt

SEQ ID NO: 9386 - DNA, 23 bp, Artificial Sequence
  Synthetic
ctggttttgcgattctaaaatgt

SEQ ID NO: 9387 - DNA, 22 bp, Artificial Sequence
  Synthetic
taaacatgtggcagaaagtagg

SEQ ID NO: 9388 - DNA, 18 bp, Artificial Sequence
  Synthetic
gcaggaagcactatgggc

SEQ ID NO: 9389 - DNA, 19 bp, Artificial Sequence
  Synthetic
aagatgggtggcaagtggt

SEQ ID NO: 9390 - DNA, 19 bp, Artificial Sequence
  Synthetic
gagtggaggtttgacagcc

SEQ ID NO: 9391 - DNA, 16 bp, Artificial Sequence
  Synthetic
acgcctgggggatgct

SEQ ID NO: 9392 - DNA, 16 bp, Artificial Sequence
  Synthetic
tggctacgtacgcgct

SEQ ID NO: 9393 - DNA, 16 bp, Artificial Sequence
  Synthetic
gcagggccacggacat

SEQ ID NO: 9394 - DNA, 16 bp, Artificial Sequence
  Synthetic
gcggtggtctcaggct

SEQ ID NO: 9395 - DNA, 17 bp, Artificial Sequence
  Synthetic
cgcgacaggaaccggta

SEQ ID NO: 9396 - DNA, 19 bp, Artificial Sequence
  Synthetic
gtgagcacggggagggtaa

SEQ ID NO: 9397 - DNA, 16 bp, Artificial Sequence
  Synthetic
tcagaaacgcccccga

SEQ ID NO: 9398 - DNA, 19 bp, Artificial Sequence
  Synthetic
gccaacagtttccagcacc

SEQ ID NO: 9399 - DNA, 18 bp, Artificial Sequence
  Synthetic
ggctctccttgtttcgcc

SEQ ID NO: 9400 - DNA, 16 bp, Artificial Sequence
  Synthetic
ctccgcagctgccact

SEQ ID NO: 9401 - DNA, 18 bp, Artificial Sequence
  Synthetic
agggtaatggcgctgacg

SEQ ID NO: 9402 - DNA, 16 bp, Artificial Sequence
  Synthetic
gtcggccacgcgctta

SEQ ID NO: 9403 - DNA, 16 bp, Artificial Sequence
  Synthetic
cggccatggtgctgca

SEQ ID NO: 9404 - DNA, 17 bp, Artificial Sequence
  Synthetic
ccacgtggttgagcagc

SEQ ID NO: 9405 - DNA, 16 bp, Artificial Sequence
  Synthetic
gtgcggcggatcgaag

SEQ ID NO: 9406 - DNA, 20 bp, Artificial Sequence
  Synthetic
tgtccacgacgtcaaattcg

SEQ ID NO: 9407 - DNA, 16 bp, Artificial Sequence
  Synthetic
ctcggggccacgtaca

SEQ ID NO: 9408 - DNA, 16 bp, Artificial Sequence
  Synthetic
tgtcgtacgcggggaa

SEQ ID NO: 9409 - DNA, 16 bp, Artificial Sequence
  Synthetic
aggtcgctcgctgtcg

SEQ ID NO: 9410 - DNA, 17 bp, Artificial Sequence
  Synthetic
cccaacgcaacgcctac

SEQ ID NO: 9411 - DNA, 17 bp, Artificial Sequence
  Synthetic
gctggtttggctcgtcc

SEQ ID NO: 9412 - DNA, 18 bp, Artificial Sequence
  Synthetic
cgcaccaaaagcagaggg

SEQ ID NO: 9413 - DNA, 20 bp, Artificial Sequence
  Synthetic
atggtaaacgcaaagcctcc

SEQ ID NO: 9414 - DNA, 16 bp, Artificial Sequence
  Synthetic
gccgggttgaacagcc

SEQ ID NO: 9415 - DNA, 17 bp, Artificial Sequence
  Synthetic
gagcggccattgggttc

SEQ ID NO: 9416 - DNA, 16 bp, Artificial Sequence
  Synthetic
gcaggtggcggtgaga

SEQ ID NO: 9417 - DNA, 16 bp, Artificial Sequence
  Synthetic
ggacgaaggcgcggat

SEQ ID NO: 9418 - DNA, 20 bp, Artificial Sequence
  Synthetic
tcaaagaacgtggtgttggg

SEQ ID NO: 9419 - DNA, 19 bp, Artificial Sequence
  Synthetic
gaccttcatgaccgcgctg

SEQ ID NO: 9420 - DNA, 19 bp, Artificial Sequence
  Synthetic
aacaccattacggccctgg

SEQ ID NO: 9421 - DNA, 17 bp, Artificial Sequence
  Synthetic
ccttgatctcgtggcgc

SEQ ID NO: 9422 - DNA, 18 bp, Artificial Sequence
  Synthetic
ttgaaactcgctgacggc

SEQ ID NO: 9423 - DNA, 16 bp, Artificial Sequence
  Synthetic
tcgcgccgtagtccag

SEQ ID NO: 9424 - DNA, 16 bp, Artificial Sequence
  Synthetic
ggcggcgtctgggttt

SEQ ID NO: 9425 - DNA, 18 bp, Artificial Sequence
  Synthetic
ggggtttgtcaccttcgg

SEQ ID NO: 9426 - DNA, 19 bp, Artificial Sequence
  Synthetic
aagtggtggtccatgacgt

SEQ ID NO: 9427 - DNA, 17 bp, Artificial Sequence
  Synthetic
gagtacgtcctgcggct

SEQ ID NO: 9428 - DNA, 18 bp, Artificial Sequence
  Synthetic
ggactgtccctcggagac

SEQ ID NO: 9429 - DNA, 16 bp, Artificial Sequence
  Synthetic
cgggcggtctgggtta

SEQ ID NO: 9430 - DNA, 16 bp, Artificial Sequence
  Synthetic
actacgcgctcgctga

SEQ ID NO: 9431 - DNA, 16 bp, Artificial Sequence
  Synthetic
ggcatcgggctgtgca

SEQ ID NO: 9432 - DNA, 19 bp, Artificial Sequence
  Synthetic
atgatcgacagcacgctac

SEQ ID NO: 9433 - DNA, 16 bp, Artificial Sequence
  Synthetic
ctgcgcgctgtaagca

SEQ ID NO: 9434 - DNA, 18 bp, Artificial Sequence
  Synthetic
ctcccagtgccccgacat

SEQ ID NO: 9435 - DNA, 20 bp, Artificial Sequence
  Synthetic
ttgacgtatctgtgctccac

SEQ ID NO: 9436 - DNA, 18 bp, Artificial Sequence
  Synthetic
ggggatcggagtggctgt

SEQ ID NO: 9437 - DNA, 18 bp, Artificial Sequence
  Synthetic
gacccacccgttgatcgc

SEQ ID NO: 9438 - DNA, 16 bp, Artificial Sequence
  Synthetic
gcccagggcgatcctt

SEQ ID NO: 9439 - DNA, 16 bp, Artificial Sequence
  Synthetic
ggcgatggggacggaa

SEQ ID NO: 9440 - DNA, 17 bp, Artificial Sequence
  Synthetic
cggactccgtcgtgtgt

SEQ ID NO: 9441 - DNA, 18 bp, Artificial Sequence
  Synthetic
ttccactttcacgccccg

SEQ ID NO: 9442 - DNA, 19 bp, Artificial Sequence
  Synthetic
gaaccaaagcctctcgtgt

SEQ ID NO: 9443 - DNA, 17 bp, Artificial Sequence
  Synthetic
tgcttggaggccctctg

SEQ ID NO: 9444 - DNA, 20 bp, Artificial Sequence
  Synthetic
cgtgttcttgcaatacccct

SEQ ID NO: 9445 - DNA, 18 bp, Artificial Sequence
  Synthetic
catgacaacgacgcccct

SEQ ID NO: 9446 - DNA, 18 bp, Artificial Sequence
  Synthetic
gtcatccctgcatgcgtg

SEQ ID NO: 9447 - DNA, 17 bp, Artificial Sequence
  Synthetic
ggggtggtggtagtggt

SEQ ID NO: 9448 - DNA, 18 bp, Artificial Sequence
  Synthetic
cggtcacgcccactatca

SEQ ID NO: 9449 - DNA, 19 bp, Artificial Sequence
  Synthetic
gggctcatcgggaatctcg

SEQ ID NO: 9450 - DNA, 16 bp, Artificial Sequence
  Synthetic
ccgggtttcgtggcct

SEQ ID NO: 9451 - DNA, 17 bp, Artificial Sequence
  Synthetic
cctgctagttgtcgcgg

SEQ ID NO: 9452 - DNA, 16 bp, Artificial Sequence
  Synthetic
ttccagccccccagca

SEQ ID NO: 9453 - DNA, 17 bp, Artificial Sequence
  Synthetic
gcaacgcgcgactatgc

SEQ ID NO: 9454 - DNA, 17 bp, Artificial Sequence
  Synthetic
ggtcacaccctaagcgc

SEQ ID NO: 9455 - DNA, 20 bp, Artificial Sequence
  Synthetic
tttacgctttcgaccagagc

SEQ ID NO: 9456 - DNA, 19 bp, Artificial Sequence
  Synthetic
tctgtgcatagaattggcg

SEQ ID NO: 9457 - DNA, 18 bp, Artificial Sequence
  Synthetic
tccccacacccaggagaa

SEQ ID NO: 9458 - DNA, 18 bp, Artificial Sequence
  Synthetic
accaggccattcaaaagc

SEQ ID NO: 9459 - DNA, 18 bp, Artificial Sequence
  Synthetic
aaggacacgaaacatgcc

SEQ ID NO: 9460 - DNA, 24 bp, Artificial Sequence
  Synthetic
gtgaagaattgtagcataatggtt

SEQ ID NO: 9461 - DNA, 22 bp, Artificial Sequence
  Synthetic
caaatcatattttgccaatggt

SEQ ID NO: 9462 - DNA, 24 bp, Artificial Sequence
  Synthetic
cgtctcggacatttaagaaattag

SEQ ID NO: 9463 - DNA, 19 bp, Artificial Sequence
  Synthetic
ctgtcacctaccggctagg

SEQ ID NO: 9464 - DNA, 23 bp, Artificial Sequence
  Synthetic
agagaaaagttcctcaaatctgt

SEQ ID NO: 9465 - DNA, 20 bp, Artificial Sequence
  Synthetic
tgtaggggttttctttggcg

SEQ ID NO: 9466 - DNA, 18 bp, Artificial Sequence
  Synthetic
ctgaaagcggtggcacat

SEQ ID NO: 9467 - DNA, 20 bp, Artificial Sequence
  Synthetic
ttgaggatgatctgcagcag

SEQ ID NO: 9468 - DNA, 23 bp, Artificial Sequence
  Synthetic
ctattgagccaattgatgcaatt

SEQ ID NO: 9469 - DNA, 22 bp, Artificial Sequence
  Synthetic
agattttacttaccccctcaac

SEQ ID NO: 9470 - DNA, 18 bp, Artificial Sequence
  Synthetic
ctggtctggggtattcgt

SEQ ID NO: 9471 - DNA, 18 bp, Artificial Sequence
  Synthetic
aaaaccctccactgacca

SEQ ID NO: 9472 - DNA, 18 bp, Artificial Sequence
  Synthetic
ttgacactaccaggggaa

SEQ ID NO: 9473 - DNA, 21 bp, Artificial Sequence
  Synthetic
gtacatactgtccattgcaac

SEQ ID NO: 9474 - DNA, 18 bp, Artificial Sequence
  Synthetic
tccccaaacccaaagcgt

SEQ ID NO: 9475 - DNA, 25 bp, Artificial Sequence
  Synthetic
cctactttaggtgacataattttgg

SEQ ID NO: 9476 - DNA, 19 bp, Artificial Sequence
  Synthetic
agaggagtgtaacagagct

SEQ ID NO: 9477 - DNA, 20 bp, Artificial Sequence
  Synthetic
ctgataccagaagaagacca

SEQ ID NO: 9478 - DNA, 24 bp, Artificial Sequence
  Synthetic
atagagctagtagaaataaacgag

SEQ ID NO: 9479 - DNA, 23 bp, Artificial Sequence
  Synthetic
aagaacacgtgacttatacagac

SEQ ID NO: 9480 - DNA, 18 bp, Artificial Sequence
  Synthetic
tgtcagcagaattggcac

SEQ ID NO: 9481 - DNA, 20 bp, Artificial Sequence
  Synthetic
tttacagatggctttctggc

SEQ ID NO: 9482 - DNA, 23 bp, Artificial Sequence
  Synthetic
ccagatccaaataagtttgcttt

SEQ ID NO: 9483 - DNA, 23 bp, Artificial Sequence
  Synthetic
attgtaaatactttcgtgtgtct

SEQ ID NO: 9484 - DNA, 20 bp, Artificial Sequence
  Synthetic
taattcgttgctatggttgc

SEQ ID NO: 9485 - DNA, 18 bp, Artificial Sequence
  Synthetic
cctgaagaggaggagcaa

SEQ ID NO: 9486 - DNA, 20 bp, Artificial Sequence
  Synthetic
tatgttgtgactgaagctga

SEQ ID NO: 9487 - DNA, 21 bp, Artificial Sequence
  Synthetic
gtgaaggaaagagcaaaagac

SEQ ID NO: 9488 - DNA, 24 bp, Artificial Sequence
  Synthetic
taaacgttcaatgtctaatgtagc

SEQ ID NO: 9489 - DNA, 22 bp, Artificial Sequence
  Synthetic
gaaacattggtgtatttgcgta

SEQ ID NO: 9490 - DNA, 20 bp, Artificial Sequence
  Synthetic
ctagctacaccaaacggacc

SEQ ID NO: 9491 - DNA, 20 bp, Artificial Sequence
  Synthetic
agacgatcagtttcccctga

SEQ ID NO: 9492 - DNA, 23 bp, Artificial Sequence
  Synthetic
agttctgttaatcaaagaaacca

SEQ ID NO: 9493 - DNA, 25 bp, Artificial Sequence
  Synthetic
agtattatatacttaggtgggttgg

SEQ ID NO: 9494 - DNA, 18 bp, Artificial Sequence
  Synthetic
ggaacccgctattgtacc

SEQ ID NO: 9495 - DNA, 21 bp, Artificial Sequence
  Synthetic
actttcataaggacttctgca

SEQ ID NO: 9496 - DNA, 18 bp, Artificial Sequence
  Synthetic
ccatcacgtgctgttcaa

SEQ ID NO: 9497 - DNA, 20 bp, Artificial Sequence
  Synthetic
tatgatttaagccccatcgc

SEQ ID NO: 9498 - DNA, 19 bp, Artificial Sequence
  Synthetic
atcatgagcgtcttgtttg

SEQ ID NO: 9499 - DNA, 18 bp, Artificial Sequence
  Synthetic
cgaggaccagcaaaatgg

SEQ ID NO: 9500 - DNA, 22 bp, Artificial Sequence
  Synthetic
ttatgagctgtttacatcttgt

SEQ ID NO: 9501 - DNA, 19 bp, Artificial Sequence
  Synthetic
ttttggtacattgttggcg

SEQ ID NO: 9502 - DNA, 23 bp, Artificial Sequence
  Synthetic
tgtcttttctattgacaatagca

SEQ ID NO: 9503 - DNA, 21 bp, Artificial Sequence
  Synthetic
gaggaccattaggaaaaactc

SEQ ID NO: 9504 - DNA, 24 bp, Artificial Sequence
  Synthetic
caaaagaaaaaattcaccttgagc

SEQ ID NO: 9505 - DNA, 24 bp, Artificial Sequence
  Synthetic
caatgtattttcttggagtaaggc

SEQ ID NO: 9506 - DNA, 18 bp, Artificial Sequence
  Synthetic
cgtgttgtgtcccttgtt

SEQ ID NO: 9507 - DNA, 18 bp, Artificial Sequence
  Synthetic
aatgattgggaaggagcc

SEQ ID NO: 9508 - DNA, 21 bp, Artificial Sequence
  Synthetic
cagaggattgtaacacagcta

SEQ ID NO: 9509 - DNA, 23 bp, Artificial Sequence
  Synthetic
atcatttctcattgcattgaaac

SEQ ID NO: 9510 - DNA, 23 bp, Artificial Sequence
  Synthetic
cagttaaacctggtcttagaaga

SEQ ID NO: 9511 - DNA, 19 bp, Artificial Sequence
  Synthetic
actacaagaggcggtcagc

SEQ ID NO: 9512 - DNA, 18 bp, Artificial Sequence
  Synthetic
taaacgtgacactgctga

SEQ ID NO: 9513 - DNA, 23 bp, Artificial Sequence
  Synthetic
aatgaaacagcaatcttagacat

SEQ ID NO: 9514 - DNA, 18 bp, Artificial Sequence
  Synthetic
aaagatttcttgggcggg

SEQ ID NO: 9515 - DNA, 18 bp, Artificial Sequence
  Synthetic
tgggaacaaaaggagcga

SEQ ID NO: 9516 - DNA, 18 bp, Artificial Sequence
  Synthetic
gcaaacgcaaacgcaata

SEQ ID NO: 9517 - DNA, 18 bp, Artificial Sequence
  Synthetic
tcctaaggtgtctgcatg

SEQ ID NO: 9518 - DNA, 18 bp, Artificial Sequence
  Synthetic
cattcctgcagatggtga

SEQ ID NO: 9519 - DNA, 23 bp, Artificial Sequence
  Synthetic
cagacttccttaaaatggacaaa

SEQ ID NO: 9520 - DNA, 23 bp, Artificial Sequence
  Synthetic
gctcacttaaatgttatgaatcc

SEQ ID NO: 9521 - DNA, 20 bp, Artificial Sequence
  Synthetic
actcgaccttataagtgtgg

SEQ ID NO: 9522 - DNA, 20 bp, Artificial Sequence
  Synthetic
gttgctgtacatgttttgct

SEQ ID NO: 9523 - DNA, 18 bp, Artificial Sequence
  Synthetic
tcgcctgatattgaagca

SEQ ID NO: 9524 - DNA, 19 bp, Artificial Sequence
  Synthetic
gaagaagcagactgtgtgg

SEQ ID NO: 9525 - DNA, 24 bp, Artificial Sequence
  Synthetic
gtccaagaaaagattatttgagga

SEQ ID NO: 9526 - DNA, 18 bp, Artificial Sequence
  Synthetic
gagagacccagagccaaa

SEQ ID NO: 9527 - DNA, 25 bp, Artificial Sequence
  Synthetic
acaaatatttgggagtatactgtac

SEQ ID NO: 9528 - DNA, 19 bp, Artificial Sequence
  Synthetic
caggtgatgttgtgggttt

SEQ ID NO: 9529 - DNA, 25 bp, Artificial Sequence
  Synthetic
cagccaactaatatatatttttgcg

SEQ ID NO: 9530 - DNA, 24 bp, Artificial Sequence
  Synthetic
tccattaggaataggtattagtgg

SEQ ID NO: 9531 - DNA, 23 bp, Artificial Sequence
  Synthetic
ggaaaccctaaatctgaaaaagc

SEQ ID NO: 9532 - DNA, 25 bp, Artificial Sequence
  Synthetic
tcttgtacttgaatatcttttaggc

SEQ ID NO: 9533 - DNA, 21 bp, Artificial Sequence
  Synthetic
aggggtacttttccaaaatgt

SEQ ID NO: 9534 - DNA, 18 bp, Artificial Sequence
  Synthetic
ctcctacaatgacgccag

SEQ ID NO: 9535 - DNA, 22 bp, Artificial Sequence
  Synthetic
gcatttgttttgtattgcagaa

SEQ ID NO: 9536 - DNA, 20 bp, Artificial Sequence
  Synthetic
gcgttcgatcaggtggattt

SEQ ID NO: 9537 - DNA, 22 bp, Artificial Sequence
  Synthetic
ctggacaatctttttcaatgga

SEQ ID NO: 9538 - DNA, 25 bp, Artificial Sequence
  Synthetic
ttacacattagatagcaaaacatgg

SEQ ID NO: 9539 - DNA, 25 bp, Artificial Sequence
  Synthetic
gtttcagttaaatacaagtacacac

SEQ ID NO: 9540 - DNA, 21 bp, Artificial Sequence
  Synthetic
tccaatagctccacttaatgc

SEQ ID NO: 9541 - DNA, 24 bp, Artificial Sequence
  Synthetic
aacacaggaacaaatgataatgtc

SEQ ID NO: 9542 - DNA, 19 bp, Artificial Sequence
  Synthetic
tttagcatacactccccct

SEQ ID NO: 9543 - DNA, 22 bp, Artificial Sequence
  Synthetic
gcatttcaatggttcagaaaca

SEQ ID NO: 9544 - DNA, 22 bp, Artificial Sequence
  Synthetic
tattccagcaatctaacagtcc

SEQ ID NO: 9545 - DNA, 22 bp, Artificial Sequence
  Synthetic
cattcagagtggttaatgaaca

SEQ ID NO: 9546 - DNA, 20 bp, Artificial Sequence
  Synthetic
ttagtagccccttacccaaa

SEQ ID NO: 9547 - DNA, 18 bp, Artificial Sequence
  Synthetic
ggagactgtggtgggata

SEQ ID NO: 9548 - DNA, 25 bp, Artificial Sequence
  Synthetic
actcatagaatggatcaaaaacaag

SEQ ID NO: 9549 - DNA, 25 bp, Artificial Sequence
  Synthetic
aattacatgcagtttaagagtaagc

SEQ ID NO: 9550 - DNA, 23 bp, Artificial Sequence
  Synthetic
tggctagtttagacaataaagga

SEQ ID NO: 9551 - DNA, 25 bp, Artificial Sequence
  Synthetic
cttactcaggaaaaatatactcaca

SEQ ID NO: 9552 - DNA, 21 bp, Artificial Sequence
  Synthetic
catatcagaggatttggaagg

SEQ ID NO: 9553 - DNA, 22 bp, Artificial Sequence
  Synthetic
agcaatactttgtggagaaaca

SEQ ID NO: 9554 - DNA, 22 bp, Artificial Sequence
  Synthetic
aggtactgatccaaaatggaag

SEQ ID NO: 9555 - DNA, 21 bp, Artificial Sequence
  Synthetic
aagctgtctcaaatgtccaaa

SEQ ID NO: 9556 - DNA, 18 bp, Artificial Sequence
  Synthetic
gcatgcgaactgacagat

SEQ ID NO: 9557 - DNA, 25 bp, Artificial Sequence
  Synthetic
tgtatggtttcatcataaaaggaag

SEQ ID NO: 9558 - DNA, 19 bp, Artificial Sequence
  Synthetic
aatggggaatggagatgag

SEQ ID NO: 9559 - DNA, 25 bp, Artificial Sequence
  Synthetic
aaagaactaagagatttgatgtcac

SEQ ID NO: 9560 - DNA, 19 bp, Artificial Sequence
  Synthetic
aacagaaatggaccaacga

SEQ ID NO: 9561 - DNA, 18 bp, Artificial Sequence
  Synthetic
acgaagttggagccagaa

SEQ ID NO: 9562 - DNA, 23 bp, Artificial Sequence
  Synthetic
agaaatgatgatgttgatcagag

SEQ ID NO: 9563 - DNA, 20 bp, Artificial Sequence
  Synthetic
aaagggaagaagaagtgctc

SEQ ID NO: 9564 - DNA, 21 bp, Artificial Sequence
  Synthetic
tttgaactttgtcaacagagc

SEQ ID NO: 9565 - DNA, 18 bp, Artificial Sequence
  Synthetic
ttcttgagggtccgagac

SEQ ID NO: 9566 - DNA, 19 bp, Artificial Sequence
  Synthetic
tattccaacagatgcgtga

SEQ ID NO: 9567 - DNA, 20 bp, Artificial Sequence
  Synthetic
ctttgcatgatcttttggga

SEQ ID NO: 9568 - DNA, 24 bp, Artificial Sequence
  Synthetic
catggtttattgtaaatgaagcag

SEQ ID NO: 9569 - DNA, 21 bp, Artificial Sequence
  Synthetic
ggaagctgttaaaatttcacc

SEQ ID NO: 9570 - DNA, 20 bp, Artificial Sequence
  Synthetic
aacaaatctcccttcctgcc

SEQ ID NO: 9571 - DNA, 18 bp, Artificial Sequence
  Synthetic
agacagcggtggaatctc

SEQ ID NO: 9572 - DNA, 25 bp, Artificial Sequence
  Synthetic
ctcttgcagatattttattaaaggc

SEQ ID NO: 9573 - DNA, 21 bp, Artificial Sequence
  Synthetic
tgctgtaatagatgttcctgg

SEQ ID NO: 9574 - DNA, 23 bp, Artificial Sequence
  Synthetic
ctactataatagataacggggct

SEQ ID NO: 9575 - DNA, 24 bp, Artificial Sequence
  Synthetic
tgatgattatattgtaccgacgaa

SEQ ID NO: 9576 - DNA, 20 bp, Artificial Sequence
  Synthetic
tacagattgacagaggtggt

SEQ ID NO: 9577 - DNA, 18 bp, Artificial Sequence
  Synthetic
ggcgacactccaccatga

SEQ ID NO: 9578 - DNA, 20 bp, Artificial Sequence
  Synthetic
tgcaacatgagcacacttcc

SEQ ID NO: 9579 - DNA, 16 bp, Artificial Sequence
  Synthetic
tgtccacgctccagca

SEQ ID NO: 9580 - DNA, 18 bp, Artificial Sequence
  Synthetic
cacagaatggcgtgggac

SEQ ID NO: 9581 - DNA, 20 bp, Artificial Sequence
  Synthetic
caaactgggtttcttagcgc

SEQ ID NO: 9582 - DNA, 20 bp, Artificial Sequence
  Synthetic
acaactggggagaaaacgag

SEQ ID NO: 9583 - DNA, 20 bp, Artificial Sequence
  Synthetic
gaccgttgcgacttgtatga

SEQ ID NO: 9584 - DNA, 19 bp, Artificial Sequence
  Synthetic
tttggttgatgctgctcgt

SEQ ID NO: 9585 - DNA, 19 bp, Artificial Sequence
  Synthetic
cctctcagtgagtgggcga

SEQ ID NO: 9586 - DNA, 18 bp, Artificial Sequence
  Synthetic
gagggggaagtgcaggtt

SEQ ID NO: 9587 - DNA, 18 bp, Artificial Sequence
  Synthetic
ctcttcaggaggccccct

SEQ ID NO: 9588 - DNA, 19 bp, Artificial Sequence
  Synthetic
caggaccatcaccacaggg

SEQ ID NO: 9589 - DNA, 20 bp, Artificial Sequence
  Synthetic
agaaatgcgacgaactgtct

SEQ ID NO: 9590 - DNA, 18 bp, Artificial Sequence
  Synthetic
gtctcgagaagccaacgg

SEQ ID NO: 9591 - DNA, 18 bp, Artificial Sequence
  Synthetic
gtgtgtgccagagccaaa

SEQ ID NO: 9592 - DNA, 20 bp, Artificial Sequence
  Synthetic
ggtcctgtaccagcagtttg

SEQ ID NO: 9593 - DNA, 18 bp, Artificial Sequence
  Synthetic
cctcccagaccctgttgc

SEQ ID NO: 9594 - DNA, 19 bp, Artificial Sequence
  Synthetic
ctctgaaggcgctaaccag

SEQ ID NO: 9595 - DNA, 19 bp, Artificial Sequence
  Synthetic
ataggggagtttgggctgg

SEQ ID NO: 9596 - DNA, 18 bp, Artificial Sequence
  Synthetic
tcactgaggtggatggcg

SEQ ID NO: 9597 - DNA, 19 bp, Artificial Sequence
  Synthetic
caacatcacccgggttgag

SEQ ID NO: 9598 - DNA, 20 bp, Artificial Sequence
  Synthetic
cgagtctgctgtatcgcaag

SEQ ID NO: 9599 - DNA, 20 bp, Artificial Sequence
  Synthetic
atgccaccccaatacctacc

SEQ ID NO: 9600 - DNA, 20 bp, Artificial Sequence
  Synthetic
ttgccaactagaccctaccg

SEQ ID NO: 9601 - DNA, 18 bp, Artificial Sequence
  Synthetic
ccacagcccacatacgac

SEQ ID NO: 9602 - DNA, 19 bp, Artificial Sequence
  Synthetic
cactccactcgatctccct

SEQ ID NO: 9603 - DNA, 23 bp, Artificial Sequence
  Synthetic
tgattttcaaaaatgtctgacag

SEQ ID NO: 9604 - DNA, 19 bp, Artificial Sequence
  Synthetic
ggacagcaacttcaatgca

SEQ ID NO: 9605 - DNA, 18 bp, Artificial Sequence
  Synthetic
gcagcaagaagaaacggt

SEQ ID NO: 9606 - DNA, 22 bp, Artificial Sequence
  Synthetic
ttaagagcactagcaagaagag

SEQ ID NO: 9607 - DNA, 20 bp, Artificial Sequence
  Synthetic
caatagaggacaaggctcaa

SEQ ID NO: 9608 - DNA, 21 bp, Artificial Sequence
  Synthetic
aataaatttcaggtctggagc

SEQ ID NO: 9609 - DNA, 21 bp, Artificial Sequence
  Synthetic
atggatcctcagtttcctact

SEQ ID NO: 9610 - DNA, 25 bp, Artificial Sequence
  Synthetic
tgagtaatgaggaatcattagaaga

SEQ ID NO: 9611 - DNA, 18 bp, Artificial Sequence
  Synthetic
tgttgccgctttaagtcc

SEQ ID NO: 9612 - DNA, 25 bp, Artificial Sequence
  Synthetic
aatgtatgattatatctgaacctcc

SEQ ID NO: 9613 - DNA, 18 bp, Artificial Sequence
  Synthetic
gagagcagctctagatgg

SEQ ID NO: 9614 - DNA, 24 bp, Artificial Sequence
  Synthetic
gggaaactattagaaaagaaagtg

SEQ ID NO: 9615 - DNA, 21 bp, Artificial Sequence
  Synthetic
aagtggactataatgggctct

SEQ ID NO: 9616 - DNA, 22 bp, Artificial Sequence
  Synthetic
ccaaagacatagatcagttgaa

SEQ ID NO: 9617 - DNA, 18 bp, Artificial Sequence
  Synthetic
tgggtattggaaccggaa

SEQ ID NO: 9618 - DNA, 24 bp, Artificial Sequence
  Synthetic
tataggttcttttgaagagatacc

SEQ ID NO: 9619 - DNA, 21 bp, Artificial Sequence
  Synthetic
attaatgccacttggacagac

SEQ ID NO: 9620 - DNA, 25 bp, Artificial Sequence
  Synthetic
gagtttacaatacggatgaatatgt

SEQ ID NO: 9621 - DNA, 20 bp, Artificial Sequence
  Synthetic
gtgcaccactggatatcaat

SEQ ID NO: 9622 - DNA, 25 bp, Artificial Sequence
  Synthetic
accaggattataagtataaagctac

SEQ ID NO: 9623 - DNA, 21 bp, Artificial Sequence
  Synthetic
tggaacatagtactgtgaaca

SEQ ID NO: 9624 - DNA, 19 bp, Artificial Sequence
  Synthetic
gacgctttgtccaaaatgc

SEQ ID NO: 9625 - DNA, 19 bp, Artificial Sequence
  Synthetic
gcagatgcaacgattcaag

SEQ ID NO: 9626 - DNA, 19 bp, Artificial Sequence
  Synthetic
aggtaccaatggggaagag

SEQ ID NO: 9627 - DNA, 22 bp, Artificial Sequence
  Synthetic
tagaaaaacaaagtagagctgc

SEQ ID NO: 9628 - DNA, 20 bp, Artificial Sequence
  Synthetic
cgtggtccagattaagtttg

SEQ ID NO: 9629 - DNA, 25 bp, Artificial Sequence
  Synthetic
ctcacaatatagtaatgaaaagtgg

SEQ ID NO: 9630 - DNA, 25 bp, Artificial Sequence
  Synthetic
gtggaagaaactagttttattgatg

SEQ ID NO: 9631 - DNA, 19 bp, Artificial Sequence
  Synthetic
tacgaaaacgacgtaaacg

SEQ ID NO: 9632 - DNA, 20 bp, Artificial Sequence
  Synthetic
tacatttacctgaccccaat

SEQ ID NO: 9633 - DNA, 19 bp, Artificial Sequence
  Synthetic
ccacctataggggaacact

SEQ ID NO: 9634 - DNA, 20 bp, Artificial Sequence
  Synthetic
acgaagggaacaaatgtttg

SEQ ID NO: 9635 - DNA, 19 bp, Artificial Sequence
  Synthetic
ctccagcacctaaagaaga

SEQ ID NO: 9636 - DNA, 21 bp, Artificial Sequence
  Synthetic
ttttgtagcttcaaccgaatt

SEQ ID NO: 9637 - DNA, 23 bp, Artificial Sequence
  Synthetic
ataaaagcagacattttatgcac

SEQ ID NO: 9638 - DNA, 24 bp, Artificial Sequence
  Synthetic
accgttgtgtgatttgttaattag

SEQ ID NO: 9639 - DNA, 21 bp, Artificial Sequence
  Synthetic
caaccagagacaactgatctc

SEQ ID NO: 9640 - DNA, 19 bp, Artificial Sequence
  Synthetic
gaagactttgtgcgacagt

SEQ ID NO: 9641 - DNA, 18 bp, Artificial Sequence
  Synthetic
aacaatggcctggacagt

SEQ ID NO: 9642 - DNA, 19 bp, Artificial Sequence
  Synthetic
atctcctgacttggaagca

SEQ ID NO: 9643 - DNA, 18 bp, Artificial Sequence
  Synthetic
gactgactcaagctgggt

SEQ ID NO: 9644 - DNA, 25 bp, Artificial Sequence
  Synthetic
ggattcattataaaaggaagatctc

SEQ ID NO: 9645 - DNA, 19 bp, Artificial Sequence
  Synthetic
gccttcttcaatctctcca

SEQ ID NO: 9646 - DNA, 25 bp, Artificial Sequence
  Synthetic
gattcaatggataaggaagaaatgg

SEQ ID NO: 9647 - DNA, 21 bp, Artificial Sequence
  Synthetic
ttcgtgtattttgtagaagca

SEQ ID NO: 9648 - DNA, 21 bp, Artificial Sequence
  Synthetic
gaaatgtcttaagcattgctc

SEQ ID NO: 9649 - DNA, 23 bp, Artificial Sequence
  Synthetic
agtcttaggagtttcaattctga

SEQ ID NO: 9650 - DNA, 22 bp, Artificial Sequence
  Synthetic
ttcgtagctaacttcagtatgg

SEQ ID NO: 9651 - DNA, 19 bp, Artificial Sequence
  Synthetic
caggactgttggtttcaga

SEQ ID NO: 9652 - DNA, 21 bp, Artificial Sequence
  Synthetic
gttaacaactatcaggcgatt

SEQ ID NO: 9653 - DNA, 19 bp, Artificial Sequence
  Synthetic
ctggcgagataatttcgtg

SEQ ID NO: 9654 - DNA, 25 bp, Artificial Sequence
  Synthetic
gcagactctatataattaacaatgg

SEQ ID NO: 9655 - DNA, 18 bp, Artificial Sequence
  Synthetic
ctgctgttaggctcactg

SEQ ID NO: 9656 - DNA, 19 bp, Artificial Sequence
  Synthetic
ctgttccacttacaggagc

SEQ ID NO: 9657 - DNA, 18 bp, Artificial Sequence
  Synthetic
caggagcaggtagacatc

SEQ ID NO: 9658 - DNA, 22 bp, Artificial Sequence
  Synthetic
atttgatgaaaatggtcaaccg

SEQ ID NO: 9659 - DNA, 21 bp, Artificial Sequence
  Synthetic
ccgaaaaaagggaataatgcg

SEQ ID NO: 9660 - DNA, 16 bp, Artificial Sequence
  Synthetic
ccaacccagccaccca

SEQ ID NO: 9661 - DNA, 20 bp, Artificial Sequence
  Synthetic
tttagataaggtggtggtgc

SEQ ID NO: 9662 - DNA, 18 bp, Artificial Sequence
  Synthetic
cggcacctactactgatg

SEQ ID NO: 9663 - DNA, 19 bp, Artificial Sequence
  Synthetic
ctactgaaggtgagcttga

SEQ ID NO: 9664 - DNA, 20 bp, Artificial Sequence
  Synthetic
cagagccactataagtacca

SEQ ID NO: 9665 - DNA, 22 bp, Artificial Sequence
  Synthetic
atcctactgatcttgacattcc

SEQ ID NO: 9666 - DNA, 18 bp, Artificial Sequence
  Synthetic
cacccgctctatgaggtt

SEQ ID NO: 9667 - DNA, 22 bp, Artificial Sequence
  Synthetic
taataatacacatgcaactggt

SEQ ID NO: 9668 - DNA, 18 bp, Artificial Sequence
  Synthetic
cggagcagcttgatcaat

SEQ ID NO: 9669 - DNA, 19 bp, Artificial Sequence
  Synthetic
ggttacacacctgtacagt

SEQ ID NO: 9670 - DNA, 18 bp, Artificial Sequence
  Synthetic
cgtctcaaggcaccaaac

SEQ ID NO: 9671 - DNA, 18 bp, Artificial Sequence
  Synthetic
ctgcggtgaaaggagttg

SEQ ID NO: 9672 - DNA, 19 bp, Artificial Sequence
  Synthetic
cattttcctggcacggtca

SEQ ID NO: 9673 - DNA, 23 bp, Artificial Sequence
  Synthetic
gctgcatttgaagatttaagagt

SEQ ID NO: 9674 - DNA, 19 bp, Artificial Sequence
  Synthetic
tgggtgggctatatacagc

SEQ ID NO: 9675 - DNA, 18 bp, Artificial Sequence
  Synthetic
cttggtcagcaagtgcat

SEQ ID NO: 9676 - DNA, 21 bp, Artificial Sequence
  Synthetic
tcaatagagttgaatgcacct

SEQ ID NO: 9677 - DNA, 25 bp, Artificial Sequence
  Synthetic
agggattttcatataggtatggtaa

SEQ ID NO: 9678 - DNA, 18 bp, Artificial Sequence
  Synthetic
cgagtgggtatgcacaaa

SEQ ID NO: 9679 - DNA, 20 bp, Artificial Sequence
  Synthetic
tgcaaatcagaggattcgtg

SEQ ID NO: 9680 - DNA, 19 bp, Artificial Sequence
  Synthetic
caaggaaccaacctgaatg

SEQ ID NO: 9681 - DNA, 22 bp, Artificial Sequence
  Synthetic
gcatgttcaatatgctgagtac

SEQ ID NO: 9682 - DNA, 20 bp, Artificial Sequence
  Synthetic
gcttcttctaccgctatggg

SEQ ID NO: 9683 - DNA, 25 bp, Artificial Sequence
  Synthetic
tagtatataaaaaagggagtaaccg

SEQ ID NO: 9684 - DNA, 22 bp, Artificial Sequence
  Synthetic
ggtgtatagagacagtataccc

SEQ ID NO: 9685 - DNA, 18 bp, Artificial Sequence
  Synthetic
caacgacgcagagaaaca

SEQ ID NO: 9686 - DNA, 25 bp, Artificial Sequence
  Synthetic
tggtagattttattgatacacaagg

SEQ ID NO: 9687 - DNA, 21 bp, Artificial Sequence
  Synthetic
atatcagatagtggctatggc

SEQ ID NO: 9688 - DNA, 23 bp, Artificial Sequence
  Synthetic
cctttttaaaaagcaattgccaa

SEQ ID NO: 9689 - DNA, 23 bp, Artificial Sequence
  Synthetic
atagaccactatgaaaatgacag

SEQ ID NO: 9690 - DNA, 21 bp, Artificial Sequence
  Synthetic
ttaaaaaaggtggccaaacag

SEQ ID NO: 9691 - DNA, 19 bp, Artificial Sequence
  Synthetic
atgtgcagtaccagtgacg

SEQ ID NO: 9692 - DNA, 25 bp, Artificial Sequence
  Synthetic
ctacgcctataatacatttaaaagg

SEQ ID NO: 9693 - DNA, 23 bp, Artificial Sequence
  Synthetic
tattttgcttttgtgtatgcatg

SEQ ID NO: 9694 - DNA, 19 bp, Artificial Sequence
  Synthetic
tgagtttcttacacgtcca

SEQ ID NO: 9695 - DNA, 23 bp, Artificial Sequence
  Synthetic
accttccccagaatatattgaac

SEQ ID NO: 9696 - DNA, 18 bp, Artificial Sequence
  Synthetic
cgccacgtctaatgtttc

SEQ ID NO: 9697 - DNA, 25 bp, Artificial Sequence
  Synthetic
atcctgattatttacaaatgtctgc

SEQ ID NO: 9698 - DNA, 22 bp, Artificial Sequence
  Synthetic
tattggttacataaggcacagg

SEQ ID NO: 9699 - DNA, 19 bp, Artificial Sequence
  Synthetic
cgccctagtgagtaacaac

SEQ ID NO: 9700 - DNA, 18 bp, Artificial Sequence
  Synthetic
cgaaagcaggcaaaccat

SEQ ID NO: 9701 - DNA, 18 bp, Artificial Sequence
  Synthetic
ccaagtggttatgcccaa

SEQ ID NO: 9702 - DNA, 24 bp, Artificial Sequence
  Synthetic
aaataagggggtttgtatactttg

SEQ ID NO: 9703 - DNA, 25 bp, Artificial Sequence
  Synthetic
catgttcaatatgttaagcactgta

SEQ ID NO: 9704 - DNA, 24 bp, Artificial Sequence
  Synthetic
acaagttttttctatcgttatggg

SEQ ID NO: 9705 - DNA, 18 bp, Artificial Sequence
  Synthetic
cactcctggatccccaaa

SEQ ID NO: 9706 - DNA, 16 bp, Artificial Sequence
  Synthetic
ggtggaaggcccggaa

SEQ ID NO: 9707 - DNA, 19 bp, Artificial Sequence
  Synthetic
caacgccgcttaaaaccct

SEQ ID NO: 9708 - DNA, 20 bp, Artificial Sequence
  Synthetic
tgctggactctctacagacc

SEQ ID NO: 9709 - DNA, 19 bp, Artificial Sequence
  Synthetic
caacgcctcaatgttggct

SEQ ID NO: 9710 - DNA, 16 bp, Artificial Sequence
  Synthetic
ctgtggcgtgacggtg

SEQ ID NO: 9711 - DNA, 18 bp, Artificial Sequence
  Synthetic
ggggtggaaagcaaggtg

SEQ ID NO: 9712 - DNA, 20 bp, Artificial Sequence
  Synthetic
gtgtaattggccaacagtgc

SEQ ID NO: 9713 - DNA, 18 bp, Artificial Sequence
  Synthetic
atcatggggttggaccgt

SEQ ID NO: 9714 - DNA, 19 bp, Artificial Sequence
  Synthetic
gcacaggagtcttggttcg

SEQ ID NO: 9715 - DNA, 20 bp, Artificial Sequence
  Synthetic
aagcttaggtggtatcgcac

SEQ ID NO: 9716 - DNA, 19 bp, Artificial Sequence
  Synthetic
tttgagcacgctggacatg

SEQ ID NO: 9717 - DNA, 20 bp, Artificial Sequence
  Synthetic
ccatgggcacttgtgtgaat

SEQ ID NO: 9718 - DNA, 18 bp, Artificial Sequence
  Synthetic
ggtcgtctggctctccga

SEQ ID NO: 9719 - DNA, 20 bp, Artificial Sequence
  Synthetic
atcccagaaagtacctccgc

SEQ ID NO: 9720 - DNA, 20 bp, Artificial Sequence
  Synthetic
ttatggacacaggttgccag

SEQ ID NO: 9721 - DNA, 17 bp, Artificial Sequence
  Synthetic
gccagcaccagcagagt

SEQ ID NO: 9722 - DNA, 16 bp, Artificial Sequence
  Synthetic
ggtgtccagcggcaga

SEQ ID NO: 9723 - DNA, 19 bp, Artificial Sequence
  Synthetic
caaccccctgttgtaccag

SEQ ID NO: 9724 - DNA, 18 bp, Artificial Sequence
  Synthetic
ccagacgtgggaggccat

SEQ ID NO: 9725 - DNA, 18 bp, Artificial Sequence
  Synthetic
taacgcggcctctctcac

SEQ ID NO: 9726 - DNA, 20 bp, Artificial Sequence
  Synthetic
gtactgtgggacctccttga

SEQ ID NO: 9727 - DNA, 18 bp, Artificial Sequence
  Synthetic
ctcctcggggtcccaaga

SEQ ID NO: 9728 - DNA, 18 bp, Artificial Sequence
  Synthetic
gctgagcttcagtgtgcg

SEQ ID NO: 9729 - DNA, 20 bp, Artificial Sequence
  Synthetic
tatgacccagaagaccacct

SEQ ID NO: 9730 - DNA, 18 bp, Artificial Sequence
  Synthetic
tgggcagcgcttatctgt

SEQ ID NO: 9731 - DNA, 20 bp, Artificial Sequence
  Synthetic
catctatgagaacgacggca

SEQ ID NO: 9732 - DNA, 19 bp, Artificial Sequence
  Synthetic
gctctcgggaccatcttga

SEQ ID NO: 9733 - DNA, 20 bp, Artificial Sequence
  Synthetic
caccaacagaaactgacaga

SEQ ID NO: 9734 - DNA, 24 bp, Artificial Sequence
  Synthetic
tattgatatcaggtgtcaaacttg

SEQ ID NO: 9735 - DNA, 25 bp, Artificial Sequence
  Synthetic
tgtagtgatgtagaaaatgatttgg

SEQ ID NO: 9736 - DNA, 21 bp, Artificial Sequence
  Synthetic
gctgaagatgttactcctgag

SEQ ID NO: 9737 - DNA, 21 bp, Artificial Sequence
  Synthetic
gttgtctctgtatatgcagtg

SEQ ID NO: 9738 - DNA, 22 bp, Artificial Sequence
  Synthetic
gcccaacaaactatattaggtc

SEQ ID NO: 9739 - DNA, 24 bp, Artificial Sequence
  Synthetic
gcattaaaagaattcctacactca

SEQ ID NO: 9740 - DNA, 23 bp, Artificial Sequence
  Synthetic
tttgaatttccaaatccttttcc

SEQ ID NO: 9741 - DNA, 20 bp, Artificial Sequence
  Synthetic
actgtgtttgctcctgtcac

SEQ ID NO: 9742 - DNA, 18 bp, Artificial Sequence
  Synthetic
cacgtcgctcaccaagac

SEQ ID NO: 9743 - DNA, 18 bp, Artificial Sequence
  Synthetic
tctctcctggtgaagtgg

SEQ ID NO: 9744 - DNA, 25 bp, Artificial Sequence
  Synthetic
cattagcttttcttcctatactcaa

SEQ ID NO: 9745 - DNA, 19 bp, Artificial Sequence
  Synthetic
agttaaccccgtggaacct

SEQ ID NO: 9746 - DNA, 23 bp, Artificial Sequence
  Synthetic
caatccattgtttctaactcaac

SEQ ID NO: 9747 - DNA, 24 bp, Artificial Sequence
  Synthetic
ggtttgaaactacaagaaatggtt

SEQ ID NO: 9748 - DNA, 18 bp, Artificial Sequence
  Synthetic
tacggagtactggtcacc

SEQ ID NO: 9749 - DNA, 18 bp, Artificial Sequence
  Synthetic
gatgacattccacgtgca

SEQ ID NO: 9750 - DNA, 25 bp, Artificial Sequence
  Synthetic
tttagatcaatattccttaggcaga

SEQ ID NO: 9751 - DNA, 23 bp, Artificial Sequence
  Synthetic
ggctctgtttctataactattgc

SEQ ID NO: 9752 - DNA, 18 bp, Artificial Sequence
  Synthetic
ggtcaaaaccgcaatgtc

SEQ ID NO: 9753 - DNA, 18 bp, Artificial Sequence
  Synthetic
ggaaccaaacaagtgtgc

SEQ ID NO: 9754 - DNA, 25 bp, Artificial Sequence
  Synthetic
attcattagagaagggaaaattgtc

SEQ ID NO: 9755 - DNA, 19 bp, Artificial Sequence
  Synthetic
taataacgagagagggggc

SEQ ID NO: 9756 - DNA, 18 bp, Artificial Sequence
  Synthetic
ggcagaagcacagcattt

SEQ ID NO: 9757 - DNA, 21 bp, Artificial Sequence
  Synthetic
ccaaaagaaacaaaccccaac

SEQ ID NO: 9758 - DNA, 20 bp, Artificial Sequence
  Synthetic
gtgatgcagatgtcaaagga

SEQ ID NO: 9759 - DNA, 21 bp, Artificial Sequence
  Synthetic
caggtgagtacaagttcaaac

SEQ ID NO: 9760 - DNA, 23 bp, Artificial Sequence
  Synthetic
aaacgtttggactttatagagaa

SEQ ID NO: 9761 - DNA, 23 bp, Artificial Sequence
  Synthetic
ggagcaagtaccttataaagttg

SEQ ID NO: 9762 - DNA, 23 bp, Artificial Sequence
  Synthetic
tagatgaactatttgaaggcagt

SEQ ID NO: 9763 - DNA, 25 bp, Artificial Sequence
  Synthetic
ttaccagattggataaaaagacaga

SEQ ID NO: 9764 - DNA, 25 bp, Artificial Sequence
  Synthetic
catggcaaagttatttctatgatga

SEQ ID NO: 9765 - DNA, 18 bp, Artificial Sequence
  Synthetic
ctctaaaggaggacggct

SEQ ID NO: 9766 - DNA, 20 bp, Artificial Sequence
  Synthetic
agcacctcacaagacacctt

SEQ ID NO: 9767 - DNA, 22 bp, Artificial Sequence
  Synthetic
attgtaacactcactgaaacag

SEQ ID NO: 9768 - DNA, 20 bp, Artificial Sequence
  Synthetic
tccttttgcaacagtggaaa

SEQ ID NO: 9769 - DNA, 25 bp, Artificial Sequence
  Synthetic
tctagtaattctgatattccttcag

SEQ ID NO: 9770 - DNA, 25 bp, Artificial Sequence
  Synthetic
catccttattttgatgttatggatg

SEQ ID NO: 9771 - DNA, 18 bp, Artificial Sequence
  Synthetic
taggagcaacaggccatc

SEQ ID NO: 9772 - DNA, 24 bp, Artificial Sequence
  Synthetic
tggtgatatgtgtgaaataggatt

SEQ ID NO: 9773 - DNA, 24 bp, Artificial Sequence
  Synthetic
tattggaccgtattgttactacac

SEQ ID NO: 9774 - DNA, 24 bp, Artificial Sequence
  Synthetic
ccatacgaacagtatacattttgg

SEQ ID NO: 9775 - DNA, 18 bp, Artificial Sequence
  Synthetic
caaaagcaggcaaaccat

SEQ ID NO: 9776 - DNA, 21 bp, Artificial Sequence
  Synthetic
taatgagccaagtggatatgc

SEQ ID NO: 9777 - DNA, 23 bp, Artificial Sequence
  Synthetic
atcaggaaggctaatagatttcc

SEQ ID NO: 9778 - DNA, 21 bp, Artificial Sequence
  Synthetic
caaattagagggttcgtgtac

SEQ ID NO: 9779 - DNA, 20 bp, Artificial Sequence
  Synthetic
tggttcagaaacatcctgag

SEQ ID NO: 9780 - DNA, 22 bp, Artificial Sequence
  Synthetic
acatgctaagtacggttttagg

SEQ ID NO: 9781 - DNA, 18 bp, Artificial Sequence
  Synthetic
catggagcttcccagttt

SEQ ID NO: 9782 - DNA, 20 bp, Artificial Sequence
  Synthetic
aagaagctgtgggatcaaac

SEQ ID NO: 9783 - DNA, 21 bp, Artificial Sequence
  Synthetic
gaaccgctctattctaaacac

SEQ ID NO: 9784 - DNA, 23 bp, Artificial Sequence
  Synthetic
agttgccaacaattattagacat

SEQ ID NO: 9785 - DNA, 18 bp, Artificial Sequence
  Synthetic
gttacgaacatgaggggt

SEQ ID NO: 9786 - DNA, 21 bp, Artificial Sequence
  Synthetic
gacctggttacagtaaaacga

SEQ ID NO: 9787 - DNA, 25 bp, Artificial Sequence
  Synthetic
actggtgattcagtatactttaaac

SEQ ID NO: 9788 - DNA, 25 bp, Artificial Sequence
  Synthetic
caaaaatatgcagatctctatgagt

SEQ ID NO: 9789 - DNA, 18 bp, Artificial Sequence
  Synthetic
caagggggggattgcata

SEQ ID NO: 9790 - DNA, 18 bp, Artificial Sequence
  Synthetic
gtagatccctctgcagct

SEQ ID NO: 9791 - DNA, 24 bp, Artificial Sequence
  Synthetic
tttgaaacacagattaatcccttc

SEQ ID NO: 9792 - DNA, 22 bp, Artificial Sequence
  Synthetic
agattttttgagtcaaccttcc

SEQ ID NO: 9793 - DNA, 22 bp, Artificial Sequence
  Synthetic
ctggaaagttataccttccacc

SEQ ID NO: 9794 - DNA, 21 bp, Artificial Sequence
  Synthetic
ctcagatacagaacgtttggt

SEQ ID NO: 9795 - DNA, 24 bp, Artificial Sequence
  Synthetic
gacaaaaacagcttaaataatggc

SEQ ID NO: 9796 - DNA, 20 bp, Artificial Sequence
  Synthetic
actcaggatgcatggtaatc

SEQ ID NO: 9797 - DNA, 19 bp, Artificial Sequence
  Synthetic
tattttagccctgcgaagg

SEQ ID NO: 9798 - DNA, 18 bp, Artificial Sequence
  Synthetic
aaccgaaatcgcaccaca

SEQ ID NO: 9799 - DNA, 19 bp, Artificial Sequence
  Synthetic
tctctcaagacttggacga

SEQ ID NO: 9800 - DNA, 19 bp, Artificial Sequence
  Synthetic
tacaggttatcggcctttg

SEQ ID NO: 9801 - DNA, 24 bp, Artificial Sequence
  Synthetic
attatagatgtaactggtcctaga

SEQ ID NO: 9802 - DNA, 20 bp, Artificial Sequence
  Synthetic
ggacacttttaatgagccag

SEQ ID NO: 9803 - DNA, 23 bp, Artificial Sequence
  Synthetic
cagaaagtacatttgtagatgca

SEQ ID NO: 9804 - DNA, 25 bp, Artificial Sequence
  Synthetic
gtaggaccaagtattttaatcaatg

SEQ ID NO: 9805 - DNA, 25 bp, Artificial Sequence
  Synthetic
tgatttaactcaaacatctttaggc

SEQ ID NO: 9806 - DNA, 25 bp, Artificial Sequence
  Synthetic
aataaaggtctgatgaatacttgtg

SEQ ID NO: 9807 - DNA, 19 bp, Artificial Sequence
  Synthetic
atggacttgcagcaatcac

SEQ ID NO: 9808 - DNA, 19 bp, Artificial Sequence
  Synthetic
tcatgcctgctgatctact

SEQ ID NO: 9809 - DNA, 18 bp, Artificial Sequence
  Synthetic
tatgccactccaagtcca

SEQ ID NO: 9810 - DNA, 23 bp, Artificial Sequence
  Synthetic
tgttcaatactaactgtcaatga

SEQ ID NO: 9811 - DNA, 23 bp, Artificial Sequence
  Synthetic
aatactggaaaatcctactttgt

SEQ ID NO: 9812 - DNA, 18 bp, Artificial Sequence
  Synthetic
tgccaggcagttagaact

SEQ ID NO: 9813 - DNA, 25 bp, Artificial Sequence
  Synthetic
tgtattatatagatgactatgggga

SEQ ID NO: 9814 - DNA, 21 bp, Artificial Sequence
  Synthetic
atttgaacaggcatctacagt

SEQ ID NO: 9815 - DNA, 20 bp, Artificial Sequence
  Synthetic
tggtacgacctacaatacca

SEQ ID NO: 9816 - DNA, 23 bp, Artificial Sequence
  Synthetic
ctctgctcctaaacatagtactc

SEQ ID NO: 9817 - DNA, 22 bp, Artificial Sequence
  Synthetic
ttaacatctaatacacgcactc

SEQ ID NO: 9818 - DNA, 23 bp, Artificial Sequence
  Synthetic
ctgttggtcatccatatttcaat

SEQ ID NO: 9819 - DNA, 23 bp, Artificial Sequence
  Synthetic
taattttaaaaagttccagcagg

SEQ ID NO: 9820 - DNA, 22 bp, Artificial Sequence
  Synthetic
tggaagaaatagagtttgagct

SEQ ID NO: 9821 - DNA, 23 bp, Artificial Sequence
  Synthetic
tacctcagtgttacatgtttcag

SEQ ID NO: 9822 - DNA, 22 bp, Artificial Sequence
  Synthetic
aagtacagacaaactttgactc

SEQ ID NO: 9823 - DNA, 16 bp, Artificial Sequence
  Synthetic
ctcacgcgctacctgc

SEQ ID NO: 9824 - DNA, 16 bp, Artificial Sequence
  Synthetic
ccccggcctggtgttt

SEQ ID NO: 9825 - DNA, 19 bp, Artificial Sequence
  Synthetic
gcttgcgattctagcctcg

SEQ ID NO: 9826 - DNA, 16 bp, Artificial Sequence
  Synthetic
gaggtggtgcgggaca

SEQ ID NO: 9827 - DNA, 19 bp, Artificial Sequence
  Synthetic
gactcgacaaactcgctga

SEQ ID NO: 9828 - DNA, 19 bp, Artificial Sequence
  Synthetic
gtaagtgacgtcgttgcgg

SEQ ID NO: 9829 - DNA, 19 bp, Artificial Sequence
  Synthetic
aactccttgaccgacacga

SEQ ID NO: 9830 - DNA, 17 bp, Artificial Sequence
  Synthetic
cgtgagcacgttctcgc

SEQ ID NO: 9831 - DNA, 16 bp, Artificial Sequence
  Synthetic
cgttctgctgcaccgg

SEQ ID NO: 9832 - DNA, 19 bp, Artificial Sequence
  Synthetic
gttcgctgccttttcctcc

SEQ ID NO: 9833 - DNA, 16 bp, Artificial Sequence
  Synthetic
ccgggaaacgtctgcg

SEQ ID NO: 9834 - DNA, 19 bp, Artificial Sequence
  Synthetic
tacgttacagtggcccagt

SEQ ID NO: 9835 - DNA, 18 bp, Artificial Sequence
  Synthetic
aaccacgcggtattggcc

SEQ ID NO: 9836 - DNA, 18 bp, Artificial Sequence
  Synthetic
cgacaggagacgacgagc

SEQ ID NO: 9837 - DNA, 18 bp, Artificial Sequence
  Synthetic
cgtctgctcttggttgct

SEQ ID NO: 9838 - DNA, 18 bp, Artificial Sequence
  Synthetic
cgtcgtcggtgatgagga

SEQ ID NO: 9839 - DNA, 18 bp, Artificial Sequence
  Synthetic
ttcgggagaatggacgcc

SEQ ID NO: 9840 - DNA, 18 bp, Artificial Sequence
  Synthetic
tgaggcgtcagaaagtgc

SEQ ID NO: 9841 - DNA, 16 bp, Artificial Sequence
  Synthetic
gcgcacgggttggtgt

SEQ ID NO: 9842 - DNA, 20 bp, Artificial Sequence
  Synthetic
gttggacgtcaccgtatccc

SEQ ID NO: 9843 - DNA, 18 bp, Artificial Sequence
  Synthetic
cccacagagaagcgttgg

SEQ ID NO: 9844 - DNA, 20 bp, Artificial Sequence
  Synthetic
tgtcgcatcatctctaagcg

SEQ ID NO: 9845 - DNA, 17 bp, Artificial Sequence
  Synthetic
gctgttcggtggttggg

SEQ ID NO: 9846 - DNA, 15 bp, Artificial Sequence
  Synthetic
caaccgcagcgcctt

SEQ ID NO: 9847 - DNA, 18 bp, Artificial Sequence
  Synthetic
gaaccaaagacgagggcc

SEQ ID NO: 9848 - DNA, 19 bp, Artificial Sequence
  Synthetic
ggaccgccgatttgtttct

SEQ ID NO: 9849 - DNA, 20 bp, Artificial Sequence
  Synthetic
ataacctcaccgaaaccgtc

SEQ ID NO: 9850 - DNA, 16 bp, Artificial Sequence
  Synthetic
gagccagggccaaggt

SEQ ID NO: 9851 - DNA, 16 bp, Artificial Sequence
  Synthetic
aggtctggcagccctc

SEQ ID NO: 9852 - DNA, 16 bp, Artificial Sequence
  Synthetic
ccggggggcgcttaaa

SEQ ID NO: 9853 - DNA, 15 bp, Artificial Sequence
  Synthetic
tttcgtgccgggcca

SEQ ID NO: 9854 - DNA, 20 bp, Artificial Sequence
  Synthetic
gtcacgacgtacgagaccag

SEQ ID NO: 9855 - DNA, 16 bp, Artificial Sequence
  Synthetic
aggcggccgttgtcca

SEQ ID NO: 9856 - DNA, 19 bp, Artificial Sequence
  Synthetic
cccctcgttcatgtaggcc

SEQ ID NO: 9857 - DNA, 16 bp, Artificial Sequence
  Synthetic
cgtgtgcgcaggggat

SEQ ID NO: 9858 - DNA, 17 bp, Artificial Sequence
  Synthetic
tgtcggtgttcccccat

SEQ ID NO: 9859 - DNA, 16 bp, Artificial Sequence
  Synthetic
cgaaggcgcggatcag

SEQ ID NO: 9860 - DNA, 18 bp, Artificial Sequence
  Synthetic
aaagcctagcaggtcgga

SEQ ID NO: 9861 - DNA, 19 bp, Artificial Sequence
  Synthetic
gcaagcagcccataaacgc

SEQ ID NO: 9862 - DNA, 18 bp, Artificial Sequence
  Synthetic
cgtgttgatggcaggggt

SEQ ID NO: 9863 - DNA, 17 bp, Artificial Sequence
  Synthetic
taagaggatcgcggcgc

SEQ ID NO: 9864 - DNA, 18 bp, Artificial Sequence
  Synthetic
tgcccatttgacgctctg

SEQ ID NO: 9865 - DNA, 18 bp, Artificial Sequence
  Synthetic
cgcactatccaggaccgc

SEQ ID NO: 9866 - DNA, 20 bp, Artificial Sequence
  Synthetic
cttcttggccttgtgttccg

SEQ ID NO: 9867 - DNA, 19 bp, Artificial Sequence
  Synthetic
gtgtacacctccaggggga

SEQ ID NO: 9868 - DNA, 18 bp, Artificial Sequence
  Synthetic
cacgtggagacggccatc

SEQ ID NO: 9869 - DNA, 19 bp, Artificial Sequence
  Synthetic
ctgagaaggggctggtacg

SEQ ID NO: 9870 - DNA, 18 bp, Artificial Sequence
  Synthetic
ggttggtggtgaaggtgg

SEQ ID NO: 9871 - DNA, 17 bp, Artificial Sequence
  Synthetic
gctggttgcgttggagg

SEQ ID NO: 9872 - DNA, 18 bp, Artificial Sequence
  Synthetic
cgaccgtcagcgttttgg

SEQ ID NO: 9873 - DNA, 19 bp, Artificial Sequence
  Synthetic
gttcaccaccgtatgcagg

SEQ ID NO: 9874 - DNA, 20 bp, Artificial Sequence
  Synthetic
gacacggctaaaatccggca

SEQ ID NO: 9875 - DNA, 17 bp, Artificial Sequence
  Synthetic
gccagaagctcgatgcc

SEQ ID NO: 9876 - DNA, 16 bp, Artificial Sequence
  Synthetic
gcatctccgcggacca

SEQ ID NO: 9877 - DNA, 17 bp, Artificial Sequence
  Synthetic
caaggctcacgtgcgag

SEQ ID NO: 9878 - DNA, 18 bp, Artificial Sequence
  Synthetic
tcatctacggggacacgg

SEQ ID NO: 9879 - DNA, 19 bp, Artificial Sequence
  Synthetic
agcatccggtctatgagcc

SEQ ID NO: 9880 - DNA, 16 bp, Artificial Sequence
  Synthetic
acgtcctcgtcgagcg

SEQ ID NO: 9881 - DNA, 16 bp, Artificial Sequence
  Synthetic
gagacgacggggctgt

SEQ ID NO: 9882 - DNA, 16 bp, Artificial Sequence
  Synthetic
cgcgcctgttggtcgt

SEQ ID NO: 9883 - DNA, 17 bp, Artificial Sequence
  Synthetic
gtccctgaacagcccca

SEQ ID NO: 9884 - DNA, 19 bp, Artificial Sequence
  Synthetic
agaaaggacagcgacgagc

SEQ ID NO: 9885 - DNA, 16 bp, Artificial Sequence
  Synthetic
tggccctcaaccgtgg

SEQ ID NO: 9886 - DNA, 16 bp, Artificial Sequence
  Synthetic
agtgagggtcgcgtcg

SEQ ID NO: 9887 - DNA, 20 bp, Artificial Sequence
  Synthetic
cccaaatggccctttaaacg

SEQ ID NO: 9888 - DNA, 17 bp, Artificial Sequence
  Synthetic
aggaacacacccccgtg

SEQ ID NO: 9889 - DNA, 16 bp, Artificial Sequence
  Synthetic
ccccaggccaccacaa

SEQ ID NO: 9890 - DNA, 16 bp, Artificial Sequence
  Synthetic
gggagccccttcgtca

SEQ ID NO: 9891 - DNA, 19 bp, Artificial Sequence
  Synthetic
ccagaatttggccaggacg

SEQ ID NO: 9892 - DNA, 18 bp, Artificial Sequence
  Synthetic
gcgcatgttggaaaaggc

SEQ ID NO: 9893 - DNA, 19 bp, Artificial Sequence
  Synthetic
cgcttctggttatgggcga

SEQ ID NO: 9894 - DNA, 18 bp, Artificial Sequence
  Synthetic
gaacccccgacgttcagt

SEQ ID NO: 9895 - DNA, 16 bp, Artificial Sequence
  Synthetic
agtcccgaagaccgcc

SEQ ID NO: 9896 - DNA, 16 bp, Artificial Sequence
  Synthetic
agccccacgcggtgat

SEQ ID NO: 9897 - DNA, 16 bp, Artificial Sequence
  Synthetic
acttggcgggggtggt

SEQ ID NO: 9898 - DNA, 16 bp, Artificial Sequence
  Synthetic
gccatcgccacgtcct

SEQ ID NO: 9899 - DNA, 19 bp, Artificial Sequence
  Synthetic
gaaaacccccaaacgcgtt

SEQ ID NO: 9900 - DNA, 16 bp, Artificial Sequence
  Synthetic
ctcgaggtcgctcggt

SEQ ID NO: 9901 - DNA, 18 bp, Artificial Sequence
  Synthetic
gaacacgctagggtcgga

SEQ ID NO: 9902 - DNA, 16 bp, Artificial Sequence
  Synthetic
caggcgccgcatcttg

SEQ ID NO: 9903 - DNA, 16 bp, Artificial Sequence
  Synthetic
gcccgtgtgttcctgc

SEQ ID NO: 9904 - DNA, 17 bp, Artificial Sequence
  Synthetic
agcctgtcgtgtctgcg

SEQ ID NO: 9905 - DNA, 16 bp, Artificial Sequence
  Synthetic
catgctcgccgtccgt

SEQ ID NO: 9906 - DNA, 20 bp, Artificial Sequence
  Synthetic
agaccctatggtacacacgg

SEQ ID NO: 9907 - DNA, 20 bp, Artificial Sequence
  Synthetic
tatgctaattgacctcggcc

SEQ ID NO: 9908 - DNA, 16 bp, Artificial Sequence
  Synthetic
cgacccccctcaccaa

SEQ ID NO: 9909 - DNA, 20 bp, Artificial Sequence
  Synthetic
gaattgaccctaggaggccg

SEQ ID NO: 9910 - DNA, 16 bp, Artificial Sequence
  Synthetic
ggaggaggttggcgga

SEQ ID NO: 9911 - DNA, 16 bp, Artificial Sequence
  Synthetic
ccgcctccgaagccat

SEQ ID NO: 9912 - DNA, 16 bp, Artificial Sequence
  Synthetic
ttctcccccccccctt

SEQ ID NO: 9913 - DNA, 19 bp, Artificial Sequence
  Synthetic
ttcgaccgagtctggggac

SEQ ID NO: 9914 - DNA, 17 bp, Artificial Sequence
  Synthetic
gggggctaaagggtggt

SEQ ID NO: 9915 - DNA, 16 bp, Artificial Sequence
  Synthetic
ggggctgggttggtct

SEQ ID NO: 9916 - DNA, 17 bp, Artificial Sequence
  Synthetic
ggccaaccgtcgaaggt

SEQ ID NO: 9917 - DNA, 18 bp, Artificial Sequence
  Synthetic
ggggaggggagggtgatt

SEQ ID NO: 9918 - DNA, 16 bp, Artificial Sequence
  Synthetic
gtcccgccggagacaa

SEQ ID NO: 9919 - DNA, 16 bp, Artificial Sequence
  Synthetic
cccgtgtggcgcatct

SEQ ID NO: 9920 - DNA, 16 bp, Artificial Sequence
  Synthetic
agcgctcaccccagga

SEQ ID NO: 9921 - DNA, 16 bp, Artificial Sequence
  Synthetic
tctccggggtcacgtg

SEQ ID NO: 9922 - DNA, 19 bp, Artificial Sequence
  Synthetic
gccggtctggtgatcttcg

SEQ ID NO: 9923 - DNA, 18 bp, Artificial Sequence
  Synthetic
ccaactccagaccaccgg

SEQ ID NO: 9924 - DNA, 18 bp, Artificial Sequence
  Synthetic
gtttttggggtgtggcgg

SEQ ID NO: 9925 - DNA, 18 bp, Artificial Sequence
  Synthetic
gtgtcgcgatgtctctgc

SEQ ID NO: 9926 - DNA, 20 bp, Artificial Sequence
  Synthetic
tggtataaatcaccggtgcg

SEQ ID NO: 9927 - DNA, 17 bp, Artificial Sequence
  Synthetic
cctctgggtctgtgcca

SEQ ID NO: 9928 - DNA, 18 bp, Artificial Sequence
  Synthetic
gcttttgcgggtccagag

SEQ ID NO: 9929 - DNA, 17 bp, Artificial Sequence
  Synthetic
cggacttcgtgtggcag

SEQ ID NO: 9930 - DNA, 19 bp, Artificial Sequence
  Synthetic
gctctccgatcccaactcc

SEQ ID NO: 9931 - DNA, 16 bp, Artificial Sequence
  Synthetic
gctgcgtcggcatggt

SEQ ID NO: 9932 - DNA, 24 bp, Artificial Sequence
  Synthetic
aaagcaggagattaaaatgaatcc

SEQ ID NO: 9933 - DNA, 20 bp, Artificial Sequence
  Synthetic
ctccctccccatataactca

SEQ ID NO: 9934 - DNA, 21 bp, Artificial Sequence
  Synthetic
gcaggcctcatataagatctt

SEQ ID NO: 9935 - DNA, 18 bp, Artificial Sequence
  Synthetic
ctaacggggcatatggag

SEQ ID NO: 9936 - DNA, 19 bp, Artificial Sequence
  Synthetic
cggacctgcatgactactg

SEQ ID NO: 9937 - DNA, 19 bp, Artificial Sequence
  Synthetic
cctttttaccgctgttacc

SEQ ID NO: 9938 - DNA, 19 bp, Artificial Sequence
  Synthetic
tctctttacgcggactccc

SEQ ID NO: 9939 - DNA, 18 bp, Artificial Sequence
  Synthetic
tcagctctgtatcgggaa

SEQ ID NO: 9940 - DNA, 19 bp, Artificial Sequence
  Synthetic
cacactctatggaaggcgg

SEQ ID NO: 9941 - DNA, 25 bp, Artificial Sequence
  Synthetic
caggtcaattatattcagtatggaa

SEQ ID NO: 9942 - DNA, 21 bp, Artificial Sequence
  Synthetic
ggagtaaaatgagtgatgctg

SEQ ID NO: 9943 - DNA, 20 bp, Artificial Sequence
  Synthetic
aatgacgatgttgaccaaag

SEQ ID NO: 9944 - DNA, 24 bp, Artificial Sequence
  Synthetic
tggtgggtttacatttaaaagaac

SEQ ID NO: 9945 - DNA, 22 bp, Artificial Sequence
  Synthetic
catgataaaagcagttagaggt

SEQ ID NO: 9946 - DNA, 18 bp, Artificial Sequence
  Synthetic
gagggtggtggttagcat

SEQ ID NO: 9947 - DNA, 23 bp, Artificial Sequence
  Synthetic
tgaaccatttcaatctttagtcc

SEQ ID NO: 9948 - DNA, 24 bp, Artificial Sequence
  Synthetic
ccactaaaagactaacaattctcg

SEQ ID NO: 9949 - DNA, 20 bp, Artificial Sequence
  Synthetic
gaacctcttgcttccagttt

SEQ ID NO: 9950 - DNA, 24 bp, Artificial Sequence
  Synthetic
agtattttactcaaactccattgc

SEQ ID NO: 9951 - DNA, 21 bp, Artificial Sequence
  Synthetic
gagtttgtcaccagattcaga

SEQ ID NO: 9952 - DNA, 20 bp, Artificial Sequence
  Synthetic
actttgtaactgaagcagac

SEQ ID NO: 9953 - DNA, 23 bp, Artificial Sequence
  Synthetic
aagaaaaacaaagtaaaagacgc

SEQ ID NO: 9954 - DNA, 22 bp, Artificial Sequence
  Synthetic
tcttgaatctaattgagcaggg

SEQ ID NO: 9955 - DNA, 20 bp, Artificial Sequence
  Synthetic
aaaactctttccgcccctag

SEQ ID NO: 9956 - DNA, 23 bp, Artificial Sequence
  Synthetic
tgtaataaacaaagtagaaggca

SEQ ID NO: 9957 - DNA, 20 bp, Artificial Sequence
  Synthetic
agaagctggaattcctgatg

SEQ ID NO: 9958 - DNA, 23 bp, Artificial Sequence
  Synthetic
caatttgattttgaaaatcccgc

SEQ ID NO: 9959 - DNA, 22 bp, Artificial Sequence
  Synthetic
acacttctattttgacctcagt

SEQ ID NO: 9960 - DNA, 22 bp, Artificial Sequence
  Synthetic
cagaatggtaaactgtatctgc

SEQ ID NO: 9961 - DNA, 23 bp, Artificial Sequence
  Synthetic
tctttaacatggatagagaacga

SEQ ID NO: 9962 - DNA, 18 bp, Artificial Sequence
  Synthetic
acctcaggctggagaatg

SEQ ID NO: 9963 - DNA, 25 bp, Artificial Sequence
  Synthetic
tgaggatcaatatagatttttgcag

SEQ ID NO: 9964 - DNA, 24 bp, Artificial Sequence
  Synthetic
cctcaaaataagcaatgtatccaa

SEQ ID NO: 9965 - DNA, 19 bp, Artificial Sequence
  Synthetic
ctgacaagcacgaatctgt

SEQ ID NO: 9966 - DNA, 21 bp, Artificial Sequence
  Synthetic
agaaattgtatcagccatgag

SEQ ID NO: 9967 - DNA, 23 bp, Artificial Sequence
  Synthetic
agaaagttaaatgttactcctga

SEQ ID NO: 9968 - DNA, 18 bp, Artificial Sequence
  Synthetic
gagcgacgacgacgagaa

SEQ ID NO: 9969 - DNA, 25 bp, Artificial Sequence
  Synthetic
tgaaaattctactattgcagattgg

SEQ ID NO: 9970 - DNA, 19 bp, Artificial Sequence
  Synthetic
gcgtcatctatagtccctc

SEQ ID NO: 9971 - DNA, 18 bp, Artificial Sequence
  Synthetic
gcaaacacaggtaaaccc

SEQ ID NO: 9972 - DNA, 18 bp, Artificial Sequence
  Synthetic
ccttctcgattggtgcag

SEQ ID NO: 9973 - DNA, 22 bp, Artificial Sequence
  Synthetic
caaatccatggctactaaatgc

SEQ ID NO: 9974 - DNA, 24 bp, Artificial Sequence
  Synthetic
acaaactgtgatcaataaacactg

SEQ ID NO: 9975 - DNA, 20 bp, Artificial Sequence
  Synthetic
tgcaagggatgttttacagt

SEQ ID NO: 9976 - DNA, 20 bp, Artificial Sequence
  Synthetic
ccatacttggtcaaggcagg

SEQ ID NO: 9977 - DNA, 20 bp, Artificial Sequence
  Synthetic
cctggtcattcggtgttcat

SEQ ID NO: 9978 - DNA, 23 bp, Artificial Sequence
  Synthetic
cctttagacaggtagaagattgt

SEQ ID NO: 9979 - DNA, 20 bp, Artificial Sequence
  Synthetic
agtggcagaaactggaactg

SEQ ID NO: 9980 - DNA, 18 bp, Artificial Sequence
  Synthetic
ttaccagcaggacagctc

SEQ ID NO: 9981 - DNA, 20 bp, Artificial Sequence
  Synthetic
gctgaagccctaaaagaggc

SEQ ID NO: 9982 - DNA, 25 bp, Artificial Sequence
  Synthetic
agtactaaataaaagagtaagagcc

SEQ ID NO: 9983 - DNA, 25 bp, Artificial Sequence
  Synthetic
gaggatgctgatagattttagagaa

SEQ ID NO: 9984 - DNA, 25 bp, Artificial Sequence
  Synthetic
gtacatggatgatatcttaatagct

SEQ ID NO: 9985 - DNA, 23 bp, Artificial Sequence
  Synthetic
aattagaggaaaaatgacactca

SEQ ID NO: 9986 - DNA, 19 bp, Artificial Sequence
  Synthetic
aactactggcaagtgacat

SEQ ID NO: 9987 - DNA, 25 bp, Artificial Sequence
  Synthetic
tagaagaaatgataaagaaggaagc

SEQ ID NO: 9988 - DNA, 20 bp, Artificial Sequence
  Synthetic
gcagtacatgttgcaagtgg

SEQ ID NO: 9989 - DNA, 18 bp, Artificial Sequence
  Synthetic
ctgatggcagttcattgc

SEQ ID NO: 9990 - DNA, 25 bp, Artificial Sequence
  Synthetic
ggaaaaagtcatctagaaatacagg

SEQ ID NO: 9991 - DNA, 18 bp, Artificial Sequence
  Synthetic
ttcgagtggctagagagg

SEQ ID NO: 9992 - DNA, 21 bp, Artificial Sequence
  Synthetic
ggtaatagaaactctgaggga

SEQ ID NO: 9993 - DNA, 21 bp, Artificial Sequence
  Synthetic
atatcatatgagcgaaagggc

SEQ ID NO: 9994 - DNA, 18 bp, Artificial Sequence
  Synthetic
acagaggcttttgatgca

SEQ ID NO: 9995 - DNA, 25 bp, Artificial Sequence
  Synthetic
gataagaaaaggaggtataaggaca

SEQ ID NO: 9996 - DNA, 24 bp, Artificial Sequence
  Synthetic
caagtattataatctcacaatgcg

SEQ ID NO: 9997 - DNA, 20 bp, Artificial Sequence
  Synthetic
ctgtaacatgacttggttcc

SEQ ID NO: 9998 - DNA, 19 bp, Artificial Sequence
  Synthetic
gtctggggaacgaaaaacc

SEQ ID NO: 9999 - DNA, 18 bp, Artificial Sequence
  Synthetic
cgcctcttgatcgggcta

SEQ ID NO: 10000 - DNA, 18 bp, Artificial Sequence
  Synthetic
acagcagtatcagcaggg

SEQ ID NO: 10001 - DNA, 19 bp, Artificial Sequence
  Synthetic
aactgcttagtacacccag

SEQ ID NO: 10002 - DNA, 20 bp, Artificial Sequence
  Synthetic
aaatgtacccgcttcttgca

SEQ ID NO: 10003 - DNA, 22 bp, Artificial Sequence
  Synthetic
cgttgcattttctaatatccac

SEQ ID NO: 10004 - DNA, 20 bp, Artificial Sequence
  Synthetic
ttaactgcacagatctggac

SEQ ID NO: 10005 - DNA, 18 bp, Artificial Sequence
  Synthetic
atcttgccctaacgttgc

SEQ ID NO: 10006 - DNA, 18 bp, Artificial Sequence
  Synthetic
tctcagattggtggcttc

SEQ ID NO: 10007 - DNA, 19 bp, Artificial Sequence
  Synthetic
aaaggccataggaaattgc

SEQ ID NO: 10008 - DNA, 25 bp, Artificial Sequence
  Synthetic
ttaagtgagctagaagtaaaaaacc

SEQ ID NO: 10009 - DNA, 22 bp, Artificial Sequence
  Synthetic
ctgctgtagaaatagggaatgg

SEQ ID NO: 10010 - DNA, 21 bp, Artificial Sequence
  Synthetic
ctttgtccagaatgccttaaa

SEQ ID NO: 10011 - DNA, 20 bp, Artificial Sequence
  Synthetic
gacagatggcaactaccacc

SEQ ID NO: 10012 - DNA, 18 bp, Artificial Sequence
  Synthetic
acgaatgggagtgcaaat

SEQ ID NO: 10013 - DNA, 20 bp, Artificial Sequence
  Synthetic
gagtagactccctttgttct

SEQ ID NO: 10014 - DNA, 23 bp, Artificial Sequence
  Synthetic
atttgatgaaagtacagattgct

SEQ ID NO: 10015 - DNA, 22 bp, Artificial Sequence
  Synthetic
aaaatgccttttactgaaagtg

SEQ ID NO: 10016 - DNA, 22 bp, Artificial Sequence
  Synthetic
taaagcccttccatatcctaac

SEQ ID NO: 10017 - DNA, 23 bp, Artificial Sequence
  Synthetic
ctgtaaatgttcctaaaggctct

SEQ ID NO: 10018 - DNA, 21 bp, Artificial Sequence
  Synthetic
gcactggctatagacctatag

SEQ ID NO: 10019 - DNA, 25 bp, Artificial Sequence
  Synthetic
gggtaatcctacagttataacatca

SEQ ID NO: 10020 - DNA, 22 bp, Artificial Sequence
  Synthetic
cctttaacaacgttttctgaaa

SEQ ID NO: 10021 - DNA, 22 bp, Artificial Sequence
  Synthetic
cctgatagtgatttcagagatg

SEQ ID NO: 10022 - DNA, 20 bp, Artificial Sequence
  Synthetic
cctagcacagacaatacacc

SEQ ID NO: 10023 - DNA, 23 bp, Artificial Sequence
  Synthetic
taggacatccattttttcctgtt

SEQ ID NO: 10024 - DNA, 22 bp, Artificial Sequence
  Synthetic
tagaaaatcccactctttaccc

SEQ ID NO: 10025 - DNA, 23 bp, Artificial Sequence
  Synthetic
ataacagaacattttttgctgac

SEQ ID NO: 10026 - DNA, 23 bp, Artificial Sequence
  Synthetic
tgatattgaaattgtaatgcagc

SEQ ID NO: 10027 - DNA, 20 bp, Artificial Sequence
  Synthetic
tttacctcagagctttctca

SEQ ID NO: 10028 - DNA, 23 bp, Artificial Sequence
  Synthetic
aagaattagcatccttttttgag

SEQ ID NO: 10029 - DNA, 19 bp, Artificial Sequence
  Synthetic
tggaagatctagtgatgcc

SEQ ID NO: 10030 - DNA, 18 bp, Artificial Sequence
  Synthetic
ttgcggctcttagtccaa

SEQ ID NO: 10031 - DNA, 19 bp, Artificial Sequence
  Synthetic
cagccgcattgtactttta

SEQ ID NO: 10032 - DNA, 23 bp, Artificial Sequence
  Synthetic
ctgcaaaagcatttagatcttca

SEQ ID NO: 10033 - DNA, 20 bp, Artificial Sequence
  Synthetic
ctccctctgttaccagctct

SEQ ID NO: 10034 - DNA, 25 bp, Artificial Sequence
  Synthetic
gaaaaattgtaattatgtacccagc

SEQ ID NO: 10035 - DNA, 21 bp, Artificial Sequence
  Synthetic
acaaacaccaaatacaggaac

SEQ ID NO: 10036 - DNA, 23 bp, Artificial Sequence
  Synthetic
ttagagaggagtttgatattgac

SEQ ID NO: 10037 - DNA, 23 bp, Artificial Sequence
  Synthetic
tttttctcaaactcatttggttg

SEQ ID NO: 10038 - DNA, 22 bp, Artificial Sequence
  Synthetic
tattttgatgtagtaggaggcg

SEQ ID NO: 10039 - DNA, 19 bp, Artificial Sequence
  Synthetic
ccgatgctcctttagaagt

SEQ ID NO: 10040 - DNA, 24 bp, Artificial Sequence
  Synthetic
agtagaaataacaatgcaactgtg

SEQ ID NO: 10041 - DNA, 23 bp, Artificial Sequence
  Synthetic
tattgactcatgagtttgttgat

SEQ ID NO: 10042 - DNA, 23 bp, Artificial Sequence
  Synthetic
aagaactaagaaatttgatgtcg

SEQ ID NO: 10043 - DNA, 22 bp, Artificial Sequence
  Synthetic
tctttggagcaaaacaaatgac

SEQ ID NO: 10044 - DNA, 20 bp, Artificial Sequence
  Synthetic
agcacaagatgtcatcatgg

SEQ ID NO: 10045 - DNA, 19 bp, Artificial Sequence
  Synthetic
cagatgtacacaccaggag

SEQ ID NO: 10046 - DNA, 22 bp, Artificial Sequence
  Synthetic
gagggttcactttcaaaagaac

SEQ ID NO: 10047 - DNA, 18 bp, Artificial Sequence
  Synthetic
ttgcatggtaaaggcagt

SEQ ID NO: 10048 - DNA, 18 bp, Artificial Sequence
  Synthetic
gtggtcgtgagcattgac

SEQ ID NO: 10049 - DNA, 24 bp, Artificial Sequence
  Synthetic
tgaaccatttcaatctttagtacc

SEQ ID NO: 10050 - DNA, 20 bp, Artificial Sequence
  Synthetic
caacaagacaactaagaggc

SEQ ID NO: 10051 - DNA, 20 bp, Artificial Sequence
  Synthetic
aaatcctggtattcgctctg

SEQ ID NO: 10052 - DNA, 24 bp, Artificial Sequence
  Synthetic
gtgaccaattcctagaattttcag

SEQ ID NO: 10053 - DNA, 20 bp, Artificial Sequence
  Synthetic
gcccagctctaatagtatgg

SEQ ID NO: 10054 - DNA, 18 bp, Artificial Sequence
  Synthetic
gtgcaagcttcctgagag

SEQ ID NO: 10055 - DNA, 20 bp, Artificial Sequence
  Synthetic
agattccaaaaggaagaggc

SEQ ID NO: 10056 - DNA, 21 bp, Artificial Sequence
  Synthetic
cagaagtgtggtcatacaatg

SEQ ID NO: 10057 - DNA, 25 bp, Artificial Sequence
  Synthetic
gaattataaaaaagtagggaggaac

SEQ ID NO: 10058 - DNA, 19 bp, Artificial Sequence
  Synthetic
gacactacgacagatcagc

SEQ ID NO: 10059 - DNA, 23 bp, Artificial Sequence
  Synthetic
ggttgacctgtattgttatgaac

SEQ ID NO: 10060 - DNA, 20 bp, Artificial Sequence
  Synthetic
caggaacaggtagaaaatgg

SEQ ID NO: 10061 - DNA, 20 bp, Artificial Sequence
  Synthetic
gcagaggcgttatatacaca

SEQ ID NO: 10062 - DNA, 21 bp, Artificial Sequence
  Synthetic
ttaacagaaatggtgcaatgg

SEQ ID NO: 10063 - DNA, 19 bp, Artificial Sequence
  Synthetic
aaggttgtggtccagctta

SEQ ID NO: 10064 - DNA, 20 bp, Artificial Sequence
  Synthetic
agtccacatttggtacagaa

SEQ ID NO: 10065 - DNA, 20 bp, Artificial Sequence
  Synthetic
ccaccgacctatacaacacc

SEQ ID NO: 10066 - DNA, 25 bp, Artificial Sequence
  Synthetic
atgtacaaacatatataggggaaca

SEQ ID NO: 10067 - DNA, 18 bp, Artificial Sequence
  Synthetic
tgtgtggtgtgcatggta

SEQ ID NO: 10068 - DNA, 20 bp, Artificial Sequence
  Synthetic
tattggaagagtctgcagtt

SEQ ID NO: 10069 - DNA, 19 bp, Artificial Sequence
  Synthetic
cttccttgcaaacacgtag

SEQ ID NO: 10070 - DNA, 18 bp, Artificial Sequence
  Synthetic
gtaagcgccgtaaacctg

SEQ ID NO: 10071 - DNA, 18 bp, Artificial Sequence
  Synthetic
gagcattggggtaagggt

SEQ ID NO: 10072 - DNA, 25 bp, Artificial Sequence
  Synthetic
atgcagaggaatatgatatacagtt

SEQ ID NO: 10073 - DNA, 23 bp, Artificial Sequence
  Synthetic
tgattgtgttcattgtatgttgt

SEQ ID NO: 10074 - DNA, 22 bp, Artificial Sequence
  Synthetic
attacaggaaaagcatttgtct

SEQ ID NO: 10075 - DNA, 22 bp, Artificial Sequence
  Synthetic
ctgcgttcttaaacagtaattc

SEQ ID NO: 10076 - DNA, 20 bp, Artificial Sequence
  Synthetic
ttcctccctctgttggtagc

SEQ ID NO: 10077 - DNA, 18 bp, Artificial Sequence
  Synthetic
ctgaaggacgtggaggaa

SEQ ID NO: 10078 - DNA, 20 bp, Artificial Sequence
  Synthetic
ggttaattgacactcctggt

SEQ ID NO: 10079 - DNA, 22 bp, Artificial Sequence
  Synthetic
ggagatatgtgcgatataggtc

SEQ ID NO: 10080 - DNA, 20 bp, Artificial Sequence
  Synthetic
gcaggttctttttatcacct

SEQ ID NO: 10081 - DNA, 23 bp, Artificial Sequence
  Synthetic
attatatgagacataccgaggag

SEQ ID NO: 10082 - DNA, 25 bp, Artificial Sequence
  Synthetic
tacaaggatttaacattttggaagg

SEQ ID NO: 10083 - DNA, 22 bp, Artificial Sequence
  Synthetic
tgtactgtgaaaataagctgtg

SEQ ID NO: 10084 - DNA, 25 bp, Artificial Sequence
  Synthetic
gctttctagtttaaaccacctttta

SEQ ID NO: 10085 - DNA, 18 bp, Artificial Sequence
  Synthetic
cccaacatcggtcccaca

SEQ ID NO: 10086 - DNA, 18 bp, Artificial Sequence
  Synthetic
accagaaacggatgggag

SEQ ID NO: 10087 - DNA, 25 bp, Artificial Sequence
  Synthetic
gctcttctttttttatctcattcac

SEQ ID NO: 10088 - DNA, 22 bp, Artificial Sequence
  Synthetic
atcaggaaactatgttgcagaa

SEQ ID NO: 10089 - DNA, 22 bp, Artificial Sequence
  Synthetic
ctgtatcctcagagatcccata

SEQ ID NO: 10090 - DNA, 25 bp, Artificial Sequence
  Synthetic
atcctattataccagaatatagggt

SEQ ID NO: 10091 - DNA, 25 bp, Artificial Sequence
  Synthetic
agcaaaagatagaactattgatcag

SEQ ID NO: 10092 - DNA, 19 bp, Artificial Sequence
  Synthetic
ccacatcaaaagggcagaa

SEQ ID NO: 10093 - DNA, 22 bp, Artificial Sequence
  Synthetic
tccaatgagagagtatccatga

SEQ ID NO: 10094 - DNA, 25 bp, Artificial Sequence
  Synthetic
tccaaaatgagtataactaactctg

SEQ ID NO: 10095 - DNA, 23 bp, Artificial Sequence
  Synthetic
aaagagatggttgtgtatacagt

SEQ ID NO: 10096 - DNA, 21 bp, Artificial Sequence
  Synthetic
cttaatctggttatctgggct

SEQ ID NO: 10097 - DNA, 22 bp, Artificial Sequence
  Synthetic
taattttgagcctcataccaaa

SEQ ID NO: 10098 - DNA, 25 bp, Artificial Sequence
  Synthetic
tttacagaatcaataaaggtgagag

SEQ ID NO: 10099 - DNA, 19 bp, Artificial Sequence
  Synthetic
ttgtcaatggaggagtggt

SEQ ID NO: 10100 - DNA, 24 bp, Artificial Sequence
  Synthetic
aaaaacttaggagtaaagttacgc

SEQ ID NO: 10101 - DNA, 18 bp, Artificial Sequence
  Synthetic
gaagtgccgcaacaaaga

SEQ ID NO: 10102 - DNA, 22 bp, Artificial Sequence
  Synthetic
taacataagctttgatcaaccc

SEQ ID NO: 10103 - DNA, 21 bp, Artificial Sequence
  Synthetic
tgatgcgtatccactaaatcc

SEQ ID NO: 10104 - DNA, 24 bp, Artificial Sequence
  Synthetic
taattaacggatatagagagaggc

SEQ ID NO: 10105 - DNA, 23 bp, Artificial Sequence
  Synthetic
tgaaacgattataagtagcaaga

SEQ ID NO: 10106 - DNA, 23 bp, Artificial Sequence
  Synthetic
caactatatattgcccttgggat

SEQ ID NO: 10107 - DNA, 21 bp, Artificial Sequence
  Synthetic
aacactaagtaggactttgcg

SEQ ID NO: 10108 - DNA, 21 bp, Artificial Sequence
  Synthetic
ccgcaataagaatagcaatga

SEQ ID NO: 10109 - DNA, 23 bp, Artificial Sequence
  Synthetic
atctacagatagaaaagttgctt

SEQ ID NO: 10110 - DNA, 19 bp, Artificial Sequence
  Synthetic
ccgtagcaagtgattctga

SEQ ID NO: 10111 - DNA, 21 bp, Artificial Sequence
  Synthetic
gatggcaaacctgttatgagt

SEQ ID NO: 10112 - DNA, 23 bp, Artificial Sequence
  Synthetic
tgctcttgacaaactttacaaag

SEQ ID NO: 10113 - DNA, 19 bp, Artificial Sequence
  Synthetic
tgaaggtgtctctgtttgg

SEQ ID NO: 10114 - DNA, 22 bp, Artificial Sequence
  Synthetic
gtggtactatacaaattctcgc

SEQ ID NO: 10115 - DNA, 18 bp, Artificial Sequence
  Synthetic
cgtgaacgtggccttaat

SEQ ID NO: 10116 - DNA, 23 bp, Artificial Sequence
  Synthetic
aattgtcaaacctaatatcagcc

SEQ ID NO: 10117 - DNA, 18 bp, Artificial Sequence
  Synthetic
cacacaacagggtttgct

SEQ ID NO: 10118 - DNA, 20 bp, Artificial Sequence
  Synthetic
atggattgagctttttccac

SEQ ID NO: 10119 - DNA, 21 bp, Artificial Sequence
  Synthetic
tgtttacagagtcaagctttg

SEQ ID NO: 10120 - DNA, 22 bp, Artificial Sequence
  Synthetic
ccttttgaaatgccatttgaag

SEQ ID NO: 10121 - DNA, 22 bp, Artificial Sequence
  Synthetic
actggttttatggttatggatt

SEQ ID NO: 10122 - DNA, 25 bp, Artificial Sequence
  Synthetic
gtattaaggatgcagattataatgc

SEQ ID NO: 10123 - DNA, 20 bp, Artificial Sequence
  Synthetic
atacagacacagaggtttgt

SEQ ID NO: 10124 - DNA, 25 bp, Artificial Sequence
  Synthetic
ccttctggtaatcttattaagtttg

SEQ ID NO: 10125 - DNA, 22 bp, Artificial Sequence
  Synthetic
aagtcatttgaacaacaagttg

SEQ ID NO: 10126 - DNA, 23 bp, Artificial Sequence
  Synthetic
aaaactctgttgcatctatcaat

SEQ ID NO: 10127 - DNA, 24 bp, Artificial Sequence
  Synthetic
tttgtgtaaaactgcagtaactac

SEQ ID NO: 10128 - DNA, 22 bp, Artificial Sequence
  Synthetic
ggttatgctaagtcaaactttg

SEQ ID NO: 10129 - DNA, 23 bp, Artificial Sequence
  Synthetic
aaggttatttcttttgtcagaca

SEQ ID NO: 10130 - DNA, 25 bp, Artificial Sequence
  Synthetic
gatgtactacgtaatagctttggta

SEQ ID NO: 10131 - DNA, 19 bp, Artificial Sequence
  Synthetic
cagtctttctgctgaaggt

SEQ ID NO: 10132 - DNA, 23 bp, Artificial Sequence
  Synthetic
tttttgaaaactttgaggactgg

SEQ ID NO: 10133 - DNA, 22 bp, Artificial Sequence
  Synthetic
ttaagttgccagaagttattgc

SEQ ID NO: 10134 - DNA, 23 bp, Artificial Sequence
  Synthetic
ttagtaacaatgattgcttatgc

SEQ ID NO: 10135 - DNA, 20 bp, Artificial Sequence
  Synthetic
ttagcaaaagcaatgttgga

SEQ ID NO: 10136 - DNA, 19 bp, Artificial Sequence
  Synthetic
ttggtgttgtaggtgctac

SEQ ID NO: 10137 - DNA, 22 bp, Artificial Sequence
  Synthetic
ctttgatggtgttatgtatggt

SEQ ID NO: 10138 - DNA, 19 bp, Artificial Sequence
  Synthetic
cctgcaaagtggtaaaacc

SEQ ID NO: 10139 - DNA, 21 bp, Artificial Sequence
  Synthetic
ctgttatgcaaatggacatcc

SEQ ID NO: 10140 - DNA, 23 bp, Artificial Sequence
  Synthetic
gttttacatgttgttaggctttg

SEQ ID NO: 10141 - DNA, 25 bp, Artificial Sequence
  Synthetic
gtctaaattgactgatcttaagtgc

SEQ ID NO: 10142 - DNA, 23 bp, Artificial Sequence
  Synthetic
ttcctcaccacaaataatcaaac

SEQ ID NO: 10143 - DNA, 23 bp, Artificial Sequence
  Synthetic
taccagatcatgattcatttgtg

SEQ ID NO: 10144 - DNA, 25 bp, Artificial Sequence
  Synthetic
gaaggtaatgctctatacaacaatg

SEQ ID NO: 10145 - DNA, 21 bp, Artificial Sequence
  Synthetic
cattgttcttttgctgttgac

SEQ ID NO: 10146 - DNA, 21 bp, Artificial Sequence
  Synthetic
tgtaaagtttgtggttgttgg

SEQ ID NO: 10147 - DNA, 22 bp, Artificial Sequence
  Synthetic
gcatgatttctttacttggcat

SEQ ID NO: 10148 - DNA, 22 bp, Artificial Sequence
  Synthetic
gttttgaccttagacaaccaag

SEQ ID NO: 10149 - DNA, 23 bp, Artificial Sequence
  Synthetic
gcattgttcaaattttaacacac

SEQ ID NO: 10150 - DNA, 20 bp, Artificial Sequence
  Synthetic
acgcactgtttgtttttctg

SEQ ID NO: 10151 - DNA, 25 bp, Artificial Sequence
  Synthetic
tcattaacaaagcgtaatattctcc

SEQ ID NO: 10152 - DNA, 23 bp, Artificial Sequence
  Synthetic
ttgatgaatcttttgtggatgac

SEQ ID NO: 10153 - DNA, 19 bp, Artificial Sequence
  Synthetic
tctgctggtgtttttgtgg

SEQ ID NO: 10154 - DNA, 23 bp, Artificial Sequence
  Synthetic
tggaggtttgaattattactgtg

SEQ ID NO: 10155 - DNA, 20 bp, Artificial Sequence
  Synthetic
ccaccgttaaaccgtaattc

SEQ ID NO: 10156 - DNA, 19 bp, Artificial Sequence
  Synthetic
gcaaacagcgtataaccac

SEQ ID NO: 10157 - DNA, 19 bp, Artificial Sequence
  Synthetic
gacattgttgtcgtggatg

SEQ ID NO: 10158 - DNA, 22 bp, Artificial Sequence
  Synthetic
ctccagtataaataggcgtcaa

SEQ ID NO: 10159 - DNA, 22 bp, Artificial Sequence
  Synthetic
agtctgaaagtagttgtggttt

SEQ ID NO: 10160 - DNA, 19 bp, Artificial Sequence
  Synthetic
ctagagactttgccatgcg

SEQ ID NO: 10161 - DNA, 19 bp, Artificial Sequence
  Synthetic
ctggctcatctgatgtact

SEQ ID NO: 10162 - DNA, 19 bp, Artificial Sequence
  Synthetic
tgactagatgtttggctgt

SEQ ID NO: 10163 - DNA, 24 bp, Artificial Sequence
  Synthetic
gaattgtaatgtggatatgtaccc

SEQ ID NO: 10164 - DNA, 23 bp, Artificial Sequence
  Synthetic
tctctatagagcatatgttgagt

SEQ ID NO: 10165 - DNA, 22 bp, Artificial Sequence
  Synthetic
agtattctcaaaaaccttggtg

SEQ ID NO: 10166 - DNA, 21 bp, Artificial Sequence
  Synthetic
actgtcaaatcagaagatggt

SEQ ID NO: 10167 - DNA, 23 bp, Artificial Sequence
  Synthetic
ctgacataacactcaaatgttgt

SEQ ID NO: 10168 - DNA, 20 bp, Artificial Sequence
  Synthetic
cccagtggcattatgttcaa

SEQ ID NO: 10169 - DNA, 24 bp, Artificial Sequence
  Synthetic
acttctgttaatacgtcatcatca

SEQ ID NO: 10170 - DNA, 22 bp, Artificial Sequence
  Synthetic
aaatgtttgttttgcttgttgc

SEQ ID NO: 10171 - DNA, 22 bp, Artificial Sequence
  Synthetic
caacaacactttagtttcaggt

SEQ ID NO: 10172 - DNA, 20 bp, Artificial Sequence
  Synthetic
cagttgtcctttgatgtacc

SEQ ID NO: 10173 - DNA, 24 bp, Artificial Sequence
  Synthetic
gttcctttatgaatgttacattgg

SEQ ID NO: 10174 - DNA, 22 bp, Artificial Sequence
  Synthetic
gtccaatggcacttataattgc

SEQ ID NO: 10175 - DNA, 19 bp, Artificial Sequence
  Synthetic
ttaagaaatagcgccaggc

SEQ ID NO: 10176 - DNA, 20 bp, Artificial Sequence
  Synthetic
cgaatggccatgtatacagg

SEQ ID NO: 10177 - DNA, 22 bp, Artificial Sequence
  Synthetic
ctatctctagctctattcaggc

SEQ ID NO: 10178 - DNA, 20 bp, Artificial Sequence
  Synthetic
ataaggatgttgaagcgtgg

SEQ ID NO: 10179 - DNA, 23 bp, Artificial Sequence
  Synthetic
tattgatgttaataagacgctgc

SEQ ID NO: 10180 - DNA, 23 bp, Artificial Sequence
  Synthetic
gctattatgttgttgttctactg

SEQ ID NO: 10181 - DNA, 21 bp, Artificial Sequence
  Synthetic
cagagctgctcttatagtgtt

SEQ ID NO: 10182 - DNA, 25 bp, Artificial Sequence
  Synthetic
aattagaaatccactaagatgttcc

SEQ ID NO: 10183 - DNA, 23 bp, Artificial Sequence
  Synthetic
aatactccagattgttttatggt

SEQ ID NO: 10184 - DNA, 22 bp, Artificial Sequence
  Synthetic
acctacctgaatacatgacagt

SEQ ID NO: 10185 - DNA, 20 bp, Artificial Sequence
  Synthetic
ggtgatacctcgtaatttgg

SEQ ID NO: 10186 - DNA, 21 bp, Artificial Sequence
  Synthetic
gtgaatccaaacctcaatctc

SEQ ID NO: 10187 - DNA, 22 bp, Artificial Sequence
  Synthetic
gaaacaaaagaacaaaagcatg

SEQ ID NO: 10188 - DNA, 23 bp, Artificial Sequence
  Synthetic
aagtttcttgaggagttaaatgc

SEQ ID NO: 10189 - DNA, 22 bp, Artificial Sequence
  Synthetic
tgatctatgtatgatggtacga

SEQ ID NO: 10190 - DNA, 21 bp, Artificial Sequence
  Synthetic
actgtttggcatgtttacagt

SEQ ID NO: 10191 - DNA, 23 bp, Artificial Sequence
  Synthetic
tacaatttatagagactgaagcc

SEQ ID NO: 10192 - DNA, 18 bp, Artificial Sequence
  Synthetic
atcgttgtgtgtgtcgcc

SEQ ID NO: 10193 - DNA, 25 bp, Artificial Sequence
  Synthetic
tgtagaagagtatcaaatacttgca

SEQ ID NO: 10194 - DNA, 21 bp, Artificial Sequence
  Synthetic
gcagatgtagaacctaatgct

SEQ ID NO: 10195 - DNA, 20 bp, Artificial Sequence
  Synthetic
catggggactaacagatacc

SEQ ID NO: 10196 - DNA, 18 bp, Artificial Sequence
  Synthetic
caatcgacgaaggaagcg

SEQ ID NO: 10197 - DNA, 18 bp, Artificial Sequence
  Synthetic
cgcaaaagggacactgta

SEQ ID NO: 10198 - DNA, 18 bp, Artificial Sequence
  Synthetic
cgtgtaacatcccagggc

SEQ ID NO: 10199 - DNA, 18 bp, Artificial Sequence
  Synthetic
cagtgctgtcctagaggt

SEQ ID NO: 10200 - DNA, 18 bp, Artificial Sequence
  Synthetic
ccccagggctttccaaag

SEQ ID NO: 10201 - DNA, 21 bp, Artificial Sequence
  Synthetic
gagcctttactaaatgctgac

SEQ ID NO: 10202 - DNA, 25 bp, Artificial Sequence
  Synthetic
ctgatacattttatttgcatccttc

SEQ ID NO: 10203 - DNA, 23 bp, Artificial Sequence
  Synthetic
aaaactgttgttattcctaaggt

SEQ ID NO: 10204 - DNA, 23 bp, Artificial Sequence
  Synthetic
atgtctaatgatccatatggcag

SEQ ID NO: 10205 - DNA, 20 bp, Artificial Sequence
  Synthetic
ctcttactgctgatgtgttg

SEQ ID NO: 10206 - DNA, 18 bp, Artificial Sequence
  Synthetic
ggcaaggccttccacatg

SEQ ID NO: 10207 - DNA, 20 bp, Artificial Sequence
  Synthetic
acccttagatgtggacgaga

SEQ ID NO: 10208 - DNA, 20 bp, Artificial Sequence
  Synthetic
cattgggagaacaggggtac

SEQ ID NO: 10209 - DNA, 18 bp, Artificial Sequence
  Synthetic
gggcatgacatcagcgac

SEQ ID NO: 10210 - DNA, 17 bp, Artificial Sequence
  Synthetic
agaccctgcgctccatg

SEQ ID NO: 10211 - DNA, 16 bp, Artificial Sequence
  Synthetic
tgagtcccgctggctg

SEQ ID NO: 10212 - DNA, 23 bp, Artificial Sequence
  Synthetic
cacaaaacaaactatctccccta

SEQ ID NO: 10213 - DNA, 18 bp, Artificial Sequence
  Synthetic
tgtgtccaccccagtccc

SEQ ID NO: 10214 - DNA, 17 bp, Artificial Sequence
  Synthetic
cggggccaccttcatca

SEQ ID NO: 10215 - DNA, 16 bp, Artificial Sequence
  Synthetic
tcagggtcccctcgga

SEQ ID NO: 10216 - DNA, 18 bp, Artificial Sequence
  Synthetic
cccaggatgtcccccaga

SEQ ID NO: 10217 - DNA, 18 bp, Artificial Sequence
  Synthetic
acacccaggcacacacta

SEQ ID NO: 10218 - DNA, 20 bp, Artificial Sequence
  Synthetic
ggcttgtttgtgacttcacc

SEQ ID NO: 10219 - DNA, 19 bp, Artificial Sequence
  Synthetic
ctaagcccaacactccacc

SEQ ID NO: 10220 - DNA, 19 bp, Artificial Sequence
  Synthetic
caacacgaccccaaggaag

SEQ ID NO: 10221 - DNA, 17 bp, Artificial Sequence
  Synthetic
ggggtgtcttggggact

SEQ ID NO: 10222 - DNA, 17 bp, Artificial Sequence
  Synthetic
actcgtccgcctactgg

SEQ ID NO: 10223 - DNA, 17 bp, Artificial Sequence
  Synthetic
ccccccttgttgaggca

SEQ ID NO: 10224 - DNA, 17 bp, Artificial Sequence
  Synthetic
tgctggttggggaagga

SEQ ID NO: 10225 - DNA, 19 bp, Artificial Sequence
  Synthetic
atctgctgactgaaacccg

SEQ ID NO: 10226 - DNA, 16 bp, Artificial Sequence
  Synthetic
gccgaggcatagcgca

SEQ ID NO: 10227 - DNA, 18 bp, Artificial Sequence
  Synthetic
gggcctcctggatgatgg

SEQ ID NO: 10228 - DNA, 17 bp, Artificial Sequence
  Synthetic
aagcgtccagtctggcc

SEQ ID NO: 10229 - DNA, 20 bp, Artificial Sequence
  Synthetic
aggagagataatcggaggcc

SEQ ID NO: 10230 - DNA, 20 bp, Artificial Sequence
  Synthetic
gtcctcctcatctaccccag

SEQ ID NO: 10231 - DNA, 20 bp, Artificial Sequence
  Synthetic
cggacatggataggaaaggc

SEQ ID NO: 10232 - DNA, 18 bp, Artificial Sequence
  Synthetic
gttcctgccgttacccag

SEQ ID NO: 10233 - DNA, 16 bp, Artificial Sequence
  Synthetic
gcgtcccggcacacat

SEQ ID NO: 10234 - DNA, 16 bp, Artificial Sequence
  Synthetic
gggagcacagcctcca

SEQ ID NO: 10235 - DNA, 17 bp, Artificial Sequence
  Synthetic
gagagcgggttttgggc

SEQ ID NO: 10236 - DNA, 17 bp, Artificial Sequence
  Synthetic
tggaaacgaagctgccg

SEQ ID NO: 10237 - DNA, 19 bp, Artificial Sequence
  Synthetic
gcgagtactatcggctggt

SEQ ID NO: 10238 - DNA, 16 bp, Artificial Sequence
  Synthetic
caacctgtgcgccgag

SEQ ID NO: 10239 - DNA, 18 bp, Artificial Sequence
  Synthetic
tgagtgtggggccatacg

SEQ ID NO: 10240 - DNA, 19 bp, Artificial Sequence
  Synthetic
acggtcagtccatctcctt

SEQ ID NO: 10241 - DNA, 18 bp, Artificial Sequence
  Synthetic
aagtttggcccggtttgc

SEQ ID NO: 10242 - DNA, 16 bp, Artificial Sequence
  Synthetic
tccacactgagcccgg

SEQ ID NO: 10243 - DNA, 17 bp, Artificial Sequence
  Synthetic
cagcggctctgtgaggt

SEQ ID NO: 10244 - DNA, 17 bp, Artificial Sequence
  Synthetic
agagacgtccaggccca

SEQ ID NO: 10245 - DNA, 19 bp, Artificial Sequence
  Synthetic
tagccgggatcgatgatgc

SEQ ID NO: 10246 - DNA, 16 bp, Artificial Sequence
  Synthetic
tgctcttcctcgccgc

SEQ ID NO: 10247 - DNA, 19 bp, Artificial Sequence
  Synthetic
ttctgacgcttgtcttagt

SEQ ID NO: 10248 - DNA, 18 bp, Artificial Sequence
  Synthetic
acccccaaccattcacct

SEQ ID NO: 10249 - DNA, 17 bp, Artificial Sequence
  Synthetic
gccccggggaaacttct

SEQ ID NO: 10250 - DNA, 18 bp, Artificial Sequence
  Synthetic
gccgtgtgaagctcttga

SEQ ID NO: 10251 - DNA, 20 bp, Artificial Sequence
  Synthetic
gtcatcttgcagatcctggc

SEQ ID NO: 10252 - DNA, 16 bp, Artificial Sequence
  Synthetic
gtcccccaccacgtct

SEQ ID NO: 10253 - DNA, 18 bp, Artificial Sequence
  Synthetic
ctcggtgtcactgttgcc

SEQ ID NO: 10254 - DNA, 19 bp, Artificial Sequence
  Synthetic
attaggcgactctgcatca

SEQ ID NO: 10255 - DNA, 20 bp, Artificial Sequence
  Synthetic
tgctctcagttaacgagcag

SEQ ID NO: 10256 - DNA, 19 bp, Artificial Sequence
  Synthetic
ccagtgacgaagacccatc

SEQ ID NO: 10257 - DNA, 18 bp, Artificial Sequence
  Synthetic
catcccaggcaacctcca

SEQ ID NO: 10258 - DNA, 20 bp, Artificial Sequence
  Synthetic
ccacggctgttagaatgtgc

SEQ ID NO: 10259 - DNA, 19 bp, Artificial Sequence
  Synthetic
ccagtatttggccaggtcc

SEQ ID NO: 10260 - DNA, 20 bp, Artificial Sequence
  Synthetic
tgaccatcgagtaccttccg

SEQ ID NO: 10261 - DNA, 20 bp, Artificial Sequence
  Synthetic
tctacatcgaggacctcggt

SEQ ID NO: 10262 - DNA, 16 bp, Artificial Sequence
  Synthetic
cgtggccaccaacgtc

SEQ ID NO: 10263 - DNA, 18 bp, Artificial Sequence
  Synthetic
agttcggggtccaggagg

SEQ ID NO: 10264 - DNA, 19 bp, Artificial Sequence
  Synthetic
agagtgcctctgagcatgg

SEQ ID NO: 10265 - DNA, 19 bp, Artificial Sequence
  Synthetic
tgtttgagatctgaggagg

SEQ ID NO: 10266 - DNA, 16 bp, Artificial Sequence
  Synthetic
ccatggcgcggtgtca

SEQ ID NO: 10267 - DNA, 20 bp, Artificial Sequence
  Synthetic
agttcaggttccacatctgc

SEQ ID NO: 10268 - DNA, 17 bp, Artificial Sequence
  Synthetic
cctggtgaggtgtgcca

SEQ ID NO: 10269 - DNA, 18 bp, Artificial Sequence
  Synthetic
cctctttctggacggggc

SEQ ID NO: 10270 - DNA, 18 bp, Artificial Sequence
  Synthetic
catagctcgagggcccca

SEQ ID NO: 10271 - DNA, 18 bp, Artificial Sequence
  Synthetic
tccagaagccagggaggg

SEQ ID NO: 10272 - DNA, 18 bp, Artificial Sequence
  Synthetic
ccatccactgccgtgatg

SEQ ID NO: 10273 - DNA, 18 bp, Artificial Sequence
  Synthetic
ctggagatccccgtgact

SEQ ID NO: 10274 - DNA, 23 bp, Artificial Sequence
  Synthetic
aggaaaaacataacaatcttgtg

SEQ ID NO: 10275 - DNA, 17 bp, Artificial Sequence
  Synthetic
tgtaggcggggagatgc

SEQ ID NO: 10276 - DNA, 16 bp, Artificial Sequence
  Synthetic
agcccgctctctgtcc

SEQ ID NO: 10277 - DNA, 17 bp, Artificial Sequence
  Synthetic
acggtatgcaggggctg

SEQ ID NO: 10278 - DNA, 20 bp, Artificial Sequence
  Synthetic
atgctctccttcctctgagc

SEQ ID NO: 10279 - DNA, 17 bp, Artificial Sequence
  Synthetic
acacaggccccgaactc

SEQ ID NO: 10280 - DNA, 17 bp, Artificial Sequence
  Synthetic
tcgtctgcaccccagtg

SEQ ID NO: 10281 - DNA, 18 bp, Artificial Sequence
  Synthetic
atagcgggcacaatggtg

SEQ ID NO: 10282 - DNA, 20 bp, Artificial Sequence
  Synthetic
taatgatgaggagcaccgga

SEQ ID NO: 10283 - DNA, 18 bp, Artificial Sequence
  Synthetic
tggcgtttaccggacaca

SEQ ID NO: 10284 - DNA, 17 bp, Artificial Sequence
  Synthetic
ctcaaggcgaggctcct

SEQ ID NO: 10285 - DNA, 18 bp, Artificial Sequence
  Synthetic
tggatctggggcagttcc

SEQ ID NO: 10286 - DNA, 18 bp, Artificial Sequence
  Synthetic
catcagggtcttgccgtc

SEQ ID NO: 10287 - DNA, 16 bp, Artificial Sequence
  Synthetic
cggcgatggagaggca

SEQ ID NO: 10288 - DNA, 19 bp, Artificial Sequence
  Synthetic
cacatcctccttcttggcc

SEQ ID NO: 10289 - DNA, 20 bp, Artificial Sequence
  Synthetic
atgggaactcgtagacctca

SEQ ID NO: 10290 - DNA, 16 bp, Artificial Sequence
  Synthetic
tcccagggacccgaga

SEQ ID NO: 10291 - DNA, 19 bp, Artificial Sequence
  Synthetic
gccaggtggttacaggaga

SEQ ID NO: 10292 - DNA, 18 bp, Artificial Sequence
  Synthetic
aaactggaccacttcggc

SEQ ID NO: 10293 - DNA, 20 bp, Artificial Sequence
  Synthetic
cgtagaggacggaattggtg

SEQ ID NO: 10294 - DNA, 15 bp, Artificial Sequence
  Synthetic
aaggagcggcaccgt

SEQ ID NO: 10295 - DNA, 18 bp, Artificial Sequence
  Synthetic
tacgtgcgtgtctttgcc

SEQ ID NO: 10296 - DNA, 16 bp, Artificial Sequence
  Synthetic
gaggtcgttggcggca

SEQ ID NO: 10297 - DNA, 22 bp, Artificial Sequence
  Synthetic
caacaataatttcctgtgcaca

SEQ ID NO: 10298 - DNA, 19 bp, Artificial Sequence
  Synthetic
ttggagaaactgttgcaga

SEQ ID NO: 10299 - DNA, 21 bp, Artificial Sequence
  Synthetic
ccctggcattgtttaatgaac

SEQ ID NO: 10300 - DNA, 23 bp, Artificial Sequence
  Synthetic
caaaagctgttttgtaacatgtt

SEQ ID NO: 10301 - DNA, 25 bp, Artificial Sequence
  Synthetic
cctaacaaattaccatttaatgagg

SEQ ID NO: 10302 - DNA, 18 bp, Artificial Sequence
  Synthetic
gcatagagcagctggaaa

SEQ ID NO: 10303 - DNA, 19 bp, Artificial Sequence
  Synthetic
gttcacgacctattcctga

SEQ ID NO: 10304 - DNA, 23 bp, Artificial Sequence
  Synthetic
taggttttgcagaaaatattgtg

SEQ ID NO: 10305 - DNA, 19 bp, Artificial Sequence
  Synthetic
gcagaccactggaaaactg

SEQ ID NO: 10306 - DNA, 24 bp, Artificial Sequence
  Synthetic
ttacaaaaccatgtaaagataggc

SEQ ID NO: 10307 - DNA, 25 bp, Artificial Sequence
  Synthetic
gctcatattaatgtaatgaatccac

SEQ ID NO: 10308 - DNA, 25 bp, Artificial Sequence
  Synthetic
ctctacaaataaatctgcaaacttg

SEQ ID NO: 10309 - DNA, 22 bp, Artificial Sequence
  Synthetic
agcaggggaaaataaaaacaac

SEQ ID NO: 10310 - DNA, 18 bp, Artificial Sequence
  Synthetic
ggatggctcttgggaaac

SEQ ID NO: 10311 - DNA, 22 bp, Artificial Sequence
  Synthetic
gggaaaagcagtttttacagaa

SEQ ID NO: 10312 - DNA, 22 bp, Artificial Sequence
  Synthetic
gaggatgaactattactggacc

SEQ ID NO: 10313 - DNA, 19 bp, Artificial Sequence
  Synthetic
gagtgccaaattgaggatg

SEQ ID NO: 10314 - DNA, 22 bp, Artificial Sequence
  Synthetic
gcatggaaagtgtaagaaatgg

SEQ ID NO: 10315 - DNA, 18 bp, Artificial Sequence
  Synthetic
caaccgccaatttcactg

SEQ ID NO: 10316 - DNA, 23 bp, Artificial Sequence
  Synthetic
tgttgataccttgtaaattttgc

SEQ ID NO: 10317 - DNA, 24 bp, Artificial Sequence
  Synthetic
ggaaatatttgtattaggtgtcgc

SEQ ID NO: 10318 - DNA, 18 bp, Artificial Sequence
  Synthetic
cggtgcaagacttcgttt

SEQ ID NO: 10319 - DNA, 22 bp, Artificial Sequence
  Synthetic
agtttagatggtgatttggaaa

SEQ ID NO: 10320 - DNA, 20 bp, Artificial Sequence
  Synthetic
acagcggactagaatgttct

SEQ ID NO: 10321 - DNA, 20 bp, Artificial Sequence
  Synthetic
ggtaattgctgtgtatgctg

SEQ ID NO: 10322 - DNA, 23 bp, Artificial Sequence
  Synthetic
agtatgaaccctaatgtatacgc

SEQ ID NO: 10323 - DNA, 23 bp, Artificial Sequence
  Synthetic
gaccaaaagtacaaatatttgca

SEQ ID NO: 10324 - DNA, 18 bp, Artificial Sequence
  Synthetic
gtcagattgaccactggc

SEQ ID NO: 10325 - DNA, 20 bp, Artificial Sequence
  Synthetic
tgtttgcccctgttactagc

SEQ ID NO: 10326 - DNA, 20 bp, Artificial Sequence
  Synthetic
caagggtcgaacagaaaccg

SEQ ID NO: 10327 - DNA, 18 bp, Artificial Sequence
  Synthetic
gacatcacgggagacttg

SEQ ID NO: 10328 - DNA, 23 bp, Artificial Sequence
  Synthetic
cctacagtagattggtctttagg

SEQ ID NO: 10329 - DNA, 18 bp, Artificial Sequence
  Synthetic
tgtttttcgggggcttgg

SEQ ID NO: 10330 - DNA, 19 bp, Artificial Sequence
  Synthetic
gttgaccttttacctggtg

SEQ ID NO: 10331 - DNA, 23 bp, Artificial Sequence
  Synthetic
ttcagtttgataatccagcattt

SEQ ID NO: 10332 - DNA, 24 bp, Artificial Sequence
  Synthetic
accattaacacagaagaacctata

SEQ ID NO: 10333 - DNA, 19 bp, Artificial Sequence
  Synthetic
ccagcaagtggtaaggtat

SEQ ID NO: 10334 - DNA, 25 bp, Artificial Sequence
  Synthetic
ttataatcctgataaggaacgtcta

SEQ ID NO: 10335 - DNA, 21 bp, Artificial Sequence
  Synthetic
agagaacaatgttatgccagg

SEQ ID NO: 10336 - DNA, 19 bp, Artificial Sequence
  Synthetic
aaaatgcggacgtaagaga

SEQ ID NO: 10337 - DNA, 20 bp, Artificial Sequence
  Synthetic
gctttgcaagacaatcaagg

SEQ ID NO: 10338 - DNA, 18 bp, Artificial Sequence
  Synthetic
tttacgaggtagccaggt

SEQ ID NO: 10339 - DNA, 18 bp, Artificial Sequence
  Synthetic
catccgttcttcacagga

SEQ ID NO: 10340 - DNA, 21 bp, Artificial Sequence
  Synthetic
cttagaaaaatcttcgcagcg

SEQ ID NO: 10341 - DNA, 22 bp, Artificial Sequence
  Synthetic
atcagaggatatagcttgcaaa

SEQ ID NO: 10342 - DNA, 18 bp, Artificial Sequence
  Synthetic
ccccttgaggcatttgtg

SEQ ID NO: 10343 - DNA, 19 bp, Artificial Sequence
  Synthetic
aacatactgcagcttgtgg

SEQ ID NO: 10344 - DNA, 20 bp, Artificial Sequence
  Synthetic
attcgtggaactttcagtca

SEQ ID NO: 10345 - DNA, 22 bp, Artificial Sequence
  Synthetic
atagggatgttttgatcgaatc

SEQ ID NO: 10346 - DNA, 20 bp, Artificial Sequence
  Synthetic
ctgtggctccaaatacagat

SEQ ID NO: 10347 - DNA, 18 bp, Artificial Sequence
  Synthetic
caaactagacgctcgcat

SEQ ID NO: 10348 - DNA, 19 bp, Artificial Sequence
  Synthetic
ctctggaagcaaaggtttc

SEQ ID NO: 10349 - DNA, 18 bp, Artificial Sequence
  Synthetic
atcgcccaacaattttcc

SEQ ID NO: 10350 - DNA, 23 bp, Artificial Sequence
  Synthetic
gagcaagaatttgtaagaaacag

SEQ ID NO: 10351 - DNA, 20 bp, Artificial Sequence
  Synthetic
tagactagttctgcgccttt

SEQ ID NO: 10352 - DNA, 18 bp, Artificial Sequence
  Synthetic
tctcgaagccgtagaagc

SEQ ID NO: 10353 - DNA, 21 bp, Artificial Sequence
  Synthetic
agttcattcgttttgtatcgt

SEQ ID NO: 10354 - DNA, 20 bp, Artificial Sequence
  Synthetic
ccctgttttcttctcggaaa

SEQ ID NO: 10355 - DNA, 22 bp, Artificial Sequence
  Synthetic
ctattcaactaaatggagcact

SEQ ID NO: 10356 - DNA, 18 bp, Artificial Sequence
  Synthetic
ctagacgggcgatttctg

SEQ ID NO: 10357 - DNA, 21 bp, Artificial Sequence
  Synthetic
ggtatcgtaacgaatagccaa

SEQ ID NO: 10358 - DNA, 18 bp, Artificial Sequence
  Synthetic
ccaacacttccgcgattt

SEQ ID NO: 10359 - DNA, 21 bp, Artificial Sequence
  Synthetic
tggcagattctttttcgtgaa

SEQ ID NO: 10360 - DNA, 21 bp, Artificial Sequence
  Synthetic
aaagccttttagtcattccaa

SEQ ID NO: 10361 - DNA, 18 bp, Artificial Sequence
  Synthetic
atgacagagacacgacga

SEQ ID NO: 10362 - DNA, 20 bp, Artificial Sequence
  Synthetic
agcaatagtcctttccatcg

SEQ ID NO: 10363 - DNA, 21 bp, Artificial Sequence
  Synthetic
atctctagaaacttgtgcaga

SEQ ID NO: 10364 - DNA, 23 bp, Artificial Sequence
  Synthetic
tgcagaagctaagtttatcaaac

SEQ ID NO: 10365 - DNA, 20 bp, Artificial Sequence
  Synthetic
acgaataacaccacgatagc

SEQ ID NO: 10366 - DNA, 19 bp, Artificial Sequence
  Synthetic
tgggcagaatcttatccag

SEQ ID NO: 10367 - DNA, 21 bp, Artificial Sequence
  Synthetic
ccaactcctgtaatacatggt

SEQ ID NO: 10368 - DNA, 18 bp, Artificial Sequence
  Synthetic
ggagagtctcatgaccac

SEQ ID NO: 10369 - DNA, 21 bp, Artificial Sequence
  Synthetic
atttccttcattacgacagga

SEQ ID NO: 10370 - DNA, 19 bp, Artificial Sequence
  Synthetic
gatctcgcatagctgaagg

SEQ ID NO: 10371 - DNA, 21 bp, Artificial Sequence
  Synthetic
ccccaatttttcatgaagagc

SEQ ID NO: 10372 - DNA, 19 bp, Artificial Sequence
  Synthetic
gtgaactcaagctcttcac

SEQ ID NO: 10373 - DNA, 21 bp, Artificial Sequence
  Synthetic
taagacgttgctcttatcacc

SEQ ID NO: 10374 - DNA, 20 bp, Artificial Sequence
  Synthetic
taatttcgccacaagaccac

SEQ ID NO: 10375 - DNA, 18 bp, Artificial Sequence
  Synthetic
gaagtcaacccatccacc

SEQ ID NO: 10376 - DNA, 21 bp, Artificial Sequence
  Synthetic
caattgcacttcaaactcaac

SEQ ID NO: 10377 - DNA, 23 bp, Artificial Sequence
  Synthetic
aactgtgtatgaggtttaacact

SEQ ID NO: 10378 - DNA, 22 bp, Artificial Sequence
  Synthetic
atcacaaaccataacaatacga

SEQ ID NO: 10379 - DNA, 21 bp, Artificial Sequence
  Synthetic
catgctttctgtagaaaaacg

SEQ ID NO: 10380 - DNA, 18 bp, Artificial Sequence
  Synthetic
tagcttcaacacgcctct

SEQ ID NO: 10381 - DNA, 18 bp, Artificial Sequence
  Synthetic
ctcctcttcctgctgttg

SEQ ID NO: 10382 - DNA, 20 bp, Artificial Sequence
  Synthetic
agcgctcttaaacaatctca

SEQ ID NO: 10383 - DNA, 23 bp, Artificial Sequence
  Synthetic
caagcatcacaagatttatagcc

SEQ ID NO: 10384 - DNA, 18 bp, Artificial Sequence
  Synthetic
aactgctccaaaacctga

SEQ ID NO: 10385 - DNA, 23 bp, Artificial Sequence
  Synthetic
agtttgaaactccaatactcttc

SEQ ID NO: 10386 - DNA, 22 bp, Artificial Sequence
  Synthetic
taataaccgtatccgtttgact

SEQ ID NO: 10387 - DNA, 20 bp, Artificial Sequence
  Synthetic
tcaggagacgagaaatcaac

SEQ ID NO: 10388 - DNA, 18 bp, Artificial Sequence
  Synthetic
tgtcattctcggagcaac

SEQ ID NO: 10389 - DNA, 21 bp, Artificial Sequence
  Synthetic
tttccatatttcgtgattgca

SEQ ID NO: 10390 - DNA, 21 bp, Artificial Sequence
  Synthetic
gtggaaaagctttgttagagg

SEQ ID NO: 10391 - DNA, 18 bp, Artificial Sequence
  Synthetic
gctgttgtgttcaaagct

SEQ ID NO: 10392 - DNA, 19 bp, Artificial Sequence
  Synthetic
aaaatcctcgctatcccct

SEQ ID NO: 10393 - DNA, 18 bp, Artificial Sequence
  Synthetic
attgatccgagcaaggga

SEQ ID NO: 10394 - DNA, 18 bp, Artificial Sequence
  Synthetic
gcccggaattggatttgg

SEQ ID NO: 10395 - DNA, 20 bp, Artificial Sequence
  Synthetic
ctttggatagagaagctgct

SEQ ID NO: 10396 - DNA, 18 bp, Artificial Sequence
  Synthetic
ctcaagcgtacgtccttc

SEQ ID NO: 10397 - DNA, 18 bp, Artificial Sequence
  Synthetic
acaagaagcggtgtgaag

SEQ ID NO: 10398 - DNA, 18 bp, Artificial Sequence
  Synthetic
cgttcgttgcagacttac

SEQ ID NO: 10399 - DNA, 19 bp, Artificial Sequence
  Synthetic
gacgttactgcatcttctg

SEQ ID NO: 10400 - DNA, 21 bp, Artificial Sequence
  Synthetic
ttaaatcccttcccattcagg

SEQ ID NO: 10401 - DNA, 22 bp, Artificial Sequence
  Synthetic
gactctgaaggtaatatcgagt

SEQ ID NO: 10402 - DNA, 21 bp, Artificial Sequence
  Synthetic
gaatttaatccctcttcgacc

SEQ ID NO: 10403 - DNA, 19 bp, Artificial Sequence
  Synthetic
ttcaggaacagcttgtgtg

SEQ ID NO: 10404 - DNA, 20 bp, Artificial Sequence
  Synthetic
gcctagtcctggtaaaactg

SEQ ID NO: 10405 - DNA, 19 bp, Artificial Sequence
  Synthetic
aaaggagtcggaccatgaa

SEQ ID NO: 10406 - DNA, 22 bp, Artificial Sequence
  Synthetic
ccagctttctgtaaaaagacaa

SEQ ID NO: 10407 - DNA, 19 bp, Artificial Sequence
  Synthetic
agaaaattgcggaggaacc

SEQ ID NO: 10408 - DNA, 18 bp, Artificial Sequence
  Synthetic
gcatcttcaggaaccgta

SEQ ID NO: 10409 - DNA, 25 bp, Artificial Sequence
  Synthetic
atctactaagccctatattaaagtc

SEQ ID NO: 10410 - DNA, 21 bp, Artificial Sequence
  Synthetic
caaaaccgatacagaacatct

SEQ ID NO: 10411 - DNA, 19 bp, Artificial Sequence
  Synthetic
ctgtccatacactaagcca

SEQ ID NO: 10412 - DNA, 18 bp, Artificial Sequence
  Synthetic
ccattccaccatctgagc

SEQ ID NO: 10413 - DNA, 20 bp, Artificial Sequence
  Synthetic
taaaaagtgagcaacgaacc

SEQ ID NO: 10414 - DNA, 22 bp, Artificial Sequence
  Synthetic
ttttcgttacactcttatctgg

SEQ ID NO: 10415 - DNA, 23 bp, Artificial Sequence
  Synthetic
taattccataagtagtttctgca

SEQ ID NO: 10416 - DNA, 19 bp, Artificial Sequence
  Synthetic
gacatcaacccgaacttct

SEQ ID NO: 10417 - DNA, 19 bp, Artificial Sequence
  Synthetic
tacggccattatgaacctc

SEQ ID NO: 10418 - DNA, 23 bp, Artificial Sequence
  Synthetic
ttctctcttttttgttgatacga

SEQ ID NO: 10419 - DNA, 22 bp, Artificial Sequence
  Synthetic
gcttacattcaagatgagagaa

SEQ ID NO: 10420 - DNA, 20 bp, Artificial Sequence
  Synthetic
ttagaagaactttgcgagca

SEQ ID NO: 10421 - DNA, 22 bp, Artificial Sequence
  Synthetic
ccttctgacttcatgatcatca

SEQ ID NO: 10422 - DNA, 19 bp, Artificial Sequence
  Synthetic
aactattcccgtcaccaat

SEQ ID NO: 10423 - DNA, 18 bp, Artificial Sequence
  Synthetic
agaacaaacgaaggagct

SEQ ID NO: 10424 - DNA, 18 bp, Artificial Sequence
  Synthetic
ccgcttttggtttcttcc

SEQ ID NO: 10425 - DNA, 20 bp, Artificial Sequence
  Synthetic
tagaagctatggccaaaacg

SEQ ID NO: 10426 - DNA, 18 bp, Artificial Sequence
  Synthetic
ttcgataacagaccgctc

SEQ ID NO: 10427 - DNA, 18 bp, Artificial Sequence
  Synthetic
gctggaaactcctatccg

SEQ ID NO: 10428 - DNA, 18 bp, Artificial Sequence
  Synthetic
atcgatggagctgtaggc

SEQ ID NO: 10429 - DNA, 18 bp, Artificial Sequence
  Synthetic
taacgcacgggaaaaagt

SEQ ID NO: 10430 - DNA, 22 bp, Artificial Sequence
  Synthetic
tttcgaaaccataccattactc

SEQ ID NO: 10431 - DNA, 19 bp, Artificial Sequence
  Synthetic
tctttatcagggagagggc

SEQ ID NO: 10432 - DNA, 19 bp, Artificial Sequence
  Synthetic
gaaacgcaaacatggggta

SEQ ID NO: 10433 - DNA, 21 bp, Artificial Sequence
  Synthetic
tttgtaattgctggttttcct

SEQ ID NO: 10434 - DNA, 20 bp, Artificial Sequence
  Synthetic
atggcacgtcttaaaagagc

SEQ ID NO: 10435 - DNA, 18 bp, Artificial Sequence
  Synthetic
acaagatcagtggcaagc

SEQ ID NO: 10436 - DNA, 18 bp, Artificial Sequence
  Synthetic
aatgcgcacagagaactc

SEQ ID NO: 10437 - DNA, 24 bp, Artificial Sequence
  Synthetic
aatacttccactatatccccttag

SEQ ID NO: 10438 - DNA, 23 bp, Artificial Sequence
  Synthetic
catatccttgttgatgttcttga

SEQ ID NO: 10439 - DNA, 21 bp, Artificial Sequence
  Synthetic
cgcctatggattaaaaatggg

SEQ ID NO: 10440 - DNA, 23 bp, Artificial Sequence
  Synthetic
atctggattattagcaaagactt

SEQ ID NO: 10441 - DNA, 19 bp, Artificial Sequence
  Synthetic
acgggatcaccttttctca

SEQ ID NO: 10442 - DNA, 18 bp, Artificial Sequence
  Synthetic
ctcttgtgcatgcgacat

SEQ ID NO: 10443 - DNA, 20 bp, Artificial Sequence
  Synthetic
atcagaaggtagggggattc

SEQ ID NO: 10444 - DNA, 20 bp, Artificial Sequence
  Synthetic
gggacaataatgaaggcctt

SEQ ID NO: 10445 - DNA, 18 bp, Artificial Sequence
  Synthetic
cggacgttatggaccagt

SEQ ID NO: 10446 - DNA, 18 bp, Artificial Sequence
  Synthetic
tcgaagacaacagggaac

SEQ ID NO: 10447 - DNA, 22 bp, Artificial Sequence
  Synthetic
caggagcttttaaaattacagg

SEQ ID NO: 10448 - DNA, 18 bp, Artificial Sequence
  Synthetic
agctcgtggtcaagaaga

SEQ ID NO: 10449 - DNA, 20 bp, Artificial Sequence
  Synthetic
aaaaccccctctttagaaga

SEQ ID NO: 10450 - DNA, 20 bp, Artificial Sequence
  Synthetic
aaactttggaagatgctgga

SEQ ID NO: 10451 - DNA, 23 bp, Artificial Sequence
  Synthetic
gaaagggatttgttctgttttac

SEQ ID NO: 10452 - DNA, 18 bp, Artificial Sequence
  Synthetic
ctttgccggaaattgctc

SEQ ID NO: 10453 - DNA, 22 bp, Artificial Sequence
  Synthetic
taatgggagtggaaatggatac

SEQ ID NO: 10454 - DNA, 18 bp, Artificial Sequence
  Synthetic
cttttgcgtatggctacc

SEQ ID NO: 10455 - DNA, 22 bp, Artificial Sequence
  Synthetic
tagtgacaatagtaggagaagc

SEQ ID NO: 10456 - DNA, 20 bp, Artificial Sequence
  Synthetic
cgtgatatagctatcccgga

SEQ ID NO: 10457 - DNA, 22 bp, Artificial Sequence
  Synthetic
gtggagaagtagactttgagtt

SEQ ID NO: 10458 - DNA, 23 bp, Artificial Sequence
  Synthetic
cttttactgctaagattggatcg

SEQ ID NO: 10459 - DNA, 18 bp, Artificial Sequence
  Synthetic
aggaaacgccatctttcc

SEQ ID NO: 10460 - DNA, 19 bp, Artificial Sequence
  Synthetic
tgttgtttcggagagaagg

SEQ ID NO: 10461 - DNA, 19 bp, Artificial Sequence
  Synthetic
aacttgcttctcagtgagg

SEQ ID NO: 10462 - DNA, 20 bp, Artificial Sequence
  Synthetic
catctctctcgctatctgat

SEQ ID NO: 10463 - DNA, 18 bp, Artificial Sequence
  Synthetic
cgaatcgcccttattggt

SEQ ID NO: 10464 - DNA, 22 bp, Artificial Sequence
  Synthetic
agagatacaaagtgtcttgagt

SEQ ID NO: 10465 - DNA, 21 bp, Artificial Sequence
  Synthetic
gagatcctttttgcaagagaa

SEQ ID NO: 10466 - DNA, 21 bp, Artificial Sequence
  Synthetic
ataacgattacttgcttgtgc

SEQ ID NO: 10467 - DNA, 19 bp, Artificial Sequence
  Synthetic
gactacagtctctcctggg

SEQ ID NO: 10468 - DNA, 23 bp, Artificial Sequence
  Synthetic
ccctaattttatgctaagtgggt

SEQ ID NO: 10469 - DNA, 20 bp, Artificial Sequence
  Synthetic
gcagagaatcctttctgttt

SEQ ID NO: 10470 - DNA, 20 bp, Artificial Sequence
  Synthetic
ttggcttggattacgaatgt

SEQ ID NO: 10471 - DNA, 18 bp, Artificial Sequence
  Synthetic
tattgtctccggcttgtg

SEQ ID NO: 10472 - DNA, 18 bp, Artificial Sequence
  Synthetic
caactgtttccgcagctt

SEQ ID NO: 10473 - DNA, 19 bp, Artificial Sequence
  Synthetic
agttcgttgctatccacat

SEQ ID NO: 10474 - DNA, 20 bp, Artificial Sequence
  Synthetic
aacacttttgagctgctatc

SEQ ID NO: 10475 - DNA, 18 bp, Artificial Sequence
  Synthetic
caccccagagttgtcttt

SEQ ID NO: 10476 - DNA, 21 bp, Artificial Sequence
  Synthetic
atgcttttttggttatgcatg

SEQ ID NO: 10477 - DNA, 22 bp, Artificial Sequence
  Synthetic
aaaatttccaggggatagagaa

SEQ ID NO: 10478 - DNA, 18 bp, Artificial Sequence
  Synthetic
agaagtttgatgcggagg

SEQ ID NO: 10479 - DNA, 23 bp, Artificial Sequence
  Synthetic
gtttgtttttggccttatctttg

SEQ ID NO: 10480 - DNA, 18 bp, Artificial Sequence
  Synthetic
cgaacaatggaaagctgg

SEQ ID NO: 10481 - DNA, 20 bp, Artificial Sequence
  Synthetic
agatgccaaaatgacgattg

SEQ ID NO: 10482 - DNA, 18 bp, Artificial Sequence
  Synthetic
gctgggagagaaactgtg

SEQ ID NO: 10483 - DNA, 19 bp, Artificial Sequence
  Synthetic
aggctttttgggagttacc

SEQ ID NO: 10484 - DNA, 24 bp, Artificial Sequence
  Synthetic
ctttttattgctatagctaccgag

SEQ ID NO: 10485 - DNA, 20 bp, Artificial Sequence
  Synthetic
acaattgttaagcgcaatgg

SEQ ID NO: 10486 - DNA, 21 bp, Artificial Sequence
  Synthetic
ccaatattgaaaaggagcctg

SEQ ID NO: 10487 - DNA, 21 bp, Artificial Sequence
  Synthetic
caatcttggttttgttgatgc

SEQ ID NO: 10488 - DNA, 18 bp, Artificial Sequence
  Synthetic
ggatgaacggttctgcta

SEQ ID NO: 10489 - DNA, 19 bp, Artificial Sequence
  Synthetic
aagactaatcttccagcgt

SEQ ID NO: 10490 - DNA, 19 bp, Artificial Sequence
  Synthetic
acgctcgataatttgacgg

SEQ ID NO: 10491 - DNA, 22 bp, Artificial Sequence
  Synthetic
cagcagcagaatatctagagaa

SEQ ID NO: 10492 - DNA, 20 bp, Artificial Sequence
  Synthetic
agagatagggaaaagaggga

SEQ ID NO: 10493 - DNA, 19 bp, Artificial Sequence
  Synthetic
aagctacctgttccgagtt

SEQ ID NO: 10494 - DNA, 21 bp, Artificial Sequence
  Synthetic
gatcattgactgtgttagctt

SEQ ID NO: 10495 - DNA, 19 bp, Artificial Sequence
  Synthetic
attcccgtagttagtccgg

SEQ ID NO: 10496 - DNA, 23 bp, Artificial Sequence
  Synthetic
tatttttatcgcgaatagaaacg

SEQ ID NO: 10497 - DNA, 19 bp, Artificial Sequence
  Synthetic
gctttattgggactgggtt

SEQ ID NO: 10498 - DNA, 21 bp, Artificial Sequence
  Synthetic
gtactacgagagaagttcgtg

SEQ ID NO: 10499 - DNA, 23 bp, Artificial Sequence
  Synthetic
aaccatcaaaagcttctaaaagg

SEQ ID NO: 10500 - DNA, 20 bp, Artificial Sequence
  Synthetic
ttcgtctacaattgagaggc

SEQ ID NO: 10501 - DNA, 18 bp, Artificial Sequence
  Synthetic
caagcagcaggatccaat

SEQ ID NO: 10502 - DNA, 18 bp, Artificial Sequence
  Synthetic
tgggtataatcctgggcc

SEQ ID NO: 10503 - DNA, 21 bp, Artificial Sequence
  Synthetic
aacaagctttatgtggatcct

SEQ ID NO: 10504 - DNA, 24 bp, Artificial Sequence
  Synthetic
gatggaacgactgtttctttaaat

SEQ ID NO: 10505 - DNA, 20 bp, Artificial Sequence
  Synthetic
atacgccctaattcagctaa

SEQ ID NO: 10506 - DNA, 18 bp, Artificial Sequence
  Synthetic
acggagattctcgcctag

SEQ ID NO: 10507 - DNA, 20 bp, Artificial Sequence
  Synthetic
caccaaacggtcttatgaac

SEQ ID NO: 10508 - DNA, 22 bp, Artificial Sequence
  Synthetic
ggaaggatcctaagaaaactgg

SEQ ID NO: 10509 - DNA, 19 bp, Artificial Sequence
  Synthetic
ctgcagtcaaaggagttgg

SEQ ID NO: 10510 - DNA, 22 bp, Artificial Sequence
  Synthetic
actagaggagtacaaattgctt

SEQ ID NO: 10511 - DNA, 18 bp, Artificial Sequence
  Synthetic
ttagcgggcaattcctct

SEQ ID NO: 10512 - DNA, 20 bp, Artificial Sequence
  Synthetic
tcaagatttgagtcagtcgc

SEQ ID NO: 10513 - DNA, 21 bp, Artificial Sequence
  Synthetic
gcctcatacaagatcttcaga

SEQ ID NO: 10514 - DNA, 20 bp, Artificial Sequence
  Synthetic
cagtatcgtctaatggagca

SEQ ID NO: 10515 - DNA, 21 bp, Artificial Sequence
  Synthetic
atcattgggatcttgcacttt

SEQ ID NO: 10516 - DNA, 25 bp, Artificial Sequence
  Synthetic
gtttttctcattactcttgatgttg

SEQ ID NO: 10517 - DNA, 23 bp, Artificial Sequence
  Synthetic
caaaaactgctgataagtttcgt

SEQ ID NO: 10518 - DNA, 20 bp, Artificial Sequence
  Synthetic
ttcacaatcacattgcatga

SEQ ID NO: 10519 - DNA, 23 bp, Artificial Sequence
  Synthetic
aagaagtgtacaataaaagagga

SEQ ID NO: 10520 - DNA, 18 bp, Artificial Sequence
  Synthetic
agggtgcatgttgatcca

SEQ ID NO: 10521 - DNA, 18 bp, Artificial Sequence
  Synthetic
ccttggctgcaaaggaag

SEQ ID NO: 10522 - DNA, 24 bp, Artificial Sequence
  Synthetic
cctaagatcttctacaaatatcgc

SEQ ID NO: 10523 - DNA, 24 bp, Artificial Sequence
  Synthetic
gggtaattgacaataacatttgtg

SEQ ID NO: 10524 - DNA, 22 bp, Artificial Sequence
  Synthetic
aacatggatagagcagttaaac

SEQ ID NO: 10525 - DNA, 20 bp, Artificial Sequence
  Synthetic
gaaaacagaatggtgctggc

SEQ ID NO: 10526 - DNA, 19 bp, Artificial Sequence
  Synthetic
tgttgccaacaatcatcac

SEQ ID NO: 10527 - DNA, 25 bp, Artificial Sequence
  Synthetic
taggttttgtacagagatatgattg

SEQ ID NO: 10528 - DNA, 19 bp, Artificial Sequence
  Synthetic
aagaaatagcgttgctgtg

SEQ ID NO: 10529 - DNA, 18 bp, Artificial Sequence
  Synthetic
gctgcagcagttaaaacg

SEQ ID NO: 10530 - DNA, 23 bp, Artificial Sequence
  Synthetic
aaagaacttgttgatgtccattt

SEQ ID NO: 10531 - DNA, 23 bp, Artificial Sequence
  Synthetic
aatctttttttcaaaggctttgg

SEQ ID NO: 10532 - DNA, 21 bp, Artificial Sequence
  Synthetic
aaaagactgagggacatttgg

SEQ ID NO: 10533 - DNA, 19 bp, Artificial Sequence
  Synthetic
gtacccactcaacggaagc

SEQ ID NO: 10534 - DNA, 17 bp, Artificial Sequence
  Synthetic
cgggagcagaagcagga

SEQ ID NO: 10535 - DNA, 21 bp, Artificial Sequence
  Synthetic
attttgttgaaaggacaagcc

SEQ ID NO: 10536 - DNA, 18 bp, Artificial Sequence
  Synthetic
cactggatatgggccatt

SEQ ID NO: 10537 - DNA, 25 bp, Artificial Sequence
  Synthetic
ctcctgatagacaatttttagatgt

SEQ ID NO: 10538 - DNA, 22 bp, Artificial Sequence
  Synthetic
tccagaagttattcctacagaa

SEQ ID NO: 10539 - DNA, 18 bp, Artificial Sequence
  Synthetic
aatagtgatcgcctgctg

SEQ ID NO: 10540 - DNA, 22 bp, Artificial Sequence
  Synthetic
aggtattggacactgaaaatcc

SEQ ID NO: 10541 - DNA, 23 bp, Artificial Sequence
  Synthetic
atgaattttaaggccttatcagt

SEQ ID NO: 10542 - DNA, 20 bp, Artificial Sequence
  Synthetic
ccagtgaccagtctagaagt

SEQ ID NO: 10543 - DNA, 18 bp, Artificial Sequence
  Synthetic
ccgcttcactgatctctt

SEQ ID NO: 10544 - DNA, 20 bp, Artificial Sequence
  Synthetic
aacagacggaatttgtcctg

SEQ ID NO: 10545 - DNA, 25 bp, Artificial Sequence
  Synthetic
atcagttatatatgattgatcctgc

SEQ ID NO: 10546 - DNA, 23 bp, Artificial Sequence
  Synthetic
taagacattgcaagaaatgaagg

SEQ ID NO: 10547 - DNA, 20 bp, Artificial Sequence
  Synthetic
gtgttgctttgaaagattgc

SEQ ID NO: 10548 - DNA, 25 bp, Artificial Sequence
  Synthetic
atatgacagtttggtttatactgga

SEQ ID NO: 10549 - DNA, 23 bp, Artificial Sequence
  Synthetic
gttaaaaacattcctcgttatgc

SEQ ID NO: 10550 - DNA, 22 bp, Artificial Sequence
  Synthetic
ttgttacaacttcacttacacc

SEQ ID NO: 10551 - DNA, 23 bp, Artificial Sequence
  Synthetic
aaattgtattgtgcctttacagc

SEQ ID NO: 10552 - DNA, 18 bp, Artificial Sequence
  Synthetic
tttggcagtgatgcagaa

SEQ ID NO: 10553 - DNA, 21 bp, Artificial Sequence
  Synthetic
gacagcagtttgttaaagaga

SEQ ID NO: 10554 - DNA, 21 bp, Artificial Sequence
  Synthetic
gtgtcagataactgctgttga

SEQ ID NO: 10555 - DNA, 24 bp, Artificial Sequence
  Synthetic
gcagggtatttttaataaggctac

SEQ ID NO: 10556 - DNA, 22 bp, Artificial Sequence
  Synthetic
attgcttgcctattacaacatg

SEQ ID NO: 10557 - DNA, 23 bp, Artificial Sequence
  Synthetic
gcaatatgtgattttgaaattgc

SEQ ID NO: 10558 - DNA, 25 bp, Artificial Sequence
  Synthetic
gaaaattgagtataaacctgacttg

SEQ ID NO: 10559 - DNA, 21 bp, Artificial Sequence
  Synthetic
ttaagccatgagaaagcttcc

SEQ ID NO: 10560 - DNA, 21 bp, Artificial Sequence
  Synthetic
tacggcatggttttatccatt

SEQ ID NO: 10561 - DNA, 23 bp, Artificial Sequence
  Synthetic
attacgatgttatggctaatggt

SEQ ID NO: 10562 - DNA, 22 bp, Artificial Sequence
  Synthetic
gtgttctgattcaaaattctgc

SEQ ID NO: 10563 - DNA, 19 bp, Artificial Sequence
  Synthetic
ggcttgtcccattgttgtt

SEQ ID NO: 10564 - DNA, 20 bp, Artificial Sequence
  Synthetic
cgtgcggtataatcttgcta

SEQ ID NO: 10565 - DNA, 25 bp, Artificial Sequence
  Synthetic
tatcagctatttaaaggtttagcac

SEQ ID NO: 10566 - DNA, 23 bp, Artificial Sequence
  Synthetic
taggtattacagcggtaaaatgg

SEQ ID NO: 10567 - DNA, 19 bp, Artificial Sequence
  Synthetic
gtggttaaacctggtgaga

SEQ ID NO: 10568 - DNA, 23 bp, Artificial Sequence
  Synthetic
ttgtaattggtttgtacaaagtg

SEQ ID NO: 10569 - DNA, 23 bp, Artificial Sequence
  Synthetic
atgtttagtattacgttttgtgc

SEQ ID NO: 10570 - DNA, 24 bp, Artificial Sequence
  Synthetic
atttctgttttctctttgtggtac

SEQ ID NO: 10571 - DNA, 24 bp, Artificial Sequence
  Synthetic
atatatgaatgctaatggattgcg

SEQ ID NO: 10572 - DNA, 22 bp, Artificial Sequence
  Synthetic
aagtgcctgactagtattgaag

SEQ ID NO: 10573 - DNA, 22 bp, Artificial Sequence
  Synthetic
gttgtgtaccattgaatgcaat

SEQ ID NO: 10574 - DNA, 23 bp, Artificial Sequence
  Synthetic
ttactgttcaagatgctaaaggt

SEQ ID NO: 10575 - DNA, 19 bp, Artificial Sequence
  Synthetic
ggattcatatggtggtgcg

SEQ ID NO: 10576 - DNA, 19 bp, Artificial Sequence
  Synthetic
cgccagtggtttatctact

SEQ ID NO: 10577 - DNA, 24 bp, Artificial Sequence
  Synthetic
taatgtgtataaaaagctaggacc

SEQ ID NO: 10578 - DNA, 23 bp, Artificial Sequence
  Synthetic
gctaccattataaagaacttggt

SEQ ID NO: 10579 - DNA, 21 bp, Artificial Sequence
  Synthetic
ggacattaagcagttgttgtt

SEQ ID NO: 10580 - DNA, 20 bp, Artificial Sequence
  Synthetic
actatgactggcagaatgtt

SEQ ID NO: 10581 - DNA, 24 bp, Artificial Sequence
  Synthetic
ttcagtctttaacatatgtcaagc

SEQ ID NO: 10582 - DNA, 23 bp, Artificial Sequence
  Synthetic
cgtttttatgtcagaatccaaat

SEQ ID NO: 10583 - DNA, 21 bp, Artificial Sequence
  Synthetic
tacaatgacctgggtaatcag

SEQ ID NO: 10584 - DNA, 19 bp, Artificial Sequence
  Synthetic
tcttgtacaggatctccgt

SEQ ID NO: 10585 - DNA, 25 bp, Artificial Sequence
  Synthetic
tgtaggagatgtttttgttttaacc

SEQ ID NO: 10586 - DNA, 23 bp, Artificial Sequence
  Synthetic
ttgaatataaatgattgcactcg

SEQ ID NO: 10587 - DNA, 24 bp, Artificial Sequence
  Synthetic
aaagttctagtgctgtaaatatgc

SEQ ID NO: 10588 - DNA, 23 bp, Artificial Sequence
  Synthetic
agcattacagtttactacattga

SEQ ID NO: 10589 - DNA, 18 bp, Artificial Sequence
  Synthetic
cctgggttggctttgatg

SEQ ID NO: 10590 - DNA, 20 bp, Artificial Sequence
  Synthetic
tctgtctgattgtgttgtgc

SEQ ID NO: 10591 - DNA, 19 bp, Artificial Sequence
  Synthetic
cttaaagctgccatgctct

SEQ ID NO: 10592 - DNA, 21 bp, Artificial Sequence
  Synthetic
aataaacatgcattccacact

SEQ ID NO: 10593 - DNA, 21 bp, Artificial Sequence
  Synthetic
tacaaagcttggagaatgttg

SEQ ID NO: 10594 - DNA, 21 bp, Artificial Sequence
  Synthetic
ggtgtctgcatgtatacagat

SEQ ID NO: 10595 - DNA, 23 bp, Artificial Sequence
  Synthetic
atagctttagatcaagatgtgtt

SEQ ID NO: 10596 - DNA, 23 bp, Artificial Sequence
  Synthetic
agattttcagtttatgctttggt

SEQ ID NO: 10597 - DNA, 23 bp, Artificial Sequence
  Synthetic
gagtacaatgtgagtaaagatgg

SEQ ID NO: 10598 - DNA, 23 bp, Artificial Sequence
  Synthetic
attttccacttacccattttcag

SEQ ID NO: 10599 - DNA, 18 bp, Artificial Sequence
  Synthetic
gattggccattgcaccat

SEQ ID NO: 10600 - DNA, 22 bp, Artificial Sequence
  Synthetic
tatcatctaaagctggcaactc

SEQ ID NO: 10601 - DNA, 25 bp, Artificial Sequence
  Synthetic
cattaccactggttttgatcttaat

SEQ ID NO: 10602 - DNA, 24 bp, Artificial Sequence
  Synthetic
taccaaggttattaaagatcgtgt

SEQ ID NO: 10603 - DNA, 24 bp, Artificial Sequence
  Synthetic
ttatgcatattttacagacactgg

SEQ ID NO: 10604 - DNA, 18 bp, Artificial Sequence
  Synthetic
ctgttcagccaatcgcag

SEQ ID NO: 10605 - DNA, 21 bp, Artificial Sequence
  Synthetic
tactactgcaacaagttgtca

SEQ ID NO: 10606 - DNA, 24 bp, Artificial Sequence
  Synthetic
tcctgatcctattacatttacagg

SEQ ID NO: 10607 - DNA, 25 bp, Artificial Sequence
  Synthetic
ctctacggttttagagactacataa

SEQ ID NO: 10608 - DNA, 20 bp, Artificial Sequence
  Synthetic
cctgtaggtggtttgtatga

SEQ ID NO: 10609 - DNA, 24 bp, Artificial Sequence
  Synthetic
taaagtaaagttatctgatgtcgg

SEQ ID NO: 10610 - DNA, 25 bp, Artificial Sequence
  Synthetic
caacaactctctaatagatttggtg

SEQ ID NO: 10611 - DNA, 24 bp, Artificial Sequence
  Synthetic
cactttagttatgtccctactaag

SEQ ID NO: 10612 - DNA, 19 bp, Artificial Sequence
  Synthetic
gcaccagatttgtcacttg

SEQ ID NO: 10613 - DNA, 21 bp, Artificial Sequence
  Synthetic
gttaaagttcttaaggccacg

SEQ ID NO: 10614 - DNA, 23 bp, Artificial Sequence
  Synthetic
ttttgtgaatagtatcaggttgt

SEQ ID NO: 10615 - DNA, 22 bp, Artificial Sequence
  Synthetic
ttatgttaagtccaaagtcggt

SEQ ID NO: 10616 - DNA, 18 bp, Artificial Sequence
  Synthetic
gtcaactgctgccacgat

SEQ ID NO: 10617 - DNA, 18 bp, Artificial Sequence
  Synthetic
gagcctctagtgcaggat

SEQ ID NO: 10618 - DNA, 18 bp, Artificial Sequence
  Synthetic
gttggccaaagtgcagaa

SEQ ID NO: 10619 - DNA, 22 bp, Artificial Sequence
  Synthetic
ttcttaagaagatggatgagcc

SEQ ID NO: 10620 - DNA, 18 bp, Artificial Sequence
  Synthetic
acctgcttcgcgatacat

SEQ ID NO: 10621 - DNA, 20 bp, Artificial Sequence
  Synthetic
gaaatctcaccattgccttc

SEQ ID NO: 10622 - DNA, 20 bp, Artificial Sequence
  Synthetic
ttccaacactgtgtcaagct

SEQ ID NO: 10623 - DNA, 18 bp, Artificial Sequence
  Synthetic
cttcagtgcctgcttcac

SEQ ID NO: 10624 - DNA, 21 bp, Artificial Sequence
  Synthetic
gaaatctcaccattaccttcc

SEQ ID NO: 10625 - DNA, 19 bp, Artificial Sequence
  Synthetic
gaggcgacactccaccatg

SEQ ID NO: 10626 - DNA, 20 bp, Artificial Sequence
  Synthetic
tgcaacatgagcacacttcc

SEQ ID NO: 10627 - DNA, 18 bp, Artificial Sequence
  Synthetic
gtccatcctggggcccaa

SEQ ID NO: 10628 - DNA, 20 bp, Artificial Sequence
  Synthetic
gtgtatgaggccgatgatgt

SEQ ID NO: 10629 - DNA, 20 bp, Artificial Sequence
  Synthetic
tgtacccaggccatctttca

SEQ ID NO: 10630 - DNA, 20 bp, Artificial Sequence
  Synthetic
actggatgtcctcaaaggct

SEQ ID NO: 10631 - DNA, 19 bp, Artificial Sequence
  Synthetic
ggcactactgatgccaggg

SEQ ID NO: 10632 - DNA, 20 bp, Artificial Sequence
  Synthetic
aaggtgaggatgtttgtggg

SEQ ID NO: 10633 - DNA, 19 bp, Artificial Sequence
  Synthetic
gttttcctccttctggcgg

SEQ ID NO: 10634 - DNA, 20 bp, Artificial Sequence
  Synthetic
tactgagcattggcagatgg

SEQ ID NO: 10635 - DNA, 20 bp, Artificial Sequence
  Synthetic
ttgtgactagcttgactggc

SEQ ID NO: 10636 - DNA, 18 bp, Artificial Sequence
  Synthetic
ggactccacagcgagctt

SEQ ID NO: 10637 - DNA, 20 bp, Artificial Sequence
  Synthetic
tactaaatccatcggtggcg

SEQ ID NO: 10638 - DNA, 20 bp, Artificial Sequence
  Synthetic
acagtacgttgacttcagcc

SEQ ID NO: 10639 - DNA, 20 bp, Artificial Sequence
  Synthetic
agatgcccactttctgtcac

SEQ ID NO: 10640 - DNA, 18 bp, Artificial Sequence
  Synthetic
cggcctactgcttgtcag

SEQ ID NO: 10641 - DNA, 18 bp, Artificial Sequence
  Synthetic
cctagcaggcctctccac

SEQ ID NO: 10642 - DNA, 20 bp, Artificial Sequence
  Synthetic
gaggacatggtcaacctgtt

SEQ ID NO: 10643 - DNA, 18 bp, Artificial Sequence
  Synthetic
gactgggtttgctcggtg

SEQ ID NO: 10644 - DNA, 19 bp, Artificial Sequence
  Synthetic
gccaacagctacgttgagg

SEQ ID NO: 10645 - DNA, 19 bp, Artificial Sequence
  Synthetic
ctccatcagaggcaagctc

SEQ ID NO: 10646 - DNA, 18 bp, Artificial Sequence
  Synthetic
ctgttggaccgctggaaa

SEQ ID NO: 10647 - DNA, 18 bp, Artificial Sequence
  Synthetic
gacccggacttgagttgc

SEQ ID NO: 10648 - DNA, 19 bp, Artificial Sequence
  Synthetic
ctcaccatcgaggaagcgt

SEQ ID NO: 10649 - DNA, 20 bp, Artificial Sequence
  Synthetic
gggttctcatatgacacccg

SEQ ID NO: 10650 - DNA, 20 bp, Artificial Sequence
  Synthetic
tgttacatcaaggccacagc

SEQ ID NO: 10651 - DNA, 25 bp, Artificial Sequence
  Synthetic
cgaaagcaggtcaattatattcaat

SEQ ID NO: 10652 - DNA, 24 bp, Artificial Sequence
  Synthetic
ttatggagtaaaatgaatgatgcc

SEQ ID NO: 10653 - DNA, 20 bp, Artificial Sequence
  Synthetic
ggcacaggatgtaatcatgg

SEQ ID NO: 10654 - DNA, 18 bp, Artificial Sequence
  Synthetic
ccaggaggggaagtgaag

SEQ ID NO: 10655 - DNA, 23 bp, Artificial Sequence
  Synthetic
ttggtggattcacatttaagaga

SEQ ID NO: 10656 - DNA, 24 bp, Artificial Sequence
  Synthetic
ttgtatgataaaagcagttagagg

SEQ ID NO: 10657 - DNA, 18 bp, Artificial Sequence
  Synthetic
gagagggtagtggtgagc

SEQ ID NO: 10658 - DNA, 21 bp, Artificial Sequence
  Synthetic
tggaatttgaaccatttcagt

SEQ ID NO: 10659 - DNA, 20 bp, Artificial Sequence
  Synthetic
cagttctcggaaaggatgct

SEQ ID NO: 10660 - DNA, 20 bp, Artificial Sequence
  Synthetic
tcaatagcacggccttgaac

SEQ ID NO: 10661 - DNA, 19 bp, Artificial Sequence
  Synthetic
ggggtgcaaatgatacgga

SEQ ID NO: 10662 - DNA, 16 bp, Artificial Sequence
  Synthetic
gcacaggctggaagcg

SEQ ID NO: 10663 - DNA, 15 bp, Artificial Sequence
  Synthetic
aagcggaggcggctt

SEQ ID NO: 10664 - DNA, 19 bp, Artificial Sequence
  Synthetic
cgcgatgccgtcatcttac

SEQ ID NO: 10665 - DNA, 17 bp, Artificial Sequence
  Synthetic
gagactgggcgcacaac

SEQ ID NO: 10666 - DNA, 20 bp, Artificial Sequence
  Synthetic
ctgctacccaaaccttcctg

SEQ ID NO: 10667 - DNA, 16 bp, Artificial Sequence
  Synthetic
acacgccgtgggccta

SEQ ID NO: 10668 - DNA, 18 bp, Artificial Sequence
  Synthetic
ggaccggggtgagaacaa

SEQ ID NO: 10669 - DNA, 20 bp, Artificial Sequence
  Synthetic
tcaaggggggaagacatctc

SEQ ID NO: 10670 - DNA, 16 bp, Artificial Sequence
  Synthetic
agggggaagccaggca

SEQ ID NO: 10671 - DNA, 20 bp, Artificial Sequence
  Synthetic
tgtggaagtgtttgatccgc

SEQ ID NO: 10672 - DNA, 20 bp, Artificial Sequence
  Synthetic
gatggaagagtgctctcagc

SEQ ID NO: 10673 - DNA, 17 bp, Artificial Sequence
  Synthetic
gtgccgctaccgccttt

SEQ ID NO: 10674 - DNA, 16 bp, Artificial Sequence
  Synthetic
tagccttcgcctcccg

SEQ ID NO: 10675 - DNA, 18 bp, Artificial Sequence
  Synthetic
ctgccactgtggagctga

SEQ ID NO: 10676 - DNA, 16 bp, Artificial Sequence
  Synthetic
cccccttgcaagccct

SEQ ID NO: 10677 - DNA, 20 bp, Artificial Sequence
  Synthetic
agtggtgattctggactcct

SEQ ID NO: 10678 - DNA, 20 bp, Artificial Sequence
  Synthetic
aaagttttggcagctcctca

SEQ ID NO: 10679 - DNA, 20 bp, Artificial Sequence
  Synthetic
tgacagactgcaagttctgg

SEQ ID NO: 10680 - DNA, 19 bp, Artificial Sequence
  Synthetic
acgaggttttctgcgttca

SEQ ID NO: 10681 - DNA, 16 bp, Artificial Sequence
  Synthetic
cccgcgtggccatcaa

SEQ ID NO: 10682 - DNA, 20 bp, Artificial Sequence
  Synthetic
aacatcatgctcctccaacg

SEQ ID NO: 10683 - DNA, 18 bp, Artificial Sequence
  Synthetic
gcctcagcgcattttcac

SEQ ID NO: 10684 - DNA, 25 bp, Artificial Sequence
  Synthetic
atctagacaataataaatagggagg

SEQ ID NO: 10685 - DNA, 21 bp, Artificial Sequence
  Synthetic
tacgacgcctaaaatattggg

SEQ ID NO: 10686 - DNA, 25 bp, Artificial Sequence
  Synthetic
gtaaaagatatcgaattgagtcttg

SEQ ID NO: 10687 - DNA, 20 bp, Artificial Sequence
  Synthetic
gaaagtttgcacccagtcct

SEQ ID NO: 10688 - DNA, 18 bp, Artificial Sequence
  Synthetic
tgttttgcacagtggcag

SEQ ID NO: 10689 - DNA, 22 bp, Artificial Sequence
  Synthetic
gtgcctttaaaacattcctaca

SEQ ID NO: 10690 - DNA, 22 bp, Artificial Sequence
  Synthetic
cagctcttcacatttaaaaacc

SEQ ID NO: 10691 - DNA, 20 bp, Artificial Sequence
  Synthetic
tgtgctatgtacaatggagg

SEQ ID NO: 10692 - DNA, 18 bp, Artificial Sequence
  Synthetic
gtccgagggaccggaaca

SEQ ID NO: 10693 - DNA, 25 bp, Artificial Sequence
  Synthetic
agatctatagggtgattgtacattc

SEQ ID NO: 10694 - DNA, 18 bp, Artificial Sequence
  Synthetic
catccgccacacagcttt

SEQ ID NO: 10695 - DNA, 22 bp, Artificial Sequence
  Synthetic
aggactccagcattattaattc

SEQ ID NO: 10696 - DNA, 18 bp, Artificial Sequence
  Synthetic
agtggcaagggtattgga

SEQ ID NO: 10697 - DNA, 22 bp, Artificial Sequence
  Synthetic
aacgtgtctcatatttttttgc

SEQ ID NO: 10698 - DNA, 20 bp, Artificial Sequence
  Synthetic
cccctggagcttataacttc

SEQ ID NO: 10699 - DNA, 21 bp, Artificial Sequence
  Synthetic
aagaatatttgaggcacggag

SEQ ID NO: 10700 - DNA, 25 bp, Artificial Sequence
  Synthetic
gtttgtaatgtctatgtatgtgtgt

SEQ ID NO: 10701 - DNA, 19 bp, Artificial Sequence
  Synthetic
gtttgtcgcctgattctga

SEQ ID NO: 10702 - DNA, 18 bp, Artificial Sequence
  Synthetic
atgtgtgggtagcttgga

SEQ ID NO: 10703 - DNA, 20 bp, Artificial Sequence
  Synthetic
cacacacagccaaaaaactg

SEQ ID NO: 10704 - DNA, 19 bp, Artificial Sequence
  Synthetic
ttttaccctccgcctctgt

SEQ ID NO: 10705 - DNA, 20 bp, Artificial Sequence
  Synthetic
gaatcgccaaccaaaagacg

SEQ ID NO: 10706 - DNA, 23 bp, Artificial Sequence
  Synthetic
attacaaatttttggtagtgctg

SEQ ID NO: 10707 - DNA, 23 bp, Artificial Sequence
  Synthetic
cctactgatattattgacccttt

SEQ ID NO: 10708 - DNA, 20 bp, Artificial Sequence
  Synthetic
attacaaacgagaaacccag

SEQ ID NO: 10709 - DNA, 24 bp, Artificial Sequence
  Synthetic
gaaaatgagcaactttttattccc

SEQ ID NO: 10710 - DNA, 18 bp, Artificial Sequence
  Synthetic
atggctttgtggatgcaa

SEQ ID NO: 10711 - DNA, 24 bp, Artificial Sequence
  Synthetic
aaatctctgtataatccagacagg

SEQ ID NO: 10712 - DNA, 19 bp, Artificial Sequence
  Synthetic
caccagtgggagaacattg

SEQ ID NO: 10713 - DNA, 23 bp, Artificial Sequence
  Synthetic
tgttcttttttggaagaaaggaa

SEQ ID NO: 10714 - DNA, 24 bp, Artificial Sequence
  Synthetic
atactcggaacatactattgaact

SEQ ID NO: 10715 - DNA, 21 bp, Artificial Sequence
  Synthetic
gacgttggctaaaattgaact

SEQ ID NO: 10716 - DNA, 22 bp, Artificial Sequence
  Synthetic
taggaactaaaggacaaatgtg

SEQ ID NO: 10717 - DNA, 24 bp, Artificial Sequence
  Synthetic
aatattattccctaaagaagcagg

SEQ ID NO: 10718 - DNA, 25 bp, Artificial Sequence
  Synthetic
actaactgaatctagatctcaatca

SEQ ID NO: 10719 - DNA, 23 bp, Artificial Sequence
  Synthetic
cggaacaatacaaaagattggaa

SEQ ID NO: 10720 - DNA, 25 bp, Artificial Sequence
  Synthetic
ggagagataaattttcttaatcgag

SEQ ID NO: 10721 - DNA, 25 bp, Artificial Sequence
  Synthetic
tcttagtttaataaaaaggactggg

SEQ ID NO: 10722 - DNA, 19 bp, Artificial Sequence
  Synthetic
taatccctcagaagatggc

SEQ ID NO: 10723 - DNA, 25 bp, Artificial Sequence
  Synthetic
tgaggatgaagaaagaaatagatca

SEQ ID NO: 10724 - DNA, 19 bp, Artificial Sequence
  Synthetic
gagtttgagcgattgacgt

SEQ ID NO: 10725 - DNA, 18 bp, Artificial Sequence
  Synthetic
gaagtcagatgagggtgg

SEQ ID NO: 10726 - DNA, 22 bp, Artificial Sequence
  Synthetic
gtggttttgttatgcagtatgg

SEQ ID NO: 10727 - DNA, 25 bp, Artificial Sequence
  Synthetic
gttaaagaaactgctcttattactc

SEQ ID NO: 10728 - DNA, 25 bp, Artificial Sequence
  Synthetic
agaagatgatgttattgagaatgtc

SEQ ID NO: 10729 - DNA, 25 bp, Artificial Sequence
  Synthetic
atggaatgtcatttagtatgtcttc

SEQ ID NO: 10730 - DNA, 23 bp, Artificial Sequence
  Synthetic
ttaacagtatgtaaatggtctgt

SEQ ID NO: 10731 - DNA, 22 bp, Artificial Sequence
  Synthetic
ttaaacaagaaagtcgtgttgg

SEQ ID NO: 10732 - DNA, 25 bp, Artificial Sequence
  Synthetic
tacaaaacctattataaaggctcag

SEQ ID NO: 10733 - DNA, 24 bp, Artificial Sequence
  Synthetic
atttgtagctaatatgttacctgc

SEQ ID NO: 10734 - DNA, 22 bp, Artificial Sequence
  Synthetic
ttttgttaacattgctcatgct

SEQ ID NO: 10735 - DNA, 23 bp, Artificial Sequence
  Synthetic
aatgatttttatgctagtggttg

SEQ ID NO: 10736 - DNA, 23 bp, Artificial Sequence
  Synthetic
attctgccttattgtgtagagtt

SEQ ID NO: 10737 - DNA, 20 bp, Artificial Sequence
  Synthetic
cacactggcactgattttac

SEQ ID NO: 10738 - DNA, 25 bp, Artificial Sequence
  Synthetic
aaagcatgtaatatagctaagtctg

SEQ ID NO: 10739 - DNA, 22 bp, Artificial Sequence
  Synthetic
aattgtgttaaaatgctctgtg

SEQ ID NO: 10740 - DNA, 25 bp, Artificial Sequence
  Synthetic
aattaggccctatttttaatagagc

SEQ ID NO: 10741 - DNA, 20 bp, Artificial Sequence
  Synthetic
ttggtccccttgttagacaa

SEQ ID NO: 10742 - DNA, 23 bp, Artificial Sequence
  Synthetic
tgataaaagtgctggttatccat

SEQ ID NO: 10743 - DNA, 24 bp, Artificial Sequence
  Synthetic
cgtcatcttataaaggatgttgac

SEQ ID NO: 10744 - DNA, 25 bp, Artificial Sequence
  Synthetic
actatgttagttaagatagatggtg

SEQ ID NO: 10745 - DNA, 23 bp, Artificial Sequence
  Synthetic
ttatgaatggtatggtctttggt

SEQ ID NO: 10746 - DNA, 23 bp, Artificial Sequence
  Synthetic
gttttaacatcacattctgtagc

SEQ ID NO: 10747 - DNA, 24 bp, Artificial Sequence
  Synthetic
tactaaagatgaagccattaaacg

SEQ ID NO: 10748 - DNA, 25 bp, Artificial Sequence
  Synthetic
gtatccaataatttctaatgaggtc

SEQ ID NO: 10749 - DNA, 25 bp, Artificial Sequence
  Synthetic
gaactgtttttgaaaatcttaagcc

SEQ ID NO: 10750 - DNA, 23 bp, Artificial Sequence
  Synthetic
tagaaaagcaagaaatggtgttt

SEQ ID NO: 10751 - DNA, 23 bp, Artificial Sequence
  Synthetic
atggtaaacctattaatttgcct

SEQ ID NO: 10752 - DNA, 22 bp, Artificial Sequence
  Synthetic
aatactttttgtccttgtgcta

SEQ ID NO: 10753 - DNA, 21 bp, Artificial Sequence
  Synthetic
tgatagttatcttggttgcgt

SEQ ID NO: 10754 - DNA, 23 bp, Artificial Sequence
  Synthetic
aatttggtgcaattagttcttct

SEQ ID NO: 10755 - DNA, 24 bp, Artificial Sequence
  Synthetic
ccagagaccaataatcttatgtgt

SEQ ID NO: 10756 - DNA, 25 bp, Artificial Sequence
  Synthetic
aaactattaggatgtcttatactcc

SEQ ID NO: 10757 - DNA, 22 bp, Artificial Sequence
  Synthetic
cgctaatcttgttttagccaag

SEQ ID NO: 10758 - DNA, 25 bp, Artificial Sequence
  Synthetic
cttgaagagaatttaaatgcttacg

SEQ ID NO: 10759 - DNA, 20 bp, Artificial Sequence
  Synthetic
aggtactgattcgaaatgga

SEQ ID NO: 10760 - DNA, 18 bp, Artificial Sequence
  Synthetic
agactacactctcgacga

SEQ ID NO: 10761 - DNA, 18 bp, Artificial Sequence
  Synthetic
gagggcaagctttctcaa

SEQ ID NO: 10762 - DNA, 22 bp, Artificial Sequence
  Synthetic
aaattcaaattacctgctgtca

SEQ ID NO: 10763 - DNA, 20 bp, Artificial Sequence
  Synthetic
tgcgagctaactgattcaat

SEQ ID NO: 10764 - DNA, 24 bp, Artificial Sequence
  Synthetic
atatggattcatcataaagggaag

SEQ ID NO: 10765 - DNA, 18 bp, Artificial Sequence
  Synthetic
ttcagtcactccagcaga

SEQ ID NO: 10766 - DNA, 21 bp, Artificial Sequence
  Synthetic
aaacgatcctatgaacagatg

SEQ ID NO: 10767 - DNA, 19 bp, Artificial Sequence
  Synthetic
tgcagcaataaagggagtc

SEQ ID NO: 10768 - DNA, 20 bp, Artificial Sequence
  Synthetic
atgatggatcaggtgcgaga

SEQ ID NO: 10769 - DNA, 21 bp, Artificial Sequence
  Synthetic
atccagcacataaaagtcaat

SEQ ID NO: 10770 - DNA, 21 bp, Artificial Sequence
  Synthetic
gaggaggagcgctataaaatt

SEQ ID NO: 10771 - DNA, 20 bp, Artificial Sequence
  Synthetic
ttctgcctctgtgtctagct

SEQ ID NO: 10772 - DNA, 19 bp, Artificial Sequence
  Synthetic
ccaactcctgaagaagtgg

SEQ ID NO: 10773 - DNA, 20 bp, Artificial Sequence
  Synthetic
gcgactgtatgtgaaagaca

SEQ ID NO: 10774 - DNA, 20 bp, Artificial Sequence
  Synthetic
gtattggtacaggaaggggt

SEQ ID NO: 10775 - DNA, 20 bp, Artificial Sequence
  Synthetic
cacaataacagacaccactg

SEQ ID NO: 10776 - DNA, 23 bp, Artificial Sequence
  Synthetic
gtgtatgaagatattcctttgga

SEQ ID NO: 10777 - DNA, 18 bp, Artificial Sequence
  Synthetic
catcagtagaggctgcac

SEQ ID NO: 10778 - DNA, 25 bp, Artificial Sequence
  Synthetic
attagagatacagaaaatcccaatc

SEQ ID NO: 10779 - DNA, 23 bp, Artificial Sequence
  Synthetic
ttttggagctgctaatttcaaag

SEQ ID NO: 10780 - DNA, 25 bp, Artificial Sequence
  Synthetic
actagacatactgaagaatatgaac

SEQ ID NO: 10781 - DNA, 18 bp, Artificial Sequence
  Synthetic
ttggactgttgatctgca

SEQ ID NO: 10782 - DNA, 18 bp, Artificial Sequence
  Synthetic
gcagcatagtttacccca

SEQ ID NO: 10783 - DNA, 21 bp, Artificial Sequence
  Synthetic
cgacaatgcttcaatccaatg

SEQ ID NO: 10784 - DNA, 18 bp, Artificial Sequence
  Synthetic
gaatcatggcctggacag

SEQ ID NO: 10785 - DNA, 21 bp, Artificial Sequence
  Synthetic
cagggcaagaatcaaaactag

SEQ ID NO: 10786 - DNA, 24 bp, Artificial Sequence
  Synthetic
tacaggacattgaaaatgaagaga

SEQ ID NO: 10787 - DNA, 22 bp, Artificial Sequence
  Synthetic
ctgattcaagctggatagaact

SEQ ID NO: 10788 - DNA, 24 bp, Artificial Sequence
  Synthetic
atttgagaaatgatactgatgtgg

SEQ ID NO: 10789 - DNA, 20 bp, Artificial Sequence
  Synthetic
ttcttcagtctcttcagcag

SEQ ID NO: 10790 - DNA, 23 bp, Artificial Sequence
  Synthetic
tgacaaagacataatggattcca

SEQ ID NO: 10791 - DNA, 18 bp, Artificial Sequence
  Synthetic
ccattgcttccagtcctg

SEQ ID NO: 10792 - DNA, 18 bp, Artificial Sequence
  Synthetic
cctccgtaccaggacatt

SEQ ID NO: 10793 - DNA, 24 bp, Artificial Sequence
  Synthetic
gaaggttaatagatttcctcaagg

SEQ ID NO: 10794 - DNA, 18 bp, Artificial Sequence
  Synthetic
acccggaatgcaaatcag

SEQ ID NO: 10795 - DNA, 24 bp, Artificial Sequence
  Synthetic
gcatgtttaatatgctaagtacgg

SEQ ID NO: 10796 - DNA, 21 bp, Artificial Sequence
  Synthetic
ttttctaccgctatgggtttg

SEQ ID NO: 10797 - DNA, 20 bp, Artificial Sequence
  Synthetic
ttgcaactacacattcatgg

SEQ ID NO: 10798 - DNA, 21 bp, Artificial Sequence
  Synthetic
attactgaaaagggtgtaacc

SEQ ID NO: 10799 - DNA, 18 bp, Artificial Sequence
  Synthetic
gtgcacaagaacagcaag

SEQ ID NO: 10800 - DNA, 21 bp, Artificial Sequence
  Synthetic
cagatacaggttcagacttgg

SEQ ID NO: 10801 - DNA, 18 bp, Artificial Sequence
  Synthetic
ttgagccaccaaaactgc

SEQ ID NO: 10802 - DNA, 22 bp, Artificial Sequence
  Synthetic
atacaaatcctgcaacagatga

SEQ ID NO: 10803 - DNA, 25 bp, Artificial Sequence
  Synthetic
gatcaaatagactattggaagtgtg

SEQ ID NO: 10804 - DNA, 23 bp, Artificial Sequence
  Synthetic
attgaatgtgtaaatacctgtga

SEQ ID NO: 10805 - DNA, 19 bp, Artificial Sequence
  Synthetic
cgtaccggctatattccat

SEQ ID NO: 10806 - DNA, 23 bp, Artificial Sequence
  Synthetic
aagtagcactagttttaccaatc

SEQ ID NO: 10807 - DNA, 21 bp, Artificial Sequence
  Synthetic
ttaccaatcctgcatatgagc

SEQ ID NO: 10808 - DNA, 25 bp, Artificial Sequence
  Synthetic
tggacatccatactataaagttacc

SEQ ID NO: 10809 - DNA, 23 bp, Artificial Sequence
  Synthetic
caaattggatgacacagaaaatt

SEQ ID NO: 10810 - DNA, 24 bp, Artificial Sequence
  Synthetic
gtactttgcaggataataaaagtg

SEQ ID NO: 10811 - DNA, 25 bp, Artificial Sequence
  Synthetic
aaagggctctgtactataaattcat

SEQ ID NO: 10812 - DNA, 18 bp, Artificial Sequence
  Synthetic
cagggtggaatgcattgg

SEQ ID NO: 10813 - DNA, 23 bp, Artificial Sequence
  Synthetic
ggaaaatattgaaatgggagtct

SEQ ID NO: 10814 - DNA, 25 bp, Artificial Sequence
  Synthetic
ccttatccaggtaataataacaatg

SEQ ID NO: 10815 - DNA, 23 bp, Artificial Sequence
  Synthetic
atggagagaataaaagaactgag

SEQ ID NO: 10816 - DNA, 18 bp, Artificial Sequence
  Synthetic
ctggatcagaccgagtga

SEQ ID NO: 10817 - DNA, 18 bp, Artificial Sequence
  Synthetic
tgacatcagagtcacagc

SEQ ID NO: 10818 - DNA, 21 bp, Artificial Sequence
  Synthetic
agaaatgatgatgttgaccaa

SEQ ID NO: 10819 - DNA, 18 bp, Artificial Sequence
  Synthetic
gcggatcatcagtcaaga

SEQ ID NO: 10820 - DNA, 23 bp, Artificial Sequence
  Synthetic
ttaagggttagagatcaaagagg

SEQ ID NO: 10821 - DNA, 19 bp, Artificial Sequence
  Synthetic
cggtacagtggattcgtaa

SEQ ID NO: 10822 - DNA, 19 bp, Artificial Sequence
  Synthetic
tgcattgactgaagatcca

SEQ ID NO: 10823 - DNA, 22 bp, Artificial Sequence
  Synthetic
caacaatcatctgactagctat

SEQ ID NO: 10824 - DNA, 21 bp, Artificial Sequence
  Synthetic
agaatctttggtgttacctgc

SEQ ID NO: 10825 - DNA, 20 bp, Artificial Sequence
  Synthetic
cgaaagtttatagctagccc

SEQ ID NO: 10826 - DNA, 18 bp, Artificial Sequence
  Synthetic
tcgactacgaggaggaga

SEQ ID NO: 10827 - DNA, 22 bp, Artificial Sequence
  Synthetic
gcagtttagtttactttggtgg

SEQ ID NO: 10828 - DNA, 18 bp, Artificial Sequence
  Synthetic
tgtaccattggcagaagg

SEQ ID NO: 10829 - DNA, 20 bp, Artificial Sequence
  Synthetic
ttcccgcctagttcaatttg

SEQ ID NO: 10830 - DNA, 23 bp, Artificial Sequence
  Synthetic
agtgaaataccaccaatagaaga

SEQ ID NO: 10831 - DNA, 21 bp, Artificial Sequence
  Synthetic
cacaacgtttagtttggagac

SEQ ID NO: 10832 - DNA, 19 bp, Artificial Sequence
  Synthetic
tgcccgccaattcaattag

SEQ ID NO: 10833 - DNA, 25 bp, Artificial Sequence
  Synthetic
catttcaatgtctttatctgtttgg

SEQ ID NO: 10834 - DNA, 18 bp, Artificial Sequence
  Synthetic
gagcaggaagagcaggat

SEQ ID NO: 10835 - DNA, 19 bp, Artificial Sequence
  Synthetic
acagtggcttaggacatga

SEQ ID NO: 10836 - DNA, 23 bp, Artificial Sequence
  Synthetic
ttatgcttgtttgagttttcaag

SEQ ID NO: 10837 - DNA, 24 bp, Artificial Sequence
  Synthetic
gctaatagtaaaagtcagttttgg

SEQ ID NO: 10838 - DNA, 18 bp, Artificial Sequence
  Synthetic
acgctcagacctggaatc

SEQ ID NO: 10839 - DNA, 20 bp, Artificial Sequence
  Synthetic
cgaggaagaaaaagctatgc

SEQ ID NO: 10840 - DNA, 24 bp, Artificial Sequence
  Synthetic
cccccaatattattagttaaaggg

SEQ ID NO: 10841 - DNA, 19 bp, Artificial Sequence
  Synthetic
tggattgccagtgtggttt

SEQ ID NO: 10842 - DNA, 18 bp, Artificial Sequence
  Synthetic
ccactgcatcaacaccta

SEQ ID NO: 10843 - DNA, 22 bp, Artificial Sequence
  Synthetic
gtaggcctactttatctgaaac

SEQ ID NO: 10844 - DNA, 21 bp, Artificial Sequence
  Synthetic
ccttctgtggtagtagattcc

SEQ ID NO: 10845 - DNA, 23 bp, Artificial Sequence
  Synthetic
agttatgttaaaacaggaaagga

SEQ ID NO: 10846 - DNA, 21 bp, Artificial Sequence
  Synthetic
agggccctaataatagtgtgt

SEQ ID NO: 10847 - DNA, 21 bp, Artificial Sequence
  Synthetic
atctttttggaaggtggatct

SEQ ID NO: 10848 - DNA, 23 bp, Artificial Sequence
  Synthetic
ccaactttcaggtatgtactttg

SEQ ID NO: 10849 - DNA, 21 bp, Artificial Sequence
  Synthetic
tgtaaatttggaggagttggt

SEQ ID NO: 10850 - DNA, 19 bp, Artificial Sequence
  Synthetic
gcttcaagaagtgttcctg

SEQ ID NO: 10851 - DNA, 21 bp, Artificial Sequence
  Synthetic
gctattttagcgctaaaacga

SEQ ID NO: 10852 - DNA, 24 bp, Artificial Sequence
  Synthetic
atttcgcagtactaatagaaaagc

SEQ ID NO: 10853 - DNA, 25 bp, Artificial Sequence
  Synthetic
tggactataatggactttatttcac

SEQ ID NO: 10854 - DNA, 19 bp, Artificial Sequence
  Synthetic
cgactactaccgacggagg

SEQ ID NO: 10855 - DNA, 25 bp, Artificial Sequence
  Synthetic
gcaagtgaaattgatatagtttcag

SEQ ID NO: 10856 - DNA, 23 bp, Artificial Sequence
  Synthetic
agttttggagaagaaatagagtt

SEQ ID NO: 10857 - DNA, 19 bp, Artificial Sequence
  Synthetic
caagatttgcaagaggtgg

SEQ ID NO: 10858 - DNA, 24 bp, Artificial Sequence
  Synthetic
ttaactgaaactacaaatgaaggc

SEQ ID NO: 10859 - DNA, 25 bp, Artificial Sequence
  Synthetic
attttgattcctaatgttccagatg

SEQ ID NO: 10860 - DNA, 25 bp, Artificial Sequence
  Synthetic
gtggttcaaataatattactgtacc

SEQ ID NO: 10861 - DNA, 23 bp, Artificial Sequence
  Synthetic
atatggagatacagaaaatcctg

SEQ ID NO: 10862 - DNA, 18 bp, Artificial Sequence
  Synthetic
tgcacatcagcaagtgtc

SEQ ID NO: 10863 - DNA, 18 bp, Artificial Sequence
  Synthetic
ggcaaggccttccacatg

SEQ ID NO: 10864 - DNA, 17 bp, Artificial Sequence
  Synthetic
agaccctgcgctccatg

SEQ ID NO: 10865 - DNA, 21 bp, Artificial Sequence
  Synthetic
ccctacaacacaaaacaaact

SEQ ID NO: 10866 - DNA, 16 bp, Artificial Sequence
  Synthetic
accccagtcccgtcca

SEQ ID NO: 10867 - DNA, 17 bp, Artificial Sequence
  Synthetic
tggggccaccttcatca

SEQ ID NO: 10868 - DNA, 20 bp, Artificial Sequence
  Synthetic
cttctacctctccctagccc

SEQ ID NO: 10869 - DNA, 18 bp, Artificial Sequence
  Synthetic
gtcagctgaccgatgctc

SEQ ID NO: 10870 - DNA, 18 bp, Artificial Sequence
  Synthetic
acccaatagcatgacagc

SEQ ID NO: 10871 - DNA, 17 bp, Artificial Sequence
  Synthetic
ggacaccgacttcacgc

SEQ ID NO: 10872 - DNA, 20 bp, Artificial Sequence
  Synthetic
tcagaagctgagaccgaaga

SEQ ID NO: 10873 - DNA, 16 bp, Artificial Sequence
  Synthetic
cgggcctggactcaca

SEQ ID NO: 10874 - DNA, 18 bp, Artificial Sequence
  Synthetic
gccgggatgttttcgtgg

SEQ ID NO: 10875 - DNA, 20 bp, Artificial Sequence
  Synthetic
agaatggccatagggtgggt

SEQ ID NO: 10876 - DNA, 18 bp, Artificial Sequence
  Synthetic
cggtctgggctctcggaa

SEQ ID NO: 10877 - DNA, 18 bp, Artificial Sequence
  Synthetic
agcctgtaggtgaggacc

SEQ ID NO: 10878 - DNA, 20 bp, Artificial Sequence
  Synthetic
aaagttgtggtagacgggga

SEQ ID NO: 10879 - DNA, 18 bp, Artificial Sequence
  Synthetic
gagttcatcgtcgggggc

SEQ ID NO: 10880 - DNA, 16 bp, Artificial Sequence
  Synthetic
agcagggaggccagca

SEQ ID NO: 10881 - DNA, 16 bp, Artificial Sequence
  Synthetic
tcggccagctggggaa

SEQ ID NO: 10882 - DNA, 20 bp, Artificial Sequence
  Synthetic
agctcttgaccaggtagagg

SEQ ID NO: 10883 - DNA, 17 bp, Artificial Sequence
  Synthetic
ggaggatgcggaatggc

SEQ ID NO: 10884 - DNA, 18 bp, Artificial Sequence
  Synthetic
cgtctggaggtccgtgga

SEQ ID NO: 10885 - DNA, 16 bp, Artificial Sequence
  Synthetic
gtgtgctgctccacgc

SEQ ID NO: 10886 - DNA, 19 bp, Artificial Sequence
  Synthetic
cgggtctccatcaagtccc

SEQ ID NO: 10887 - DNA, 18 bp, Artificial Sequence
  Synthetic
tggccacctgcaatctgg

SEQ ID NO: 10888 - DNA, 19 bp, Artificial Sequence
  Synthetic
gggaggaacagaatgagcg

SEQ ID NO: 10889 - DNA, 17 bp, Artificial Sequence
  Synthetic
aaggctcaggacgtggg

SEQ ID NO: 10890 - DNA, 19 bp, Artificial Sequence
  Synthetic
cctacttgggagagtccgg

SEQ ID NO: 10891 - DNA, 17 bp, Artificial Sequence
  Synthetic
agagggccctggtgaga

SEQ ID NO: 10892 - DNA, 18 bp, Artificial Sequence
  Synthetic
ctcgtgtgcaaagtgggc

SEQ ID NO: 10893 - DNA, 19 bp, Artificial Sequence
  Synthetic
taagcagccgtgactagca

SEQ ID NO: 10894 - DNA, 19 bp, Artificial Sequence
  Synthetic
caggtgaagctgcagttcc

SEQ ID NO: 10895 - DNA, 16 bp, Artificial Sequence
  Synthetic
gtgcctgggcgcaaga

SEQ ID NO: 10896 - DNA, 18 bp, Artificial Sequence
  Synthetic
gacccttgtcctcctcca

SEQ ID NO: 10897 - DNA, 17 bp, Artificial Sequence
  Synthetic
tggaagacatggccgcc

SEQ ID NO: 10898 - DNA, 16 bp, Artificial Sequence
  Synthetic
tgctgaggtggggctg

SEQ ID NO: 10899 - DNA, 22 bp, Artificial Sequence
  Synthetic
tggccagtcttaatttattgtc

SEQ ID NO: 10900 - DNA, 19 bp, Artificial Sequence
  Synthetic
ttgtgcttcgtgatggcag

SEQ ID NO: 10901 - DNA, 16 bp, Artificial Sequence
  Synthetic
gcagtcggcgctttgg

SEQ ID NO: 10902 - DNA, 18 bp, Artificial Sequence
  Synthetic
gaagcgactacacagccg

SEQ ID NO: 10903 - DNA, 20 bp, Artificial Sequence
  Synthetic
ataaccatggacgaggacgg

SEQ ID NO: 10904 - DNA, 18 bp, Artificial Sequence
  Synthetic
ggtcgaggaggcagtgga

SEQ ID NO: 10905 - DNA, 19 bp, Artificial Sequence
  Synthetic
catagtcacggatgctgca

SEQ ID NO: 10906 - DNA, 19 bp, Artificial Sequence
  Synthetic
ccacgatcacattggtggt

SEQ ID NO: 10907 - DNA, 16 bp, Artificial Sequence
  Synthetic
ggcgtccgtagagcga

SEQ ID NO: 10908 - DNA, 18 bp, Artificial Sequence
  Synthetic
gaccgggggagatcatgg

SEQ ID NO: 10909 - DNA, 17 bp, Artificial Sequence
  Synthetic
ttggtccagggtccagg

SEQ ID NO: 10910 - DNA, 19 bp, Artificial Sequence
  Synthetic
tctcacctgtgctagtggc

SEQ ID NO: 10911 - DNA, 18 bp, Artificial Sequence
  Synthetic
catctcggacccgaagcc

SEQ ID NO: 10912 - DNA, 20 bp, Artificial Sequence
  Synthetic
tggtgtataaaccgcagtgg

SEQ ID NO: 10913 - DNA, 19 bp, Artificial Sequence
  Synthetic
cagtgccagttccagacac

SEQ ID NO: 10914 - DNA, 16 bp, Artificial Sequence
  Synthetic
tgcccgtccgatgtgg

SEQ ID NO: 10915 - DNA, 16 bp, Artificial Sequence
  Synthetic
gcagcaaacacgcggc

SEQ ID NO: 10916 - DNA, 18 bp, Artificial Sequence
  Synthetic
cgctggtcctgtgtgtct

SEQ ID NO: 10917 - DNA, 16 bp, Artificial Sequence
  Synthetic
tcctcgctgagccagg

SEQ ID NO: 10918 - DNA, 16 bp, Artificial Sequence
  Synthetic
tcgccgccgtgactca

SEQ ID NO: 10919 - DNA, 18 bp, Artificial Sequence
  Synthetic
atgcagggaatgagcggt

SEQ ID NO: 10920 - DNA, 18 bp, Artificial Sequence
  Synthetic
ctcggagaaggcaaaggc

SEQ ID NO: 10921 - DNA, 18 bp, Artificial Sequence
  Synthetic
ggaaggtcaagagctggc

SEQ ID NO: 10922 - DNA, 20 bp, Artificial Sequence
  Synthetic
agcctagtcagagagaaccg

SEQ ID NO: 10923 - DNA, 16 bp, Artificial Sequence
  Synthetic
gccgtgcacctgccat

SEQ ID NO: 10924 - DNA, 20 bp, Artificial Sequence
  Synthetic
agactcctgcctgaatcaga

SEQ ID NO: 10925 - DNA, 23 bp, Artificial Sequence
  Synthetic
caaaagcaataaagtacaggatt

SEQ ID NO: 10926 - DNA, 17 bp, Artificial Sequence
  Synthetic
ctctagggccgagcaca

SEQ ID NO: 10927 - DNA, 18 bp, Artificial Sequence
  Synthetic
gagtttccagccctgggc

SEQ ID NO: 10928 - DNA, 17 bp, Artificial Sequence
  Synthetic
cgatggacgctcacacc

SEQ ID NO: 10929 - DNA, 16 bp, Artificial Sequence
  Synthetic
ggagcagccgggaact

SEQ ID NO: 10930 - DNA, 19 bp, Artificial Sequence
  Synthetic
gtggcatcctaaggaggga

SEQ ID NO: 10931 - DNA, 17 bp, Artificial Sequence
  Synthetic
ggcttgtcatgccgctg

SEQ ID NO: 10932 - DNA, 18 bp, Artificial Sequence
  Synthetic
tcctcggccatctccgtc

SEQ ID NO: 10933 - DNA, 20 bp, Artificial Sequence
  Synthetic
atgtctatggggatgaggcc

SEQ ID NO: 10934 - DNA, 16 bp, Artificial Sequence
  Synthetic
gggcttccgtgggtgt

SEQ ID NO: 10935 - DNA, 16 bp, Artificial Sequence
  Synthetic
tcgctcggctcgatgc

SEQ ID NO: 10936 - DNA, 16 bp, Artificial Sequence
  Synthetic
gcaggtgctccgagct

SEQ ID NO: 10937 - DNA, 18 bp, Artificial Sequence
  Synthetic
tcagcctccaacaggtgc

SEQ ID NO: 10938 - DNA, 17 bp, Artificial Sequence
  Synthetic
gcctctggaccctcaca

SEQ ID NO: 10939 - DNA, 16 bp, Artificial Sequence
  Synthetic
gcacgccctctgggaa

SEQ ID NO: 10940 - DNA, 16 bp, Artificial Sequence
  Synthetic
agttggggtcgggcct

SEQ ID NO: 10941 - DNA, 16 bp, Artificial Sequence
  Synthetic
agtcaggctggccagg

SEQ ID NO: 10942 - DNA, 19 bp, Artificial Sequence
  Synthetic
tgtgtagcacagcaccacc

SEQ ID NO: 10943 - DNA, 16 bp, Artificial Sequence
  Synthetic
gcagaggaccagggct

SEQ ID NO: 10944 - DNA, 16 bp, Artificial Sequence
  Synthetic
gtgacgaagggcccca

SEQ ID NO: 10945 - DNA, 20 bp, Artificial Sequence
  Synthetic
tgaaagttgtgtggagaagt

SEQ ID NO: 10946 - DNA, 18 bp, Artificial Sequence
  Synthetic
ttggaaaccatgcgaggc

SEQ ID NO: 10947 - DNA, 18 bp, Artificial Sequence
  Synthetic
cagcacacacaggaacaa

SEQ ID NO: 10948 - DNA, 22 bp, Artificial Sequence
  Synthetic
tggggagtggttatattaatgc

SEQ ID NO: 10949 - DNA, 23 bp, Artificial Sequence
  Synthetic
acagatgaaagtatattggcata

SEQ ID NO: 10950 - DNA, 23 bp, Artificial Sequence
  Synthetic
taaagggtataccaaagaaaagc

SEQ ID NO: 10951 - DNA, 18 bp, Artificial Sequence
  Synthetic
tttagatgcgtgccagga

SEQ ID NO: 10952 - DNA, 23 bp, Artificial Sequence
  Synthetic
taaagacattacttaacagtccc

SEQ ID NO: 10953 - DNA, 20 bp, Artificial Sequence
  Synthetic
atatggggacacaggcatct

SEQ ID NO: 10954 - DNA, 21 bp, Artificial Sequence
  Synthetic
caacatttgtaacattgtggc

SEQ ID NO: 10955 - DNA, 22 bp, Artificial Sequence
  Synthetic
tttttgttactgtgtttcttgg

SEQ ID NO: 10956 - DNA, 20 bp, Artificial Sequence
  Synthetic
gcacacaaaatgttacagca

SEQ ID NO: 10957 - DNA, 19 bp, Artificial Sequence
  Synthetic
caccgacgactatgttacc

SEQ ID NO: 10958 - DNA, 18 bp, Artificial Sequence
  Synthetic
aagggtcttgaggtaggc

SEQ ID NO: 10959 - DNA, 22 bp, Artificial Sequence
  Synthetic
atacaggatggtgatatggtag

SEQ ID NO: 10960 - DNA, 18 bp, Artificial Sequence
  Synthetic
tgcttcccctacaagctc

SEQ ID NO: 10961 - DNA, 22 bp, Artificial Sequence
  Synthetic
tttaacagctgaaattatggcc

SEQ ID NO: 10962 - DNA, 19 bp, Artificial Sequence
  Synthetic
ccctggcttcctgtatgca

SEQ ID NO: 10963 - DNA, 21 bp, Artificial Sequence
  Synthetic
catatcctttccaacacaggt

SEQ ID NO: 10964 - DNA, 20 bp, Artificial Sequence
  Synthetic
gccacaagctacattagacc

SEQ ID NO: 10965 - DNA, 24 bp, Artificial Sequence
  Synthetic
gaaagcttattgtagaaagtgtgt

SEQ ID NO: 10966 - DNA, 25 bp, Artificial Sequence
  Synthetic
gtatcagatttaattgatgatgtgg

SEQ ID NO: 10967 - DNA, 23 bp, Artificial Sequence
  Synthetic
caaaacattactacaaacgcatg

SEQ ID NO: 10968 - DNA, 19 bp, Artificial Sequence
  Synthetic
actgaaaatgcaaacgcag

SEQ ID NO: 10969 - DNA, 25 bp, Artificial Sequence
  Synthetic
agctatacaaatacaacttttggtc

SEQ ID NO: 10970 - DNA, 19 bp, Artificial Sequence
  Synthetic
gccgaagaatcacacagga

SEQ ID NO: 10971 - DNA, 23 bp, Artificial Sequence
  Synthetic
actcttgcagatattttactgaa

SEQ ID NO: 10972 - DNA, 24 bp, Artificial Sequence
  Synthetic
actatgagatattgacaaccacag

SEQ ID NO: 10973 - DNA, 25 bp, Artificial Sequence
  Synthetic
ctagatcgcccaatatatagtgaaa

SEQ ID NO: 10974 - DNA, 25 bp, Artificial Sequence
  Synthetic
aactactacatatccagatattcca

SEQ ID NO: 10975 - DNA, 22 bp, Artificial Sequence
  Synthetic
ccatccgttgtttaataaagtg

SEQ ID NO: 10976 - DNA, 24 bp, Artificial Sequence
  Synthetic
ctcagagtattgaggataactaca

SEQ ID NO: 10977 - DNA, 18 bp, Artificial Sequence
  Synthetic
ggagactactgcccaaga

SEQ ID NO: 10978 - DNA, 20 bp, Artificial Sequence
  Synthetic
gctacctgtgccataaacca

SEQ ID NO: 10979 - DNA, 18 bp, Artificial Sequence
  Synthetic
gaggacggtgagcaacct

SEQ ID NO: 10980 - DNA, 18 bp, Artificial Sequence
  Synthetic
gccacagtggacagaacc

SEQ ID NO: 10981 - DNA, 20 bp, Artificial Sequence
  Synthetic
ggcagaagctcacaaaaagc

SEQ ID NO: 10982 - DNA, 19 bp, Artificial Sequence
  Synthetic
tggagctagcaagacagtt

SEQ ID NO: 10983 - DNA, 22 bp, Artificial Sequence
  Synthetic
caacatatgctcatagaacctc

SEQ ID NO: 10984 - DNA, 18 bp, Artificial Sequence
  Synthetic
ggcattcctagcaagcaa

SEQ ID NO: 10985 - DNA, 20 bp, Artificial Sequence
  Synthetic
atatatggacctgcagacac

SEQ ID NO: 10986 - DNA, 22 bp, Artificial Sequence
  Synthetic
atgacaacaaataccaatccct

SEQ ID NO: 10987 - DNA, 19 bp, Artificial Sequence
  Synthetic
aaaaagggctacaccgtag

SEQ ID NO: 10988 - DNA, 20 bp, Artificial Sequence
  Synthetic
tactgaccccccatacaccg

SEQ ID NO: 10989 - DNA, 23 bp, Artificial Sequence
  Synthetic
ggtgatccaaacaaattaaagtg

SEQ ID NO: 10990 - DNA, 20 bp, Artificial Sequence
  Synthetic
ggaacgttaagggacatctg

SEQ ID NO: 10991 - DNA, 24 bp, Artificial Sequence
  Synthetic
tgctgctcaattgtatatattcct

SEQ ID NO: 10992 - DNA, 18 bp, Artificial Sequence
  Synthetic
tggggtagcttgggtgtc

SEQ ID NO: 10993 - DNA, 18 bp, Artificial Sequence
  Synthetic
gttgtacagcagggcata

SEQ ID NO: 10994 - DNA, 25 bp, Artificial Sequence
  Synthetic
caaacatatattattatgcaggcag

SEQ ID NO: 10995 - DNA, 18 bp, Artificial Sequence
  Synthetic
gttgtacaaccgcctgta

SEQ ID NO: 10996 - DNA, 20 bp, Artificial Sequence
  Synthetic
cgttgcaaaccaataagtct

SEQ ID NO: 10997 - DNA, 18 bp, Artificial Sequence
  Synthetic
cctagtgggtccatggtt

SEQ ID NO: 10998 - DNA, 21 bp, Artificial Sequence
  Synthetic
cctctacaaaacgtaaacggt

SEQ ID NO: 10999 - DNA, 18 bp, Artificial Sequence
  Synthetic
ggttgcgccttgtgagtc

SEQ ID NO: 11000 - DNA, 20 bp, Artificial Sequence
  Synthetic
ccctaataggggcgacactc

SEQ ID NO: 11001 - DNA, 20 bp, Artificial Sequence
  Synthetic
gcaccatgagcacaaatcct

SEQ ID NO: 11002 - DNA, 19 bp, Artificial Sequence
  Synthetic
caatgacccccggcatagg

SEQ ID NO: 11003 - DNA, 19 bp, Artificial Sequence
  Synthetic
gcattacctggcagctcca

SEQ ID NO: 11004 - DNA, 20 bp, Artificial Sequence
  Synthetic
atgatgatgaactggtcgcc

SEQ ID NO: 11005 - DNA, 19 bp, Artificial Sequence
  Synthetic
gccctgaactgcaatgact

SEQ ID NO: 11006 - DNA, 20 bp, Artificial Sequence
  Synthetic
attgaacagcactcgaccac

SEQ ID NO: 11007 - DNA, 18 bp, Artificial Sequence
  Synthetic
ctcacggctgcatgcaat

SEQ ID NO: 11008 - DNA, 20 bp, Artificial Sequence
  Synthetic
cagcactagagaagctggtc

SEQ ID NO: 11009 - DNA, 20 bp, Artificial Sequence
  Synthetic
ccgtgatggcatcatatggg

SEQ ID NO: 11010 - DNA, 19 bp, Artificial Sequence
  Synthetic
gtcattgtctggggagcgg

SEQ ID NO: 11011 - DNA, 19 bp, Artificial Sequence
  Synthetic
tccttcctcggaacatcca

SEQ ID NO: 11012 - DNA, 18 bp, Artificial Sequence
  Synthetic
gggcgtggctaagtccat

SEQ ID NO: 11013 - DNA, 18 bp, Artificial Sequence
  Synthetic
cgcccatcacgtactcca

SEQ ID NO: 11014 - DNA, 20 bp, Artificial Sequence
  Synthetic
aaaaagtgtgacgagctcgc

SEQ ID NO: 11015 - DNA, 20 bp, Artificial Sequence
  Synthetic
tatgtttccactggtgagcg

SEQ ID NO: 11016 - DNA, 20 bp, Artificial Sequence
  Synthetic
tgtttgactcgactcaagcc

SEQ ID NO: 11017 - DNA, 18 bp, Artificial Sequence
  Synthetic
gggcggctctcattgaag

SEQ ID NO: 11018 - DNA, 19 bp, Artificial Sequence
  Synthetic
cagtggcctagtgggagct

SEQ ID NO: 11019 - DNA, 18 bp, Artificial Sequence
  Synthetic
caatgtccgcttgggctc

SEQ ID NO: 11020 - DNA, 19 bp, Artificial Sequence
  Synthetic
tcgttctgcgttgggctta

SEQ ID NO: 11021 - DNA, 20 bp, Artificial Sequence
  Synthetic
acccaatggtcgaagaaagg

SEQ ID NO: 11022 - DNA, 16 bp, Artificial Sequence
  Synthetic
cggcagtcagacgcct

SEQ ID NO: 11023 - DNA, 20 bp, Artificial Sequence
  Synthetic
acaaagagcgcctcactaag

SEQ ID NO: 11024 - DNA, 18 bp, Artificial Sequence
  Synthetic
caaggggggcaagaaagc

SEQ ID NO: 11025 - DNA, 18 bp, Artificial Sequence
  Synthetic
ggccaaacctgcgggtac

SEQ ID NO: 11026 - DNA, 20 bp, Artificial Sequence
  Synthetic
ccccagaccggagtatgatc

SEQ ID NO: 11027 - DNA, 20 bp, Artificial Sequence
  Synthetic
aaggttacatgggcttgacg

SEQ ID NO: 11028 - DNA, 19 bp, Artificial Sequence
  Synthetic
ctcaacggtctgctgatgc

SEQ ID NO: 11029 - DNA, 19 bp, Artificial Sequence
  Synthetic
ggcggtgatttgttcgtcg

SEQ ID NO: 11030 - DNA, 18 bp, Artificial Sequence
  Synthetic
gcgcggaggttttgtacg

SEQ ID NO: 11031 - DNA, 17 bp, Artificial Sequence
  Synthetic
ccagcaggctcagttcg

SEQ ID NO: 11032 - DNA, 18 bp, Artificial Sequence
  Synthetic
gattccaaacgcggtgca

SEQ ID NO: 11033 - DNA, 16 bp, Artificial Sequence
  Synthetic
ggtcaacagcggcgac

SEQ ID NO: 11034 - DNA, 19 bp, Artificial Sequence
  Synthetic
cgagctggtacttcttccg

SEQ ID NO: 11035 - DNA, 16 bp, Artificial Sequence
  Synthetic
caggctggccgacagt

SEQ ID NO: 11036 - DNA, 18 bp, Artificial Sequence
  Synthetic
ccaagtcggctacgcaat

SEQ ID NO: 11037 - DNA, 17 bp, Artificial Sequence
  Synthetic
gttcgggtacgctgtcg

SEQ ID NO: 11038 - DNA, 19 bp, Artificial Sequence
  Synthetic
cgattaaatcgtgctcgcg

SEQ ID NO: 11039 - DNA, 20 bp, Artificial Sequence
  Synthetic
ttttgatgttttggtcgcgc

SEQ ID NO: 11040 - DNA, 20 bp, Artificial Sequence
  Synthetic
aataaaactactgcgccgca

SEQ ID NO: 11041 - DNA, 15 bp, Artificial Sequence
  Synthetic
gcgattgcgtgccga

SEQ ID NO: 11042 - DNA, 17 bp, Artificial Sequence
  Synthetic
ggaacgggtgcgtttcc

SEQ ID NO: 11043 - DNA, 20 bp, Artificial Sequence
  Synthetic
tcatatcggtcagcggtact

SEQ ID NO: 11044 - DNA, 17 bp, Artificial Sequence
  Synthetic
tggtgaaatcgctggcg

SEQ ID NO: 11045 - DNA, 18 bp, Artificial Sequence
  Synthetic
cttggtcgtttccacgct

SEQ ID NO: 11046 - DNA, 17 bp, Artificial Sequence
  Synthetic
cggcaggctttcctcga

SEQ ID NO: 11047 - DNA, 16 bp, Artificial Sequence
  Synthetic
tctgcggcggctttcc

SEQ ID NO: 11048 - DNA, 16 bp, Artificial Sequence
  Synthetic
cctgtccgagcgaggt

SEQ ID NO: 11049 - DNA, 16 bp, Artificial Sequence
  Synthetic
cggcggcggttttcac

SEQ ID NO: 11050 - DNA, 16 bp, Artificial Sequence
  Synthetic
ggggttgcgggtgtgt

SEQ ID NO: 11051 - DNA, 16 bp, Artificial Sequence
  Synthetic
gtgaggctgggcggat

SEQ ID NO: 11052 - DNA, 16 bp, Artificial Sequence
  Synthetic
gcctgagaagggcgga

SEQ ID NO: 11053 - DNA, 16 bp, Artificial Sequence
  Synthetic
gttgccgagccagcga

SEQ ID NO: 11054 - DNA, 20 bp, Artificial Sequence
  Synthetic
gaaaaactatctgccgctgc

SEQ ID NO: 11055 - DNA, 17 bp, Artificial Sequence
  Synthetic
agtcgtcgaagccgtgc

SEQ ID NO: 11056 - DNA, 19 bp, Artificial Sequence
  Synthetic
gccagatttgttcggtggg

SEQ ID NO: 11057 - DNA, 16 bp, Artificial Sequence
  Synthetic
atgcgccgtcagagcc

SEQ ID NO: 11058 - DNA, 16 bp, Artificial Sequence
  Synthetic
cgtccgcgcaggttac

SEQ ID NO: 11059 - DNA, 20 bp, Artificial Sequence
  Synthetic
ggggacgacttctttttcca

SEQ ID NO: 11060 - DNA, 18 bp, Artificial Sequence
  Synthetic
ccaatgcgttggcgagtt

SEQ ID NO: 11061 - DNA, 20 bp, Artificial Sequence
  Synthetic
cgctttttcaacggtggcat

SEQ ID NO: 11062 - DNA, 18 bp, Artificial Sequence
  Synthetic
gtgccgatttccgtgtct

SEQ ID NO: 11063 - DNA, 17 bp, Artificial Sequence
  Synthetic
tgttcgggcgttcgtct

SEQ ID NO: 11064 - DNA, 17 bp, Artificial Sequence
  Synthetic
ttcctcgccgcattgtg

SEQ ID NO: 11065 - DNA, 18 bp, Artificial Sequence
  Synthetic
gcgccgtttaccgctatg

SEQ ID NO: 11066 - DNA, 18 bp, Artificial Sequence
  Synthetic
cctgctgcccgtattggc

SEQ ID NO: 11067 - DNA, 20 bp, Artificial Sequence
  Synthetic
taccgagttcgcctattccc

SEQ ID NO: 11068 - DNA, 16 bp, Artificial Sequence
  Synthetic
gattgcccgtcgtggc

SEQ ID NO: 11069 - DNA, 18 bp, Artificial Sequence
  Synthetic
cctcttggcaagcagcaa

SEQ ID NO: 11070 - DNA, 17 bp, Artificial Sequence
  Synthetic
gttcccggccatcaacg

SEQ ID NO: 11071 - DNA, 16 bp, Artificial Sequence
  Synthetic
ggctggacggcatcga

SEQ ID NO: 11072 - DNA, 18 bp, Artificial Sequence
  Synthetic
agcacttggtcggctttg

SEQ ID NO: 11073 - DNA, 16 bp, Artificial Sequence
  Synthetic
aaacagcccgccctga

SEQ ID NO: 11074 - DNA, 17 bp, Artificial Sequence
  Synthetic
gcgcaggcccaaaaagt

SEQ ID NO: 11075 - DNA, 20 bp, Artificial Sequence
  Synthetic
ctgaagcataaagccgaagc

SEQ ID NO: 11076 - DNA, 17 bp, Artificial Sequence
  Synthetic
gcgttacgccgctgtca

SEQ ID NO: 11077 - DNA, 16 bp, Artificial Sequence
  Synthetic
ggcgttgacgagcagg

SEQ ID NO: 11078 - DNA, 19 bp, Artificial Sequence
  Synthetic
aacgcgatttcgtcgtcgg

SEQ ID NO: 11079 - DNA, 20 bp, Artificial Sequence
  Synthetic
gttggacagcaggactttgg

SEQ ID NO: 11080 - DNA, 18 bp, Artificial Sequence
  Synthetic
aggccaggcagaacaatg

SEQ ID NO: 11081 - DNA, 16 bp, Artificial Sequence
  Synthetic
gcgcccaaggtggcaa

SEQ ID NO: 11082 - DNA, 18 bp, Artificial Sequence
  Synthetic
aaacagcaaaaaggcggc

SEQ ID NO: 11083 - DNA, 18 bp, Artificial Sequence
  Synthetic
aagtgtctttgtcggcgg

SEQ ID NO: 11084 - DNA, 19 bp, Artificial Sequence
  Synthetic
ggcgcaaagttggaaaagc

SEQ ID NO: 11085 - DNA, 17 bp, Artificial Sequence
  Synthetic
tcaggcggacggtttcg

SEQ ID NO: 11086 - DNA, 17 bp, Artificial Sequence
  Synthetic
tcgccagcgaggtttga

SEQ ID NO: 11087 - DNA, 17 bp, Artificial Sequence
  Synthetic
tgcggcggaggttttgc

SEQ ID NO: 11088 - DNA, 18 bp, Artificial Sequence
  Synthetic
ggcgatcatgtggcagtg

SEQ ID NO: 11089 - DNA, 18 bp, Artificial Sequence
  Synthetic
ggtcaggggcataggcga

SEQ ID NO: 11090 - DNA, 15 bp, Artificial Sequence
  Synthetic
ggcgcggttttgcct

SEQ ID NO: 11091 - DNA, 15 bp, Artificial Sequence
  Synthetic
cggcggcattgcgtt

SEQ ID NO: 11092 - DNA, 19 bp, Artificial Sequence
  Synthetic
cgtagcatacggtttgcgg

SEQ ID NO: 11093 - DNA, 20 bp, Artificial Sequence
  Synthetic
gtcaggtagtcgatgtcgga

SEQ ID NO: 11094 - DNA, 16 bp, Artificial Sequence
  Synthetic
cggcaggtgtcggaca

SEQ ID NO: 11095 - DNA, 17 bp, Artificial Sequence
  Synthetic
cggcgttggacgttacg

SEQ ID NO: 11096 - DNA, 16 bp, Artificial Sequence
  Synthetic
gcatgaaggccgccga

SEQ ID NO: 11097 - DNA, 18 bp, Artificial Sequence
  Synthetic
gtgcctatgctgcgcttc

SEQ ID NO: 11098 - DNA, 18 bp, Artificial Sequence
  Synthetic
acccacacatcggattgc

SEQ ID NO: 11099 - DNA, 16 bp, Artificial Sequence
  Synthetic
cggtggcgtgcatacc

SEQ ID NO: 11100 - DNA, 18 bp, Artificial Sequence
  Synthetic
cgtacacggcttgggaaa

SEQ ID NO: 11101 - DNA, 20 bp, Artificial Sequence
  Synthetic
agacgatgtcgcattgttcc

SEQ ID NO: 11102 - DNA, 19 bp, Artificial Sequence
  Synthetic
aagccttcagtgaagactt

SEQ ID NO: 11103 - DNA, 20 bp, Artificial Sequence
  Synthetic
atgaacgaaatgaccgctgt

SEQ ID NO: 11104 - DNA, 20 bp, Artificial Sequence
  Synthetic
cgcaagtttacgggaattgc

SEQ ID NO: 11105 - DNA, 16 bp, Artificial Sequence
  Synthetic
cgatatcgcggcgcaa

SEQ ID NO: 11106 - DNA, 20 bp, Artificial Sequence
  Synthetic
ccaacagcgcggattttgtc

SEQ ID NO: 11107 - DNA, 16 bp, Artificial Sequence
  Synthetic
ccccgccattactgcg

SEQ ID NO: 11108 - DNA, 20 bp, Artificial Sequence
  Synthetic
gtaggtaacgagcaatccgg

SEQ ID NO: 11109 - DNA, 16 bp, Artificial Sequence
  Synthetic
ggtttgcccagcgacc

SEQ ID NO: 11110 - DNA, 19 bp, Artificial Sequence
  Synthetic
gtttttcagctgttcggcg

SEQ ID NO: 11111 - DNA, 18 bp, Artificial Sequence
  Synthetic
acagcccgatggttttcg

SEQ ID NO: 11112 - DNA, 15 bp, Artificial Sequence
  Synthetic
tgcttctgccgcgca

SEQ ID NO: 11113 - DNA, 16 bp, Artificial Sequence
  Synthetic
ttccgccgcctctgtc

SEQ ID NO: 11114 - DNA, 19 bp, Artificial Sequence
  Synthetic
cgttacaacgtcggactcg

SEQ ID NO: 11115 - DNA, 18 bp, Artificial Sequence
  Synthetic
aacggcgacatcacttcg

SEQ ID NO: 11116 - DNA, 18 bp, Artificial Sequence
  Synthetic
tcttgaaaggcttgccgg

SEQ ID NO: 11117 - DNA, 19 bp, Artificial Sequence
  Synthetic
acaggtgttcgtcaacgtc

SEQ ID NO: 11118 - DNA, 20 bp, Artificial Sequence
  Synthetic
gatttgctcgcgctttacca

SEQ ID NO: 11119 - DNA, 17 bp, Artificial Sequence
  Synthetic
cgaagccgtcgttccct

SEQ ID NO: 11120 - DNA, 16 bp, Artificial Sequence
  Synthetic
cggcgtggctcaatgc

SEQ ID NO: 11121 - DNA, 18 bp, Artificial Sequence
  Synthetic
ccgctggagattttgcgg

SEQ ID NO: 11122 - DNA, 17 bp, Artificial Sequence
  Synthetic
ggcgacgatgttgctgt

SEQ ID NO: 11123 - DNA, 20 bp, Artificial Sequence
  Synthetic
tttgtgttccaggtatgcgg

SEQ ID NO: 11124 - DNA, 18 bp, Artificial Sequence
  Synthetic
tgtgttggcggtattcgg

SEQ ID NO: 11125 - DNA, 18 bp, Artificial Sequence
  Synthetic
gtggctgccgaattggaa

SEQ ID NO: 11126 - DNA, 17 bp, Artificial Sequence
  Synthetic
aggatggtcaggacggc

SEQ ID NO: 11127 - DNA, 19 bp, Artificial Sequence
  Synthetic
tgtcggacaggatgtcgag

SEQ ID NO: 11128 - DNA, 20 bp, Artificial Sequence
  Synthetic
cgtatggcgggtaaattggc

SEQ ID NO: 11129 - DNA, 18 bp, Artificial Sequence
  Synthetic
gtcagttcgagcggcatg

SEQ ID NO: 11130 - DNA, 19 bp, Artificial Sequence
  Synthetic
ttttggcactgtcgtcagc

SEQ ID NO: 11131 - DNA, 20 bp, Artificial Sequence
  Synthetic
tatagctgacttcgacggcc

SEQ ID NO: 11132 - DNA, 18 bp, Artificial Sequence
  Synthetic
cggtagcggcataaggtg

SEQ ID NO: 11133 - DNA, 18 bp, Artificial Sequence
  Synthetic
cggcggtctctgaggtaa

SEQ ID NO: 11134 - DNA, 19 bp, Artificial Sequence
  Synthetic
aatgcgtttcaggcggtat

SEQ ID NO: 11135 - DNA, 16 bp, Artificial Sequence
  Synthetic
gccaaataccggcgcg

SEQ ID NO: 11136 - DNA, 20 bp, Artificial Sequence
  Synthetic
ttgctgaaaaaagacagtcc

SEQ ID NO: 11137 - DNA, 19 bp, Artificial Sequence
  Synthetic
ccttgccctgaccgacttt

SEQ ID NO: 11138 - DNA, 18 bp, Artificial Sequence
  Synthetic
gtcgccgacgtagagggt

SEQ ID NO: 11139 - DNA, 15 bp, Artificial Sequence
  Synthetic
gcgccgcgtttttgc

SEQ ID NO: 11140 - DNA, 16 bp, Artificial Sequence
  Synthetic
gtaacggcggcggtgt

SEQ ID NO: 11141 - DNA, 19 bp, Artificial Sequence
  Synthetic
gtcgagggaatctgccagt

SEQ ID NO: 11142 - DNA, 20 bp, Artificial Sequence
  Synthetic
tggtgaacacgatgtcttcc

SEQ ID NO: 11143 - DNA, 16 bp, Artificial Sequence
  Synthetic
cgcaccgtccacgaca

SEQ ID NO: 11144 - DNA, 19 bp, Artificial Sequence
  Synthetic
agattttgtcggcatcggg

SEQ ID NO: 11145 - DNA, 19 bp, Artificial Sequence
  Synthetic
gttgtccgcccgaaagttc

SEQ ID NO: 11146 - DNA, 16 bp, Artificial Sequence
  Synthetic
gcggcggcgtattgtg

SEQ ID NO: 11147 - DNA, 18 bp, Artificial Sequence
  Synthetic
tcagacagtttgcgggtg

SEQ ID NO: 11148 - DNA, 19 bp, Artificial Sequence
  Synthetic
caattcggcggtgatttcg

SEQ ID NO: 11149 - DNA, 20 bp, Artificial Sequence
  Synthetic
caggccggttaaaagatcga

SEQ ID NO: 11150 - DNA, 20 bp, Artificial Sequence
  Synthetic
ctgcccagttccaaaatcgc

SEQ ID NO: 11151 - DNA, 18 bp, Artificial Sequence
  Synthetic
gacgcaaggagtaggcga

SEQ ID NO: 11152 - DNA, 17 bp, Artificial Sequence
  Synthetic
gatgctggcatcgtggg

SEQ ID NO: 11153 - DNA, 20 bp, Artificial Sequence
  Synthetic
ctttctttgtcaatgccggg

SEQ ID NO: 11154 - DNA, 16 bp, Artificial Sequence
  Synthetic
cggacgatgcacgagc

SEQ ID NO: 11155 - DNA, 17 bp, Artificial Sequence
  Synthetic
gccgcggttgacgatgt

SEQ ID NO: 11156 - DNA, 19 bp, Artificial Sequence
  Synthetic
cttcgctgaggacggaaac

SEQ ID NO: 11157 - DNA, 17 bp, Artificial Sequence
  Synthetic
cgacggcttcgccttct

SEQ ID NO: 11158 - DNA, 17 bp, Artificial Sequence
  Synthetic
ctgtcgggcagcttgag

SEQ ID NO: 11159 - DNA, 18 bp, Artificial Sequence
  Synthetic
ttctacgccgctgatgct

SEQ ID NO: 11160 - DNA, 18 bp, Artificial Sequence
  Synthetic
cttcctgcgaggcaagtc

SEQ ID NO: 11161 - DNA, 18 bp, Artificial Sequence
  Synthetic
tgccaacagcgtttcgag

SEQ ID NO: 11162 - DNA, 19 bp, Artificial Sequence
  Synthetic
cgtgcaatcaggaaatggc

SEQ ID NO: 11163 - DNA, 17 bp, Artificial Sequence
  Synthetic
aacattgggtgcagggc

SEQ ID NO: 11164 - DNA, 15 bp, Artificial Sequence
  Synthetic
aggctacgggcgcaa

SEQ ID NO: 11165 - DNA, 16 bp, Artificial Sequence
  Synthetic
cgccggcttcctgcaa

SEQ ID NO: 11166 - DNA, 16 bp, Artificial Sequence
  Synthetic
gtcgtcgttgccgcgt

SEQ ID NO: 11167 - DNA, 16 bp, Artificial Sequence
  Synthetic
cgcgccgtcatcatgc

SEQ ID NO: 11168 - DNA, 18 bp, Artificial Sequence
  Synthetic
ttatcgggcgcgtgatga

SEQ ID NO: 11169 - DNA, 16 bp, Artificial Sequence
  Synthetic
gtgtgcgcccccatca

SEQ ID NO: 11170 - DNA, 19 bp, Artificial Sequence
  Synthetic
ggcgacggtctgtatttgg

SEQ ID NO: 11171 - DNA, 16 bp, Artificial Sequence
  Synthetic
gtcgatacgccgggct

SEQ ID NO: 11172 - DNA, 18 bp, Artificial Sequence
  Synthetic
cgataaaggcggcgactt

SEQ ID NO: 11173 - DNA, 17 bp, Artificial Sequence
  Synthetic
ggccggatatcgcgttc

SEQ ID NO: 11174 - DNA, 18 bp, Artificial Sequence
  Synthetic
gctcgctgatttcgctgt

SEQ ID NO: 11175 - DNA, 16 bp, Artificial Sequence
  Synthetic
ccgggcaggacttgga

SEQ ID NO: 11176 - DNA, 18 bp, Artificial Sequence
  Synthetic
tggatacgcctgaccacg

SEQ ID NO: 11177 - DNA, 20 bp, Artificial Sequence
  Synthetic
ttcacaaaatctcttgcgtg

SEQ ID NO: 11178 - DNA, 21 bp, Artificial Sequence
  Synthetic
ctacatcattatgaccgttgt

SEQ ID NO: 11179 - DNA, 18 bp, Artificial Sequence
  Synthetic
ggactggtggtgcatccg

SEQ ID NO: 11180 - DNA, 19 bp, Artificial Sequence
  Synthetic
acgctatcttgcccacagc

SEQ ID NO: 11181 - DNA, 18 bp, Artificial Sequence
  Synthetic
tgtgggaagccaaaccgg

SEQ ID NO: 11182 - DNA, 20 bp, Artificial Sequence
  Synthetic
gggcatgccgtcaatatcga

SEQ ID NO: 11183 - DNA, 18 bp, Artificial Sequence
  Synthetic
gaagacgtgcggacgctg

SEQ ID NO: 11184 - DNA, 16 bp, Artificial Sequence
  Synthetic
aatctggcggatgcgc

SEQ ID NO: 11185 - DNA, 17 bp, Artificial Sequence
  Synthetic
gcgtttgaccgccttca

SEQ ID NO: 11186 - DNA, 16 bp, Artificial Sequence
  Synthetic
tcggggcgggtgaagt

SEQ ID NO: 11187 - DNA, 19 bp, Artificial Sequence
  Synthetic
cacagtgccggataaaggg

SEQ ID NO: 11188 - DNA, 16 bp, Artificial Sequence
  Synthetic
aggccgaggttgtggg

SEQ ID NO: 11189 - DNA, 19 bp, Artificial Sequence
  Synthetic
ctgtcgctgctgattcagg

SEQ ID NO: 11190 - DNA, 20 bp, Artificial Sequence
  Synthetic
tcgccgaaacgggtaaacag

SEQ ID NO: 11191 - DNA, 22 bp, Artificial Sequence
  Synthetic
cgtcaagcaactctatcctaat

SEQ ID NO: 11192 - DNA, 18 bp, Artificial Sequence
  Synthetic
gcaacttttggaacgtgt

SEQ ID NO: 11193 - DNA, 19 bp, Artificial Sequence
  Synthetic
cggtaaggattgggaacag

SEQ ID NO: 11194 - DNA, 18 bp, Artificial Sequence
  Synthetic
cgaacccggcattaccaa

SEQ ID NO: 11195 - DNA, 19 bp, Artificial Sequence
  Synthetic
tagctttcgcctgaaacgg

SEQ ID NO: 11196 - DNA, 19 bp, Artificial Sequence
  Synthetic
gggcaggatgtgttcgatg

SEQ ID NO: 11197 - DNA, 17 bp, Artificial Sequence
  Synthetic
gctttgggctttgcggt

SEQ ID NO: 11198 - DNA, 18 bp, Artificial Sequence
  Synthetic
ttggatgaggacaggttg

SEQ ID NO: 11199 - DNA, 18 bp, Artificial Sequence
  Synthetic
ttacccccgaggacgtgc

SEQ ID NO: 11200 - DNA, 19 bp, Artificial Sequence
  Synthetic
ctgccttcttatggcgaac

SEQ ID NO: 11201 - DNA, 18 bp, Artificial Sequence
  Synthetic
cttgtcggcaatcggtgt

SEQ ID NO: 11202 - DNA, 16 bp, Artificial Sequence
  Synthetic
caccacgtcgccgact

SEQ ID NO: 11203 - DNA, 19 bp, Artificial Sequence
  Synthetic
tgccggaagaaggttttgc

SEQ ID NO: 11204 - DNA, 19 bp, Artificial Sequence
  Synthetic
cagctcaaaatgttgctgt

SEQ ID NO: 11205 - DNA, 15 bp, Artificial Sequence
  Synthetic
gcgggcgtgtttgca

SEQ ID NO: 11206 - DNA, 17 bp, Artificial Sequence
  Synthetic
ttaaatgccgtccgcgc

SEQ ID NO: 11207 - DNA, 18 bp, Artificial Sequence
  Synthetic
acagcagctttcccgcta

SEQ ID NO: 11208 - DNA, 18 bp, Artificial Sequence
  Synthetic
cgataacgcgcttctgct

SEQ ID NO: 11209 - DNA, 18 bp, Artificial Sequence
  Synthetic
aggtcgcacgtatcctga

SEQ ID NO: 11210 - DNA, 20 bp, Artificial Sequence
  Synthetic
aatcgggaatagttggatca

SEQ ID NO: 11211 - DNA, 17 bp, Artificial Sequence
  Synthetic
attgcggcgagtggaac

SEQ ID NO: 11212 - DNA, 16 bp, Artificial Sequence
  Synthetic
ccgccgcctttgccat

SEQ ID NO: 11213 - DNA, 16 bp, Artificial Sequence
  Synthetic
gaaatccgtgccggcc

SEQ ID NO: 11214 - DNA, 16 bp, Artificial Sequence
  Synthetic
tgcatcgggcagccct

SEQ ID NO: 11215 - DNA, 18 bp, Artificial Sequence
  Synthetic
accgttgtaatcgggcgg

SEQ ID NO: 11216 - DNA, 17 bp, Artificial Sequence
  Synthetic
taagcccgtgccgaaca

SEQ ID NO: 11217 - DNA, 19 bp, Artificial Sequence
  Synthetic
gggcgacttccttccattg

SEQ ID NO: 11218 - DNA, 20 bp, Artificial Sequence
  Synthetic
ggtcggcattaaagacctgc

SEQ ID NO: 11219 - DNA, 20 bp, Artificial Sequence
  Synthetic
tttgtttgatgccgtgtccg

SEQ ID NO: 11220 - DNA, 16 bp, Artificial Sequence
  Synthetic
aggcggctgacgggat

SEQ ID NO: 11221 - DNA, 18 bp, Artificial Sequence
  Synthetic
cggttgaggtcgaaggtg

SEQ ID NO: 11222 - DNA, 18 bp, Artificial Sequence
  Synthetic
caccgccgatttggaagc

SEQ ID NO: 11223 - DNA, 19 bp, Artificial Sequence
  Synthetic
caaaaggatgttgctgccg

SEQ ID NO: 11224 - DNA, 17 bp, Artificial Sequence
  Synthetic
gcgggcgttatgacgga

SEQ ID NO: 11225 - DNA, 18 bp, Artificial Sequence
  Synthetic
gtcggcggcaaaaaaacc

SEQ ID NO: 11226 - DNA, 16 bp, Artificial Sequence
  Synthetic
cctgcccgctgatcct

SEQ ID NO: 11227 - DNA, 20 bp, Artificial Sequence
  Synthetic
ttgaccacgccttgaatcag

SEQ ID NO: 11228 - DNA, 18 bp, Artificial Sequence
  Synthetic
cgggtatccgcttggacg

SEQ ID NO: 11229 - DNA, 18 bp, Artificial Sequence
  Synthetic
ggactggtgtcaggacga

SEQ ID NO: 11230 - DNA, 18 bp, Artificial Sequence
  Synthetic
gctttgtcgggcaggaag

SEQ ID NO: 11231 - DNA, 19 bp, Artificial Sequence
  Synthetic
caaaacgtccaaaggctcg

SEQ ID NO: 11232 - DNA, 18 bp, Artificial Sequence
  Synthetic
aacaacccggtcagccaa

SEQ ID NO: 11233 - DNA, 18 bp, Artificial Sequence
  Synthetic
cgatgtcgtccccctcga

SEQ ID NO: 11234 - DNA, 19 bp, Artificial Sequence
  Synthetic
tcagacgactttggtggcg

SEQ ID NO: 11235 - DNA, 16 bp, Artificial Sequence
  Synthetic
cccgcctgcgacatca

SEQ ID NO: 11236 - DNA, 18 bp, Artificial Sequence
  Synthetic
atcgggtatgcgcacttg

SEQ ID NO: 11237 - DNA, 18 bp, Artificial Sequence
  Synthetic
tttccgccctcgaaaggc

SEQ ID NO: 11238 - DNA, 16 bp, Artificial Sequence
  Synthetic
ctgccggcgcgcatat

SEQ ID NO: 11239 - DNA, 16 bp, Artificial Sequence
  Synthetic
cgaacgcgcacggctt

SEQ ID NO: 11240 - DNA, 16 bp, Artificial Sequence
  Synthetic
caatgacggcggcgat

SEQ ID NO: 11241 - DNA, 18 bp, Artificial Sequence
  Synthetic
atgatgggaagaaggacg

SEQ ID NO: 11242 - DNA, 17 bp, Artificial Sequence
  Synthetic
gctggttacgccgaggt

SEQ ID NO: 11243 - DNA, 17 bp, Artificial Sequence
  Synthetic
tattcccccgttgcccg

SEQ ID NO: 11244 - DNA, 16 bp, Artificial Sequence
  Synthetic
gcggctgttgcggtag

SEQ ID NO: 11245 - DNA, 18 bp, Artificial Sequence
  Synthetic
cgacaaccaatgcgactt

SEQ ID NO: 11246 - DNA, 17 bp, Artificial Sequence
  Synthetic
cacgtcagggcttcgtc

SEQ ID NO: 11247 - DNA, 20 bp, Artificial Sequence
  Synthetic
cgttcaggaggccgtaattc

SEQ ID NO: 11248 - DNA, 17 bp, Artificial Sequence
  Synthetic
gtttctctgccgccgtt

SEQ ID NO: 11249 - DNA, 16 bp, Artificial Sequence
  Synthetic
caccgcgtccgctaag

SEQ ID NO: 11250 - DNA, 17 bp, Artificial Sequence
  Synthetic
acgaagttttgggcggc

SEQ ID NO: 11251 - DNA, 18 bp, Artificial Sequence
  Synthetic
cggtttccaaagacggcg

SEQ ID NO: 11252 - DNA, 16 bp, Artificial Sequence
  Synthetic
ccgatattgggcgccg

SEQ ID NO: 11253 - DNA, 16 bp, Artificial Sequence
  Synthetic
cgcgatgccgtccgaa

SEQ ID NO: 11254 - DNA, 18 bp, Artificial Sequence
  Synthetic
catgggcgaaggtggatg

SEQ ID NO: 11255 - DNA, 16 bp, Artificial Sequence
  Synthetic
gggcttgacgggcgaa

SEQ ID NO: 11256 - DNA, 20 bp, Artificial Sequence
  Synthetic
ttttgcgtagggtttagcat

SEQ ID NO: 11257 - DNA, 16 bp, Artificial Sequence
  Synthetic
caggtttcggtgcggg

SEQ ID NO: 11258 - DNA, 16 bp, Artificial Sequence
  Synthetic
gggatttggcggcgga

SEQ ID NO: 11259 - DNA, 18 bp, Artificial Sequence
  Synthetic
tgtgcaggaattggcagg

SEQ ID NO: 11260 - DNA, 18 bp, Artificial Sequence
  Synthetic
atatgaagttcggcgcgg

SEQ ID NO: 11261 - DNA, 16 bp, Artificial Sequence
  Synthetic
cgatacgttcggcggc

SEQ ID NO: 11262 - DNA, 17 bp, Artificial Sequence
  Synthetic
ctaaaaccgggcagccg

SEQ ID NO: 11263 - DNA, 18 bp, Artificial Sequence
  Synthetic
gttgaacatgaccggcgg

SEQ ID NO: 11264 - DNA, 17 bp, Artificial Sequence
  Synthetic
tgtcgtttcgggcgaag

SEQ ID NO: 11265 - DNA, 16 bp, Artificial Sequence
  Synthetic
gcgaagaagcggccga

SEQ ID NO: 11266 - DNA, 18 bp, Artificial Sequence
  Synthetic
ccctgcagatttcagccg

SEQ ID NO: 11267 - DNA, 18 bp, Artificial Sequence
  Synthetic
caggtcgtccgtgaaggt

SEQ ID NO: 11268 - DNA, 20 bp, Artificial Sequence
  Synthetic
tgctgaagcacaatctgacg

SEQ ID NO: 11269 - DNA, 20 bp, Artificial Sequence
  Synthetic
tttcgaccgcacaaatacgt

SEQ ID NO: 11270 - DNA, 16 bp, Artificial Sequence
  Synthetic
cgggcagcgtcaacga

SEQ ID NO: 11271 - DNA, 16 bp, Artificial Sequence
  Synthetic
ggcacgcccgaaagca

SEQ ID NO: 11272 - DNA, 16 bp, Artificial Sequence
  Synthetic
ccggtggcagtggaca

SEQ ID NO: 11273 - DNA, 17 bp, Artificial Sequence
  Synthetic
atttccgtaccggcggc

SEQ ID NO: 11274 - DNA, 16 bp, Artificial Sequence
  Synthetic
ggacgcgcggtcatca

SEQ ID NO: 11275 - DNA, 16 bp, Artificial Sequence
  Synthetic
tgtcggtttgcgccgt

SEQ ID NO: 11276 - DNA, 17 bp, Artificial Sequence
  Synthetic
gatgttttcggcggcgg

SEQ ID NO: 11277 - DNA, 16 bp, Artificial Sequence
  Synthetic
gaacgggccgccgata

SEQ ID NO: 11278 - DNA, 20 bp, Artificial Sequence
  Synthetic
gcctatgacgcattgcagga

SEQ ID NO: 11279 - DNA, 20 bp, Artificial Sequence
  Synthetic
gcgcatatcccatatgtcgg

SEQ ID NO: 11280 - DNA, 19 bp, Artificial Sequence
  Synthetic
agccgttgacgatggtttc

SEQ ID NO: 11281 - DNA, 20 bp, Artificial Sequence
  Synthetic
gaacaccaacgcgtaaatgg

SEQ ID NO: 11282 - DNA, 16 bp, Artificial Sequence
  Synthetic
cgcggcaggcttttgg

SEQ ID NO: 11283 - DNA, 20 bp, Artificial Sequence
  Synthetic
ttatcgttggtgaaggaaga

SEQ ID NO: 11284 - DNA, 22 bp, Artificial Sequence
  Synthetic
ctttgcctatatcgtgaaaacc

SEQ ID NO: 11285 - DNA, 17 bp, Artificial Sequence
  Synthetic
ggctgccgaatttcccg

SEQ ID NO: 11286 - DNA, 17 bp, Artificial Sequence
  Synthetic
cgctgcggatttcgtgc

SEQ ID NO: 11287 - DNA, 20 bp, Artificial Sequence
  Synthetic
gatgaccgcatccaaaacgt

SEQ ID NO: 11288 - DNA, 16 bp, Artificial Sequence
  Synthetic
tcgaccccgccctgtt

SEQ ID NO: 11289 - DNA, 17 bp, Artificial Sequence
  Synthetic
ggtcgatctgcaggcca

SEQ ID NO: 11290 - DNA, 16 bp, Artificial Sequence
  Synthetic
ccctcaatgcgcggca

SEQ ID NO: 11291 - DNA, 18 bp, Artificial Sequence
  Synthetic
tcgttggtggattggctg

SEQ ID NO: 11292 - DNA, 19 bp, Artificial Sequence
  Synthetic
aacgccctgaagttaaacg

SEQ ID NO: 11293 - DNA, 17 bp, Artificial Sequence
  Synthetic
tgaggaggcaggtcggt

SEQ ID NO: 11294 - DNA, 20 bp, Artificial Sequence
  Synthetic
atacgcagttcggaatcagg

SEQ ID NO: 11295 - DNA, 16 bp, Artificial Sequence
  Synthetic
ggctgcgcgtgttacg

SEQ ID NO: 11296 - DNA, 20 bp, Artificial Sequence
  Synthetic
tgttttcaagcacatcgcgg

SEQ ID NO: 11297 - DNA, 18 bp, Artificial Sequence
  Synthetic
ccgaagcctatgtgccca

SEQ ID NO: 11298 - DNA, 20 bp, Artificial Sequence
  Synthetic
tgctgtccgtaaaagaaggc

SEQ ID NO: 11299 - DNA, 16 bp, Artificial Sequence
  Synthetic
gcctcgacatccccga

SEQ ID NO: 11300 - DNA, 16 bp, Artificial Sequence
  Synthetic
ggcatcggcgagctga

SEQ ID NO: 11301 - DNA, 19 bp, Artificial Sequence
  Synthetic
cagcgtaccggttttgtcc

SEQ ID NO: 11302 - DNA, 17 bp, Artificial Sequence
  Synthetic
tttggctgccgagctgc

SEQ ID NO: 11303 - DNA, 19 bp, Artificial Sequence
  Synthetic
gtcaaaccgttaccgttgc

SEQ ID NO: 11304 - DNA, 20 bp, Artificial Sequence
  Synthetic
cagaccgttgaccagatacg

SEQ ID NO: 11305 - DNA, 18 bp, Artificial Sequence
  Synthetic
cgaactgccaaagctgcc

SEQ ID NO: 11306 - DNA, 17 bp, Artificial Sequence
  Synthetic
gatgacagggccggtga

SEQ ID NO: 11307 - DNA, 16 bp, Artificial Sequence
  Synthetic
ccgccgcgctgtttgt

SEQ ID NO: 11308 - DNA, 22 bp, Artificial Sequence
  Synthetic
acgggattaaattgaatttgca

SEQ ID NO: 11309 - DNA, 21 bp, Artificial Sequence
  Synthetic
ccgactttaacttcaatttcg

SEQ ID NO: 11310 - DNA, 19 bp, Artificial Sequence
  Synthetic
catgtcgtttggggggatg

SEQ ID NO: 11311 - DNA, 18 bp, Artificial Sequence
  Synthetic
tgcgttgacaaggttgcc

SEQ ID NO: 11312 - DNA, 19 bp, Artificial Sequence
  Synthetic
aaaaccggcaaaaacctgc

SEQ ID NO: 11313 - DNA, 19 bp, Artificial Sequence
  Synthetic
tcggtgtagagcgtgaagc

SEQ ID NO: 11314 - DNA, 19 bp, Artificial Sequence
  Synthetic
aaggctggcgacttttacg

SEQ ID NO: 11315 - DNA, 16 bp, Artificial Sequence
  Synthetic
cggtatcgcgcgcttt

SEQ ID NO: 11316 - DNA, 20 bp, Artificial Sequence
  Synthetic
gttttcagccaaaacgtgcg

SEQ ID NO: 11317 - DNA, 20 bp, Artificial Sequence
  Synthetic
atagccggtcatacccaaga

SEQ ID NO: 11318 - DNA, 16 bp, Artificial Sequence
  Synthetic
gtgttcgccgtggtgg

SEQ ID NO: 11319 - DNA, 17 bp, Artificial Sequence
  Synthetic
cgaccagtttggcggtt

SEQ ID NO: 11320 - DNA, 20 bp, Artificial Sequence
  Synthetic
gtccaaaagacgcagacagg

SEQ ID NO: 11321 - DNA, 18 bp, Artificial Sequence
  Synthetic
gccgcgaattgcacttct

SEQ ID NO: 11322 - DNA, 16 bp, Artificial Sequence
  Synthetic
cccgtgctgctggctt

SEQ ID NO: 11323 - DNA, 20 bp, Artificial Sequence
  Synthetic
caatccatcaaaaggctctc

SEQ ID NO: 11324 - DNA, 19 bp, Artificial Sequence
  Synthetic
aggggagccggaagaatcc

SEQ ID NO: 11325 - DNA, 16 bp, Artificial Sequence
  Synthetic
cccatcccgcgaacct

SEQ ID NO: 11326 - DNA, 15 bp, Artificial Sequence
  Synthetic
gcaacgcgctggcaa

SEQ ID NO: 11327 - DNA, 17 bp, Artificial Sequence
  Synthetic
ccggcggcttttcgatt

SEQ ID NO: 11328 - DNA, 16 bp, Artificial Sequence
  Synthetic
cccgtccgtccgcaat

SEQ ID NO: 11329 - DNA, 17 bp, Artificial Sequence
  Synthetic
gccgaatgcgatgtgct

SEQ ID NO: 11330 - DNA, 18 bp, Artificial Sequence
  Synthetic
ggcagcaaagccctgttc

SEQ ID NO: 11331 - DNA, 18 bp, Artificial Sequence
  Synthetic
caaccccgacgacgaaac

SEQ ID NO: 11332 - DNA, 20 bp, Artificial Sequence
  Synthetic
gtcgaagataccgatgcgat

SEQ ID NO: 11333 - DNA, 17 bp, Artificial Sequence
  Synthetic
ggttcacgggcaggttg

SEQ ID NO: 11334 - DNA, 17 bp, Artificial Sequence
  Synthetic
gcagtgtgcctaagccg

SEQ ID NO: 11335 - DNA, 19 bp, Artificial Sequence
  Synthetic
ggaaaaaatccgatgccgc

SEQ ID NO: 11336 - DNA, 16 bp, Artificial Sequence
  Synthetic
cactttctcgccgcgg

SEQ ID NO: 11337 - DNA, 18 bp, Artificial Sequence
  Synthetic
aattgccgggaatggaaa

SEQ ID NO: 11338 - DNA, 20 bp, Artificial Sequence
  Synthetic
taattttgtcggcgtgttgc

SEQ ID NO: 11339 - DNA, 19 bp, Artificial Sequence
  Synthetic
gaaaagccggtcgacttgt

SEQ ID NO: 11340 - DNA, 18 bp, Artificial Sequence
  Synthetic
gcgtaccggccttcaaac

SEQ ID NO: 11341 - DNA, 18 bp, Artificial Sequence
  Synthetic
tcgcggtaatgcactggg

SEQ ID NO: 11342 - DNA, 17 bp, Artificial Sequence
  Synthetic
ggctttgagcgatgccg

SEQ ID NO: 11343 - DNA, 20 bp, Artificial Sequence
  Synthetic
tttggctgcttctattgggc

SEQ ID NO: 11344 - DNA, 18 bp, Artificial Sequence
  Synthetic
ccgccccaagaaatcctc

SEQ ID NO: 11345 - DNA, 18 bp, Artificial Sequence
  Synthetic
gcgcgacctgaaaaaccg

SEQ ID NO: 11346 - DNA, 16 bp, Artificial Sequence
  Synthetic
gcgaaggcaagccgct

SEQ ID NO: 11347 - DNA, 16 bp, Artificial Sequence
  Synthetic
ttacgtgccgccgaca

SEQ ID NO: 11348 - DNA, 18 bp, Artificial Sequence
  Synthetic
gcaagccgtgctgtacct

SEQ ID NO: 11349 - DNA, 16 bp, Artificial Sequence
  Synthetic
gggatgcgccgtcttc

SEQ ID NO: 11350 - DNA, 20 bp, Artificial Sequence
  Synthetic
cggcgaatttcatcagttcg

SEQ ID NO: 11351 - DNA, 20 bp, Artificial Sequence
  Synthetic
ggcactcaaattcacagtca

SEQ ID NO: 11352 - DNA, 21 bp, Artificial Sequence
  Synthetic
caatcatgttcgcattggtac

SEQ ID NO: 11353 - DNA, 17 bp, Artificial Sequence
  Synthetic
ccgcagcatgaggcaac

SEQ ID NO: 11354 - DNA, 19 bp, Artificial Sequence
  Synthetic
tgtccgacgatttgttgcg

SEQ ID NO: 11355 - DNA, 19 bp, Artificial Sequence
  Synthetic
gaagaaatcgccctgctgt

SEQ ID NO: 11356 - DNA, 17 bp, Artificial Sequence
  Synthetic
gtcggcgtaaggtccgt

SEQ ID NO: 11357 - DNA, 19 bp, Artificial Sequence
  Synthetic
gcactgctggtcatactgc

SEQ ID NO: 11358 - DNA, 16 bp, Artificial Sequence
  Synthetic
gcgatgttgccgccca

SEQ ID NO: 11359 - DNA, 16 bp, Artificial Sequence
  Synthetic
gggccttggtagcgga

SEQ ID NO: 11360 - DNA, 16 bp, Artificial Sequence
  Synthetic
gcacggttacggcgca

SEQ ID NO: 11361 - DNA, 18 bp, Artificial Sequence
  Synthetic
cccgctgacgatgtgtac

SEQ ID NO: 11362 - DNA, 18 bp, Artificial Sequence
  Synthetic
gcatcaaggcacgcacat

SEQ ID NO: 11363 - DNA, 16 bp, Artificial Sequence
  Synthetic
cgggaatgacggcggt

SEQ ID NO: 11364 - DNA, 18 bp, Artificial Sequence
  Synthetic
gtggtgtgggtgtggtcg

SEQ ID NO: 11365 - DNA, 19 bp, Artificial Sequence
  Synthetic
agccgcgttcctattcttg

SEQ ID NO: 11366 - DNA, 17 bp, Artificial Sequence
  Synthetic
ccggcgaacaggctttg

SEQ ID NO: 11367 - DNA, 18 bp, Artificial Sequence
  Synthetic
tctagattcccgcctgcg

SEQ ID NO: 11368 - DNA, 20 bp, Artificial Sequence
  Synthetic
ttcgcagttgaggcttttgg

SEQ ID NO: 11369 - DNA, 17 bp, Artificial Sequence
  Synthetic
gcaacacttcgcctgcg

SEQ ID NO: 11370 - DNA, 20 bp, Artificial Sequence
  Synthetic
tcgaggaaaaggacgaaagc

SEQ ID NO: 11371 - DNA, 17 bp, Artificial Sequence
  Synthetic
ggaagaatacgcccgcc

SEQ ID NO: 11372 - DNA, 17 bp, Artificial Sequence
  Synthetic
cgacggcggcatcgatt

SEQ ID NO: 11373 - DNA, 20 bp, Artificial Sequence
  Synthetic
tttctttttcctacgcgccc

SEQ ID NO: 11374 - DNA, 18 bp, Artificial Sequence
  Synthetic
cctttcgccaactcctgc

SEQ ID NO: 11375 - DNA, 18 bp, Artificial Sequence
  Synthetic
gcccatctgtcgttcagc

SEQ ID NO: 11376 - DNA, 18 bp, Artificial Sequence
  Synthetic
aataggcagaatgaccgc

SEQ ID NO: 11377 - DNA, 20 bp, Artificial Sequence
  Synthetic
cctacatgactacttgggcg

SEQ ID NO: 11378 - DNA, 20 bp, Artificial Sequence
  Synthetic
attttctgttttgcctgcgg

SEQ ID NO: 11379 - DNA, 24 bp, Artificial Sequence
  Synthetic
ctgtctcagtttgatttttttcag

SEQ ID NO: 11380 - DNA, 19 bp, Artificial Sequence
  Synthetic
atgctgaaatggactcctc

SEQ ID NO: 11381 - DNA, 23 bp, Artificial Sequence
  Synthetic
tttcccactcagataatttctca

SEQ ID NO: 11382 - DNA, 24 bp, Artificial Sequence
  Synthetic
gtaaagttacccgagttaaaaacc

SEQ ID NO: 11383 - DNA, 22 bp, Artificial Sequence
  Synthetic
gaagataaggctttttttaccg

SEQ ID NO: 11384 - DNA, 18 bp, Artificial Sequence
  Synthetic
cgcaagaaatccactccg

SEQ ID NO: 11385 - DNA, 24 bp, Artificial Sequence
  Synthetic
atatcaaccaacttattgagatcc

SEQ ID NO: 11386 - DNA, 21 bp, Artificial Sequence
  Synthetic
aaacagttttttgctggtttg

SEQ ID NO: 11387 - DNA, 19 bp, Artificial Sequence
  Synthetic
ggtggagatggaacaccgc

SEQ ID NO: 11388 - DNA, 18 bp, Artificial Sequence
  Synthetic
gccatgagctgccctacg

SEQ ID NO: 11389 - DNA, 19 bp, Artificial Sequence
  Synthetic
atagccaaggcgtgatcga

SEQ ID NO: 11390 - DNA, 16 bp, Artificial Sequence
  Synthetic
cgtgggtgtgccgcaa

SEQ ID NO: 11391 - DNA, 18 bp, Artificial Sequence
  Synthetic
ccgggcgaaatcgaactc

SEQ ID NO: 11392 - DNA, 19 bp, Artificial Sequence
  Synthetic
atttccccgtccaactggt

SEQ ID NO: 11393 - DNA, 18 bp, Artificial Sequence
  Synthetic
cctgatcggcaaatgggc

SEQ ID NO: 11394 - DNA, 17 bp, Artificial Sequence
  Synthetic
gctgattgccgccatgc

SEQ ID NO: 11395 - DNA, 18 bp, Artificial Sequence
  Synthetic
gtcgaacaaaacgcctgc

SEQ ID NO: 11396 - DNA, 17 bp, Artificial Sequence
  Synthetic
gcaagacggcggtttgg

SEQ ID NO: 11397 - DNA, 16 bp, Artificial Sequence
  Synthetic
ttgaggcttgcgggca

SEQ ID NO: 11398 - DNA, 16 bp, Artificial Sequence
  Synthetic
gcgtttgcggtaggcg

SEQ ID NO: 11399 - DNA, 16 bp, Artificial Sequence
  Synthetic
cggtctgatgccggca

SEQ ID NO: 11400 - DNA, 17 bp, Artificial Sequence
  Synthetic
tccaaatccgcctgcga

SEQ ID NO: 11401 - DNA, 20 bp, Artificial Sequence
  Synthetic
atcgtcaatacagttccggc

SEQ ID NO: 11402 - DNA, 18 bp, Artificial Sequence
  Synthetic
cggcatccagcaaatcgc

SEQ ID NO: 11403 - DNA, 19 bp, Artificial Sequence
  Synthetic
ccttgcacgacgtgtatcg

SEQ ID NO: 11404 - DNA, 17 bp, Artificial Sequence
  Synthetic
cgccgcccaaatcgtac

SEQ ID NO: 11405 - DNA, 19 bp, Artificial Sequence
  Synthetic
ttttgccgaattgatggcg

SEQ ID NO: 11406 - DNA, 18 bp, Artificial Sequence
  Synthetic
ctcgaaacgcgcgtatgc

SEQ ID NO: 11407 - DNA, 15 bp, Artificial Sequence
  Synthetic
aaccgtttccgccgc

SEQ ID NO: 11408 - DNA, 19 bp, Artificial Sequence
  Synthetic
ttgtatttcctgccgctgc

SEQ ID NO: 11409 - DNA, 18 bp, Artificial Sequence
  Synthetic
gcccaagctcaatcggtt

SEQ ID NO: 11410 - DNA, 16 bp, Artificial Sequence
  Synthetic
gcgttttttcggcgcg

SEQ ID NO: 11411 - DNA, 18 bp, Artificial Sequence
  Synthetic
gttacttccgatgcggcg

SEQ ID NO: 11412 - DNA, 20 bp, Artificial Sequence
  Synthetic
cagttcttcttcggtttgcg

SEQ ID NO: 11413 - DNA, 19 bp, Artificial Sequence
  Synthetic
acactttcgacgacaaccg

SEQ ID NO: 11414 - DNA, 20 bp, Artificial Sequence
  Synthetic
ttcattgcaaaaaccgaccg

SEQ ID NO: 11415 - DNA, 17 bp, Artificial Sequence
  Synthetic
gccgcaccaaaacgacc

SEQ ID NO: 11416 - DNA, 20 bp, Artificial Sequence
  Synthetic
tttcaaccgcaaagacaagc

SEQ ID NO: 11417 - DNA, 19 bp, Artificial Sequence
  Synthetic
acacactgacccgattcct

SEQ ID NO: 11418 - DNA, 19 bp, Artificial Sequence
  Synthetic
aaaaacgccatcccgaacg

SEQ ID NO: 11419 - DNA, 18 bp, Artificial Sequence
  Synthetic
gacaagtgactgccttgt

SEQ ID NO: 11420 - DNA, 19 bp, Artificial Sequence
  Synthetic
ttgagcggcaaaatccacc

SEQ ID NO: 11421 - DNA, 18 bp, Artificial Sequence
  Synthetic
gggagcaatacccgaagt

SEQ ID NO: 11422 - DNA, 20 bp, Artificial Sequence
  Synthetic
cataccaacgtttcccccag

SEQ ID NO: 11423 - DNA, 17 bp, Artificial Sequence
  Synthetic
cgaaagccctgttgccg

SEQ ID NO: 11424 - DNA, 16 bp, Artificial Sequence
  Synthetic
cgcaagccgcctgaca

SEQ ID NO: 11425 - DNA, 18 bp, Artificial Sequence
  Synthetic
tgaagcctttcagacggc

SEQ ID NO: 11426 - DNA, 20 bp, Artificial Sequence
  Synthetic
atccatttcatcaaccgccc

SEQ ID NO: 11427 - DNA, 20 bp, Artificial Sequence
  Synthetic
gccctcgataaaaccttggc

SEQ ID NO: 11428 - DNA, 16 bp, Artificial Sequence
  Synthetic
gcgctggccgttttgg

SEQ ID NO: 11429 - DNA, 15 bp, Artificial Sequence
  Synthetic
tgcccgcgaactgga

SEQ ID NO: 11430 - DNA, 17 bp, Artificial Sequence
  Synthetic
atttgtagggcgtgccg

SEQ ID NO: 11431 - DNA, 16 bp, Artificial Sequence
  Synthetic
ttcgggtggcgggatc

SEQ ID NO: 11432 - DNA, 19 bp, Artificial Sequence
  Synthetic
tccgagtgcttgaagaccc

SEQ ID NO: 11433 - DNA, 19 bp, Artificial Sequence
  Synthetic
tcgtcgccgatattgcgtc

SEQ ID NO: 11434 - DNA, 17 bp, Artificial Sequence
  Synthetic
tgatgaaggcggcaagc

SEQ ID NO: 11435 - DNA, 20 bp, Artificial Sequence
  Synthetic
actggtggaaaacggtatgc

SEQ ID NO: 11436 - DNA, 19 bp, Artificial Sequence
  Synthetic
tcgataacggttttctcgc

SEQ ID NO: 11437 - DNA, 18 bp, Artificial Sequence
  Synthetic
gtcgcgctcggatttgac

SEQ ID NO: 11438 - DNA, 17 bp, Artificial Sequence
  Synthetic
taatttgcgcccctgcc

SEQ ID NO: 11439 - DNA, 18 bp, Artificial Sequence
  Synthetic
tgccgtctgaaaccgaac

SEQ ID NO: 11440 - DNA, 19 bp, Artificial Sequence
  Synthetic
ctactcgtcatcctcgccc

SEQ ID NO: 11441 - DNA, 20 bp, Artificial Sequence
  Synthetic
gcatttggatcatcggcacc

SEQ ID NO: 11442 - DNA, 16 bp, Artificial Sequence
  Synthetic
cgtcatcgccggcaca

SEQ ID NO: 11443 - DNA, 16 bp, Artificial Sequence
  Synthetic
accgccctgccgttca

SEQ ID NO: 11444 - DNA, 22 bp, Artificial Sequence
  Synthetic
tcaattcaattacggtttgtct

SEQ ID NO: 11445 - DNA, 20 bp, Artificial Sequence
  Synthetic
gccgatggttacttgttcgc

SEQ ID NO: 11446 - DNA, 19 bp, Artificial Sequence
  Synthetic
aatcgaccaaatcctgcgc

SEQ ID NO: 11447 - DNA, 19 bp, Artificial Sequence
  Synthetic
catgtccgacaacgctttg

SEQ ID NO: 11448 - DNA, 16 bp, Artificial Sequence
  Synthetic
ggtgcgccgtctgctt

SEQ ID NO: 11449 - DNA, 20 bp, Artificial Sequence
  Synthetic
gcttgccaaagaaggattgg

SEQ ID NO: 11450 - DNA, 16 bp, Artificial Sequence
  Synthetic
gccgccgctacaagct

SEQ ID NO: 11451 - DNA, 17 bp, Artificial Sequence
  Synthetic
gcgcctgcggaatttcc

SEQ ID NO: 11452 - DNA, 20 bp, Artificial Sequence
  Synthetic
acgcccttgaatatcgtgtt

SEQ ID NO: 11453 - DNA, 20 bp, Artificial Sequence
  Synthetic
acattcatgcggctttgaac

SEQ ID NO: 11454 - DNA, 16 bp, Artificial Sequence
  Synthetic
tgctgcaaagcgtggc

SEQ ID NO: 11455 - DNA, 16 bp, Artificial Sequence
  Synthetic
ccgccattcctgccga

SEQ ID NO: 11456 - DNA, 20 bp, Artificial Sequence
  Synthetic
ccttggcagggatagatgac

SEQ ID NO: 11457 - DNA, 22 bp, Artificial Sequence
  Synthetic
ttgatttttttaccgcttttgc

SEQ ID NO: 11458 - DNA, 16 bp, Artificial Sequence
  Synthetic
caaccgcgccagagct

SEQ ID NO: 11459 - DNA, 21 bp, Artificial Sequence
  Synthetic
ttaaacataccgagtgaatgg

SEQ ID NO: 11460 - DNA, 21 bp, Artificial Sequence
  Synthetic
aaaacgacttttaccaaagcg

SEQ ID NO: 11461 - DNA, 20 bp, Artificial Sequence
  Synthetic
accgcatttttttgacggag

SEQ ID NO: 11462 - DNA, 19 bp, Artificial Sequence
  Synthetic
attctgaataccgtccgtt

SEQ ID NO: 11463 - DNA, 19 bp, Artificial Sequence
  Synthetic
ccgcattcaaatcatgggc

SEQ ID NO: 11464 - DNA, 18 bp, Artificial Sequence
  Synthetic
ctgacggaaaagcagctt

SEQ ID NO: 11465 - DNA, 18 bp, Artificial Sequence
  Synthetic
acgcgaagaactactgaa

SEQ ID NO: 11466 - DNA, 20 bp, Artificial Sequence
  Synthetic
gcaaaaattccaaaggcatg

SEQ ID NO: 11467 - DNA, 18 bp, Artificial Sequence
  Synthetic
tgcaaacccgcatcctct

SEQ ID NO: 11468 - DNA, 19 bp, Artificial Sequence
  Synthetic
aagcgaaattcacggtcga

SEQ ID NO: 11469 - DNA, 21 bp, Artificial Sequence
  Synthetic
taaaacgtggcagatacagac

SEQ ID NO: 11470 - DNA, 18 bp, Artificial Sequence
  Synthetic
gctgtatcaactgctgcc

SEQ ID NO: 11471 - DNA, 19 bp, Artificial Sequence
  Synthetic
ctgcacgacggcaaaatcg

SEQ ID NO: 11472 - DNA, 16 bp, Artificial Sequence
  Synthetic
cacgcccttgtgcgtt

SEQ ID NO: 11473 - DNA, 19 bp, Artificial Sequence
  Synthetic
ttgcaagccttcatcttcg

SEQ ID NO: 11474 - DNA, 18 bp, Artificial Sequence
  Synthetic
cgttactttggccgggtc

SEQ ID NO: 11475 - DNA, 18 bp, Artificial Sequence
  Synthetic
ccggcaatgattgagcgt

SEQ ID NO: 11476 - DNA, 19 bp, Artificial Sequence
  Synthetic
cgccgagcaggtattgagc

SEQ ID NO: 11477 - DNA, 18 bp, Artificial Sequence
  Synthetic
gttcagacggcatcggtg

SEQ ID NO: 11478 - DNA, 16 bp, Artificial Sequence
  Synthetic
gactggccgcacgaca

SEQ ID NO: 11479 - DNA, 21 bp, Artificial Sequence
  Synthetic
attgatttgattgacgaagct

SEQ ID NO: 11480 - DNA, 18 bp, Artificial Sequence
  Synthetic
tgtacccgaaacggcagg

SEQ ID NO: 11481 - DNA, 18 bp, Artificial Sequence
  Synthetic
gcgcaatgccgtctgaat

SEQ ID NO: 11482 - DNA, 18 bp, Artificial Sequence
  Synthetic
ccatatccgtccgggcaa

SEQ ID NO: 11483 - DNA, 18 bp, Artificial Sequence
  Synthetic
cgtggatgagcaacgaca

SEQ ID NO: 11484 - DNA, 17 bp, Artificial Sequence
  Synthetic
gcagtgaaggcgacacg

SEQ ID NO: 11485 - DNA, 16 bp, Artificial Sequence
  Synthetic
agggacgccgcctgaa

SEQ ID NO: 11486 - DNA, 19 bp, Artificial Sequence
  Synthetic
cagagtttcttaccgccgc

SEQ ID NO: 11487 - DNA, 19 bp, Artificial Sequence
  Synthetic
taccgctaccacaactggg

SEQ ID NO: 11488 - DNA, 20 bp, Artificial Sequence
  Synthetic
cgtcattcccgacaataccg

SEQ ID NO: 11489 - DNA, 17 bp, Artificial Sequence
  Synthetic
caactcgccgtcaaccg

SEQ ID NO: 11490 - DNA, 20 bp, Artificial Sequence
  Synthetic
aaacacgtccaacagttcct

SEQ ID NO: 11491 - DNA, 20 bp, Artificial Sequence
  Synthetic
atccatcgaagacctccctg

SEQ ID NO: 11492 - DNA, 16 bp, Artificial Sequence
  Synthetic
cacatcctgcaccgcg

SEQ ID NO: 11493 - DNA, 16 bp, Artificial Sequence
  Synthetic
cggataccgccgtgca

SEQ ID NO: 11494 - DNA, 16 bp, Artificial Sequence
  Synthetic
cgccggacgaatcagc

SEQ ID NO: 11495 - DNA, 16 bp, Artificial Sequence
  Synthetic
aaacccaaacgccccg

SEQ ID NO: 11496 - DNA, 16 bp, Artificial Sequence
  Synthetic
gcgcggacggttttgc

SEQ ID NO: 11497 - DNA, 20 bp, Artificial Sequence
  Synthetic
agcccgatctgtttagaagc

SEQ ID NO: 11498 - DNA, 16 bp, Artificial Sequence
  Synthetic
acagcctcgcccagct

SEQ ID NO: 11499 - DNA, 17 bp, Artificial Sequence
  Synthetic
attcccgtccgcatcct

SEQ ID NO: 11500 - DNA, 17 bp, Artificial Sequence
  Synthetic
cagatccgcaagcgctt

SEQ ID NO: 11501 - DNA, 19 bp, Artificial Sequence
  Synthetic
ttcgggcgtaaggttttcc

SEQ ID NO: 11502 - DNA, 15 bp, Artificial Sequence
  Synthetic
ccaaacggcgcgtga

SEQ ID NO: 11503 - DNA, 19 bp, Artificial Sequence
  Synthetic
ggtaaccgtaaaccgcacg

SEQ ID NO: 11504 - DNA, 19 bp, Artificial Sequence
  Synthetic
gcataagccttcgttccgg

SEQ ID NO: 11505 - DNA, 18 bp, Artificial Sequence
  Synthetic
ccgccgcctgatattcgg

SEQ ID NO: 11506 - DNA, 16 bp, Artificial Sequence
  Synthetic
gggtttgcgccgtcaa

SEQ ID NO: 11507 - DNA, 16 bp, Artificial Sequence
  Synthetic
cgtctcgcccgggaaa

SEQ ID NO: 11508 - DNA, 20 bp, Artificial Sequence
  Synthetic
ggggtaaggcaggataaggc

SEQ ID NO: 11509 - DNA, 16 bp, Artificial Sequence
  Synthetic
tggccatccccgggat

SEQ ID NO: 11510 - DNA, 16 bp, Artificial Sequence
  Synthetic
gcggtcggcaaagtcg

SEQ ID NO: 11511 - DNA, 18 bp, Artificial Sequence
  Synthetic
cccccgacggataagcga

SEQ ID NO: 11512 - DNA, 18 bp, Artificial Sequence
  Synthetic
caatccggtgttgacgcg

SEQ ID NO: 11513 - DNA, 18 bp, Artificial Sequence
  Synthetic
gtcgggttcgggattggg

SEQ ID NO: 11514 - DNA, 18 bp, Artificial Sequence
  Synthetic
gctttctgttcttcgtgg

SEQ ID NO: 11515 - DNA, 18 bp, Artificial Sequence
  Synthetic
cccgtgtccgtctatggc

SEQ ID NO: 11516 - DNA, 19 bp, Artificial Sequence
  Synthetic
ttgtcccacatgaagctgc

SEQ ID NO: 11517 - DNA, 18 bp, Artificial Sequence
  Synthetic
gactacatcgacgcgctt

SEQ ID NO: 11518 - DNA, 17 bp, Artificial Sequence
  Synthetic
atgcggacatgagcgtg

SEQ ID NO: 11519 - DNA, 20 bp, Artificial Sequence
  Synthetic
ggcgaaagaatccctgatga

SEQ ID NO: 11520 - DNA, 18 bp, Artificial Sequence
  Synthetic
aaaccatcagccccgaac

SEQ ID NO: 11521 - DNA, 18 bp, Artificial Sequence
  Synthetic
gccgactgccaaatctgc

SEQ ID NO: 11522 - DNA, 20 bp, Artificial Sequence
  Synthetic
ttctgccgccgatattttgg

SEQ ID NO: 11523 - DNA, 19 bp, Artificial Sequence
  Synthetic
acgatatggacacacccgt

SEQ ID NO: 11524 - DNA, 18 bp, Artificial Sequence
  Synthetic
gcgaatgctgcaaatttg

SEQ ID NO: 11525 - DNA, 20 bp, Artificial Sequence
  Synthetic
gcgcttatctcttccgaact

SEQ ID NO: 11526 - DNA, 19 bp, Artificial Sequence
  Synthetic
ggaatgccgaagacaaccg

SEQ ID NO: 11527 - DNA, 20 bp, Artificial Sequence
  Synthetic
cagacggcatttccattcca

SEQ ID NO: 11528 - DNA, 20 bp, Artificial Sequence
  Synthetic
gaaagtggaaacgcacaacc

SEQ ID NO: 11529 - DNA, 16 bp, Artificial Sequence
  Synthetic
ccgtacaacgcggcaa

SEQ ID NO: 11530 - DNA, 16 bp, Artificial Sequence
  Synthetic
ctgccgtagccgccaa

SEQ ID NO: 11531 - DNA, 17 bp, Artificial Sequence
  Synthetic
catcgccgcgccgttta

SEQ ID NO: 11532 - DNA, 16 bp, Artificial Sequence
  Synthetic
aaaatgctggcggcgt

SEQ ID NO: 11533 - DNA, 18 bp, Artificial Sequence
  Synthetic
cgtcatcgtttcgcagct

SEQ ID NO: 11534 - DNA, 18 bp, Artificial Sequence
  Synthetic
gccaccgtcatcattgcc

SEQ ID NO: 11535 - DNA, 17 bp, Artificial Sequence
  Synthetic
catcgacggcattgccc

SEQ ID NO: 11536 - DNA, 16 bp, Artificial Sequence
  Synthetic
atggggctgctgctcg

SEQ ID NO: 11537 - DNA, 16 bp, Artificial Sequence
  Synthetic
gcaacgcccccatcct

SEQ ID NO: 11538 - DNA, 16 bp, Artificial Sequence
  Synthetic
acaccctgcgcgacga

SEQ ID NO: 11539 - DNA, 19 bp, Artificial Sequence
  Synthetic
ccgaactgaacggcaaact

SEQ ID NO: 11540 - DNA, 21 bp, Artificial Sequence
  Synthetic
gcttattttcagcggattcac

SEQ ID NO: 11541 - DNA, 18 bp, Artificial Sequence
  Synthetic
gcgcgtacatctgaaccg

SEQ ID NO: 11542 - DNA, 20 bp, Artificial Sequence
  Synthetic
ccatatgctcaacctcggtg

SEQ ID NO: 11543 - DNA, 17 bp, Artificial Sequence
  Synthetic
cgccgaaaccctttccg

SEQ ID NO: 11544 - DNA, 16 bp, Artificial Sequence
  Synthetic
tacccctctcgcgcga

SEQ ID NO: 11545 - DNA, 18 bp, Artificial Sequence
  Synthetic
ggcaacggtataggcccg

SEQ ID NO: 11546 - DNA, 18 bp, Artificial Sequence
  Synthetic
gcgttcgcgaatgtgtcc

SEQ ID NO: 11547 - DNA, 18 bp, Artificial Sequence
  Synthetic
cgcgattttgacggtgtg

SEQ ID NO: 11548 - DNA, 19 bp, Artificial Sequence
  Synthetic
gatgccgctccgtttaagc

SEQ ID NO: 11549 - DNA, 20 bp, Artificial Sequence
  Synthetic
tgtcaccgtgtacgatttcg

SEQ ID NO: 11550 - DNA, 17 bp, Artificial Sequence
  Synthetic
cccatttggcggcttcg

SEQ ID NO: 11551 - DNA, 16 bp, Artificial Sequence
  Synthetic
caacctgcttggccgc

SEQ ID NO: 11552 - DNA, 17 bp, Artificial Sequence
  Synthetic
attcccgccctcccttt

SEQ ID NO: 11553 - DNA, 16 bp, Artificial Sequence
  Synthetic
gctcaaccgcctgctg

SEQ ID NO: 11554 - DNA, 16 bp, Artificial Sequence
  Synthetic
gcgccgcctccaaact

SEQ ID NO: 11555 - DNA, 17 bp, Artificial Sequence
  Synthetic
tttcgtacttgccgcgc

SEQ ID NO: 11556 - DNA, 16 bp, Artificial Sequence
  Synthetic
aacgccttcgtcgccg

SEQ ID NO: 11557 - DNA, 19 bp, Artificial Sequence
  Synthetic
tccgtccgctccttcatcc

SEQ ID NO: 11558 - DNA, 18 bp, Artificial Sequence
  Synthetic
tcatgtaccgccacaacg

SEQ ID NO: 11559 - DNA, 17 bp, Artificial Sequence
  Synthetic
gcaaaggcgacctgcac

SEQ ID NO: 11560 - DNA, 19 bp, Artificial Sequence
  Synthetic
cacaaatcggctgggtagg

SEQ ID NO: 11561 - DNA, 18 bp, Artificial Sequence
  Synthetic
ggcaggtagaaaaggaca

SEQ ID NO: 11562 - DNA, 16 bp, Artificial Sequence
  Synthetic
gtccggctgggcgtat

SEQ ID NO: 11563 - DNA, 20 bp, Artificial Sequence
  Synthetic
tggaaaaagaattggcacgc

SEQ ID NO: 11564 - DNA, 15 bp, Artificial Sequence
  Synthetic
acgcaaccgcacgct

SEQ ID NO: 11565 - DNA, 18 bp, Artificial Sequence
  Synthetic
gaacctgcacgcctcatg

SEQ ID NO: 11566 - DNA, 20 bp, Artificial Sequence
  Synthetic
gtcaccaataccttcgtcgt

SEQ ID NO: 11567 - DNA, 20 bp, Artificial Sequence
  Synthetic
gtcatcctccttcataccgc

SEQ ID NO: 11568 - DNA, 23 bp, Artificial Sequence
  Synthetic
gtttactaaaacttcatcgtcct

SEQ ID NO: 11569 - DNA, 18 bp, Artificial Sequence
  Synthetic
ctgaccgaatcccgaaat

SEQ ID NO: 11570 - DNA, 17 bp, Artificial Sequence
  Synthetic
ttttcggcgggcgatac

SEQ ID NO: 11571 - DNA, 21 bp, Artificial Sequence
  Synthetic
tctaaataacgctgctcttcc

SEQ ID NO: 11572 - DNA, 17 bp, Artificial Sequence
  Synthetic
gctgcttcaggcttgcg

SEQ ID NO: 11573 - DNA, 18 bp, Artificial Sequence
  Synthetic
cctgaatcacgccgacag

SEQ ID NO: 11574 - DNA, 18 bp, Artificial Sequence
  Synthetic
accagtgctcgtatgcct

SEQ ID NO: 11575 - DNA, 19 bp, Artificial Sequence
  Synthetic
tatcctcgcaaccgaaagc

SEQ ID NO: 11576 - DNA, 16 bp, Artificial Sequence
  Synthetic
gcgcatcgatccgcaa

SEQ ID NO: 11577 - DNA, 19 bp, Artificial Sequence
  Synthetic
gcacaagtaaaagccgccc

SEQ ID NO: 11578 - DNA, 19 bp, Artificial Sequence
  Synthetic
cgcagaaacctaccgaagc

SEQ ID NO: 11579 - DNA, 19 bp, Artificial Sequence
  Synthetic
caatgactgcgggctttgt

SEQ ID NO: 11580 - DNA, 16 bp, Artificial Sequence
  Synthetic
agtccgggcgtgtcat

SEQ ID NO: 11581 - DNA, 16 bp, Artificial Sequence
  Synthetic
tgtctccagcgcggca

SEQ ID NO: 11582 - DNA, 17 bp, Artificial Sequence
  Synthetic
ccgacaccagcattccg

SEQ ID NO: 11583 - DNA, 18 bp, Artificial Sequence
  Synthetic
gggtacgaaagggctgga

SEQ ID NO: 11584 - DNA, 18 bp, Artificial Sequence
  Synthetic
ccattgcccgaacggaaa

SEQ ID NO: 11585 - DNA, 18 bp, Artificial Sequence
  Synthetic
acggtgcgttgacgatac

SEQ ID NO: 11586 - DNA, 17 bp, Artificial Sequence
  Synthetic
agctgtttcggcggacg

SEQ ID NO: 11587 - DNA, 19 bp, Artificial Sequence
  Synthetic
actggcgttacaaccggta

SEQ ID NO: 11588 - DNA, 18 bp, Artificial Sequence
  Synthetic
tctttccccgaaacaagt

SEQ ID NO: 11589 - DNA, 18 bp, Artificial Sequence
  Synthetic
cgaacgccatcacgtctg

SEQ ID NO: 11590 - DNA, 18 bp, Artificial Sequence
  Synthetic
aacccgacgcgctgatta

SEQ ID NO: 11591 - DNA, 19 bp, Artificial Sequence
  Synthetic
cactttcccgatgaagccg

SEQ ID NO: 11592 - DNA, 16 bp, Artificial Sequence
  Synthetic
aacctgttgcagccgc

SEQ ID NO: 11593 - DNA, 18 bp, Artificial Sequence
  Synthetic
gcgtggaagttactgccc

SEQ ID NO: 11594 - DNA, 18 bp, Artificial Sequence
  Synthetic
cccctaccgcatcaacac

SEQ ID NO: 11595 - DNA, 20 bp, Artificial Sequence
  Synthetic
tcaaccccaacgaatttgcc

SEQ ID NO: 11596 - DNA, 20 bp, Artificial Sequence
  Synthetic
tgttgaacttccagcaggtg

SEQ ID NO: 11597 - DNA, 17 bp, Artificial Sequence
  Synthetic
gggcatgggtccgattg

SEQ ID NO: 11598 - DNA, 17 bp, Artificial Sequence
  Synthetic
tcgccaaacgcctgatg

SEQ ID NO: 11599 - DNA, 20 bp, Artificial Sequence
  Synthetic
gaaagacgacaacccactgg

SEQ ID NO: 11600 - DNA, 17 bp, Artificial Sequence
  Synthetic
accgggaatcgaaccgc

SEQ ID NO: 11601 - DNA, 17 bp, Artificial Sequence
  Synthetic
cggtgcaggaaatccgc

SEQ ID NO: 11602 - DNA, 17 bp, Artificial Sequence
  Synthetic
gcgttgccgaaaagctg

SEQ ID NO: 11603 - DNA, 16 bp, Artificial Sequence
  Synthetic
cttcctgtgcgtcggc

SEQ ID NO: 11604 - DNA, 20 bp, Artificial Sequence
  Synthetic
aagcgaaccgtcttcatgaa

SEQ ID NO: 11605 - DNA, 20 bp, Artificial Sequence
  Synthetic
tcaaagtcagcatcagaccg

SEQ ID NO: 11606 - DNA, 17 bp, Artificial Sequence
  Synthetic
tatcggtgcgcaggtcg

SEQ ID NO: 11607 - DNA, 19 bp, Artificial Sequence
  Synthetic
gcgtaaagtcttgcacggc

SEQ ID NO: 11608 - DNA, 17 bp, Artificial Sequence
  Synthetic
cggatttcgaggccgtc

SEQ ID NO: 11609 - DNA, 20 bp, Artificial Sequence
  Synthetic
cttttcagacggcattcggc

SEQ ID NO: 11610 - DNA, 19 bp, Artificial Sequence
  Synthetic
acactgcatccgcattgct

SEQ ID NO: 11611 - DNA, 16 bp, Artificial Sequence
  Synthetic
cccaaccgggccaaca

SEQ ID NO: 11612 - DNA, 19 bp, Artificial Sequence
  Synthetic
caataccgcctgtaccacg

SEQ ID NO: 11613 - DNA, 19 bp, Artificial Sequence
  Synthetic
atcgaaactacgcgccatt

SEQ ID NO: 11614 - DNA, 16 bp, Artificial Sequence
  Synthetic
cgcgacgaagccgaag

SEQ ID NO: 11615 - DNA, 18 bp, Artificial Sequence
  Synthetic
tcctcgcctttcagacgg

SEQ ID NO: 11616 - DNA, 16 bp, Artificial Sequence
  Synthetic
ggcgggcgcaatcgaa

SEQ ID NO: 11617 - DNA, 16 bp, Artificial Sequence
  Synthetic
gccggcggcaaaagga

SEQ ID NO: 11618 - DNA, 18 bp, Artificial Sequence
  Synthetic
ccgcccaattcgacagaa

SEQ ID NO: 11619 - DNA, 17 bp, Artificial Sequence
  Synthetic
cagtgctgcttcgctgc

SEQ ID NO: 11620 - DNA, 16 bp, Artificial Sequence
  Synthetic
cggctgcaaccgccaa

SEQ ID NO: 11621 - DNA, 17 bp, Artificial Sequence
  Synthetic
cgttgcagacggccttg

SEQ ID NO: 11622 - DNA, 19 bp, Artificial Sequence
  Synthetic
gggtaacttgtgctagcgt

SEQ ID NO: 11623 - DNA, 16 bp, Artificial Sequence
  Synthetic
ggcagcaggctttccg

SEQ ID NO: 11624 - DNA, 16 bp, Artificial Sequence
  Synthetic
caggatttcgcgcgcg

SEQ ID NO: 11625 - DNA, 16 bp, Artificial Sequence
  Synthetic
ctccgcatcggcacca

SEQ ID NO: 11626 - DNA, 20 bp, Artificial Sequence
  Synthetic
gactgccttttggtcatcgg

SEQ ID NO: 11627 - DNA, 18 bp, Artificial Sequence
  Synthetic
taccacgcgctgacatcc

SEQ ID NO: 11628 - DNA, 18 bp, Artificial Sequence
  Synthetic
ccaatgaggcaagcagcg

SEQ ID NO: 11629 - DNA, 18 bp, Artificial Sequence
  Synthetic
cacgactgaaacggggtt

SEQ ID NO: 11630 - DNA, 19 bp, Artificial Sequence
  Synthetic
ggaatgccggcatattgga

SEQ ID NO: 11631 - DNA, 18 bp, Artificial Sequence
  Synthetic
atgcctacaccacattgc

SEQ ID NO: 11632 - DNA, 20 bp, Artificial Sequence
  Synthetic
ttccgtcaactggctttacg

SEQ ID NO: 11633 - DNA, 16 bp, Artificial Sequence
  Synthetic
ggcggcgttgcaggaa

SEQ ID NO: 11634 - DNA, 20 bp, Artificial Sequence
  Synthetic
gttgtagaggtgcagttcgg

SEQ ID NO: 11635 - DNA, 16 bp, Artificial Sequence
  Synthetic
tggcgctgtcggggtt

SEQ ID NO: 11636 - DNA, 16 bp, Artificial Sequence
  Synthetic
gccgccgaagtgctgt

SEQ ID NO: 11637 - DNA, 18 bp, Artificial Sequence
  Synthetic
aagggtttccaaacggcg

SEQ ID NO: 11638 - DNA, 20 bp, Artificial Sequence
  Synthetic
tttggcaagctgtttcatcg

SEQ ID NO: 11639 - DNA, 17 bp, Artificial Sequence
  Synthetic
tggctcgccgttgaaga

SEQ ID NO: 11640 - DNA, 17 bp, Artificial Sequence
  Synthetic
cgacttcgcccgcaatc

SEQ ID NO: 11641 - DNA, 18 bp, Artificial Sequence
  Synthetic
gattcagacggcatcggc

SEQ ID NO: 11642 - DNA, 17 bp, Artificial Sequence
  Synthetic
ggcggcaaactcttggg

SEQ ID NO: 11643 - DNA, 17 bp, Artificial Sequence
  Synthetic
gtccggcgaacttgtgc

SEQ ID NO: 11644 - DNA, 17 bp, Artificial Sequence
  Synthetic
acggcgtgatgatcggc

SEQ ID NO: 11645 - DNA, 19 bp, Artificial Sequence
  Synthetic
ctgcaccatcacgaactct

SEQ ID NO: 11646 - DNA, 18 bp, Artificial Sequence
  Synthetic
tgcacccacaaactcacg

SEQ ID NO: 11647 - DNA, 17 bp, Artificial Sequence
  Synthetic
tcaccagcttcgcctgc

SEQ ID NO: 11648 - DNA, 16 bp, Artificial Sequence
  Synthetic
gcggtatcgagtgcgc

SEQ ID NO: 11649 - DNA, 20 bp, Artificial Sequence
  Synthetic
gacggcatttttgacatccc

SEQ ID NO: 11650 - DNA, 20 bp, Artificial Sequence
  Synthetic
gcaccgacatttctttgacc

SEQ ID NO: 11651 - DNA, 19 bp, Artificial Sequence
  Synthetic
gccgattctttcgccaacg

SEQ ID NO: 11652 - DNA, 16 bp, Artificial Sequence
  Synthetic
cggcggcttcctgcaa

SEQ ID NO: 11653 - DNA, 19 bp, Artificial Sequence
  Synthetic
tgcgcttggatttggttca

SEQ ID NO: 11654 - DNA, 16 bp, Artificial Sequence
  Synthetic
gggcgcggtgatgtgt

SEQ ID NO: 11655 - DNA, 18 bp, Artificial Sequence
  Synthetic
tgcttggcaacggtttgt

SEQ ID NO: 11656 - DNA, 17 bp, Artificial Sequence
  Synthetic
aatgcccaagcggtggc

SEQ ID NO: 11657 - DNA, 16 bp, Artificial Sequence
  Synthetic
ccgtatctgggcgcga

SEQ ID NO: 11658 - DNA, 18 bp, Artificial Sequence
  Synthetic
ggcgacgaatccctctcc

SEQ ID NO: 11659 - DNA, 20 bp, Artificial Sequence
  Synthetic
ggcatccgtgttttggaaac

SEQ ID NO: 11660 - DNA, 17 bp, Artificial Sequence
  Synthetic
atgggtggacagccgct

SEQ ID NO: 11661 - DNA, 20 bp, Artificial Sequence
  Synthetic
cccacagcagaacaaaaacg

SEQ ID NO: 11662 - DNA, 17 bp, Artificial Sequence
  Synthetic
cgagttcggcagcttcc

SEQ ID NO: 11663 - DNA, 18 bp, Artificial Sequence
  Synthetic
tccccagttgtggtagcg

SEQ ID NO: 11664 - DNA, 16 bp, Artificial Sequence
  Synthetic
gtccgccgcgtcgaaa

SEQ ID NO: 11665 - DNA, 19 bp, Artificial Sequence
  Synthetic
ttgatgcggttgatgtcgg

SEQ ID NO: 11666 - DNA, 20 bp, Artificial Sequence
  Synthetic
atctgtttgacggtttcgcc

SEQ ID NO: 11667 - DNA, 16 bp, Artificial Sequence
  Synthetic
cttcgagttcggcggc

SEQ ID NO: 11668 - DNA, 16 bp, Artificial Sequence
  Synthetic
agcagcagggacagcg

SEQ ID NO: 11669 - DNA, 20 bp, Artificial Sequence
  Synthetic
gggatgatactgctgcacgt

SEQ ID NO: 11670 - DNA, 18 bp, Artificial Sequence
  Synthetic
cgcctatccgaacaggcc

SEQ ID NO: 11671 - DNA, 22 bp, Artificial Sequence
  Synthetic
aaatcatgagcaattacgaaga

SEQ ID NO: 11672 - DNA, 18 bp, Artificial Sequence
  Synthetic
agtcaatacgatgcagcc

SEQ ID NO: 11673 - DNA, 20 bp, Artificial Sequence
  Synthetic
agaacgccctgatactaact

SEQ ID NO: 11674 - DNA, 20 bp, Artificial Sequence
  Synthetic
tgatgcaaatgaccgtgatt

SEQ ID NO: 11675 - DNA, 19 bp, Artificial Sequence
  Synthetic
ataacgaagaacctcagcc

SEQ ID NO: 11676 - DNA, 20 bp, Artificial Sequence
  Synthetic
cgaacttgaccctaagcagc

SEQ ID NO: 11677 - DNA, 20 bp, Artificial Sequence
  Synthetic
gaaacgcatcactttatcgg

SEQ ID NO: 11678 - DNA, 18 bp, Artificial Sequence
  Synthetic
ctgtttagggctgcgttc

SEQ ID NO: 11679 - DNA, 21 bp, Artificial Sequence
  Synthetic
aaccagtttgcatcaaaacac

SEQ ID NO: 11680 - DNA, 20 bp, Artificial Sequence
  Synthetic
caccgtattcaaaggtatgg

SEQ ID NO: 11681 - DNA, 19 bp, Artificial Sequence
  Synthetic
tccaaatggaaaactgcca

SEQ ID NO: 11682 - DNA, 20 bp, Artificial Sequence
  Synthetic
caattccaacacgttttcca

SEQ ID NO: 11683 - DNA, 22 bp, Artificial Sequence
  Synthetic
tctgccaaaatcaaacttttcg

SEQ ID NO: 11684 - DNA, 17 bp, Artificial Sequence
  Synthetic
tactgcgaccaacccga

SEQ ID NO: 11685 - DNA, 16 bp, Artificial Sequence
  Synthetic
tgaagccttgcgcgtc

SEQ ID NO: 11686 - DNA, 21 bp, Artificial Sequence
  Synthetic
ttttgatggtttgatggtttg

SEQ ID NO: 11687 - DNA, 18 bp, Artificial Sequence
  Synthetic
ttgccgcaaacagcatct

SEQ ID NO: 11688 - DNA, 18 bp, Artificial Sequence
  Synthetic
caaatcatccgccgcacc

SEQ ID NO: 11689 - DNA, 20 bp, Artificial Sequence
  Synthetic
acgtgttcatcccattgagc

SEQ ID NO: 11690 - DNA, 19 bp, Artificial Sequence
  Synthetic
gccaatttcgccgtattgc

SEQ ID NO: 11691 - DNA, 16 bp, Artificial Sequence
  Synthetic
cggcgaggatgcggat

SEQ ID NO: 11692 - DNA, 16 bp, Artificial Sequence
  Synthetic
tcaggctgacgcggct

SEQ ID NO: 11693 - DNA, 16 bp, Artificial Sequence
  Synthetic
ccgtgtccggcgttga

SEQ ID NO: 11694 - DNA, 16 bp, Artificial Sequence
  Synthetic
cgcgcgcggtcagttt

SEQ ID NO: 11695 - DNA, 18 bp, Artificial Sequence
  Synthetic
ctgacgggtttcgacctg

SEQ ID NO: 11696 - DNA, 16 bp, Artificial Sequence
  Synthetic
gcatgcctgcgtgtcc

SEQ ID NO: 11697 - DNA, 19 bp, Artificial Sequence
  Synthetic
acggtataactttgcgcca

SEQ ID NO: 11698 - DNA, 18 bp, Artificial Sequence
  Synthetic
gagtttcttaccgccgcc

SEQ ID NO: 11699 - DNA, 17 bp, Artificial Sequence
  Synthetic
aactggggacgcctgga

SEQ ID NO: 11700 - DNA, 16 bp, Artificial Sequence
  Synthetic
ccgtcattcccgcgca

SEQ ID NO: 11701 - DNA, 20 bp, Artificial Sequence
  Synthetic
agtgccggaagaaaatacgg

SEQ ID NO: 11702 - DNA, 16 bp, Artificial Sequence
  Synthetic
cagttccgtgccgtcg

SEQ ID NO: 11703 - DNA, 19 bp, Artificial Sequence
  Synthetic
ggcacggcataagtgtagg

SEQ ID NO: 11704 - DNA, 17 bp, Artificial Sequence
  Synthetic
ggccgtccattgtccgt

SEQ ID NO: 11705 - DNA, 18 bp, Artificial Sequence
  Synthetic
agtttgcccatgctcagg

SEQ ID NO: 11706 - DNA, 18 bp, Artificial Sequence
  Synthetic
cactgccggccaaaatcg

SEQ ID NO: 11707 - DNA, 16 bp, Artificial Sequence
  Synthetic
ggcggcgacaacgttg

SEQ ID NO: 11708 - DNA, 16 bp, Artificial Sequence
  Synthetic
gcagtcgcgccgaact

SEQ ID NO: 11709 - DNA, 16 bp, Artificial Sequence
  Synthetic
gtcagctccacgccga

SEQ ID NO: 11710 - DNA, 20 bp, Artificial Sequence
  Synthetic
tcaaaaacattgccttcgcc

SEQ ID NO: 11711 - DNA, 17 bp, Artificial Sequence
  Synthetic
gggttgccgccatttcg

SEQ ID NO: 11712 - DNA, 17 bp, Artificial Sequence
  Synthetic
tcggtatgcgcttccgg

SEQ ID NO: 11713 - DNA, 16 bp, Artificial Sequence
  Synthetic
gccgtctgaaccgcct

SEQ ID NO: 11714 - DNA, 18 bp, Artificial Sequence
  Synthetic
cgcaatcaccttgtcgcc

SEQ ID NO: 11715 - DNA, 18 bp, Artificial Sequence
  Synthetic
caacagggtggacacggt

SEQ ID NO: 11716 - DNA, 17 bp, Artificial Sequence
  Synthetic
ggttgcgcccttgatgc

SEQ ID NO: 11717 - DNA, 16 bp, Artificial Sequence
  Synthetic
acggcgggcaggatgt

SEQ ID NO: 11718 - DNA, 16 bp, Artificial Sequence
  Synthetic
ggcacgccgttgactc

SEQ ID NO: 11719 - DNA, 19 bp, Artificial Sequence
  Synthetic
tgccttcgcaatcacgaac

SEQ ID NO: 11720 - DNA, 18 bp, Artificial Sequence
  Synthetic
ccatacaggctgtcttca

SEQ ID NO: 11721 - DNA, 19 bp, Artificial Sequence
  Synthetic
cgtatagaggcgcgacaga

SEQ ID NO: 11722 - DNA, 20 bp, Artificial Sequence
  Synthetic
cggtttgttcacgctcttcc

SEQ ID NO: 11723 - DNA, 19 bp, Artificial Sequence
  Synthetic
aaaccgaagaagaaaccgg

SEQ ID NO: 11724 - DNA, 18 bp, Artificial Sequence
  Synthetic
ttcgctgacgctcaaagc

SEQ ID NO: 11725 - DNA, 19 bp, Artificial Sequence
  Synthetic
accgcgactatgtcaaagc

SEQ ID NO: 11726 - DNA, 16 bp, Artificial Sequence
  Synthetic
acacccccgcgctgat

SEQ ID NO: 11727 - DNA, 16 bp, Artificial Sequence
  Synthetic
aacttcccgctcgcca

SEQ ID NO: 11728 - DNA, 16 bp, Artificial Sequence
  Synthetic
cgggtgcggcattgac

SEQ ID NO: 11729 - DNA, 16 bp, Artificial Sequence
  Synthetic
aggccttctgcgccct

SEQ ID NO: 11730 - DNA, 18 bp, Artificial Sequence
  Synthetic
aggtctcggtgtcatcgc

SEQ ID NO: 11731 - DNA, 20 bp, Artificial Sequence
  Synthetic
agcagtccccaaacaaatcc

SEQ ID NO: 11732 - DNA, 19 bp, Artificial Sequence
  Synthetic
ggcacgcaaatcgaaatcc

SEQ ID NO: 11733 - DNA, 16 bp, Artificial Sequence
  Synthetic
tctgacctgcgcggac

SEQ ID NO: 11734 - DNA, 18 bp, Artificial Sequence
  Synthetic
gtggtcgggagaggacga

SEQ ID NO: 11735 - DNA, 16 bp, Artificial Sequence
  Synthetic
ccgccgaaaccgccaa

SEQ ID NO: 11736 - DNA, 18 bp, Artificial Sequence
  Synthetic
tcccattcgttgtggcac

SEQ ID NO: 11737 - DNA, 18 bp, Artificial Sequence
  Synthetic
gcaaaatcgcaaggcagc

SEQ ID NO: 11738 - DNA, 18 bp, Artificial Sequence
  Synthetic
gcggtttgagcgcatcaa

SEQ ID NO: 11739 - DNA, 17 bp, Artificial Sequence
  Synthetic
aacatcctgtgccgccc

SEQ ID NO: 11740 - DNA, 20 bp, Artificial Sequence
  Synthetic
gagaatgccgtctgaaatgt

SEQ ID NO: 11741 - DNA, 16 bp, Artificial Sequence
  Synthetic
cggaagggcacgcctt

SEQ ID NO: 11742 - DNA, 16 bp, Artificial Sequence
  Synthetic
tcgtccccgcctttca

SEQ ID NO: 11743 - DNA, 16 bp, Artificial Sequence
  Synthetic
acaaccccgacagcgc

SEQ ID NO: 11744 - DNA, 18 bp, Artificial Sequence
  Synthetic
gtccgcctgttccgaaat

SEQ ID NO: 11745 - DNA, 19 bp, Artificial Sequence
  Synthetic
ggcaaacgttaccgtaccg

SEQ ID NO: 11746 - DNA, 20 bp, Artificial Sequence
  Synthetic
tctgatttccaagatggcgc

SEQ ID NO: 11747 - DNA, 20 bp, Artificial Sequence
  Synthetic
tgtccacaatcatgcccaaa

SEQ ID NO: 11748 - DNA, 20 bp, Artificial Sequence
  Synthetic
gaacttgccaaagacgctca

SEQ ID NO: 11749 - DNA, 19 bp, Artificial Sequence
  Synthetic
aaaccctcaaagcctacgc

SEQ ID NO: 11750 - DNA, 19 bp, Artificial Sequence
  Synthetic
gccgcctatcaagattggg

SEQ ID NO: 11751 - DNA, 17 bp, Artificial Sequence
  Synthetic
gcaaacagccgtcgtgg

SEQ ID NO: 11752 - DNA, 18 bp, Artificial Sequence
  Synthetic
ggcgttacccacatcgtg

SEQ ID NO: 11753 - DNA, 16 bp, Artificial Sequence
  Synthetic
ggctgtggcggacgat

SEQ ID NO: 11754 - DNA, 19 bp, Artificial Sequence
  Synthetic
ttcgttcatcagacacgcg

SEQ ID NO: 11755 - DNA, 16 bp, Artificial Sequence
  Synthetic
ttacggcccggaccaa

SEQ ID NO: 11756 - DNA, 18 bp, Artificial Sequence
  Synthetic
cgcaggcgcaaaaaaacc

SEQ ID NO: 11757 - DNA, 16 bp, Artificial Sequence
  Synthetic
ccgcaaaacccacggc

SEQ ID NO: 11758 - DNA, 19 bp, Artificial Sequence
  Synthetic
atatccccgtcgtcttggt

SEQ ID NO: 11759 - DNA, 20 bp, Artificial Sequence
  Synthetic
cgtgatacgccttatcctgc

SEQ ID NO: 11760 - DNA, 16 bp, Artificial Sequence
  Synthetic
ggttttcggcgggcga

SEQ ID NO: 11761 - DNA, 16 bp, Artificial Sequence
  Synthetic
caaagagacgggcggc

SEQ ID NO: 11762 - DNA, 17 bp, Artificial Sequence
  Synthetic
ttgatgctgacggcgtg

SEQ ID NO: 11763 - DNA, 18 bp, Artificial Sequence
  Synthetic
gagattcggctcgttgat

SEQ ID NO: 11764 - DNA, 20 bp, Artificial Sequence
  Synthetic
accagaacaatactgtcggc

SEQ ID NO: 11765 - DNA, 20 bp, Artificial Sequence
  Synthetic
ccacaggggatacatcttgc

SEQ ID NO: 11766 - DNA, 17 bp, Artificial Sequence
  Synthetic
gcggcagcgttaccgtt

SEQ ID NO: 11767 - DNA, 18 bp, Artificial Sequence
  Synthetic
cgtgtttcatcaggccgg

SEQ ID NO: 11768 - DNA, 20 bp, Artificial Sequence
  Synthetic
tattcggcgtaaacgtctgc

SEQ ID NO: 11769 - DNA, 18 bp, Artificial Sequence
  Synthetic
gtccacgcgtttgacgat

SEQ ID NO: 11770 - DNA, 20 bp, Artificial Sequence
  Synthetic
ctgccttcttcgacaatcgc

SEQ ID NO: 11771 - DNA, 16 bp, Artificial Sequence
  Synthetic
cccgctagcagttcgc

SEQ ID NO: 11772 - DNA, 17 bp, Artificial Sequence
  Synthetic
ggcggatttcgggcaac

SEQ ID NO: 11773 - DNA, 16 bp, Artificial Sequence
  Synthetic
gtatggcgggcggtca

SEQ ID NO: 11774 - DNA, 23 bp, Artificial Sequence
  Synthetic
aacaggcaaataacaatacaatg

SEQ ID NO: 11775 - DNA, 17 bp, Artificial Sequence
  Synthetic
ctacggcaaacgcagcg

SEQ ID NO: 11776 - DNA, 17 bp, Artificial Sequence
  Synthetic
ggtaatcacgccgtcgg

SEQ ID NO: 11777 - DNA, 15 bp, Artificial Sequence
  Synthetic
aaaacgcgggctgcc

SEQ ID NO: 11778 - DNA, 20 bp, Artificial Sequence
  Synthetic
tgtttatggacgatttgcgc

SEQ ID NO: 11779 - DNA, 21 bp, Artificial Sequence
  Synthetic
cttacctcattgtttcacaca

SEQ ID NO: 11780 - DNA, 20 bp, Artificial Sequence
  Synthetic
atcccaaagtttcaagccgt

SEQ ID NO: 11781 - DNA, 20 bp, Artificial Sequence
  Synthetic
tcatcacgatatgcagcctg

SEQ ID NO: 11782 - DNA, 16 bp, Artificial Sequence
  Synthetic
tcgacctcacccgcaa

SEQ ID NO: 11783 - DNA, 20 bp, Artificial Sequence
  Synthetic
attccgattatcgatgccgc

SEQ ID NO: 11784 - DNA, 18 bp, Artificial Sequence
  Synthetic
aatgccagccccatcagc

SEQ ID NO: 11785 - DNA, 20 bp, Artificial Sequence
  Synthetic
acagggcgaactctacatcc

SEQ ID NO: 11786 - DNA, 18 bp, Artificial Sequence
  Synthetic
tcgccaaactccccttcg

SEQ ID NO: 11787 - DNA, 19 bp, Artificial Sequence
  Synthetic
cagcaaaaggggatacagg

SEQ ID NO: 11788 - DNA, 20 bp, Artificial Sequence
  Synthetic
ttctcgtaaggattggcgac

SEQ ID NO: 11789 - DNA, 16 bp, Artificial Sequence
  Synthetic
cgtgggtgcggctcat

SEQ ID NO: 11790 - DNA, 19 bp, Artificial Sequence
  Synthetic
tcggcaaaacgggaaaacc

SEQ ID NO: 11791 - DNA, 16 bp, Artificial Sequence
  Synthetic
ccggcatcgcgcactt

SEQ ID NO: 11792 - DNA, 16 bp, Artificial Sequence
  Synthetic
atcggcgtgccaaacc

SEQ ID NO: 11793 - DNA, 18 bp, Artificial Sequence
  Synthetic
ctgctcgaggaaggcatc

SEQ ID NO: 11794 - DNA, 20 bp, Artificial Sequence
  Synthetic
ggcaatgccgtctgaaaagc

SEQ ID NO: 11795 - DNA, 19 bp, Artificial Sequence
  Synthetic
cgtcagtttgtaacgccct

SEQ ID NO: 11796 - DNA, 16 bp, Artificial Sequence
  Synthetic
taccttggacggcggc

SEQ ID NO: 11797 - DNA, 18 bp, Artificial Sequence
  Synthetic
acacgcgctacttcctcc

SEQ ID NO: 11798 - DNA, 18 bp, Artificial Sequence
  Synthetic
caacgccgaacacatccg

SEQ ID NO: 11799 - DNA, 20 bp, Artificial Sequence
  Synthetic
ctgcgtcaaaaactcgaagc

SEQ ID NO: 11800 - DNA, 17 bp, Artificial Sequence
  Synthetic
ggcagacctgacgatgc

SEQ ID NO: 11801 - DNA, 17 bp, Artificial Sequence
  Synthetic
cgccctgaccaccaaag

SEQ ID NO: 11802 - DNA, 16 bp, Artificial Sequence
  Synthetic
tggtacggcggcaggt

SEQ ID NO: 11803 - DNA, 16 bp, Artificial Sequence
  Synthetic
cggcatcggcgcgaaa

SEQ ID NO: 11804 - DNA, 20 bp, Artificial Sequence
  Synthetic
gggcaaaatcgtagagtggc

SEQ ID NO: 11805 - DNA, 18 bp, Artificial Sequence
  Synthetic
ctctttttccacggcgcg

SEQ ID NO: 11806 - DNA, 19 bp, Artificial Sequence
  Synthetic
aactcctcgaaaaacgcgg

SEQ ID NO: 11807 - DNA, 17 bp, Artificial Sequence
  Synthetic
ccaaattaccgccggct

SEQ ID NO: 11808 - DNA, 20 bp, Artificial Sequence
  Synthetic
actcccaaccctgattgtgt

SEQ ID NO: 11809 - DNA, 19 bp, Artificial Sequence
  Synthetic
gttttcgcactcgttgtcc

SEQ ID NO: 11810 - DNA, 17 bp, Artificial Sequence
  Synthetic
aagacgtgctgccctgt

SEQ ID NO: 11811 - DNA, 18 bp, Artificial Sequence
  Synthetic
tcgcggcgtgaatcaatg

SEQ ID NO: 11812 - DNA, 18 bp, Artificial Sequence
  Synthetic
catcgcgctgataccgaa

SEQ ID NO: 11813 - DNA, 19 bp, Artificial Sequence
  Synthetic
aacaacaccattacggcgc

SEQ ID NO: 11814 - DNA, 20 bp, Artificial Sequence
  Synthetic
acggcgcacgatagaatcag

SEQ ID NO: 11815 - DNA, 20 bp, Artificial Sequence
  Synthetic
ctgtcgggttgttttgctct

SEQ ID NO: 11816 - DNA, 18 bp, Artificial Sequence
  Synthetic
cataatgccgcctacgcc

SEQ ID NO: 11817 - DNA, 16 bp, Artificial Sequence
  Synthetic
cggttccggcgggttt

SEQ ID NO: 11818 - DNA, 18 bp, Artificial Sequence
  Synthetic
tacgtttggggcgcaatc

SEQ ID NO: 11819 - DNA, 17 bp, Artificial Sequence
  Synthetic
gccaccctgttcggact

SEQ ID NO: 11820 - DNA, 18 bp, Artificial Sequence
  Synthetic
cgaaagcgggaatccagg

SEQ ID NO: 11821 - DNA, 17 bp, Artificial Sequence
  Synthetic
cacgcccgtgttcttcc

SEQ ID NO: 11822 - DNA, 20 bp, Artificial Sequence
  Synthetic
gcattgtcttcactgttggc

SEQ ID NO: 11823 - DNA, 18 bp, Artificial Sequence
  Synthetic
ccagtcaggggcacaaag

SEQ ID NO: 11824 - DNA, 19 bp, Artificial Sequence
  Synthetic
gtgcgtctatgctcggttc

SEQ ID NO: 11825 - DNA, 19 bp, Artificial Sequence
  Synthetic
cccattctacgccgttgat

SEQ ID NO: 11826 - DNA, 16 bp, Artificial Sequence
  Synthetic
cgcagttcgggcgtgt

SEQ ID NO: 11827 - DNA, 16 bp, Artificial Sequence
  Synthetic
gttccgccgccgaagt

SEQ ID NO: 11828 - DNA, 16 bp, Artificial Sequence
  Synthetic
aacacccggctctggc

SEQ ID NO: 11829 - DNA, 16 bp, Artificial Sequence
  Synthetic
gcgcaatcggcatcct

SEQ ID NO: 11830 - DNA, 18 bp, Artificial Sequence
  Synthetic
tgggcttaacttgcgacc

SEQ ID NO: 11831 - DNA, 18 bp, Artificial Sequence
  Synthetic
gtaaacgaggcatccggg

SEQ ID NO: 11832 - DNA, 20 bp, Artificial Sequence
  Synthetic
atcagaatcatcagcggcac

SEQ ID NO: 11833 - DNA, 16 bp, Artificial Sequence
  Synthetic
cgcgccgtttcagcct

SEQ ID NO: 11834 - DNA, 19 bp, Artificial Sequence
  Synthetic
atgccgtctgaaactcggg

SEQ ID NO: 11835 - DNA, 17 bp, Artificial Sequence
  Synthetic
cagggcgaatacgggga

SEQ ID NO: 11836 - DNA, 17 bp, Artificial Sequence
  Synthetic
caccgtgtaccgccaca

SEQ ID NO: 11837 - DNA, 16 bp, Artificial Sequence
  Synthetic
gcgcccgcgtacagat

SEQ ID NO: 11838 - DNA, 18 bp, Artificial Sequence
  Synthetic
tttgcgcatggttcagga

SEQ ID NO: 11839 - DNA, 17 bp, Artificial Sequence
  Synthetic
cacccgttgcagatgcc

SEQ ID NO: 11840 - DNA, 17 bp, Artificial Sequence
  Synthetic
caaagtccgttccgccg

SEQ ID NO: 11841 - DNA, 16 bp, Artificial Sequence
  Synthetic
ggcaccgaaagccgca

SEQ ID NO: 11842 - DNA, 16 bp, Artificial Sequence
  Synthetic
tctcgacggcggtctc

SEQ ID NO: 11843 - DNA, 17 bp, Artificial Sequence
  Synthetic
gtgatcaccgcgatggg

SEQ ID NO: 11844 - DNA, 19 bp, Artificial Sequence
  Synthetic
gcaaaaactcgccgaagac

SEQ ID NO: 11845 - DNA, 16 bp, Artificial Sequence
  Synthetic
gcacttcccgggcgat

SEQ ID NO: 11846 - DNA, 15 bp, Artificial Sequence
  Synthetic
tgcccgtcgtcgcat

SEQ ID NO: 11847 - DNA, 17 bp, Artificial Sequence
  Synthetic
gtgcatgctcatcggcg

SEQ ID NO: 11848 - DNA, 15 bp, Artificial Sequence
  Synthetic
agcaacggcaggcgt

SEQ ID NO: 11849 - DNA, 20 bp, Artificial Sequence
  Synthetic
aaatcgtcaacaccaccgag

SEQ ID NO: 11850 - DNA, 17 bp, Artificial Sequence
  Synthetic
cgccatcaaccccgaac

SEQ ID NO: 11851 - DNA, 16 bp, Artificial Sequence
  Synthetic
cccttttggacgcgcg

SEQ ID NO: 11852 - DNA, 18 bp, Artificial Sequence
  Synthetic
catcccgatgatgccctg

SEQ ID NO: 11853 - DNA, 20 bp, Artificial Sequence
  Synthetic
ccgacttcaccatccaagac

SEQ ID NO: 11854 - DNA, 18 bp, Artificial Sequence
  Synthetic
aaaaccggcatctcaggc

SEQ ID NO: 11855 - DNA, 18 bp, Artificial Sequence
  Synthetic
tttcccattttgcggcgt

SEQ ID NO: 11856 - DNA, 16 bp, Artificial Sequence
  Synthetic
aagtttccggcggcac

SEQ ID NO: 11857 - DNA, 20 bp, Artificial Sequence
  Synthetic
gaagaactgtggcaaaccgt

SEQ ID NO: 11858 - DNA, 20 bp, Artificial Sequence
  Synthetic
agcatctaattgagtctcgt

SEQ ID NO: 11859 - DNA, 18 bp, Artificial Sequence
  Synthetic
gcacatgcacgatgagat

SEQ ID NO: 11860 - DNA, 20 bp, Artificial Sequence
  Synthetic
ccaaaatacgaccaaaacgc

SEQ ID NO: 11861 - DNA, 20 bp, Artificial Sequence
  Synthetic
atgccgtctgaaaattcttg

SEQ ID NO: 11862 - DNA, 20 bp, Artificial Sequence
  Synthetic
ccgcgcttttaggaacttca

SEQ ID NO: 11863 - DNA, 20 bp, Artificial Sequence
  Synthetic
acaaagccgtctgaagtacc

SEQ ID NO: 11864 - DNA, 18 bp, Artificial Sequence
  Synthetic
gcgccgtatgcttccaat

SEQ ID NO: 11865 - DNA, 18 bp, Artificial Sequence
  Synthetic
ggtatttccccgcacctg

SEQ ID NO: 11866 - DNA, 20 bp, Artificial Sequence
  Synthetic
taatcagtttgtggcagcct

SEQ ID NO: 11867 - DNA, 19 bp, Artificial Sequence
  Synthetic
tcttgggcgatgtggtact

SEQ ID NO: 11868 - DNA, 17 bp, Artificial Sequence
  Synthetic
cggcggaaagctggatg

SEQ ID NO: 11869 - DNA, 19 bp, Artificial Sequence
  Synthetic
aacggctgaaagacaacga

SEQ ID NO: 11870 - DNA, 19 bp, Artificial Sequence
  Synthetic
tcagcacataacgcggatt

SEQ ID NO: 11871 - DNA, 16 bp, Artificial Sequence
  Synthetic
acccgcgcggaagtca

SEQ ID NO: 11872 - DNA, 16 bp, Artificial Sequence
  Synthetic
cgtttccgcccaacgc

SEQ ID NO: 11873 - DNA, 18 bp, Artificial Sequence
  Synthetic
acacgccgatgtcaaagg

SEQ ID NO: 11874 - DNA, 24 bp, Artificial Sequence
  Synthetic
tagtgtggttaaatctttttgcag

SEQ ID NO: 11875 - DNA, 19 bp, Artificial Sequence
  Synthetic
tcgtcagcgcgatacgttt

SEQ ID NO: 11876 - DNA, 16 bp, Artificial Sequence
  Synthetic
ttcgaccaccgcgtcc

SEQ ID NO: 11877 - DNA, 16 bp, Artificial Sequence
  Synthetic
cgccagttcggacgca

SEQ ID NO: 11878 - DNA, 15 bp, Artificial Sequence
  Synthetic
acggccttgcgctct

SEQ ID NO: 11879 - DNA, 18 bp, Artificial Sequence
  Synthetic
gcagcatcaaaagcgtcc

SEQ ID NO: 11880 - DNA, 20 bp, Artificial Sequence
  Synthetic
tgacacccttacctttcacg

SEQ ID NO: 11881 - DNA, 22 bp, Artificial Sequence
  Synthetic
ggggatattcgggtaaaattag

SEQ ID NO: 11882 - DNA, 15 bp, Artificial Sequence
  Synthetic
acgcccagcccgatt

SEQ ID NO: 11883 - DNA, 15 bp, Artificial Sequence
  Synthetic
tgaccgccgccgaaa

SEQ ID NO: 11884 - DNA, 16 bp, Artificial Sequence
  Synthetic
ggcagacggcggtaca

SEQ ID NO: 11885 - DNA, 20 bp, Artificial Sequence
  Synthetic
agcctctgctcattacctcg

SEQ ID NO: 11886 - DNA, 19 bp, Artificial Sequence
  Synthetic
tacctacacccccgaaacc

SEQ ID NO: 11887 - DNA, 16 bp, Artificial Sequence
  Synthetic
tcggacgcgccatcga

SEQ ID NO: 11888 - DNA, 16 bp, Artificial Sequence
  Synthetic
catcgccgccctcgaa

SEQ ID NO: 11889 - DNA, 18 bp, Artificial Sequence
  Synthetic
tgaccgcccttttcgtct

SEQ ID NO: 11890 - DNA, 18 bp, Artificial Sequence
  Synthetic
cgaacccgcaaaattcgc

SEQ ID NO: 11891 - DNA, 17 bp, Artificial Sequence
  Synthetic
cttccaacacctgcccg

SEQ ID NO: 11892 - DNA, 19 bp, Artificial Sequence
  Synthetic
gagattggcgggatgaagc

SEQ ID NO: 11893 - DNA, 20 bp, Artificial Sequence
  Synthetic
tgccttggatttgggcattc

SEQ ID NO: 11894 - DNA, 16 bp, Artificial Sequence
  Synthetic
ttcggcaccgcacacc

SEQ ID NO: 11895 - DNA, 16 bp, Artificial Sequence
  Synthetic
gctgccgaccgatgtc

SEQ ID NO: 11896 - DNA, 18 bp, Artificial Sequence
  Synthetic
cgctttggatgcccagat

SEQ ID NO: 11897 - DNA, 18 bp, Artificial Sequence
  Synthetic
tcgtccgcttcaaaacgc

SEQ ID NO: 11898 - DNA, 18 bp, Artificial Sequence
  Synthetic
ttgccgtctttcagccag

SEQ ID NO: 11899 - DNA, 20 bp, Artificial Sequence
  Synthetic
ttccagtaatgcggaatcgg

SEQ ID NO: 11900 - DNA, 19 bp, Artificial Sequence
  Synthetic
gaaatgtcctacacctgcc

SEQ ID NO: 11901 - DNA, 23 bp, Artificial Sequence
  Synthetic
gcagaaactgaatcaaaaacaac

SEQ ID NO: 11902 - DNA, 18 bp, Artificial Sequence
  Synthetic
gataccggtttgctgcat

SEQ ID NO: 11903 - DNA, 18 bp, Artificial Sequence
  Synthetic
tgcttatccgaccgaatc

SEQ ID NO: 11904 - DNA, 20 bp, Artificial Sequence
  Synthetic
gaggatgccggagaaattgt

SEQ ID NO: 11905 - DNA, 16 bp, Artificial Sequence
  Synthetic
aatagcgcaggcgggt

SEQ ID NO: 11906 - DNA, 16 bp, Artificial Sequence
  Synthetic
cgcggaggcattcagg

SEQ ID NO: 11907 - DNA, 16 bp, Artificial Sequence
  Synthetic
ccgccgtcaagcagga

SEQ ID NO: 11908 - DNA, 16 bp, Artificial Sequence
  Synthetic
gcgcccgtaccttcca

SEQ ID NO: 11909 - DNA, 19 bp, Artificial Sequence
  Synthetic
attgcctgccggaaattgc

SEQ ID NO: 11910 - DNA, 18 bp, Artificial Sequence
  Synthetic
cagttgtcgccgtcgaag

SEQ ID NO: 11911 - DNA, 18 bp, Artificial Sequence
  Synthetic
gtgcaacggtgtaacccg

SEQ ID NO: 11912 - DNA, 19 bp, Artificial Sequence
  Synthetic
cacgttgttgagcagctgg

SEQ ID NO: 11913 - DNA, 17 bp, Artificial Sequence
  Synthetic
tcaagtcggcggacacg

SEQ ID NO: 11914 - DNA, 20 bp, Artificial Sequence
  Synthetic
ttatgaacattcgcttccac

SEQ ID NO: 11915 - DNA, 20 bp, Artificial Sequence
  Synthetic
actgccggttttgtcattgg

SEQ ID NO: 11916 - DNA, 17 bp, Artificial Sequence
  Synthetic
cggggcttcgtggaaac

SEQ ID NO: 11917 - DNA, 16 bp, Artificial Sequence
  Synthetic
cagtccgctgccgctt

SEQ ID NO: 11918 - DNA, 17 bp, Artificial Sequence
  Synthetic
cgacttgtccgagcagc

SEQ ID NO: 11919 - DNA, 19 bp, Artificial Sequence
  Synthetic
ccttccagcagtacggagt

SEQ ID NO: 11920 - DNA, 18 bp, Artificial Sequence
  Synthetic
cgtcggcacccttatccg

SEQ ID NO: 11921 - DNA, 17 bp, Artificial Sequence
  Synthetic
ccgttccctgcaactcg

SEQ ID NO: 11922 - DNA, 18 bp, Artificial Sequence
  Synthetic
gcttcgtgatggccgaca

SEQ ID NO: 11923 - DNA, 20 bp, Artificial Sequence
  Synthetic
ggcaaagtcatgcatacgct

SEQ ID NO: 11924 - DNA, 15 bp, Artificial Sequence
  Synthetic
caacacgcggcgcat

SEQ ID NO: 11925 - DNA, 16 bp, Artificial Sequence
  Synthetic
tcggcaagctcgtccg

SEQ ID NO: 11926 - DNA, 17 bp, Artificial Sequence
  Synthetic
gccgggtttgatccacc

SEQ ID NO: 11927 - DNA, 16 bp, Artificial Sequence
  Synthetic
ggagcttgccgacggt

SEQ ID NO: 11928 - DNA, 16 bp, Artificial Sequence
  Synthetic
ggtcgcaccgtttggg

SEQ ID NO: 11929 - DNA, 18 bp, Artificial Sequence
  Synthetic
tgcacttggaaacggcag

SEQ ID NO: 11930 - DNA, 16 bp, Artificial Sequence
  Synthetic
ggtgtcggcaacagcc

SEQ ID NO: 11931 - DNA, 18 bp, Artificial Sequence
  Synthetic
ctttcattgcgccggaca

SEQ ID NO: 11932 - DNA, 16 bp, Artificial Sequence
  Synthetic
aatgccagccgtccgg

SEQ ID NO: 11933 - DNA, 20 bp, Artificial Sequence
  Synthetic
caatttgtccaagccttgcg

SEQ ID NO: 11934 - DNA, 17 bp, Artificial Sequence
  Synthetic
tgagcgtgatttcgggc

SEQ ID NO: 11935 - DNA, 18 bp, Artificial Sequence
  Synthetic
cgtttgagatggcggacg

SEQ ID NO: 11936 - DNA, 18 bp, Artificial Sequence
  Synthetic
cccgtcagcgtataggcg

SEQ ID NO: 11937 - DNA, 16 bp, Artificial Sequence
  Synthetic
ccgacggcatgaccca

SEQ ID NO: 11938 - DNA, 17 bp, Artificial Sequence
  Synthetic
agcaatcgccaaagccg

SEQ ID NO: 11939 - DNA, 16 bp, Artificial Sequence
  Synthetic
cgaccgtgccgaagca

SEQ ID NO: 11940 - DNA, 19 bp, Artificial Sequence
  Synthetic
cggctatgttgacgcaaac

SEQ ID NO: 11941 - DNA, 18 bp, Artificial Sequence
  Synthetic
ttgccgccgtgatgaatg

SEQ ID NO: 11942 - DNA, 16 bp, Artificial Sequence
  Synthetic
gtgccgctgtgtaccg

SEQ ID NO: 11943 - DNA, 16 bp, Artificial Sequence
  Synthetic
ccgggcattcggggtt

SEQ ID NO: 11944 - DNA, 16 bp, Artificial Sequence
  Synthetic
ccgcagcgaactcgac

SEQ ID NO: 11945 - DNA, 20 bp, Artificial Sequence
  Synthetic
ggacaaatccgcattaccga

SEQ ID NO: 11946 - DNA, 17 bp, Artificial Sequence
  Synthetic
cggtttgcaagtcgcca

SEQ ID NO: 11947 - DNA, 18 bp, Artificial Sequence
  Synthetic
tccgccaaatgcaggaag

SEQ ID NO: 11948 - DNA, 16 bp, Artificial Sequence
  Synthetic
cactggttacgcgcgg

SEQ ID NO: 11949 - DNA, 20 bp, Artificial Sequence
  Synthetic
gtatcagttcgtgggcgagg

SEQ ID NO: 11950 - DNA, 19 bp, Artificial Sequence
  Synthetic
acatccttgtcgccatcgg

SEQ ID NO: 11951 - DNA, 20 bp, Artificial Sequence
  Synthetic
tcctgattgtcttctgtgcc

SEQ ID NO: 11952 - DNA, 18 bp, Artificial Sequence
  Synthetic
ttcattttgcctgccgtt

SEQ ID NO: 11953 - DNA, 16 bp, Artificial Sequence
  Synthetic
ggcggcggaagacctt

SEQ ID NO: 11954 - DNA, 18 bp, Artificial Sequence
  Synthetic
gaactggaaaccgacggc

SEQ ID NO: 11955 - DNA, 19 bp, Artificial Sequence
  Synthetic
aggtcgaaacactcgttgc

SEQ ID NO: 11956 - DNA, 16 bp, Artificial Sequence
  Synthetic
gaagacgtgcgcaccg

SEQ ID NO: 11957 - DNA, 20 bp, Artificial Sequence
  Synthetic
ttgtcattgacgtatcgcgg

SEQ ID NO: 11958 - DNA, 17 bp, Artificial Sequence
  Synthetic
ttcgcgcgtgttcttcc

SEQ ID NO: 11959 - DNA, 16 bp, Artificial Sequence
  Synthetic
gatgccgccgctgatg

SEQ ID NO: 11960 - DNA, 20 bp, Artificial Sequence
  Synthetic
gaagcggcttccttcaaacc

SEQ ID NO: 11961 - DNA, 18 bp, Artificial Sequence
  Synthetic
gaatgcacgggggtttga

SEQ ID NO: 11962 - DNA, 16 bp, Artificial Sequence
  Synthetic
gtggcagcggtcaagg

SEQ ID NO: 11963 - DNA, 18 bp, Artificial Sequence
  Synthetic
gcttgggcttcctgatgg

SEQ ID NO: 11964 - DNA, 20 bp, Artificial Sequence
  Synthetic
cgatatagggtttgaagcgg

SEQ ID NO: 11965 - DNA, 16 bp, Artificial Sequence
  Synthetic
cgccgtcttcgccttc

SEQ ID NO: 11966 - DNA, 16 bp, Artificial Sequence
  Synthetic
tgtcggtgggggggat

SEQ ID NO: 11967 - DNA, 20 bp, Artificial Sequence
  Synthetic
atccgataagtttccgcacc

SEQ ID NO: 11968 - DNA, 16 bp, Artificial Sequence
  Synthetic
ttgaatcgggcgggcg

SEQ ID NO: 11969 - DNA, 18 bp, Artificial Sequence
  Synthetic
cgttcgagacggggaatc

SEQ ID NO: 11970 - DNA, 20 bp, Artificial Sequence
  Synthetic
gcggaaaaatctcttggagc

SEQ ID NO: 11971 - DNA, 19 bp, Artificial Sequence
  Synthetic
tgctgctgattgtcaggtc

SEQ ID NO: 11972 - DNA, 17 bp, Artificial Sequence
  Synthetic
ggcgcggttctgtttgc

SEQ ID NO: 11973 - DNA, 18 bp, Artificial Sequence
  Synthetic
ggattcgtacagcggcag

SEQ ID NO: 11974 - DNA, 16 bp, Artificial Sequence
  Synthetic
acaccgaccagcccga

SEQ ID NO: 11975 - DNA, 20 bp, Artificial Sequence
  Synthetic
cgtatagtccgaccagttcg

SEQ ID NO: 11976 - DNA, 16 bp, Artificial Sequence
  Synthetic
ccggtgaagcggtcga

SEQ ID NO: 11977 - DNA, 18 bp, Artificial Sequence
  Synthetic
agtatgaagggcgtggcg

SEQ ID NO: 11978 - DNA, 16 bp, Artificial Sequence
  Synthetic
cgccgccgatttccct

SEQ ID NO: 11979 - DNA, 18 bp, Artificial Sequence
  Synthetic
cgcgacatcatgcgttcg

SEQ ID NO: 11980 - DNA, 18 bp, Artificial Sequence
  Synthetic
ccaaccacggatagcggt

SEQ ID NO: 11981 - DNA, 18 bp, Artificial Sequence
  Synthetic
ggaatgcccaaatccgcc

SEQ ID NO: 11982 - DNA, 17 bp, Artificial Sequence
  Synthetic
ggcaggttctttcggcg

SEQ ID NO: 11983 - DNA, 20 bp, Artificial Sequence
  Synthetic
ccgtaaaattcggaagcggc

SEQ ID NO: 11984 - DNA, 20 bp, Artificial Sequence
  Synthetic
agatgttttatcggcctggg

SEQ ID NO: 11985 - DNA, 20 bp, Artificial Sequence
  Synthetic
aacattaccgtcttggcagt

SEQ ID NO: 11986 - DNA, 22 bp, Artificial Sequence
  Synthetic
tgcttctaatttctccaatcgt

SEQ ID NO: 11987 - DNA, 17 bp, Artificial Sequence
  Synthetic
acccgaccacaacaccg

SEQ ID NO: 11988 - DNA, 16 bp, Artificial Sequence
  Synthetic
acggacgcgctttcgg

SEQ ID NO: 11989 - DNA, 19 bp, Artificial Sequence
  Synthetic
gatttcggtattgcgcgcg

SEQ ID NO: 11990 - DNA, 20 bp, Artificial Sequence
  Synthetic
ggcaactacggttacaacgc

SEQ ID NO: 11991 - DNA, 15 bp, Artificial Sequence
  Synthetic
cggcggcgcattcat

SEQ ID NO: 11992 - DNA, 20 bp, Artificial Sequence
  Synthetic
caacacctacggcattgttg

SEQ ID NO: 11993 - DNA, 20 bp, Artificial Sequence
  Synthetic
gacgatgcttttcaagacgc

SEQ ID NO: 11994 - DNA, 16 bp, Artificial Sequence
  Synthetic
cgggcagcgtcatcgt

SEQ ID NO: 11995 - DNA, 17 bp, Artificial Sequence
  Synthetic
ccgtaatgcagcacgcg

SEQ ID NO: 11996 - DNA, 16 bp, Artificial Sequence
  Synthetic
cggtccggttgtgcga

SEQ ID NO: 11997 - DNA, 19 bp, Artificial Sequence
  Synthetic
gccggtgctgtattttgcc

SEQ ID NO: 11998 - DNA, 16 bp, Artificial Sequence
  Synthetic
cgaaatcggggcgcag

SEQ ID NO: 11999 - DNA, 16 bp, Artificial Sequence
  Synthetic
gaatccgtgccgccga

SEQ ID NO: 12000 - DNA, 18 bp, Artificial Sequence
  Synthetic
cggtttgggcgattttgc

SEQ ID NO: 12001 - DNA, 17 bp, Artificial Sequence
  Synthetic
ccggatggcttcgtgga

SEQ ID NO: 12002 - DNA, 18 bp, Artificial Sequence
  Synthetic
gtccttcggtgcgtttgc

SEQ ID NO: 12003 - DNA, 15 bp, Artificial Sequence
  Synthetic
tgtcgcccgcatcga

SEQ ID NO: 12004 - DNA, 20 bp, Artificial Sequence
  Synthetic
tatgctgacctataccccgc

SEQ ID NO: 12005 - DNA, 18 bp, Artificial Sequence
  Synthetic
cacacccttgtggctgtg

SEQ ID NO: 12006 - DNA, 20 bp, Artificial Sequence
  Synthetic
agcgcaatgtgtagttgagt

SEQ ID NO: 12007 - DNA, 20 bp, Artificial Sequence
  Synthetic
cttctttgccgatgacgttc

SEQ ID NO: 12008 - DNA, 19 bp, Artificial Sequence
  Synthetic
ggcttttgtcatacagcgc

SEQ ID NO: 12009 - DNA, 16 bp, Artificial Sequence
  Synthetic
ggaaacaccacgccgc

SEQ ID NO: 12010 - DNA, 15 bp, Artificial Sequence
  Synthetic
cgcgggcaaggcaaa

SEQ ID NO: 12011 - DNA, 17 bp, Artificial Sequence
  Synthetic
cgacaagctgcccgaaa

SEQ ID NO: 12012 - DNA, 17 bp, Artificial Sequence
  Synthetic
tgaccgccaaactgcag

SEQ ID NO: 12013 - DNA, 20 bp, Artificial Sequence
  Synthetic
tgccgaccaattatgccttt

SEQ ID NO: 12014 - DNA, 18 bp, Artificial Sequence
  Synthetic
ttgaatacgccgtcccgc

SEQ ID NO: 12015 - DNA, 18 bp, Artificial Sequence
  Synthetic
cagttcggcggcatcgag

SEQ ID NO: 12016 - DNA, 18 bp, Artificial Sequence
  Synthetic
gcatcggcgatgtcttgc

SEQ ID NO: 12017 - DNA, 17 bp, Artificial Sequence
  Synthetic
cgaggcgttcggattcg

SEQ ID NO: 12018 - DNA, 17 bp, Artificial Sequence
  Synthetic
tgatgcgcccttcgaca

SEQ ID NO: 12019 - DNA, 16 bp, Artificial Sequence
  Synthetic
tcgcgccagttttgca

SEQ ID NO: 12020 - DNA, 17 bp, Artificial Sequence
  Synthetic
cggcgggtttcatcagg

SEQ ID NO: 12021 - DNA, 17 bp, Artificial Sequence
  Synthetic
cccgttgccgtctgaac

SEQ ID NO: 12022 - DNA, 21 bp, Artificial Sequence
  Synthetic
cctgatggagaacctatttcc

SEQ ID NO: 12023 - DNA, 25 bp, Artificial Sequence
  Synthetic
gagttaagtgagttagttatacctg

SEQ ID NO: 12024 - DNA, 20 bp, Artificial Sequence
  Synthetic
cgaaagtatgctaaaagccc

SEQ ID NO: 12025 - DNA, 25 bp, Artificial Sequence
  Synthetic
gtaaaagaatgccaattattgtgtg

SEQ ID NO: 12026 - DNA, 22 bp, Artificial Sequence
  Synthetic
ggatactcaaatttaggtttgc

SEQ ID NO: 12027 - DNA, 21 bp, Artificial Sequence
  Synthetic
caagacgaagatgatatgtgg

SEQ ID NO: 12028 - DNA, 23 bp, Artificial Sequence
  Synthetic
aatcttaacagacttgaaagact

SEQ ID NO: 12029 - DNA, 18 bp, Artificial Sequence
  Synthetic
cactcctattcgcccttc

SEQ ID NO: 12030 - DNA, 25 bp, Artificial Sequence
  Synthetic
ttaagggagtcatttgaaattgaag

SEQ ID NO: 12031 - DNA, 21 bp, Artificial Sequence
  Synthetic
ctttgaacaaccaattcaggg

SEQ ID NO: 12032 - DNA, 25 bp, Artificial Sequence
  Synthetic
aaaccatagatgttcctaaagtttc

SEQ ID NO: 12033 - DNA, 23 bp, Artificial Sequence
  Synthetic
tgcacctcttgaagttattaact

SEQ ID NO: 12034 - DNA, 25 bp, Artificial Sequence
  Synthetic
gaaagtatttgagacatgtagaaga

SEQ ID NO: 12035 - DNA, 22 bp, Artificial Sequence
  Synthetic
ttatcatgcttactaactgtgg

SEQ ID NO: 12036 - DNA, 23 bp, Artificial Sequence
  Synthetic
gattcgaaatggaagattttgtg

SEQ ID NO: 12037 - DNA, 19 bp, Artificial Sequence
  Synthetic
tagagggaagagatcgcac

SEQ ID NO: 12038 - DNA, 23 bp, Artificial Sequence
  Synthetic
caaatgtccaaagaagtaaatgc

SEQ ID NO: 12039 - DNA, 22 bp, Artificial Sequence
  Synthetic
aaatccaaattatctgctgtca

SEQ ID NO: 12040 - DNA, 18 bp, Artificial Sequence
  Synthetic
cgagctgaccgattcaat

SEQ ID NO: 12041 - DNA, 18 bp, Artificial Sequence
  Synthetic
ggaaggcgaaagaccaat

SEQ ID NO: 12042 - DNA, 18 bp, Artificial Sequence
  Synthetic
aatggagatgaggccttg

SEQ ID NO: 12043 - DNA, 20 bp, Artificial Sequence
  Synthetic
gggttgagagtaccccagag

SEQ ID NO: 12044 - DNA, 20 bp, Artificial Sequence
  Synthetic
gtccccacatagcagactcc

SEQ ID NO: 12045 - DNA, 19 bp, Artificial Sequence
  Synthetic
ctcggtaatggcgaatggg

SEQ ID NO: 12046 - DNA, 20 bp, Artificial Sequence
  Synthetic
atcctatgggaatccctggc

SEQ ID NO: 12047 - DNA, 20 bp, Artificial Sequence
  Synthetic
gccgatagctgctttctctt

SEQ ID NO: 12048 - DNA, 24 bp, Artificial Sequence
  Synthetic
atatgttactaaaagggtgtaacc

SEQ ID NO: 12049 - DNA, 23 bp, Artificial Sequence
  Synthetic
atagacgctatacatgttctgtg

SEQ ID NO: 12050 - DNA, 24 bp, Artificial Sequence
  Synthetic
cagaaacacaagtgtaaagaacaa

SEQ ID NO: 12051 - DNA, 21 bp, Artificial Sequence
  Synthetic
gagcagatgttaatggaagac

SEQ ID NO: 12052 - DNA, 20 bp, Artificial Sequence
  Synthetic
tgattatgcagaacaggagg

SEQ ID NO: 12053 - DNA, 23 bp, Artificial Sequence
  Synthetic
tccaaatacatttccatttgaca

SEQ ID NO: 12054 - DNA, 18 bp, Artificial Sequence
  Synthetic
ctcgtgaaggaaacatgc

SEQ ID NO: 12055 - DNA, 25 bp, Artificial Sequence
  Synthetic
attataaaactgatatagggtggtg

SEQ ID NO: 12056 - DNA, 18 bp, Artificial Sequence
  Synthetic
ccagaccaccgaagccta

SEQ ID NO: 12057 - DNA, 21 bp, Artificial Sequence
  Synthetic
gtccgcccattattattgaac

SEQ ID NO: 12058 - DNA, 25 bp, Artificial Sequence
  Synthetic
tagatgaaacacttacatatgcttc

SEQ ID NO: 12059 - DNA, 21 bp, Artificial Sequence
  Synthetic
attcatctgcacctttgtttg

SEQ ID NO: 12060 - DNA, 21 bp, Artificial Sequence
  Synthetic
accactaacttacctgcaata

SEQ ID NO: 12061 - DNA, 19 bp, Artificial Sequence
  Synthetic
cctaaaactggccaaaagg

SEQ ID NO: 12062 - DNA, 20 bp, Artificial Sequence
  Synthetic
gacaacagggacaatgtttc

SEQ ID NO: 12063 - DNA, 22 bp, Artificial Sequence
  Synthetic
atgtctgcagatacatatggaa

SEQ ID NO: 12064 - DNA, 21 bp, Artificial Sequence
  Synthetic
cttctacctcttcctctacca

SEQ ID NO: 12065 - DNA, 20 bp, Artificial Sequence
  Synthetic
tccagtttgttacactccgc

SEQ ID NO: 12066 - DNA, 19 bp, Artificial Sequence
  Synthetic
gagtatcacgcctccggaa

SEQ ID NO: 12067 - DNA, 19 bp, Artificial Sequence
  Synthetic
cctttggggtggattggtg

SEQ ID NO: 12068 - DNA, 20 bp, Artificial Sequence
  Synthetic
caatcctgaccaattgctgc

SEQ ID NO: 12069 - DNA, 24 bp, Artificial Sequence
  Synthetic
actcttatttgagtgagaatgtgt

SEQ ID NO: 12070 - DNA, 24 bp, Artificial Sequence
  Synthetic
ggtctaaagaaatgtttaaacctc

SEQ ID NO: 12071 - DNA, 20 bp, Artificial Sequence
  Synthetic
tggcagggttagttttgtgg

SEQ ID NO: 12072 - DNA, 19 bp, Artificial Sequence
  Synthetic
ccttgtgctggtttgtttc

SEQ ID NO: 12073 - DNA, 16 bp, Artificial Sequence
  Synthetic
gcttggcgtgtgggga

SEQ ID NO: 12074 - DNA, 18 bp, Artificial Sequence
  Synthetic
ggttggctcatcccacag

SEQ ID NO: 12075 - DNA, 19 bp, Artificial Sequence
  Synthetic
ataccatccccagtacaca

SEQ ID NO: 12076 - DNA, 18 bp, Artificial Sequence
  Synthetic
gtgttgggcattggaaag

SEQ ID NO: 12077 - DNA, 19 bp, Artificial Sequence
  Synthetic
ggtatggttcctgaatgca

SEQ ID NO: 12078 - DNA, 19 bp, Artificial Sequence
  Synthetic
ctgcaattgacaagctgaa

SEQ ID NO: 12079 - DNA, 20 bp, Artificial Sequence
  Synthetic
ttggtacatggacatcggtg

SEQ ID NO: 12080 - DNA, 20 bp, Artificial Sequence
  Synthetic
aactttacaaaggacccaga

SEQ ID NO: 12081 - DNA, 19 bp, Artificial Sequence
  Synthetic
gagatccgtcccaggagtg

SEQ ID NO: 12082 - DNA, 21 bp, Artificial Sequence
  Synthetic
aacggcctacaaaaaagaagt

SEQ ID NO: 12083 - DNA, 20 bp, Artificial Sequence
  Synthetic
atgaagtagcagctcacacg

SEQ ID NO: 12084 - DNA, 18 bp, Artificial Sequence
  Synthetic
gtacccgtgtcaagcgtc

SEQ ID NO: 12085 - DNA, 20 bp, Artificial Sequence
  Synthetic
tgctggctgaaggtaaatgc

SEQ ID NO: 12086 - DNA, 18 bp, Artificial Sequence
  Synthetic
cgtgtgttggctgtccat

SEQ ID NO: 12087 - DNA, 18 bp, Artificial Sequence
  Synthetic
gcaaaattggctcgcttc

SEQ ID NO: 12088 - DNA, 17 bp, Artificial Sequence
  Synthetic
tttagggcagcggcaac

SEQ ID NO: 12089 - DNA, 23 bp, Artificial Sequence
  Synthetic
atcaaaagataataacgattggc

SEQ ID NO: 12090 - DNA, 18 bp, Artificial Sequence
  Synthetic
tgccccaaactagcagaa

SEQ ID NO: 12091 - DNA, 23 bp, Artificial Sequence
  Synthetic
gaattaggtgttccatttcatct

SEQ ID NO: 12092 - DNA, 25 bp, Artificial Sequence
  Synthetic
actaaaatactattcattgaggagg

SEQ ID NO: 12093 - DNA, 18 bp, Artificial Sequence
  Synthetic
aaaaacgacagctccagc

SEQ ID NO: 12094 - DNA, 20 bp, Artificial Sequence
  Synthetic
gaaactgttgcagaaaaagc

SEQ ID NO: 12095 - DNA, 19 bp, Artificial Sequence
  Synthetic
ctgaagaggaggagcaaca

SEQ ID NO: 12096 - DNA, 23 bp, Artificial Sequence
  Synthetic
gtgaagctgaatgtattactgat

SEQ ID NO: 12097 - DNA, 22 bp, Artificial Sequence
  Synthetic
aatttctgtggaaggaaaaagt

SEQ ID NO: 12098 - DNA, 25 bp, Artificial Sequence
  Synthetic
ctgtttcagcttgttaaatttcttg

SEQ ID NO: 12099 - DNA, 20 bp, Artificial Sequence
  Synthetic
ttgtctcctcttccagctcc

SEQ ID NO: 12100 - DNA, 18 bp, Artificial Sequence
  Synthetic
acaccagtgaatcagctg

SEQ ID NO: 12101 - DNA, 23 bp, Artificial Sequence
  Synthetic
tttggaagtgtaatttatttggg

SEQ ID NO: 12102 - DNA, 21 bp, Artificial Sequence
  Synthetic
atttgagtatgataatcccgc

SEQ ID NO: 12103 - DNA, 21 bp, Artificial Sequence
  Synthetic
cttacaattaggtcgtggtgg

SEQ ID NO: 12104 - DNA, 23 bp, Artificial Sequence
  Synthetic
cacctattgaattagtcagttca

SEQ ID NO: 12105 - DNA, 24 bp, Artificial Sequence
  Synthetic
aaatcaatatagacatcacacctg

SEQ ID NO: 12106 - DNA, 23 bp, Artificial Sequence
  Synthetic
actattgaaggactagtctatgg

SEQ ID NO: 12107 - DNA, 19 bp, Artificial Sequence
  Synthetic
ggagtatgagatggctgac

SEQ ID NO: 12108 - DNA, 21 bp, Artificial Sequence
  Synthetic
tattggtcggtactaaaacca

SEQ ID NO: 12109 - DNA, 18 bp, Artificial Sequence
  Synthetic
gtgcctgctagatcaagt

SEQ ID NO: 12110 - DNA, 22 bp, Artificial Sequence
  Synthetic
aattcagtgaggttgaaactag

SEQ ID NO: 12111 - DNA, 20 bp, Artificial Sequence
  Synthetic
agaaagcgtctagccatggc

SEQ ID NO: 12112 - DNA, 20 bp, Artificial Sequence
  Synthetic
caaaagaaacaccaaccgcc

SEQ ID NO: 12113 - DNA, 17 bp, Artificial Sequence
  Synthetic
acacgcacctggttgtg

SEQ ID NO: 12114 - DNA, 19 bp, Artificial Sequence
  Synthetic
gcatactttgcgtcaacgg

SEQ ID NO: 12115 - DNA, 19 bp, Artificial Sequence
  Synthetic
gggtttatagccggcctca

SEQ ID NO: 12116 - DNA, 18 bp, Artificial Sequence
  Synthetic
ggcagcaacgagactgac

SEQ ID NO: 12117 - DNA, 18 bp, Artificial Sequence
  Synthetic
catcggaggcctagagca

SEQ ID NO: 12118 - DNA, 20 bp, Artificial Sequence
  Synthetic
tgctcctaatctgtcaggca

SEQ ID NO: 12119 - DNA, 18 bp, Artificial Sequence
  Synthetic
gtgctggtcatgtggtgg

SEQ ID NO: 12120 - DNA, 20 bp, Artificial Sequence
  Synthetic
ttatgaccatcttgccccca

SEQ ID NO: 12121 - DNA, 19 bp, Artificial Sequence
  Synthetic
gccgggacaaaaatgaagc

SEQ ID NO: 12122 - DNA, 17 bp, Artificial Sequence
  Synthetic
tccttgctcagcccgag

SEQ ID NO: 12123 - DNA, 16 bp, Artificial Sequence
  Synthetic
ccgtccgtcgcagcaa

SEQ ID NO: 12124 - DNA, 20 bp, Artificial Sequence
  Synthetic
gaaatccccttctacggcag

SEQ ID NO: 12125 - DNA, 20 bp, Artificial Sequence
  Synthetic
tggacttcagtctggatccc

SEQ ID NO: 12126 - DNA, 20 bp, Artificial Sequence
  Synthetic
agcaacagtctgtgttcgtg

SEQ ID NO: 12127 - DNA, 20 bp, Artificial Sequence
  Synthetic
aataccttgctggcctttcg

SEQ ID NO: 12128 - DNA, 20 bp, Artificial Sequence
  Synthetic
gaactggtaaacctcctgcc

SEQ ID NO: 12129 - DNA, 18 bp, Artificial Sequence
  Synthetic
tttgggactgggtctgca

SEQ ID NO: 12130 - DNA, 20 bp, Artificial Sequence
  Synthetic
taccactacataacgggggt

SEQ ID NO: 12131 - DNA, 18 bp, Artificial Sequence
  Synthetic
gcgcaggctaaatcgagg

SEQ ID NO: 12132 - DNA, 16 bp, Artificial Sequence
  Synthetic
acccgcccctcttgga

SEQ ID NO: 12133 - DNA, 18 bp, Artificial Sequence
  Synthetic
gggaccctgacctttcgt

SEQ ID NO: 12134 - DNA, 20 bp, Artificial Sequence
  Synthetic
ggttaaggccagactactgc

SEQ ID NO: 12135 - DNA, 20 bp, Artificial Sequence
  Synthetic
ccactagtatgggcaacacc

SEQ ID NO: 12136 - DNA, 20 bp, Artificial Sequence
  Synthetic
ggaaactgccaaacactccc

SEQ ID NO: 12137 - DNA, 19 bp, Artificial Sequence
  Synthetic
gggtaccccctttgagagc

SEQ ID NO: 12138 - DNA, 21 bp, Artificial Sequence
  Synthetic
ttttacctacccaggaaaagc

SEQ ID NO: 12139 - DNA, 20 bp, Artificial Sequence
  Synthetic
ctcagtttgcctgtccttca

SEQ ID NO: 12140 - DNA, 18 bp, Artificial Sequence
  Synthetic
accagacacccttcgaaa

SEQ ID NO: 12141 - DNA, 21 bp, Artificial Sequence
  Synthetic
tgcagattatcacaaccactc

SEQ ID NO: 12142 - DNA, 23 bp, Artificial Sequence
  Synthetic
ttgattacaagtctttcaaaacc

SEQ ID NO: 12143 - DNA, 21 bp, Artificial Sequence
  Synthetic
ttctgaacagtcattacgtct

SEQ ID NO: 12144 - DNA, 23 bp, Artificial Sequence
  Synthetic
ttgtgtaaaatgcttcattgatg

SEQ ID NO: 12145 - DNA, 20 bp, Artificial Sequence
  Synthetic
cacaaatggagctatcgttg

SEQ ID NO: 12146 - DNA, 22 bp, Artificial Sequence
  Synthetic
acttatttgatgatgctggtga

SEQ ID NO: 12147 - DNA, 23 bp, Artificial Sequence
  Synthetic
ttaaaacttactgacaatgttgc

SEQ ID NO: 12148 - DNA, 23 bp, Artificial Sequence
  Synthetic
aggcagcatatgaaaatttcaat

SEQ ID NO: 12149 - DNA, 22 bp, Artificial Sequence
  Synthetic
gtaagctttaccatgattctca

SEQ ID NO: 12150 - DNA, 24 bp, Artificial Sequence
  Synthetic
taatgctaaggaagagattctagg

SEQ ID NO: 12151 - DNA, 20 bp, Artificial Sequence
  Synthetic
gctgtatgcgttctcttaaa

SEQ ID NO: 12152 - DNA, 23 bp, Artificial Sequence
  Synthetic
atggtgctgatgttacaaaaatt

SEQ ID NO: 12153 - DNA, 23 bp, Artificial Sequence
  Synthetic
aaactatgacccatcttctacag

SEQ ID NO: 12154 - DNA, 23 bp, Artificial Sequence
  Synthetic
ggtcattacactcatataactgc

SEQ ID NO: 12155 - DNA, 22 bp, Artificial Sequence
  Synthetic
ttaaatcaaatgacaggcttca

SEQ ID NO: 12156 - DNA, 22 bp, Artificial Sequence
  Synthetic
tgaagaagtagtggaaaatcct

SEQ ID NO: 12157 - DNA, 25 bp, Artificial Sequence
  Synthetic
gcttttggtgtactcttatctaatt

SEQ ID NO: 12158 - DNA, 21 bp, Artificial Sequence
  Synthetic
gctagtcatttcatcagcaat

SEQ ID NO: 12159 - DNA, 19 bp, Artificial Sequence
  Synthetic
tgtgacacattttgcactg

SEQ ID NO: 12160 - DNA, 22 bp, Artificial Sequence
  Synthetic
agacgttggagatagtactgaa

SEQ ID NO: 12161 - DNA, 19 bp, Artificial Sequence
  Synthetic
tcttggcgcatgtattgac

SEQ ID NO: 12162 - DNA, 24 bp, Artificial Sequence
  Synthetic
tatgccagtacatacattgtcaat

SEQ ID NO: 12163 - DNA, 19 bp, Artificial Sequence
  Synthetic
ttcttgctgctgagtgtac

SEQ ID NO: 12164 - DNA, 24 bp, Artificial Sequence
  Synthetic
cgatgaatctcatagctaacatct

SEQ ID NO: 12165 - DNA, 25 bp, Artificial Sequence
  Synthetic
taggaaaagagtcatgtttaatgga

SEQ ID NO: 12166 - DNA, 20 bp, Artificial Sequence
  Synthetic
atgactttagcaactcaggt

SEQ ID NO: 12167 - DNA, 21 bp, Artificial Sequence
  Synthetic
gtgttattggccattctatgc

SEQ ID NO: 12168 - DNA, 23 bp, Artificial Sequence
  Synthetic
tatcaatggtgataggtggtttc

SEQ ID NO: 12169 - DNA, 25 bp, Artificial Sequence
  Synthetic
gtaagttcaagaaaattgttaaggg

SEQ ID NO: 12170 - DNA, 23 bp, Artificial Sequence
  Synthetic
tgtcattacacttgtttacaaag

SEQ ID NO: 12171 - DNA, 23 bp, Artificial Sequence
  Synthetic
tggtctctacacaagaatttagg

SEQ ID NO: 12172 - DNA, 21 bp, Artificial Sequence
  Synthetic
ttgcaaaagacacaactgaag

SEQ ID NO: 12173 - DNA, 19 bp, Artificial Sequence
  Synthetic
agttggaaaagatggcaga

SEQ ID NO: 12174 - DNA, 25 bp, Artificial Sequence
  Synthetic
gttcaacttagtgaaattaacatgg

SEQ ID NO: 12175 - DNA, 23 bp, Artificial Sequence
  Synthetic
ggcttaaacaacctaaatagagg

SEQ ID NO: 12176 - DNA, 20 bp, Artificial Sequence
  Synthetic
cacattgaccatccaaatcc

SEQ ID NO: 12177 - DNA, 23 bp, Artificial Sequence
  Synthetic
gcatactatgtctaactaccaac

SEQ ID NO: 12178 - DNA, 22 bp, Artificial Sequence
  Synthetic
catcttacgcgtatatgctaac

SEQ ID NO: 12179 - DNA, 23 bp, Artificial Sequence
  Synthetic
gctgaaatatgattttacggaag

SEQ ID NO: 12180 - DNA, 18 bp, Artificial Sequence
  Synthetic
catgcagcttctggcaat

SEQ ID NO: 12181 - DNA, 21 bp, Artificial Sequence
  Synthetic
gcgtatactaagcgtaatgtc

SEQ ID NO: 12182 - DNA, 21 bp, Artificial Sequence
  Synthetic
cttaggataatggcctctctt

SEQ ID NO: 12183 - DNA, 25 bp, Artificial Sequence
  Synthetic
tgtctctatagaaatagggatgttg

SEQ ID NO: 12184 - DNA, 25 bp, Artificial Sequence
  Synthetic
atgatattgtcaaaacagatggtac

SEQ ID NO: 12185 - DNA, 18 bp, Artificial Sequence
  Synthetic
gttgcggtgcctgtatta

SEQ ID NO: 12186 - DNA, 20 bp, Artificial Sequence
  Synthetic
tgctggcgattacatacttg

SEQ ID NO: 12187 - DNA, 20 bp, Artificial Sequence
  Synthetic
acatctcacactgtaatgcc

SEQ ID NO: 12188 - DNA, 24 bp, Artificial Sequence
  Synthetic
caaagtgaattcaacactagaaca

SEQ ID NO: 12189 - DNA, 23 bp, Artificial Sequence
  Synthetic
tgtgagtgctttagtttatgaca

SEQ ID NO: 12190 - DNA, 18 bp, Artificial Sequence
  Synthetic
ccgcttcaatgtggctat

SEQ ID NO: 12191 - DNA, 22 bp, Artificial Sequence
  Synthetic
gggtttcaaaatgaattaccaa

SEQ ID NO: 12192 - DNA, 25 bp, Artificial Sequence
  Synthetic
atgtagtgcgtattaagatagtaca

SEQ ID NO: 12193 - DNA, 18 bp, Artificial Sequence
  Synthetic
cgcgttgattggtctgtt

SEQ ID NO: 12194 - DNA, 18 bp, Artificial Sequence
  Synthetic
gttgatcgttacccagcc

SEQ ID NO: 12195 - DNA, 19 bp, Artificial Sequence
  Synthetic
taccgacagtacttggatg

SEQ ID NO: 12196 - DNA, 23 bp, Artificial Sequence
  Synthetic
agcacatgtatctacaataggtg

SEQ ID NO: 12197 - DNA, 22 bp, Artificial Sequence
  Synthetic
agagcagagacttagaggattt

SEQ ID NO: 12198 - DNA, 24 bp, Artificial Sequence
  Synthetic
atcttttacttgatgactttgtcg

SEQ ID NO: 12199 - DNA, 18 bp, Artificial Sequence
  Synthetic
taaaggagttgcaccagg

SEQ ID NO: 12200 - DNA, 19 bp, Artificial Sequence
  Synthetic
gcttatgggccatttctca

SEQ ID NO: 12201 - DNA, 25 bp, Artificial Sequence
  Synthetic
tctactaatgttgttatacgagcat

SEQ ID NO: 12202 - DNA, 21 bp, Artificial Sequence
  Synthetic
tttagagccattcttacagcc

SEQ ID NO: 12203 - DNA, 24 bp, Artificial Sequence
  Synthetic
ctaattgtgttgctgattactctg

SEQ ID NO: 12204 - DNA, 23 bp, Artificial Sequence
  Synthetic
tataggtatcttagacatggcaa

SEQ ID NO: 12205 - DNA, 21 bp, Artificial Sequence
  Synthetic
ctgatttcactgattccgttc

SEQ ID NO: 12206 - DNA, 22 bp, Artificial Sequence
  Synthetic
tttgtgctagttaccatacagt

SEQ ID NO: 12207 - DNA, 21 bp, Artificial Sequence
  Synthetic
gaccctctaaagccaactaag

SEQ ID NO: 12208 - DNA, 21 bp, Artificial Sequence
  Synthetic
ttggagttacccaaaatgttc

SEQ ID NO: 12209 - DNA, 19 bp, Artificial Sequence
  Synthetic
ttctgctaatcttgctgct

SEQ ID NO: 12210 - DNA, 23 bp, Artificial Sequence
  Synthetic
atacatttgtctcaggaaattgt

SEQ ID NO: 12211 - DNA, 20 bp, Artificial Sequence
  Synthetic
gcttcattgctggactaatt

SEQ ID NO: 12212 - DNA, 18 bp, Artificial Sequence
  Synthetic
ggatggcttgttattggc

SEQ ID NO: 12213 - DNA, 22 bp, Artificial Sequence
  Synthetic
caaaactcaaagaagactacca

SEQ ID NO: 12214 - DNA, 24 bp, Artificial Sequence
  Synthetic
aaagtgagtacgaacttatgtact

SEQ ID NO: 12215 - DNA, 21 bp, Artificial Sequence
  Synthetic
attaccgttgaggagcttaaa

SEQ ID NO: 12216 - DNA, 20 bp, Artificial Sequence
  Synthetic
ggggacaattgtgaccagac

SEQ ID NO: 12217 - DNA, 25 bp, Artificial Sequence
  Synthetic
ggagttagattatccataaaacgaa

SEQ ID NO: 12218 - DNA, 24 bp, Artificial Sequence
  Synthetic
catgaaacttctcattgttttgac

SEQ ID NO: 12219 - DNA, 20 bp, Artificial Sequence
  Synthetic
tggaccccaatcaaaccaac

SEQ ID NO: 12220 - DNA, 19 bp, Artificial Sequence
  Synthetic
taggaactggcccagaagc

SEQ ID NO: 12221 - DNA, 20 bp, Artificial Sequence
  Synthetic
tgctagacagattgaaccag

SEQ ID NO: 12222 - DNA, 18 bp, Artificial Sequence
  Synthetic
gggaacatggctgactta

SEQ ID NO: 12223 - DNA, 20 bp, Artificial Sequence
  Synthetic
cagatgggctatgtaaacgt

SEQ ID NO: 12224 - DNA, 19 bp, Artificial Sequence
  Synthetic
ttaaaactgggagtgggtt

SEQ ID NO: 12225 - DNA, 18 bp, Artificial Sequence
  Synthetic
aattgggttggtcgctcc

SEQ ID NO: 12226 - DNA, 18 bp, Artificial Sequence
  Synthetic
gtaatgcgtaagtgcggg

SEQ ID NO: 12227 - DNA, 25 bp, Artificial Sequence
  Synthetic
tcaagaccctagtaaatttactgat

SEQ ID NO: 12228 - DNA, 21 bp, Artificial Sequence
  Synthetic
catccaacagattctacacct

SEQ ID NO: 12229 - DNA, 18 bp, Artificial Sequence
  Synthetic
ggtacaatcacacccacc

SEQ ID NO: 12230 - DNA, 24 bp, Artificial Sequence
  Synthetic
acacaatccatacctataacagta

SEQ ID NO: 12231 - DNA, 24 bp, Artificial Sequence
  Synthetic
cactcattcctgttaacaatacac

SEQ ID NO: 12232 - DNA, 25 bp, Artificial Sequence
  Synthetic
tgaaactattaattgcatacactcc

SEQ ID NO: 12233 - DNA, 18 bp, Artificial Sequence
  Synthetic
atggtgtgcatggtttct

SEQ ID NO: 12234 - DNA, 25 bp, Artificial Sequence
  Synthetic
aatgatagtggacatatagtattgc

SEQ ID NO: 12235 - DNA, 25 bp, Artificial Sequence
  Synthetic
accatatgtgttagaatagtgacat

SEQ ID NO: 12236 - DNA, 25 bp, Artificial Sequence
  Synthetic
cttcatctctttaattctgatcttg

SEQ ID NO: 12237 - DNA, 23 bp, Artificial Sequence
  Synthetic
gattgtggaggaaaactattgtg

SEQ ID NO: 12238 - DNA, 24 bp, Artificial Sequence
  Synthetic
taatggtaaggaatagttctgatc

SEQ ID NO: 12239 - DNA, 23 bp, Artificial Sequence
  Synthetic
aaccagttgcagttctaatacat

SEQ ID NO: 12240 - DNA, 23 bp, Artificial Sequence
  Synthetic
gcagatcttccagataaaggaaa

SEQ ID NO: 12241 - DNA, 25 bp, Artificial Sequence
  Synthetic
agtgttctattgaaagagatttagg

SEQ ID NO: 12242 - DNA, 20 bp, Artificial Sequence
  Synthetic
aaattcacaggtcttggcat

SEQ ID NO: 12243 - DNA, 24 bp, Artificial Sequence
  Synthetic
taacatcttattgagtggtaccaa

SEQ ID NO: 12244 - DNA, 25 bp, Artificial Sequence
  Synthetic
gtcatagaagctaatagtgtgaatg

SEQ ID NO: 12245 - DNA, 19 bp, Artificial Sequence
  Synthetic
tcttgccaaagaaggagaa

SEQ ID NO: 12246 - DNA, 22 bp, Artificial Sequence
  Synthetic
ttaagtgacgaatcattgtcag

SEQ ID NO: 12247 - DNA, 23 bp, Artificial Sequence
  Synthetic
gttcatataactcctgaaaaagc

SEQ ID NO: 12248 - DNA, 25 bp, Artificial Sequence
  Synthetic
catgaataagtctagtcatttttgg

SEQ ID NO: 12249 - DNA, 24 bp, Artificial Sequence
  Synthetic
tttagatcttacttctgaagatgc

SEQ ID NO: 12250 - DNA, 25 bp, Artificial Sequence
  Synthetic
taaagaacatactggagatattgtg

SEQ ID NO: 12251 - DNA, 23 bp, Artificial Sequence
  Synthetic
tgaaatgctggagaaatagatgt

SEQ ID NO: 12252 - DNA, 23 bp, Artificial Sequence
  Synthetic
aaatgctggtaaacctattcaag

SEQ ID NO: 12253 - DNA, 25 bp, Artificial Sequence
  Synthetic
atcttcaggagtttgaaatagaaga

SEQ ID NO: 12254 - DNA, 25 bp, Artificial Sequence
  Synthetic
ctcatatagtagtgacaagtaccac

SEQ ID NO: 12255 - DNA, 23 bp, Artificial Sequence
  Synthetic
aggtctctgctaatcaatatagg

SEQ ID NO: 12256 - DNA, 20 bp, Artificial Sequence
  Synthetic
ggatagatccgcagtacctt

SEQ ID NO: 12257 - DNA, 23 bp, Artificial Sequence
  Synthetic
tgaggagtttgaaattgaaatgg

SEQ ID NO: 12258 - DNA, 18 bp, Artificial Sequence
  Synthetic
ctggacttgagcctggaa

SEQ ID NO: 12259 - DNA, 18 bp, Artificial Sequence
  Synthetic
cgcacagagtgtagactt

SEQ ID NO: 12260 - DNA, 20 bp, Artificial Sequence
  Synthetic
aattggagaactgtctgtca

SEQ ID NO: 12261 - DNA, 22 bp, Artificial Sequence
  Synthetic
ctcaaattactgatgaatgcga

SEQ ID NO: 12262 - DNA, 21 bp, Artificial Sequence
  Synthetic
ctcgctgttcaattagatctg

SEQ ID NO: 12263 - DNA, 22 bp, Artificial Sequence
  Synthetic
aatattttctgaggatgcagac

SEQ ID NO: 12264 - DNA, 20 bp, Artificial Sequence
  Synthetic
actaccaactaccaccaccg

SEQ ID NO: 12265 - DNA, 20 bp, Artificial Sequence
  Synthetic
cgtgcacctgaaattactgt

SEQ ID NO: 12266 - DNA, 18 bp, Artificial Sequence
  Synthetic
ctttgagtagcacaccca

SEQ ID NO: 12267 - DNA, 18 bp, Artificial Sequence
  Synthetic
cacccgtgagtatcttgc

SEQ ID NO: 12268 - DNA, 21 bp, Artificial Sequence
  Synthetic
agaagcacgcactttcttaaa

SEQ ID NO: 12269 - DNA, 19 bp, Artificial Sequence
  Synthetic
ggagattcatcacagagcc

SEQ ID NO: 12270 - DNA, 18 bp, Artificial Sequence
  Synthetic
ccatagcagagcagcaag

SEQ ID NO: 12271 - DNA, 21 bp, Artificial Sequence
  Synthetic
agcaaaagcagggtagataat

SEQ ID NO: 12272 - DNA, 20 bp, Artificial Sequence
  Synthetic
aaggacccaaagaaaactgg

SEQ ID NO: 12273 - DNA, 20 bp, Artificial Sequence
  Synthetic
atgatggatcaggtacggga

SEQ ID NO: 12274 - DNA, 23 bp, Artificial Sequence
  Synthetic
atgagaatccagcacataaaagt

SEQ ID NO: 12275 - DNA, 25 bp, Artificial Sequence
  Synthetic
attagctcagagtcaattaaaacag

SEQ ID NO: 12276 - DNA, 25 bp, Artificial Sequence
  Synthetic
actttattcaaggagatgaaaatcg

SEQ ID NO: 12277 - DNA, 23 bp, Artificial Sequence
  Synthetic
tagtctggttgctaatttcaaac

SEQ ID NO: 12278 - DNA, 25 bp, Artificial Sequence
  Synthetic
gaattttcagcagtatttacagatg

SEQ ID NO: 12279 - DNA, 25 bp, Artificial Sequence
  Synthetic
gataatataagtggagaaaagggaa

SEQ ID NO: 12280 - DNA, 21 bp, Artificial Sequence
  Synthetic
ttaacagcaggtattgtaggc

SEQ ID NO: 12281 - DNA, 24 bp, Artificial Sequence
  Synthetic
tcttagctgatttagagtcaatca

SEQ ID NO: 12282 - DNA, 24 bp, Artificial Sequence
  Synthetic
aatgctgaagtagttgttatctca

SEQ ID NO: 12283 - DNA, 18 bp, Artificial Sequence
  Synthetic
acattccagcccttttgg

SEQ ID NO: 12284 - DNA, 19 bp, Artificial Sequence
  Synthetic
tacgtagtaagggttcagc

SEQ ID NO: 12285 - DNA, 24 bp, Artificial Sequence
  Synthetic
agctatagcctttatcatttttcg

SEQ ID NO: 12286 - DNA, 20 bp, Artificial Sequence
  Synthetic
ctgaatattgcggtaccatc

SEQ ID NO: 12287 - DNA, 21 bp, Artificial Sequence
  Synthetic
cttcaggcgtttttttaaggt

SEQ ID NO: 12288 - DNA, 23 bp, Artificial Sequence
  Synthetic
aggtggtaagctgatgattaatc

SEQ ID NO: 12289 - DNA, 20 bp, Artificial Sequence
  Synthetic
aatgccagagatgagttgag

SEQ ID NO: 12290 - DNA, 24 bp, Artificial Sequence
  Synthetic
gaaaaaggagaagtttctatgact

SEQ ID NO: 12291 - DNA, 23 bp, Artificial Sequence
  Synthetic
aacgctgatattgttttagttgg

SEQ ID NO: 12292 - DNA, 19 bp, Artificial Sequence
  Synthetic
ggtgaacctttactcgttg

SEQ ID NO: 12293 - DNA, 23 bp, Artificial Sequence
  Synthetic
tgatgacattgatttgattgaag

SEQ ID NO: 12294 - DNA, 25 bp, Artificial Sequence
  Synthetic
ctatcagtcatattaaagatggtga

SEQ ID NO: 12295 - DNA, 23 bp, Artificial Sequence
  Synthetic
catcttagacatactagcaggat

SEQ ID NO: 12296 - DNA, 23 bp, Artificial Sequence
  Synthetic
ccaccagacctttaaaaagaaac

SEQ ID NO: 12297 - DNA, 22 bp, Artificial Sequence
  Synthetic
tatagctaaatcatcctcgtgg

SEQ ID NO: 12298 - DNA, 25 bp, Artificial Sequence
  Synthetic
tctgtattaggataagtattagctc

SEQ ID NO: 12299 - DNA, 20 bp, Artificial Sequence
  Synthetic
tttagcttgcccttagaaac

SEQ ID NO: 12300 - DNA, 23 bp, Artificial Sequence
  Synthetic
tttaggggtgacttttatgaaga

SEQ ID NO: 12301 - DNA, 22 bp, Artificial Sequence
  Synthetic
atacttatactcttcgcgatgg

SEQ ID NO: 12302 - DNA, 18 bp, Artificial Sequence
  Synthetic
tggtacaaccgatccatc

SEQ ID NO: 12303 - DNA, 22 bp, Artificial Sequence
  Synthetic
tttaacatggaatttgaaccgt

SEQ ID NO: 12304 - DNA, 25 bp, Artificial Sequence
  Synthetic
atggtttctataatcctgaaaaagc

SEQ ID NO: 12305 - DNA, 19 bp, Artificial Sequence
  Synthetic
acaaagcagtgctattcgt

SEQ ID NO: 12306 - DNA, 23 bp, Artificial Sequence
  Synthetic
aaataaaaaggaagcagagatga

SEQ ID NO: 12307 - DNA, 20 bp, Artificial Sequence
  Synthetic
acggtcaggcaacgaatttg

SEQ ID NO: 12308 - DNA, 18 bp, Artificial Sequence
  Synthetic
agcacaaaaagctgtagc

SEQ ID NO: 12309 - DNA, 19 bp, Artificial Sequence
  Synthetic
ggaaacagcgattctatgc

SEQ ID NO: 12310 - DNA, 22 bp, Artificial Sequence
  Synthetic
tgatgatatcactttgcttgac

SEQ ID NO: 12311 - DNA, 20 bp, Artificial Sequence
  Synthetic
ttgagtgtatgtgggacatg

SEQ ID NO: 12312 - DNA, 20 bp, Artificial Sequence
  Synthetic
ctgtagaaatgcgacgctat

SEQ ID NO: 12313 - DNA, 18 bp, Artificial Sequence
  Synthetic
aaagcagcacatacggta

SEQ ID NO: 12314 - DNA, 23 bp, Artificial Sequence
  Synthetic
gtcaacctcattttaaagaacaa

SEQ ID NO: 12315 - DNA, 22 bp, Artificial Sequence
  Synthetic
cattcaatgtaatgggattggt

SEQ ID NO: 12316 - DNA, 18 bp, Artificial Sequence
  Synthetic
ccaagcggctaaaaatgg

SEQ ID NO: 12317 - DNA, 19 bp, Artificial Sequence
  Synthetic
caaaggttttggttgggga

SEQ ID NO: 12318 - DNA, 19 bp, Artificial Sequence
  Synthetic
ttttgacgaggaaaggagg

SEQ ID NO: 12319 - DNA, 20 bp, Artificial Sequence
  Synthetic
gtcaggtttattatgaccgc

SEQ ID NO: 12320 - DNA, 23 bp, Artificial Sequence
  Synthetic
gacatgtttgatagaaaaaaggc

SEQ ID NO: 12321 - DNA, 21 bp, Artificial Sequence
  Synthetic
gaagatcagctctatcacagt

SEQ ID NO: 12322 - DNA, 21 bp, Artificial Sequence
  Synthetic
tattttagcaggagcacagtt

SEQ ID NO: 12323 - DNA, 25 bp, Artificial Sequence
  Synthetic
aagaattatggaaagagttgttagg

SEQ ID NO: 12324 - DNA, 19 bp, Artificial Sequence
  Synthetic
caaagcagccaatctgaca

SEQ ID NO: 12325 - DNA, 23 bp, Artificial Sequence
  Synthetic
aacaagaaaattagtcgttgctg

SEQ ID NO: 12326 - DNA, 25 bp, Artificial Sequence
  Synthetic
aaagtgaccaaaaatattagtgacc

SEQ ID NO: 12327 - DNA, 24 bp, Artificial Sequence
  Synthetic
tgaaacacatgtcaaaaacagtag

SEQ ID NO: 12328 - DNA, 24 bp, Artificial Sequence
  Synthetic
cggatttctgtcaataattcttct

SEQ ID NO: 12329 - DNA, 23 bp, Artificial Sequence
  Synthetic
agtaaacaaaatccaatggaatc

SEQ ID NO: 12330 - DNA, 25 bp, Artificial Sequence
  Synthetic
ggggatgtttttaaatttattgagg

SEQ ID NO: 12331 - DNA, 23 bp, Artificial Sequence
  Synthetic
tcaagctctttctaaaaaatacg

SEQ ID NO: 12332 - DNA, 18 bp, Artificial Sequence
  Synthetic
ggaagggtttatggacgt

SEQ ID NO: 12333 - DNA, 23 bp, Artificial Sequence
  Synthetic
gcaatcacaaattgtttatgtgg

SEQ ID NO: 12334 - DNA, 21 bp, Artificial Sequence
  Synthetic
tagctcttggtgagattgatg

SEQ ID NO: 12335 - DNA, 23 bp, Artificial Sequence
  Synthetic
caatttcaagcaaccttaacaga

SEQ ID NO: 12336 - DNA, 23 bp, Artificial Sequence
  Synthetic
cttgagacgtttaatcattgacc

SEQ ID NO: 12337 - DNA, 19 bp, Artificial Sequence
  Synthetic
tatcacaccaccaccaagt

SEQ ID NO: 12338 - DNA, 21 bp, Artificial Sequence
  Synthetic
gcaaggagaatgtgaagacat

SEQ ID NO: 12339 - DNA, 18 bp, Artificial Sequence
  Synthetic
tggatgtttgattgcggt

SEQ ID NO: 12340 - DNA, 22 bp, Artificial Sequence
  Synthetic
gataagtttgaggtctatgcag

SEQ ID NO: 12341 - DNA, 18 bp, Artificial Sequence
  Synthetic
ccacctatggtaagggtg

SEQ ID NO: 12342 - DNA, 22 bp, Artificial Sequence
  Synthetic
cagcttgattttattaggacgt

SEQ ID NO: 12343 - DNA, 25 bp, Artificial Sequence
  Synthetic
tcaccttattaatattgtgtccatg

SEQ ID NO: 12344 - DNA, 24 bp, Artificial Sequence
  Synthetic
cttctttaagctagcaaagacaaa

SEQ ID NO: 12345 - DNA, 19 bp, Artificial Sequence
  Synthetic
aggaaaaagcagaagcagc

SEQ ID NO: 12346 - DNA, 18 bp, Artificial Sequence
  Synthetic
gcgagcagttgaagtagc

SEQ ID NO: 12347 - DNA, 22 bp, Artificial Sequence
  Synthetic
atggggattttaaatgtgactc

SEQ ID NO: 12348 - DNA, 18 bp, Artificial Sequence
  Synthetic
caggtttgtacgacggtc

SEQ ID NO: 12349 - DNA, 18 bp, Artificial Sequence
  Synthetic
cggcaacaccaaagctaa

SEQ ID NO: 12350 - DNA, 21 bp, Artificial Sequence
  Synthetic
gggatggtgtttgatagtgtc

SEQ ID NO: 12351 - DNA, 18 bp, Artificial Sequence
  Synthetic
gccaggctgattttctca

SEQ ID NO: 12352 - DNA, 23 bp, Artificial Sequence
  Synthetic
acttcatgggattgatattcgag

SEQ ID NO: 12353 - DNA, 23 bp, Artificial Sequence
  Synthetic
gccaaattccatagtttaacagg

SEQ ID NO: 12354 - DNA, 23 bp, Artificial Sequence
  Synthetic
aaacaacctttagaatttccatc

SEQ ID NO: 12355 - DNA, 24 bp, Artificial Sequence
  Synthetic
ggtcatttgaggaagattaaagac

SEQ ID NO: 12356 - DNA, 25 bp, Artificial Sequence
  Synthetic
ctaaaatagctacaataattccagc

SEQ ID NO: 12357 - DNA, 20 bp, Artificial Sequence
  Synthetic
tctccaaaagctcttgccat

SEQ ID NO: 12358 - DNA, 18 bp, Artificial Sequence
  Synthetic
ccaaccaaaagctcaacc

SEQ ID NO: 12359 - DNA, 19 bp, Artificial Sequence
  Synthetic
aaagccagacacaaaaacg

SEQ ID NO: 12360 - DNA, 18 bp, Artificial Sequence
  Synthetic
agccacgttcttagcatt

SEQ ID NO: 12361 - DNA, 22 bp, Artificial Sequence
  Synthetic
tactgagattggaaaccttgac

SEQ ID NO: 12362 - DNA, 23 bp, Artificial Sequence
  Synthetic
cgctaaaatcttaaccctttagg

SEQ ID NO: 12363 - DNA, 18 bp, Artificial Sequence
  Synthetic
agaccatctggcaagagg

SEQ ID NO: 12364 - DNA, 22 bp, Artificial Sequence
  Synthetic
catcttcattttcttcaggagc

SEQ ID NO: 12365 - DNA, 19 bp, Artificial Sequence
  Synthetic
tagacaccactgctggaaa

SEQ ID NO: 12366 - DNA, 22 bp, Artificial Sequence
  Synthetic
taacacgtctaacaggaacttg

SEQ ID NO: 12367 - DNA, 22 bp, Artificial Sequence
  Synthetic
attctttttccttttctagggc

SEQ ID NO: 12368 - DNA, 22 bp, Artificial Sequence
  Synthetic
tgtaaagagtttagttgggtct

SEQ ID NO: 12369 - DNA, 25 bp, Artificial Sequence
  Synthetic
accatcacataatacttaatgtcga

SEQ ID NO: 12370 - DNA, 19 bp, Artificial Sequence
  Synthetic
aacatcaaccctaacccca

SEQ ID NO: 12371 - DNA, 22 bp, Artificial Sequence
  Synthetic
ggtacaaagtttcaaaagaagc

SEQ ID NO: 12372 - DNA, 21 bp, Artificial Sequence
  Synthetic
tttagtcatgacacagccttt

SEQ ID NO: 12373 - DNA, 18 bp, Artificial Sequence
  Synthetic
ggttgttccttgtgcttg

SEQ ID NO: 12374 - DNA, 20 bp, Artificial Sequence
  Synthetic
agttatctcttgagcagtga

SEQ ID NO: 12375 - DNA, 22 bp, Artificial Sequence
  Synthetic
tgtctaaagcagtcaataaggt

SEQ ID NO: 12376 - DNA, 21 bp, Artificial Sequence
  Synthetic
tatcatagaagactgtctgca

SEQ ID NO: 12377 - DNA, 22 bp, Artificial Sequence
  Synthetic
taagtttcagagacttgaccaa

SEQ ID NO: 12378 - DNA, 25 bp, Artificial Sequence
  Synthetic
ttctttagtattcatgactccattc

SEQ ID NO: 12379 - DNA, 20 bp, Artificial Sequence
  Synthetic
attgtaaaggcgtgtttcac

SEQ ID NO: 12380 - DNA, 22 bp, Artificial Sequence
  Synthetic
tttgtattttgtcccaacattg

SEQ ID NO: 12381 - DNA, 21 bp, Artificial Sequence
  Synthetic
tgatgctgtaacggtaaatgg

SEQ ID NO: 12382 - DNA, 20 bp, Artificial Sequence
  Synthetic
tttgaaatcatctcgctgtt

SEQ ID NO: 12383 - DNA, 21 bp, Artificial Sequence
  Synthetic
acgttttttgtaaagctctgc

SEQ ID NO: 12384 - DNA, 18 bp, Artificial Sequence
  Synthetic
ctcatcatctcccgcttg

SEQ ID NO: 12385 - DNA, 18 bp, Artificial Sequence
  Synthetic
aaccgtccataaccctga

SEQ ID NO: 12386 - DNA, 24 bp, Artificial Sequence
  Synthetic
aatacaatcaaccaagttagttcg

SEQ ID NO: 12387 - DNA, 19 bp, Artificial Sequence
  Synthetic
tgaccctctgcttgtaagg

SEQ ID NO: 12388 - DNA, 19 bp, Artificial Sequence
  Synthetic
tcatcttgaggggggcttc

SEQ ID NO: 12389 - DNA, 20 bp, Artificial Sequence
  Synthetic
actcttgggggagataagcc

SEQ ID NO: 12390 - DNA, 19 bp, Artificial Sequence
  Synthetic
ttgcgctaaaccctcctct

SEQ ID NO: 12391 - DNA, 20 bp, Artificial Sequence
  Synthetic
ctactaaaattcgctcccca

SEQ ID NO: 12392 - DNA, 21 bp, Artificial Sequence
  Synthetic
accttcttcacacatagaacg

SEQ ID NO: 12393 - DNA, 18 bp, Artificial Sequence
  Synthetic
cggctccgtctcttcaac

SEQ ID NO: 12394 - DNA, 18 bp, Artificial Sequence
  Synthetic
gatggagcctagcgggat

SEQ ID NO: 12395 - DNA, 20 bp, Artificial Sequence
  Synthetic
tcaaagcctttaccttcagt

SEQ ID NO: 12396 - DNA, 18 bp, Artificial Sequence
  Synthetic
ttggaagcgaccaagagt

SEQ ID NO: 12397 - DNA, 20 bp, Artificial Sequence
  Synthetic
cttttacagcttcgacaact

SEQ ID NO: 12398 - DNA, 22 bp, Artificial Sequence
  Synthetic
taattttttggtcaaagtcgtc

SEQ ID NO: 12399 - DNA, 24 bp, Artificial Sequence
  Synthetic
taatagagattactgtttctgggt

SEQ ID NO: 12400 - DNA, 21 bp, Artificial Sequence
  Synthetic
tagtttaatcagcaagcgaaa

SEQ ID NO: 12401 - DNA, 24 bp, Artificial Sequence
  Synthetic
cttttttaacatcatctgtcaacc

SEQ ID NO: 12402 - DNA, 24 bp, Artificial Sequence
  Synthetic
gccattatcagtgaacttcataat

SEQ ID NO: 12403 - DNA, 22 bp, Artificial Sequence
  Synthetic
tctatgacactattatccagca

SEQ ID NO: 12404 - DNA, 24 bp, Artificial Sequence
  Synthetic
ggagtgctctacaaaatacttaaa

SEQ ID NO: 12405 - DNA, 21 bp, Artificial Sequence
  Synthetic
aagtcgttaaagcagacaatg

SEQ ID NO: 12406 - DNA, 23 bp, Artificial Sequence
  Synthetic
atgggtagatcaaaacaacaaac

SEQ ID NO: 12407 - DNA, 19 bp, Artificial Sequence
  Synthetic
accgcttctgcttttcaat

SEQ ID NO: 12408 - DNA, 18 bp, Artificial Sequence
  Synthetic
ccggcactcctatctttg

SEQ ID NO: 12409 - DNA, 22 bp, Artificial Sequence
  Synthetic
tactaaccgttaagagtattgc

SEQ ID NO: 12410 - DNA, 21 bp, Artificial Sequence
  Synthetic
accgtcatgaacaattagacc

SEQ ID NO: 12411 - DNA, 18 bp, Artificial Sequence
  Synthetic
atccagacgctttcccaa

SEQ ID NO: 12412 - DNA, 21 bp, Artificial Sequence
  Synthetic
tgaccttaattcaagcctttg

SEQ ID NO: 12413 - DNA, 18 bp, Artificial Sequence
  Synthetic
aagtgggcatgtcaacct

SEQ ID NO: 12414 - DNA, 22 bp, Artificial Sequence
  Synthetic
caggttcaacttttgatagcat

SEQ ID NO: 12415 - DNA, 21 bp, Artificial Sequence
  Synthetic
ttttgaaaacttgctggaatc

SEQ ID NO: 12416 - DNA, 18 bp, Artificial Sequence
  Synthetic
tttggtctggcaaagcac

SEQ ID NO: 12417 - DNA, 25 bp, Artificial Sequence
  Synthetic
cgtttatctggtatgatagttttac

SEQ ID NO: 12418 - DNA, 18 bp, Artificial Sequence
  Synthetic
cagggggggaaatctttg

SEQ ID NO: 12419 - DNA, 18 bp, Artificial Sequence
  Synthetic
acgatgctaaagccttct

SEQ ID NO: 12420 - DNA, 22 bp, Artificial Sequence
  Synthetic
gtgctaatacactctttgctaa

SEQ ID NO: 12421 - DNA, 24 bp, Artificial Sequence
  Synthetic
ctgcaagctatctaaaatagtcaa

SEQ ID NO: 12422 - DNA, 25 bp, Artificial Sequence
  Synthetic
atccgttagataatgattttcatcg

SEQ ID NO: 12423 - DNA, 18 bp, Artificial Sequence
  Synthetic
aatcaagtgcgcaggatg

SEQ ID NO: 12424 - DNA, 22 bp, Artificial Sequence
  Synthetic
ctttttcaattgaccatcctga

SEQ ID NO: 12425 - DNA, 17 bp, Artificial Sequence
  Synthetic
gcaacccccgatggaga

SEQ ID NO: 12426 - DNA, 20 bp, Artificial Sequence
  Synthetic
ttcttccacctgacggtaga

SEQ ID NO: 12427 - DNA, 20 bp, Artificial Sequence
  Synthetic
ccttgcacgatctacatccg

SEQ ID NO: 12428 - DNA, 18 bp, Artificial Sequence
  Synthetic
ctgctgtgcactcgtcat

SEQ ID NO: 12429 - DNA, 19 bp, Artificial Sequence
  Synthetic
cttgcgaggcatctccttt

SEQ ID NO: 12430 - DNA, 19 bp, Artificial Sequence
  Synthetic
gctattggccaaggtgtgt

SEQ ID NO: 12431 - DNA, 20 bp, Artificial Sequence
  Synthetic
ttagaggactcttgcgagga

SEQ ID NO: 12432 - DNA, 19 bp, Artificial Sequence
  Synthetic
gccttattgggctgatgcg

SEQ ID NO: 12433 - DNA, 18 bp, Artificial Sequence
  Synthetic
caatttggaccccccccg

SEQ ID NO: 12434 - DNA, 20 bp, Artificial Sequence
  Synthetic
gacacccaggcccataattc

SEQ ID NO: 12435 - DNA, 18 bp, Artificial Sequence
  Synthetic
ggtgcactaccggtttgt

SEQ ID NO: 12436 - DNA, 18 bp, Artificial Sequence
  Synthetic
gacccaaggcagatccct

SEQ ID NO: 12437 - DNA, 16 bp, Artificial Sequence
  Synthetic
gagcggacggccaaca

SEQ ID NO: 12438 - DNA, 18 bp, Artificial Sequence
  Synthetic
ttggcggtcttgtcgact

SEQ ID NO: 12439 - DNA, 20 bp, Artificial Sequence
  Synthetic
actctttaggccttgagtgc

SEQ ID NO: 12440 - DNA, 20 bp, Artificial Sequence
  Synthetic
ctaccagcaagagcctcgag

SEQ ID NO: 12441 - DNA, 16 bp, Artificial Sequence
  Synthetic
aggctgcgcaacgtca

SEQ ID NO: 12442 - DNA, 18 bp, Artificial Sequence
  Synthetic
ccatgtaccccggtggag

SEQ ID NO: 12443 - DNA, 19 bp, Artificial Sequence
  Synthetic
gctggttccaaactcggtg

SEQ ID NO: 12444 - DNA, 19 bp, Artificial Sequence
  Synthetic
tggtgcccccattaattcg

SEQ ID NO: 12445 - DNA, 19 bp, Artificial Sequence
  Synthetic
cagcacctccaggataggc

SEQ ID NO: 12446 - DNA, 22 bp, Artificial Sequence
  Synthetic
ttgtatactatcaactgccact

SEQ ID NO: 12447 - DNA, 22 bp, Artificial Sequence
  Synthetic
gactttgtgtctactcttctca

SEQ ID NO: 12448 - DNA, 19 bp, Artificial Sequence
  Synthetic
gttttgccattccttctgt

SEQ ID NO: 12449 - DNA, 18 bp, Artificial Sequence
  Synthetic
aatgctgtgtatagggcg

SEQ ID NO: 12450 - DNA, 23 bp, Artificial Sequence
  Synthetic
gaaattcattagaccctttttgc

SEQ ID NO: 12451 - DNA, 24 bp, Artificial Sequence
  Synthetic
ctacaactgaagttaagttttctg

SEQ ID NO: 12452 - DNA, 22 bp, Artificial Sequence
  Synthetic
aaactgcagtttttgtgtacac

SEQ ID NO: 12453 - DNA, 25 bp, Artificial Sequence
  Synthetic
acagattggttaaaaactcttaagc

SEQ ID NO: 12454 - DNA, 23 bp, Artificial Sequence
  Synthetic
gatgatgttgttaccagtctttg

SEQ ID NO: 12455 - DNA, 22 bp, Artificial Sequence
  Synthetic
ttttgagatgtcttgtgattgt

SEQ ID NO: 12456 - DNA, 23 bp, Artificial Sequence
  Synthetic
actgtttgttttgttgatgttga

SEQ ID NO: 12457 - DNA, 20 bp, Artificial Sequence
  Synthetic
gttaaaactgtaccagctgg

SEQ ID NO: 12458 - DNA, 23 bp, Artificial Sequence
  Synthetic
atgttaaagatgttgttgttgag

SEQ ID NO: 12459 - DNA, 23 bp, Artificial Sequence
  Synthetic
tgaacaatattcaacttgtgaca

SEQ ID NO: 12460 - DNA, 25 bp, Artificial Sequence
  Synthetic
gattttaagtacattgagaatggtc

SEQ ID NO: 12461 - DNA, 22 bp, Artificial Sequence
  Synthetic
actattagaactttggctacac

SEQ ID NO: 12462 - DNA, 24 bp, Artificial Sequence
  Synthetic
gaaacttaagaattatgctgcaag

SEQ ID NO: 12463 - DNA, 21 bp, Artificial Sequence
  Synthetic
ctagacatgtcatagcaccat

SEQ ID NO: 12464 - DNA, 23 bp, Artificial Sequence
  Synthetic
aatgttagaaatgatggtactgt

SEQ ID NO: 12465 - DNA, 25 bp, Artificial Sequence
  Synthetic
ggttatttagtttgtacttattggg

SEQ ID NO: 12466 - DNA, 23 bp, Artificial Sequence
  Synthetic
gtgttgcttcatcatttgttagt

SEQ ID NO: 12467 - DNA, 23 bp, Artificial Sequence
  Synthetic
attctaagattgtttgtgatggt

SEQ ID NO: 12468 - DNA, 23 bp, Artificial Sequence
  Synthetic
ttaaataccttacgtagaggtgc

SEQ ID NO: 12469 - DNA, 21 bp, Artificial Sequence
  Synthetic
gttcctcaccctagtatggat

SEQ ID NO: 12470 - DNA, 25 bp, Artificial Sequence
  Synthetic
ttaaaaatgctgatcttaaggatgg

SEQ ID NO: 12471 - DNA, 25 bp, Artificial Sequence
  Synthetic
tattttgatagtaagggttggtatg

SEQ ID NO: 12472 - DNA, 20 bp, Artificial Sequence
  Synthetic
cttttggtccactatgtcgt

SEQ ID NO: 12473 - DNA, 25 bp, Artificial Sequence
  Synthetic
ctatatcttatgaagaacaggatgc

SEQ ID NO: 12474 - DNA, 24 bp, Artificial Sequence
  Synthetic
ttatcccaaatgtgatagagcttt

SEQ ID NO: 12475 - DNA, 25 bp, Artificial Sequence
  Synthetic
accagaataatgtctttatgagtac

SEQ ID NO: 12476 - DNA, 23 bp, Artificial Sequence
  Synthetic
gggtgttcttgaatctttttctg

SEQ ID NO: 12477 - DNA, 24 bp, Artificial Sequence
  Synthetic
aactactaagttagttcctggtat

SEQ ID NO: 12478 - DNA, 23 bp, Artificial Sequence
  Synthetic
atagtttgttttgtacacgtgac

SEQ ID NO: 12479 - DNA, 23 bp, Artificial Sequence
  Synthetic
ttgttgttttaaacatgcattgg

SEQ ID NO: 12480 - DNA, 25 bp, Artificial Sequence
  Synthetic
agtgttattcatgacattggtaatc

SEQ ID NO: 12481 - DNA, 19 bp, Artificial Sequence
  Synthetic
gtgagttacctgttgcagt

SEQ ID NO: 12482 - DNA, 25 bp, Artificial Sequence
  Synthetic
tgtacttatatggatttgttgttgg

SEQ ID NO: 12483 - DNA, 24 bp, Artificial Sequence
  Synthetic
ctttgtcaatacctaaatagcact

SEQ ID NO: 12484 - DNA, 23 bp, Artificial Sequence
  Synthetic
gaaacttttcttgattttgcttg

SEQ ID NO: 12485 - DNA, 25 bp, Artificial Sequence
  Synthetic
ttgttatttacagaacagttaggtg

SEQ ID NO: 12486 - DNA, 24 bp, Artificial Sequence
  Synthetic
acatattttctgttcaacaggatg

SEQ ID NO: 12487 - DNA, 24 bp, Artificial Sequence
  Synthetic
tattgtagtaattcttcctcaggt

SEQ ID NO: 12488 - DNA, 24 bp, Artificial Sequence
  Synthetic
aaacttactttattgcgattctcc

SEQ ID NO: 12489 - DNA, 25 bp, Artificial Sequence
  Synthetic
tggtggtattacatatgtttctaac

SEQ ID NO: 12490 - DNA, 25 bp, Artificial Sequence
  Synthetic
tggagattataacctttctagtgtt

SEQ ID NO: 12491 - DNA, 24 bp, Artificial Sequence
  Synthetic
gctatacatactgttactattgca

SEQ ID NO: 12492 - DNA, 20 bp, Artificial Sequence
  Synthetic
gctgccaactgattacaaga

SEQ ID NO: 12493 - DNA, 25 bp, Artificial Sequence
  Synthetic
cagtacatatgttgatttgaagttg

SEQ ID NO: 12494 - DNA, 25 bp, Artificial Sequence
  Synthetic
tttagtaggacattatatcaaccag

SEQ ID NO: 12495 - DNA, 20 bp, Artificial Sequence
  Synthetic
gccgtgttaaaactttttgg

SEQ ID NO: 12496 - DNA, 21 bp, Artificial Sequence
  Synthetic
gggtgttttgtcagaaagaga

SEQ ID NO: 12497 - DNA, 23 bp, Artificial Sequence
  Synthetic
ctcataaggaccttaaattcaga

SEQ ID NO: 12498 - DNA, 21 bp, Artificial Sequence
  Synthetic
gtagcacttcaagacaacagt

SEQ ID NO: 12499 - DNA, 19 bp, Artificial Sequence
  Synthetic
cagaatggtgttgatgcca

SEQ ID NO: 12500 - DNA, 19 bp, Artificial Sequence
  Synthetic
atttggtgtttggatgctg

SEQ ID NO: 12501 - DNA, 25 bp, Artificial Sequence
  Synthetic
cagtaaaatggcagataataaaggt

SEQ ID NO: 12502 - DNA, 18 bp, Artificial Sequence
  Synthetic
cgccgcattattaagcag

SEQ ID NO: 12503 - DNA, 23 bp, Artificial Sequence
  Synthetic
taaccacaattcttccagttgat

SEQ ID NO: 12504 - DNA, 20 bp, Artificial Sequence
  Synthetic
cgcttagacttactgcaaga

SEQ ID NO: 12505 - DNA, 20 bp, Artificial Sequence
  Synthetic
gtcacttcaagacactagca

SEQ ID NO: 12506 - DNA, 20 bp, Artificial Sequence
  Synthetic
tgtcttccactagctcccca

SEQ ID NO: 12507 - DNA, 22 bp, Artificial Sequence
  Synthetic
gacagatagaaaaaacaccgag

SEQ ID NO: 12508 - DNA, 20 bp, Artificial Sequence
  Synthetic
gcccccaaagatatataccc

SEQ ID NO: 12509 - DNA, 18 bp, Artificial Sequence
  Synthetic
tgtggaaacagtaggccc

SEQ ID NO: 12510 - DNA, 25 bp, Artificial Sequence
  Synthetic
tgcatctacatctaatataagtgct

SEQ ID NO: 12511 - DNA, 18 bp, Artificial Sequence
  Synthetic
ggttcgttgagcagccac

SEQ ID NO: 12512 - DNA, 25 bp, Artificial Sequence
  Synthetic
cccactttttctatgatttaagttc

SEQ ID NO: 12513 - DNA, 18 bp, Artificial Sequence
  Synthetic
tctatcttcctccccagc

SEQ ID NO: 12514 - DNA, 21 bp, Artificial Sequence
  Synthetic
atagagataggtagaggccag

SEQ ID NO: 12515 - DNA, 21 bp, Artificial Sequence
  Synthetic
ggtgacatgatggatattggt

SEQ ID NO: 12516 - DNA, 18 bp, Artificial Sequence
  Synthetic
gcagatgctgaaccaaga

SEQ ID NO: 12517 - DNA, 21 bp, Artificial Sequence
  Synthetic
cacaagtgtgcattttttgtg

SEQ ID NO: 12518 - DNA, 22 bp, Artificial Sequence
  Synthetic
ttaaaagactacacctacagga

SEQ ID NO: 12519 - DNA, 18 bp, Artificial Sequence
  Synthetic
tgcagcaaccctatttgg

SEQ ID NO: 12520 - DNA, 24 bp, Artificial Sequence
  Synthetic
cttggatgattctgatatagatga

SEQ ID NO: 12521 - DNA, 22 bp, Artificial Sequence
  Synthetic
cacctaaagaaaagggtaaacg

SEQ ID NO: 12522 - DNA, 24 bp, Artificial Sequence
  Synthetic
ctgaacctccaaaattaagaagtg

SEQ ID NO: 12523 - DNA, 23 bp, Artificial Sequence
  Synthetic
gttttgtattttatggacctcct

SEQ ID NO: 12524 - DNA, 19 bp, Artificial Sequence
  Synthetic
agagtcactgcaagagaga

SEQ ID NO: 12525 - DNA, 23 bp, Artificial Sequence
  Synthetic
aattgaaaacacaacaattgctg

SEQ ID NO: 12526 - DNA, 23 bp, Artificial Sequence
  Synthetic
ccttcagtgattcctttagaaga

SEQ ID NO: 12527 - DNA, 23 bp, Artificial Sequence
  Synthetic
atttgtacactcattcataggag

SEQ ID NO: 12528 - DNA, 18 bp, Artificial Sequence
  Synthetic
ggccaacctttaggaagt

SEQ ID NO: 12529 - DNA, 21 bp, Artificial Sequence
  Synthetic
tccacctttagagttaatgca

SEQ ID NO: 12530 - DNA, 18 bp, Artificial Sequence
  Synthetic
gaagcagttccaaacctg

SEQ ID NO: 12531 - DNA, 25 bp, Artificial Sequence
  Synthetic
ttgtattatatttgcccctaaactg

SEQ ID NO: 12532 - DNA, 18 bp, Artificial Sequence
  Synthetic
cgcagaagcagaggattt

SEQ ID NO: 12533 - DNA, 22 bp, Artificial Sequence
  Synthetic
tcttgaagagagaaaagcaatt

SEQ ID NO: 12534 - DNA, 20 bp, Artificial Sequence
  Synthetic
aaagaggggaaattccgttt

SEQ ID NO: 12535 - DNA, 19 bp, Artificial Sequence
  Synthetic
catcggatcctcaactcac

SEQ ID NO: 12536 - DNA, 18 bp, Artificial Sequence
  Synthetic
ggaatttccggagtccct

SEQ ID NO: 12537 - DNA, 18 bp, Artificial Sequence
  Synthetic
ggggtcaactccatgatt

SEQ ID NO: 12538 - DNA, 21 bp, Artificial Sequence
  Synthetic
aaggtattttccagactgttg

SEQ ID NO: 12539 - DNA, 22 bp, Artificial Sequence
  Synthetic
catgctcttttccatgaagttg

SEQ ID NO: 12540 - DNA, 23 bp, Artificial Sequence
  Synthetic
tgcaatattaacaatgtggttag

SEQ ID NO: 12541 - DNA, 25 bp, Artificial Sequence
  Synthetic
atctgtcaaattatgaagatgcaag

SEQ ID NO: 12542 - DNA, 23 bp, Artificial Sequence
  Synthetic
tttgtcagatgttttgtttttgg

SEQ ID NO: 12543 - DNA, 20 bp, Artificial Sequence
  Synthetic
ctccttacagagtgaacagg

SEQ ID NO: 12544 - DNA, 23 bp, Artificial Sequence
  Synthetic
aacaaccatgaaagatttgaaag

SEQ ID NO: 12545 - DNA, 25 bp, Artificial Sequence
  Synthetic
aagagtacacatttcctataacctt

SEQ ID NO: 12546 - DNA, 21 bp, Artificial Sequence
  Synthetic
aaatgccatgttatccactga

SEQ ID NO: 12547 - DNA, 23 bp, Artificial Sequence
  Synthetic
tctcttttttatactgaggagca

SEQ ID NO: 12548 - DNA, 20 bp, Artificial Sequence
  Synthetic
ctgtggcttcagattactgg

SEQ ID NO: 12549 - DNA, 25 bp, Artificial Sequence
  Synthetic
tttcagatgatgataatgatagtgc

SEQ ID NO: 12550 - DNA, 25 bp, Artificial Sequence
  Synthetic
gtgattaaattagatgcagatccag

SEQ ID NO: 12551 - DNA, 18 bp, Artificial Sequence
  Synthetic
gatcaggcatggagagga

SEQ ID NO: 12552 - DNA, 21 bp, Artificial Sequence
  Synthetic
cgctttttagaaagagtccca

SEQ ID NO: 12553 - DNA, 21 bp, Artificial Sequence
  Synthetic
tgatgctatcaacatggattc

SEQ ID NO: 12554 - DNA, 18 bp, Artificial Sequence
  Synthetic
gatgcttgtcctctggat

SEQ ID NO: 12555 - DNA, 23 bp, Artificial Sequence
  Synthetic
ccatgaagactatcattgctttg

SEQ ID NO: 12556 - DNA, 20 bp, Artificial Sequence
  Synthetic
ccttgatggagaaaactgca

SEQ ID NO: 12557 - DNA, 25 bp, Artificial Sequence
  Synthetic
cagtttctttagtagattgaattgg

SEQ ID NO: 12558 - DNA, 25 bp, Artificial Sequence
  Synthetic
gcatctattggacaatagtaaaacc

SEQ ID NO: 12559 - DNA, 21 bp, Artificial Sequence
  Synthetic
tgttaagcaaaacactctgaa

SEQ ID NO: 12560 - DNA, 25 bp, Artificial Sequence
  Synthetic
ccatcagattgaaaaagaattctca

SEQ ID NO: 12561 - DNA, 23 bp, Artificial Sequence
  Synthetic
aatggaacttatgaccatgatgt

SEQ ID NO: 12562 - DNA, 18 bp, Artificial Sequence
  Synthetic
ttgagaggttgttggcaa

SEQ ID NO: 12563 - DNA, 20 bp, Artificial Sequence
  Synthetic
aggaaggttatgcatatgcg

SEQ ID NO: 12564 - DNA, 23 bp, Artificial Sequence
  Synthetic
ttgtagagagatatgattgggaa

SEQ ID NO: 12565 - DNA, 22 bp, Artificial Sequence
  Synthetic
tagaagacttgctgctagaaga

SEQ ID NO: 12566 - DNA, 18 bp, Artificial Sequence
  Synthetic
caggggagtgaggagttt

SEQ ID NO: 12567 - DNA, 23 bp, Artificial Sequence
  Synthetic
ttgttaaaatgcagtaatctcag

SEQ ID NO: 12568 - DNA, 21 bp, Artificial Sequence
  Synthetic
aaaatgttatcgctacagggt

SEQ ID NO: 12569 - DNA, 25 bp, Artificial Sequence
  Synthetic
taacccactttatatattgtatggc

SEQ ID NO: 12570 - DNA, 19 bp, Artificial Sequence
  Synthetic
gtcattccagaagcgattg

SEQ ID NO: 12571 - DNA, 22 bp, Artificial Sequence
  Synthetic
ctacatatgctgaaacaccaga

SEQ ID NO: 12572 - DNA, 25 bp, Artificial Sequence
  Synthetic
ccaacaataataattcatacagagg

SEQ ID NO: 12573 - DNA, 24 bp, Artificial Sequence
  Synthetic
gatgtgaggaaaaataatggagat

SEQ ID NO: 12574 - DNA, 25 bp, Artificial Sequence
  Synthetic
aaaatccaaatggctataatacagg

SEQ ID NO: 12575 - DNA, 25 bp, Artificial Sequence
  Synthetic
agtatccagatttcttaaaaatggc

SEQ ID NO: 12576 - DNA, 25 bp, Artificial Sequence
  Synthetic
aaagataataacaattggctctgtc

SEQ ID NO: 12577 - DNA, 19 bp, Artificial Sequence
  Synthetic
acagaaattggtcaaagcc

SEQ ID NO: 12578 - DNA, 19 bp, Artificial Sequence
  Synthetic
tcatttaggaaccaggcaa

SEQ ID NO: 12579 - DNA, 25 bp, Artificial Sequence
  Synthetic
actagaatactattcattgaagagg

SEQ ID NO: 12580 - DNA, 20 bp, Artificial Sequence
  Synthetic
tgcaggaatcctaacaatga

SEQ ID NO: 12581 - DNA, 18 bp, Artificial Sequence
  Synthetic
gcaagttgctaccgctgg

SEQ ID NO: 12582 - DNA, 17 bp, Artificial Sequence
  Synthetic
cctggccgctttctacg

SEQ ID NO: 12583 - DNA, 16 bp, Artificial Sequence
  Synthetic
cgaggtgcagaccgct

SEQ ID NO: 12584 - DNA, 20 bp, Artificial Sequence
  Synthetic
ggtacctgaaaccgaaagcg

SEQ ID NO: 12585 - DNA, 17 bp, Artificial Sequence
  Synthetic
tgggcaaagacggagcc

SEQ ID NO: 12586 - DNA, 17 bp, Artificial Sequence
  Synthetic
gagggtgagcgcgaaga

SEQ ID NO: 12587 - DNA, 16 bp, Artificial Sequence
  Synthetic
cgatcaccaccgcgac

SEQ ID NO: 12588 - DNA, 20 bp, Artificial Sequence
  Synthetic
ccggtttcggtgagacactt

SEQ ID NO: 12589 - DNA, 21 bp, Artificial Sequence
  Synthetic
ctccgttatgtctttcagatc

SEQ ID NO: 12590 - DNA, 22 bp, Artificial Sequence
  Synthetic
aatcttctcataaccgtagtcc

SEQ ID NO: 12591 - DNA, 19 bp, Artificial Sequence
  Synthetic
ccgtcacatgacaggaaat

SEQ ID NO: 12592 - DNA, 20 bp, Artificial Sequence
  Synthetic
gagaatgacacaccacagaa

SEQ ID NO: 12593 - DNA, 18 bp, Artificial Sequence
  Synthetic
aaacggtcgtcatcacat

SEQ ID NO: 12594 - DNA, 20 bp, Artificial Sequence
  Synthetic
acagaagttttccaccaaag

SEQ ID NO: 12595 - DNA, 19 bp, Artificial Sequence
  Synthetic
gtgtctaaacgagtctgga

SEQ ID NO: 12596 - DNA, 20 bp, Artificial Sequence
  Synthetic
ctttttccgacaaacacaga

SEQ ID NO: 12597 - DNA, 18 bp, Artificial Sequence
  Synthetic
ggagccgagtaagcattt

SEQ ID NO: 12598 - DNA, 18 bp, Artificial Sequence
  Synthetic
gagtccaccattttcgga

SEQ ID NO: 12599 - DNA, 21 bp, Artificial Sequence
  Synthetic
aaaacctctagattcttcccg

SEQ ID NO: 12600 - DNA, 19 bp, Artificial Sequence
  Synthetic
ggtggtttcttttgaagca

SEQ ID NO: 12601 - DNA, 19 bp, Artificial Sequence
  Synthetic
tcgccagattacttcagac

SEQ ID NO: 12602 - DNA, 25 bp, Artificial Sequence
  Synthetic
ggaattagatttttattgatggtgc

SEQ ID NO: 12603 - DNA, 18 bp, Artificial Sequence
  Synthetic
cgaagtgcttctctcgat

SEQ ID NO: 12604 - DNA, 20 bp, Artificial Sequence
  Synthetic
cgaatccggaatttacttgt

SEQ ID NO: 12605 - DNA, 22 bp, Artificial Sequence
  Synthetic
tatgaataacggagagcttgtt

SEQ ID NO: 12606 - DNA, 18 bp, Artificial Sequence
  Synthetic
tttctgtgtgtgctttcg

SEQ ID NO: 12607 - DNA, 19 bp, Artificial Sequence
  Synthetic
cgtggatttgttgaatgga

SEQ ID NO: 12608 - DNA, 20 bp, Artificial Sequence
  Synthetic
acagatccgtctctcagctg

SEQ ID NO: 12609 - DNA, 18 bp, Artificial Sequence
  Synthetic
gcacagagctggtcctga

SEQ ID NO: 12610 - DNA, 16 bp, Artificial Sequence
  Synthetic
gagggctgcaacgcga

SEQ ID NO: 12611 - DNA, 17 bp, Artificial Sequence
  Synthetic
gagacgcagaagccgtc

SEQ ID NO: 12612 - DNA, 18 bp, Artificial Sequence
  Synthetic
cagagacgtgaccggaga

SEQ ID NO: 12613 - DNA, 21 bp, Artificial Sequence
  Synthetic
caagaaacatagcatggatgg

SEQ ID NO: 12614 - DNA, 18 bp, Artificial Sequence
  Synthetic
gggagagtgctaagcaga

SEQ ID NO: 12615 - DNA, 21 bp, Artificial Sequence
  Synthetic
tcagttacacccaaaaagttg

SEQ ID NO: 12616 - DNA, 19 bp, Artificial Sequence
  Synthetic
ggaggttatggagggactg

SEQ ID NO: 12617 - DNA, 20 bp, Artificial Sequence
  Synthetic
acggatgttgtaacagttgt

SEQ ID NO: 12618 - DNA, 21 bp, Artificial Sequence
  Synthetic
gaggcaattgttgatcaagaa

SEQ ID NO: 12619 - DNA, 18 bp, Artificial Sequence
  Synthetic
cgcaaatgcagacacatt

SEQ ID NO: 12620 - DNA, 19 bp, Artificial Sequence
  Synthetic
gtgaatcactctccacagc

SEQ ID NO: 12621 - DNA, 25 bp, Artificial Sequence
  Synthetic
caaatcctacattaatgataaaggg

SEQ ID NO: 12622 - DNA, 23 bp, Artificial Sequence
  Synthetic
gggagacaaaataacattcgaag

SEQ ID NO: 12623 - DNA, 20 bp, Artificial Sequence
  Synthetic
gattgaggaatatcccgtct

SEQ ID NO: 12624 - DNA, 16 bp, Artificial Sequence
  Synthetic
cgacacactgcagcgg

SEQ ID NO: 12625 - DNA, 18 bp, Artificial Sequence
  Synthetic
gagctctctcaccccgtg

SEQ ID NO: 12626 - DNA, 20 bp, Artificial Sequence
  Synthetic
ctttgcgtttctcacggcat

SEQ ID NO: 12627 - DNA, 17 bp, Artificial Sequence
  Synthetic
ggccgccgagattaacg

SEQ ID NO: 12628 - DNA, 20 bp, Artificial Sequence
  Synthetic
aatcatctgactcgtgccag

SEQ ID NO: 12629 - DNA, 16 bp, Artificial Sequence
  Synthetic
tgagggcggccagact

SEQ ID NO: 12630 - DNA, 20 bp, Artificial Sequence
  Synthetic
ctgggaccgtggatagtgtg

SEQ ID NO: 12631 - DNA, 17 bp, Artificial Sequence
  Synthetic
aaagtaacgccgcgtcc

SEQ ID NO: 12632 - DNA, 17 bp, Artificial Sequence
  Synthetic
tccactcatgccgccga

SEQ ID NO: 12633 - DNA, 16 bp, Artificial Sequence
  Synthetic
cagcaccagcgcggaa

SEQ ID NO: 12634 - DNA, 23 bp, Artificial Sequence
  Synthetic
agatggatattcaaagtacaggg

SEQ ID NO: 12635 - DNA, 20 bp, Artificial Sequence
  Synthetic
tacgtcatcacactctttgc

SEQ ID NO: 12636 - DNA, 22 bp, Artificial Sequence
  Synthetic
aactaagaaaccgatttaccac

SEQ ID NO: 12637 - DNA, 19 bp, Artificial Sequence
  Synthetic
cccacataaaatcacgtgc

SEQ ID NO: 12638 - DNA, 22 bp, Artificial Sequence
  Synthetic
caacgattgaagaacatcatca

SEQ ID NO: 12639 - DNA, 22 bp, Artificial Sequence
  Synthetic
aaacaccaacgttttagttagg

SEQ ID NO: 12640 - DNA, 21 bp, Artificial Sequence
  Synthetic
ttctaatgaaatcgtcagtcg

SEQ ID NO: 12641 - DNA, 18 bp, Artificial Sequence
  Synthetic
cgctgaccacataaacgt

SEQ ID NO: 12642 - DNA, 21 bp, Artificial Sequence
  Synthetic
ggatacagagagcaaaaacag

SEQ ID NO: 12643 - DNA, 18 bp, Artificial Sequence
  Synthetic
ggtttgaggtgtctggtt

SEQ ID NO: 12644 - DNA, 21 bp, Artificial Sequence
  Synthetic
taacttggactggaaagatca

SEQ ID NO: 12645 - DNA, 21 bp, Artificial Sequence
  Synthetic
ccaattttagaagggcatgtc

SEQ ID NO: 12646 - DNA, 21 bp, Artificial Sequence
  Synthetic
cgaatccacgtatttatgtcc

SEQ ID NO: 12647 - DNA, 22 bp, Artificial Sequence
  Synthetic
agatcgagtcaatcatagagaa

SEQ ID NO: 12648 - DNA, 21 bp, Artificial Sequence
  Synthetic
cgttaatgctgatgaacttgg

SEQ ID NO: 12649 - DNA, 20 bp, Artificial Sequence
  Synthetic
gataggacggggaaaagaac

SEQ ID NO: 12650 - DNA, 25 bp, Artificial Sequence
  Synthetic
agtgtatcttccgagtctagtatta

SEQ ID NO: 12651 - DNA, 20 bp, Artificial Sequence
  Synthetic
gtcatctatggagacgctag

SEQ ID NO: 12652 - DNA, 21 bp, Artificial Sequence
  Synthetic
ttcagtgtttcgatttcatcc

SEQ ID NO: 12653 - DNA, 18 bp, Artificial Sequence
  Synthetic
tggatcctggggagttct

SEQ ID NO: 12654 - DNA, 18 bp, Artificial Sequence
  Synthetic
tttccatgcgcgtttcgg

SEQ ID NO: 12655 - DNA, 18 bp, Artificial Sequence
  Synthetic
catctgggatcccgctcg

SEQ ID NO: 12656 - DNA, 17 bp, Artificial Sequence
  Synthetic
gcacgagaacacgcgag

SEQ ID NO: 12657 - DNA, 20 bp, Artificial Sequence
  Synthetic
aatgtttccacgtgacgtcc

SEQ ID NO: 12658 - DNA, 18 bp, Artificial Sequence
  Synthetic
gagccgtgtacgtccacc

SEQ ID NO: 12659 - DNA, 19 bp, Artificial Sequence
  Synthetic
gacgctttgtccaaaatgc

SEQ ID NO: 12660 - DNA, 18 bp, Artificial Sequence
  Synthetic
gcagatgcaacggttcaa

SEQ ID NO: 12661 - DNA, 20 bp, Artificial Sequence
  Synthetic
atggactccaacaccatgtc

SEQ ID NO: 12662 - DNA, 18 bp, Artificial Sequence
  Synthetic
tacctacttcgcgctacc

SEQ ID NO: 12663 - DNA, 25 bp, Artificial Sequence
  Synthetic
atacttatgaggatgtcaaaaatgc

SEQ ID NO: 12664 - DNA, 22 bp, Artificial Sequence
  Synthetic
aattgtacagttactaaagggc

SEQ ID NO: 12665 - DNA, 18 bp, Artificial Sequence
  Synthetic
gactttccttttgcagcg

SEQ ID NO: 12666 - DNA, 20 bp, Artificial Sequence
  Synthetic
agcaattagacagctcagac

SEQ ID NO: 12667 - DNA, 18 bp, Artificial Sequence
  Synthetic
ttgctgatgggcacacta

SEQ ID NO: 12668 - DNA, 18 bp, Artificial Sequence
  Synthetic
gaaggtatagaggggggc

SEQ ID NO: 12669 - DNA, 25 bp, Artificial Sequence
  Synthetic
ttcatacattattaaaaggacaggc

SEQ ID NO: 12670 - DNA, 18 bp, Artificial Sequence
  Synthetic
aacaccggaatggatagc

SEQ ID NO: 12671 - DNA, 21 bp, Artificial Sequence
  Synthetic
cttttttaaaaggttggcgtc

SEQ ID NO: 12672 - DNA, 18 bp, Artificial Sequence
  Synthetic
tgtgtcaaaagccaaagc

SEQ ID NO: 12673 - DNA, 18 bp, Artificial Sequence
  Synthetic
ccgaaagcgaaggagaga

SEQ ID NO: 12674 - DNA, 19 bp, Artificial Sequence
  Synthetic
cagagggtgggttttcaat

SEQ ID NO: 12675 - DNA, 21 bp, Artificial Sequence
  Synthetic
gccacaattcctgatacattc

SEQ ID NO: 12676 - DNA, 21 bp, Artificial Sequence
  Synthetic
ttatcatgcaggtagtaccag

SEQ ID NO: 12677 - DNA, 18 bp, Artificial Sequence
  Synthetic
ggtcaggacagcagagaa

SEQ ID NO: 12678 - DNA, 21 bp, Artificial Sequence
  Synthetic
acagggcctaagtttaaatcc

SEQ ID NO: 12679 - DNA, 21 bp, Artificial Sequence
  Synthetic
tgtttcaaattgctaggtcaa

SEQ ID NO: 12680 - DNA, 19 bp, Artificial Sequence
  Synthetic
ggtttaggaccgaaaacgg

SEQ ID NO: 12681 - DNA, 23 bp, Artificial Sequence
  Synthetic
gagtagtgtatagagacgggtat

SEQ ID NO: 12682 - DNA, 18 bp, Artificial Sequence
  Synthetic
tgacatgctggagacaca

SEQ ID NO: 12683 - DNA, 19 bp, Artificial Sequence
  Synthetic
tctacacaggcagaaaggg

SEQ ID NO: 12684 - DNA, 18 bp, Artificial Sequence
  Synthetic
cgggaaagagcaaaatgg

SEQ ID NO: 12685 - DNA, 21 bp, Artificial Sequence
  Synthetic
attagtgacgtgtatgggagt

SEQ ID NO: 12686 - DNA, 18 bp, Artificial Sequence
  Synthetic
gggcacaacaacaacaga

SEQ ID NO: 12687 - DNA, 22 bp, Artificial Sequence
  Synthetic
aaatccatttccaattgatgtg

SEQ ID NO: 12688 - DNA, 18 bp, Artificial Sequence
  Synthetic
tgttgtgtggaaatgggt

SEQ ID NO: 12689 - DNA, 19 bp, Artificial Sequence
  Synthetic
ccataagacccccaccacc

SEQ ID NO: 12690 - DNA, 22 bp, Artificial Sequence
  Synthetic
gtgaagcaaacagactaaagtg

SEQ ID NO: 12691 - DNA, 25 bp, Artificial Sequence
  Synthetic
tacctggtatatacaatactacaca

SEQ ID NO: 12692 - DNA, 19 bp, Artificial Sequence
  Synthetic
ataacacccacctctacct

SEQ ID NO: 12693 - DNA, 22 bp, Artificial Sequence
  Synthetic
gatcctgcatttcttcacaaac

SEQ ID NO: 12694 - DNA, 18 bp, Artificial Sequence
  Synthetic
tacatggccttatgcacc

SEQ ID NO: 12695 - DNA, 18 bp, Artificial Sequence
  Synthetic
tatccctgtctgctgagg

SEQ ID NO: 12696 - DNA, 18 bp, Artificial Sequence
  Synthetic
gcatagtgccgtttcctg

SEQ ID NO: 12697 - DNA, 19 bp, Artificial Sequence
  Synthetic
ttaaaactgggtgtgggtt

SEQ ID NO: 12698 - DNA, 20 bp, Artificial Sequence
  Synthetic
tctttggttggtcgttcagc

SEQ ID NO: 12699 - DNA, 21 bp, Artificial Sequence
  Synthetic
tcaagatccaagcaaattcac

SEQ ID NO: 12700 - DNA, 24 bp, Artificial Sequence
  Synthetic
attagtccattacgtagtgaaact

SEQ ID NO: 12701 - DNA, 24 bp, Artificial Sequence
  Synthetic
tcaataatgtgggtaacaatgttg

SEQ ID NO: 12702 - DNA, 20 bp, Artificial Sequence
  Synthetic
attacttgcatacacaccac

SEQ ID NO: 12703 - DNA, 23 bp, Artificial Sequence
  Synthetic
ataacatcacaaacaagagatga

SEQ ID NO: 12704 - DNA, 25 bp, Artificial Sequence
  Synthetic
gtaatgcaatatatgtatgttcctc

SEQ ID NO: 12705 - DNA, 20 bp, Artificial Sequence
  Synthetic
tgattgtggtggaaaacttc

SEQ ID NO: 12706 - DNA, 25 bp, Artificial Sequence
  Synthetic
tctcggctatggttattataatcag

SEQ ID NO: 12707 - DNA, 19 bp, Artificial Sequence
  Synthetic
cattcaaagatcgcagcac

SEQ ID NO: 12708 - DNA, 20 bp, Artificial Sequence
  Synthetic
cgttttcggtacaattttgg

SEQ ID NO: 12709 - DNA, 25 bp, Artificial Sequence
  Synthetic
gtgttagattatctgctttgtatga

SEQ ID NO: 12710 - DNA, 25 bp, Artificial Sequence
  Synthetic
aaaggtactgatactaatgaaactg

SEQ ID NO: 12711 - DNA, 23 bp, Artificial Sequence
  Synthetic
gttcaaagaaatgtttggtgttc

SEQ ID NO: 12712 - DNA, 23 bp, Artificial Sequence
  Synthetic
aatgaattctatgatgaagcaga

SEQ ID NO: 12713 - DNA, 22 bp, Artificial Sequence
  Synthetic
catggcagtatatggacttaaa

SEQ ID NO: 12714 - DNA, 25 bp, Artificial Sequence
  Synthetic
gaaaagaagggttaagtagtttagg

SEQ ID NO: 12715 - DNA, 20 bp, Artificial Sequence
  Synthetic
gctcttcacggtgtgcttac

SEQ ID NO: 12716 - DNA, 24 bp, Artificial Sequence
  Synthetic
tagtagtgtaactcaaagagaagc

SEQ ID NO: 12717 - DNA, 18 bp, Artificial Sequence
  Synthetic
ccaacaacggaattggga

SEQ ID NO: 12718 - DNA, 19 bp, Artificial Sequence
  Synthetic
tttgaaaatcccgcctttg

SEQ ID NO: 12719 - DNA, 25 bp, Artificial Sequence
  Synthetic
gggtatttattgatgattatggttc

SEQ ID NO: 12720 - DNA, 23 bp, Artificial Sequence
  Synthetic
agaacgtttagtctggaaattac

SEQ ID NO: 12721 - DNA, 24 bp, Artificial Sequence
  Synthetic
ttatgccagacatatgttaaacag

SEQ ID NO: 12722 - DNA, 19 bp, Artificial Sequence
  Synthetic
tactggggtagaagatgcg

SEQ ID NO: 12723 - DNA, 20 bp, Artificial Sequence
  Synthetic
tgaagcttacttggttggcc

SEQ ID NO: 12724 - DNA, 20 bp, Artificial Sequence
  Synthetic
gttgatagtcgtaatgggca

SEQ ID NO: 12725 - DNA, 18 bp, Artificial Sequence
  Synthetic
ttttcccaagacccatcg

SEQ ID NO: 12726 - DNA, 20 bp, Artificial Sequence
  Synthetic
gtagattggaccactacgtc

SEQ ID NO: 12727 - DNA, 20 bp, Artificial Sequence
  Synthetic
gagggaggacatgtaattgg

SEQ ID NO: 12728 - DNA, 22 bp, Artificial Sequence
  Synthetic
ccattacaatctcaatagcacc

SEQ ID NO: 12729 - DNA, 25 bp, Artificial Sequence
  Synthetic
tctcaatttacaatgtacaagtgac

SEQ ID NO: 12730 - DNA, 18 bp, Artificial Sequence
  Synthetic
gttagaatgctgcgtgac

SEQ ID NO: 12731 - DNA, 20 bp, Artificial Sequence
  Synthetic
aattgagaacttcatgggcc

SEQ ID NO: 12732 - DNA, 21 bp, Artificial Sequence
  Synthetic
caacccgagtgttttctatca

SEQ ID NO: 12733 - DNA, 18 bp, Artificial Sequence
  Synthetic
cacccaatacacccacaa

SEQ ID NO: 12734 - DNA, 18 bp, Artificial Sequence
  Synthetic
cccagataccatcccaca

SEQ ID NO: 12735 - DNA, 23 bp, Artificial Sequence
  Synthetic
cacagatctaagaccctattcat

SEQ ID NO: 12736 - DNA, 19 bp, Artificial Sequence
  Synthetic
caacccttgctcttttagg

SEQ ID NO: 12737 - DNA, 24 bp, Artificial Sequence
  Synthetic
tttggttacttcaataatagccag

SEQ ID NO: 12738 - DNA, 23 bp, Artificial Sequence
  Synthetic
acaaatcttttaaatctccaacc

SEQ ID NO: 12739 - DNA, 18 bp, Artificial Sequence
  Synthetic
acatggtggttcagcaac

SEQ ID NO: 12740 - DNA, 23 bp, Artificial Sequence
  Synthetic
gtaccatatacgcattatatcgc

SEQ ID NO: 12741 - DNA, 20 bp, Artificial Sequence
  Synthetic
gctacatgcaggttgtacaa

SEQ ID NO: 12742 - DNA, 18 bp, Artificial Sequence
  Synthetic
tgtcttccacgatgtgtt

SEQ ID NO: 12743 - DNA, 18 bp, Artificial Sequence
  Synthetic
cttaccactagccctggt

SEQ ID NO: 12744 - DNA, 21 bp, Artificial Sequence
  Synthetic
acagtacttttcatgcaaacc

SEQ ID NO: 12745 - DNA, 18 bp, Artificial Sequence
  Synthetic
tccaagatgacctgggat

SEQ ID NO: 12746 - DNA, 25 bp, Artificial Sequence
  Synthetic
aaaagaactaagagatctaatgtcg

SEQ ID NO: 12747 - DNA, 19 bp, Artificial Sequence
  Synthetic
ggagcaagacaaatgatgc

SEQ ID NO: 12748 - DNA, 21 bp, Artificial Sequence
  Synthetic
agcacaagatgttatcatgga

SEQ ID NO: 12749 - DNA, 22 bp, Artificial Sequence
  Synthetic
gaggcttcactttcaaaagaac

SEQ ID NO: 12750 - DNA, 19 bp, Artificial Sequence
  Synthetic
catgataaaggcagtccga

SEQ ID NO: 12751 - DNA, 18 bp, Artificial Sequence
  Synthetic
gagagagtggtggtgagt

SEQ ID NO: 12752 - DNA, 20 bp, Artificial Sequence
  Synthetic
ttaacggttttagggcaggg

SEQ ID NO: 12753 - DNA, 18 bp, Artificial Sequence
  Synthetic
gagggccaacagactttg

SEQ ID NO: 12754 - DNA, 20 bp, Artificial Sequence
  Synthetic
tgcatttatctccgtttgag

SEQ ID NO: 12755 - DNA, 22 bp, Artificial Sequence
  Synthetic
ggttgtggaaaatcattttgtg

SEQ ID NO: 12756 - DNA, 20 bp, Artificial Sequence
  Synthetic
ttacaaatgacacgcccctg

SEQ ID NO: 12757 - DNA, 22 bp, Artificial Sequence
  Synthetic
atggatgtgtggagtattcttg

SEQ ID NO: 12758 - DNA, 20 bp, Artificial Sequence
  Synthetic
gacaaatggagccaggacac

SEQ ID NO: 12759 - DNA, 19 bp, Artificial Sequence
  Synthetic
acccattggttgaacccag

SEQ ID NO: 12760 - DNA, 20 bp, Artificial Sequence
  Synthetic
aagttttacggctgctggat

SEQ ID NO: 12761 - DNA, 18 bp, Artificial Sequence
  Synthetic
caccttccagccgtacca

SEQ ID NO: 12762 - DNA, 20 bp, Artificial Sequence
  Synthetic
agcccttatttgacaacccg

SEQ ID NO: 12763 - DNA, 18 bp, Artificial Sequence
  Synthetic
tattttttcgcgcgcggt

SEQ ID NO: 12764 - DNA, 18 bp, Artificial Sequence
  Synthetic
cggggggagatgatgtgt

SEQ ID NO: 12765 - DNA, 18 bp, Artificial Sequence
  Synthetic
aaaatggtttccggggcg

SEQ ID NO: 12766 - DNA, 18 bp, Artificial Sequence
  Synthetic
agggtctgcgagaggagc

SEQ ID NO: 12767 - DNA, 18 bp, Artificial Sequence
  Synthetic
gctggtagttcagggcct

SEQ ID NO: 12768 - DNA, 20 bp, Artificial Sequence
  Synthetic
cgtagacggacttgattggc

SEQ ID NO: 12769 - DNA, 20 bp, Artificial Sequence
  Synthetic
tgctcgtcctcactctcttc

SEQ ID NO: 12770 - DNA, 20 bp, Artificial Sequence
  Synthetic
ttgagctggacatattcgcg

SEQ ID NO: 12771 - DNA, 16 bp, Artificial Sequence
  Synthetic
gcggaggcgtacatgc

SEQ ID NO: 12772 - DNA, 18 bp, Artificial Sequence
  Synthetic
cacggtaagagcccagca

SEQ ID NO: 12773 - DNA, 18 bp, Artificial Sequence
  Synthetic
gcaggctcggttgttgat

SEQ ID NO: 12774 - DNA, 18 bp, Artificial Sequence
  Synthetic
aaggtaagggggtcccgc

SEQ ID NO: 12775 - DNA, 19 bp, Artificial Sequence
  Synthetic
aaaagcgtccgcagtactc

SEQ ID NO: 12776 - DNA, 16 bp, Artificial Sequence
  Synthetic
gtgctgcgccctgaga

SEQ ID NO: 12777 - DNA, 19 bp, Artificial Sequence
  Synthetic
caaacgcggctgtaaacca

SEQ ID NO: 12778 - DNA, 17 bp, Artificial Sequence
  Synthetic
agctcggcaatggtggc

SEQ ID NO: 12779 - DNA, 18 bp, Artificial Sequence
  Synthetic
cccgttgggtagcgaaag

SEQ ID NO: 12780 - DNA, 20 bp, Artificial Sequence
  Synthetic
agtcatgcatgagcctctca

SEQ ID NO: 12781 - DNA, 18 bp, Artificial Sequence
  Synthetic
cgtagtcgttgcaggtgc

SEQ ID NO: 12782 - DNA, 16 bp, Artificial Sequence
  Synthetic
agcggttgagcaggct

SEQ ID NO: 12783 - DNA, 17 bp, Artificial Sequence
  Synthetic
cgcccgtagtctggaga

SEQ ID NO: 12784 - DNA, 16 bp, Artificial Sequence
  Synthetic
gcggccaacctggtga

SEQ ID NO: 12785 - DNA, 18 bp, Artificial Sequence
  Synthetic
cctgagcctggccgagaa

SEQ ID NO: 12786 - DNA, 20 bp, Artificial Sequence
  Synthetic
tgaggatgaggaagaggagg

SEQ ID NO: 12787 - DNA, 16 bp, Artificial Sequence
  Synthetic
gcgctggcggagaaca

SEQ ID NO: 12788 - DNA, 16 bp, Artificial Sequence
  Synthetic
agtcgggcccggacta

SEQ ID NO: 12789 - DNA, 16 bp, Artificial Sequence
  Synthetic
cgtgcactggggcaga

SEQ ID NO: 12790 - DNA, 20 bp, Artificial Sequence
  Synthetic
gttgatggactacctgcacc

SEQ ID NO: 12791 - DNA, 20 bp, Artificial Sequence
  Synthetic
gtacctgaacgactcgctgc

SEQ ID NO: 12792 - DNA, 18 bp, Artificial Sequence
  Synthetic
caccaaggccatagcgtg

SEQ ID NO: 12793 - DNA, 20 bp, Artificial Sequence
  Synthetic
tagacctgatgaacaacgcc

SEQ ID NO: 12794 - DNA, 19 bp, Artificial Sequence
  Synthetic
tccccgcacttctaaatgt

SEQ ID NO: 12795 - DNA, 16 bp, Artificial Sequence
  Synthetic
ttacctgcggcgcgga

SEQ ID NO: 12796 - DNA, 19 bp, Artificial Sequence
  Synthetic
cagtatccgcggagtccag

SEQ ID NO: 12797 - DNA, 18 bp, Artificial Sequence
  Synthetic
cactttcgcgctccctgg

SEQ ID NO: 12798 - DNA, 16 bp, Artificial Sequence
  Synthetic
acccccacaggcagga

SEQ ID NO: 12799 - DNA, 19 bp, Artificial Sequence
  Synthetic
gcgagggggcagtagagtt

SEQ ID NO: 12800 - DNA, 17 bp, Artificial Sequence
  Synthetic
gcgagggcgagaacatg

SEQ ID NO: 12801 - DNA, 20 bp, Artificial Sequence
  Synthetic
aaaaaccctcgaccagcatc

SEQ ID NO: 12802 - DNA, 18 bp, Artificial Sequence
  Synthetic
gctaccaccccagcatcc

SEQ ID NO: 12803 - DNA, 19 bp, Artificial Sequence
  Synthetic
tctgacacacctggtcctg

SEQ ID NO: 12804 - DNA, 20 bp, Artificial Sequence
  Synthetic
agtggacattgcaaaccagg

SEQ ID NO: 12805 - DNA, 17 bp, Artificial Sequence
  Synthetic
acctgccttcaccaccc

SEQ ID NO: 12806 - DNA, 18 bp, Artificial Sequence
  Synthetic
ggacgcctcggagtacct

SEQ ID NO: 12807 - DNA, 18 bp, Artificial Sequence
  Synthetic
ccccaaactccagtcagt

SEQ ID NO: 12808 - DNA, 18 bp, Artificial Sequence
  Synthetic
ggcctctcagttgaatgc

SEQ ID NO: 12809 - DNA, 20 bp, Artificial Sequence
  Synthetic
tttctgtactcgaacgtggc

SEQ ID NO: 12810 - DNA, 16 bp, Artificial Sequence
  Synthetic
tgctcccgggctccta

SEQ ID NO: 12811 - DNA, 20 bp, Artificial Sequence
  Synthetic
ccttctacctcaaccacacc

SEQ ID NO: 12812 - DNA, 20 bp, Artificial Sequence
  Synthetic
acaaggattacaaggccgtt

SEQ ID NO: 12813 - DNA, 18 bp, Artificial Sequence
  Synthetic
atgagcccaccctcctct

SEQ ID NO: 12814 - DNA, 17 bp, Artificial Sequence
  Synthetic
gcctttggctggaaccc

SEQ ID NO: 12815 - DNA, 17 bp, Artificial Sequence
  Synthetic
cccgatcgacccatgga

SEQ ID NO: 12816 - DNA, 16 bp, Artificial Sequence
  Synthetic
ctgggaagggccacgt

SEQ ID NO: 12817 - DNA, 20 bp, Artificial Sequence
  Synthetic
ggggtcatcttacacagctg

SEQ ID NO: 12818 - DNA, 17 bp, Artificial Sequence
  Synthetic
gccttgctgggttgctc

SEQ ID NO: 12819 - DNA, 20 bp, Artificial Sequence
  Synthetic
gcctcctcgtttatccaggt

SEQ ID NO: 12820 - DNA, 19 bp, Artificial Sequence
  Synthetic
tcggggtttaccttggtca

SEQ ID NO: 12821 - DNA, 20 bp, Artificial Sequence
  Synthetic
ggagaacttaaccacccacg

SEQ ID NO: 12822 - DNA, 20 bp, Artificial Sequence
  Synthetic
agaaacagcagaggaacagg

SEQ ID NO: 12823 - DNA, 16 bp, Artificial Sequence
  Synthetic
tggccgtggtcctggt

SEQ ID NO: 12824 - DNA, 18 bp, Artificial Sequence
  Synthetic
tggcagcagtgtctcgag

SEQ ID NO: 12825 - DNA, 19 bp, Artificial Sequence
  Synthetic
agccactgctacctcttgc

SEQ ID NO: 12826 - DNA, 20 bp, Artificial Sequence
  Synthetic
tttgtaccccaggactacca

SEQ ID NO: 12827 - DNA, 20 bp, Artificial Sequence
  Synthetic
ttggaagaggtggaacagga

SEQ ID NO: 12828 - DNA, 18 bp, Artificial Sequence
  Synthetic
aggaggaggcctgaggat

SEQ ID NO: 12829 - DNA, 18 bp, Artificial Sequence
  Synthetic
tcagaaaatccccgggcc

SEQ ID NO: 12830 - DNA, 19 bp, Artificial Sequence
  Synthetic
cggaggcattggaactctc

SEQ ID NO: 12831 - DNA, 18 bp, Artificial Sequence
  Synthetic
caccacctacaccgtgta

SEQ ID NO: 12832 - DNA, 20 bp, Artificial Sequence
  Synthetic
cttgctgggtggaaatcaat

SEQ ID NO: 12833 - DNA, 19 bp, Artificial Sequence
  Synthetic
actgcatgtggctagactt

SEQ ID NO: 12834 - DNA, 21 bp, Artificial Sequence
  Synthetic
ctttagtgggaccattagacc

SEQ ID NO: 12835 - DNA, 25 bp, Artificial Sequence
  Synthetic
taacaaagacggttctaatagagaa

SEQ ID NO: 12836 - DNA, 20 bp, Artificial Sequence
  Synthetic
cagcacttatgatggcatct

SEQ ID NO: 12837 - DNA, 23 bp, Artificial Sequence
  Synthetic
gagtattattaatgcatggccag

SEQ ID NO: 12838 - DNA, 18 bp, Artificial Sequence
  Synthetic
cacacctcacccgactgt

SEQ ID NO: 12839 - DNA, 24 bp, Artificial Sequence
  Synthetic
gctataatgctacaatggatatgc

SEQ ID NO: 12840 - DNA, 18 bp, Artificial Sequence
  Synthetic
cagcatcgccttgcctat

SEQ ID NO: 12841 - DNA, 19 bp, Artificial Sequence
  Synthetic
gtctacccctatggctacg

SEQ ID NO: 12842 - DNA, 20 bp, Artificial Sequence
  Synthetic
ctggaaagggtattggaaca

SEQ ID NO: 12843 - DNA, 21 bp, Artificial Sequence
  Synthetic
aaagctattggttttatgcct

SEQ ID NO: 12844 - DNA, 18 bp, Artificial Sequence
  Synthetic
tttacaccagcgcgggta

SEQ ID NO: 12845 - DNA, 18 bp, Artificial Sequence
  Synthetic
catcagtcttctggtgcg

SEQ ID NO: 12846 - DNA, 18 bp, Artificial Sequence
  Synthetic
ctctcaccagatccaggg

SEQ ID NO: 12847 - DNA, 20 bp, Artificial Sequence
  Synthetic
tgaaacaaaaagcccgtcca

SEQ ID NO: 12848 - DNA, 19 bp, Artificial Sequence
  Synthetic
ccctccatcgatttcatca

SEQ ID NO: 12849 - DNA, 19 bp, Artificial Sequence
  Synthetic
ctccaaagctagcacctaa

SEQ ID NO: 12850 - DNA, 21 bp, Artificial Sequence
  Synthetic
ccttgcggacatacaaaaatt

SEQ ID NO: 12851 - DNA, 21 bp, Artificial Sequence
  Synthetic
gcttaccagtagacaaagagc

SEQ ID NO: 12852 - DNA, 19 bp, Artificial Sequence
  Synthetic
aagggacaagtcacagaca

SEQ ID NO: 12853 - DNA, 22 bp, Artificial Sequence
  Synthetic
tttggacctatgatcaacaaga

SEQ ID NO: 12854 - DNA, 19 bp, Artificial Sequence
  Synthetic
ccgagccccttttatatgt

SEQ ID NO: 12855 - DNA, 20 bp, Artificial Sequence
  Synthetic
gtggtggagctatagaagtg

SEQ ID NO: 12856 - DNA, 18 bp, Artificial Sequence
  Synthetic
caagattgcacgaaggct

SEQ ID NO: 12857 - DNA, 20 bp, Artificial Sequence
  Synthetic
accacgaaaacaagaatcac

SEQ ID NO: 12858 - DNA, 22 bp, Artificial Sequence
  Synthetic
caagatcatagatcaagtgagg

SEQ ID NO: 12859 - DNA, 22 bp, Artificial Sequence
  Synthetic
gtacacccttatctgatgatgg

SEQ ID NO: 12860 - DNA, 21 bp, Artificial Sequence
  Synthetic
caagtgaaaatagctccaacc

SEQ ID NO: 12861 - DNA, 25 bp, Artificial Sequence
  Synthetic
cactccatataattacagatagagg

SEQ ID NO: 12862 - DNA, 18 bp, Artificial Sequence
  Synthetic
attttgcccggagaaagg

SEQ ID NO: 12863 - DNA, 21 bp, Artificial Sequence
  Synthetic
gtattacggcacagatcaaga

SEQ ID NO: 12864 - DNA, 22 bp, Artificial Sequence
  Synthetic
cagattcagggttgtatttgtc

SEQ ID NO: 12865 - DNA, 22 bp, Artificial Sequence
  Synthetic
ataagtttccatgtacatgcaa

SEQ ID NO: 12866 - DNA, 25 bp, Artificial Sequence
  Synthetic
tcgtaccattaatcaaatacagatc

SEQ ID NO: 12867 - DNA, 19 bp, Artificial Sequence
  Synthetic
ctctgaaggatgccttgga

SEQ ID NO: 12868 - DNA, 25 bp, Artificial Sequence
  Synthetic
ggactataggagaaaaaagtcttac

SEQ ID NO: 12869 - DNA, 21 bp, Artificial Sequence
  Synthetic
gtgtagtggctaattgcattg

SEQ ID NO: 12870 - DNA, 22 bp, Artificial Sequence
  Synthetic
cagatcaagtacattgtagcat

SEQ ID NO: 12871 - DNA, 19 bp, Artificial Sequence
  Synthetic
aagtcatgcaacagacagg

SEQ ID NO: 12872 - DNA, 25 bp, Artificial Sequence
  Synthetic
cagatatgtatcctgatttaaaccc

SEQ ID NO: 12873 - DNA, 23 bp, Artificial Sequence
  Synthetic
tctcatcgatacaaaaatgaaga

SEQ ID NO: 12874 - DNA, 24 bp, Artificial Sequence
  Synthetic
ataactcaaaattacttaggtgcc

SEQ ID NO: 12875 - DNA, 25 bp, Artificial Sequence
  Synthetic
atcaggtgtatatactgatgcatat

SEQ ID NO: 12876 - DNA, 24 bp, Artificial Sequence
  Synthetic
caccaaatacaaaatcagaaatgg

SEQ ID NO: 12877 - DNA, 23 bp, Artificial Sequence
  Synthetic
ttaaaattaaccggttatgtcct

SEQ ID NO: 12878 - DNA, 21 bp, Artificial Sequence
  Synthetic
gactctttgccaagatgacat

SEQ ID NO: 12879 - DNA, 23 bp, Artificial Sequence
  Synthetic
ctaatctctattagtgcaatcca

SEQ ID NO: 12880 - DNA, 25 bp, Artificial Sequence
  Synthetic
ccattaatcctactattacgtcaac

SEQ ID NO: 12881 - DNA, 18 bp, Artificial Sequence
  Synthetic
ggacactcagaaaaccgg

SEQ ID NO: 12882 - DNA, 21 bp, Artificial Sequence
  Synthetic
gaatcgcaatggtttacactt

SEQ ID NO: 12883 - DNA, 25 bp, Artificial Sequence
  Synthetic
tgatatacccttattttgttccact

SEQ ID NO: 12884 - DNA, 24 bp, Artificial Sequence
  Synthetic
tcaggaaatcttcaattaaggtgt

SEQ ID NO: 12885 - DNA, 21 bp, Artificial Sequence
  Synthetic
taactctaccttttgatgggc

SEQ ID NO: 12886 - DNA, 18 bp, Artificial Sequence
  Synthetic
caaaagcaggcaaaccat

SEQ ID NO: 12887 - DNA, 19 bp, Artificial Sequence
  Synthetic
caatggctttccttgagga

SEQ ID NO: 12888 - DNA, 21 bp, Artificial Sequence
  Synthetic
cgggaaggctaatagatttcc

SEQ ID NO: 12889 - DNA, 18 bp, Artificial Sequence
  Synthetic
ttcgtgcactttgtcgaa

SEQ ID NO: 12890 - DNA, 20 bp, Artificial Sequence
  Synthetic
cctgaatggtttagaaacgt

SEQ ID NO: 12891 - DNA, 22 bp, Artificial Sequence
  Synthetic
atgttcaacatgctaagtacag

SEQ ID NO: 12892 - DNA, 22 bp, Artificial Sequence
  Synthetic
acaagctttttctatcgctatg

SEQ ID NO: 12893 - DNA, 25 bp, Artificial Sequence
  Synthetic
gatcaaacttatacaatatccggaa

SEQ ID NO: 12894 - DNA, 20 bp, Artificial Sequence
  Synthetic
attctcaacacaagccaaag

SEQ ID NO: 12895 - DNA, 25 bp, Artificial Sequence
  Synthetic
gacctgggtacatatataaagaaac

SEQ ID NO: 12896 - DNA, 19 bp, Artificial Sequence
  Synthetic
catgcttggcacgtgaagt

SEQ ID NO: 12897 - DNA, 20 bp, Artificial Sequence
  Synthetic
tagtccttgaagagcgtcct

SEQ ID NO: 12898 - DNA, 18 bp, Artificial Sequence
  Synthetic
aggtaaccaggaaacgca

SEQ ID NO: 12899 - DNA, 23 bp, Artificial Sequence
  Synthetic
gtggggaatggtaatattaatgc

SEQ ID NO: 12900 - DNA, 22 bp, Artificial Sequence
  Synthetic
tagtttgtccatgttagtgcaa

SEQ ID NO: 12901 - DNA, 24 bp, Artificial Sequence
  Synthetic
ttgtaccatttattagtgccctta

SEQ ID NO: 12902 - DNA, 20 bp, Artificial Sequence
  Synthetic
atctgatcaacaggaggagg

SEQ ID NO: 12903 - DNA, 22 bp, Artificial Sequence
  Synthetic
attgaagtacatctgtcattgc

SEQ ID NO: 12904 - DNA, 22 bp, Artificial Sequence
  Synthetic
tcctgctgcttatacttttctg

SEQ ID NO: 12905 - DNA, 18 bp, Artificial Sequence
  Synthetic
gtgggctagtttgggggt

SEQ ID NO: 12906 - DNA, 18 bp, Artificial Sequence
  Synthetic
ccggctgtgttggacatt

SEQ ID NO: 12907 - DNA, 18 bp, Artificial Sequence
  Synthetic
ccgtagtggtaggcgcat

SEQ ID NO: 12908 - DNA, 21 bp, Artificial Sequence
  Synthetic
ctgatgttgattttgcacatg

SEQ ID NO: 12909 - DNA, 24 bp, Artificial Sequence
  Synthetic
caccaacttattttattatggtgg

SEQ ID NO: 12910 - DNA, 18 bp, Artificial Sequence
  Synthetic
gccattgattttgctgca

SEQ ID NO: 12911 - DNA, 19 bp, Artificial Sequence
  Synthetic
tagtggctctatggtgtcc

SEQ ID NO: 12912 - DNA, 20 bp, Artificial Sequence
  Synthetic
cctgaaattatggcctacct

SEQ ID NO: 12913 - DNA, 18 bp, Artificial Sequence
  Synthetic
ctacccctacatcctccc

SEQ ID NO: 12914 - DNA, 20 bp, Artificial Sequence
  Synthetic
actgtgtgtcatgtgtgtgt

SEQ ID NO: 12915 - DNA, 20 bp, Artificial Sequence
  Synthetic
aaactttatgtgttgcacct

SEQ ID NO: 12916 - DNA, 18 bp, Artificial Sequence
  Synthetic
gtgacggtgacattgcag

SEQ ID NO: 12917 - DNA, 23 bp, Artificial Sequence
  Synthetic
atgatccaaacaattcaaatcct

SEQ ID NO: 12918 - DNA, 19 bp, Artificial Sequence
  Synthetic
gagcactcacgtccctaac

SEQ ID NO: 12919 - DNA, 18 bp, Artificial Sequence
  Synthetic
ccctctcccattggtccg

SEQ ID NO: 12920 - DNA, 24 bp, Artificial Sequence
  Synthetic
cataggctcttgaaataaacaatg

SEQ ID NO: 12921 - DNA, 21 bp, Artificial Sequence
  Synthetic
cgagttccttatatgcttacc

SEQ ID NO: 12922 - DNA, 17 bp, Artificial Sequence
  Synthetic
gcgactgctggcttcaa

SEQ ID NO: 12923 - DNA, 16 bp, Artificial Sequence
  Synthetic
actggcgggtggctca

SEQ ID NO: 12924 - DNA, 16 bp, Artificial Sequence
  Synthetic
gtggtcctgggacgca

SEQ ID NO: 12925 - DNA, 17 bp, Artificial Sequence
  Synthetic
tagatcgggcagggtgg

SEQ ID NO: 12926 - DNA, 16 bp, Artificial Sequence
  Synthetic
ggtgtgtggtcgccct

SEQ ID NO: 12927 - DNA, 20 bp, Artificial Sequence
  Synthetic
tggtgtcggaagatttcgtg

SEQ ID NO: 12928 - DNA, 20 bp, Artificial Sequence
  Synthetic
cactccggtagtatctgcgt

SEQ ID NO: 12929 - DNA, 18 bp, Artificial Sequence
  Synthetic
ggtgtgccgcctagacac

SEQ ID NO: 12930 - DNA, 18 bp, Artificial Sequence
  Synthetic
gttttgggggtagcagcg

SEQ ID NO: 12931 - DNA, 18 bp, Artificial Sequence
  Synthetic
gcagtgactccatcatgg

SEQ ID NO: 12932 - DNA, 18 bp, Artificial Sequence
  Synthetic
gtggacacgctgacgaaa

SEQ ID NO: 12933 - DNA, 20 bp, Artificial Sequence
  Synthetic
cgcagcttggctatacagac

SEQ ID NO: 12934 - DNA, 19 bp, Artificial Sequence
  Synthetic
ctgaaaggagggagcacac

SEQ ID NO: 12935 - DNA, 17 bp, Artificial Sequence
  Synthetic
cggccaccggtagttca

SEQ ID NO: 12936 - DNA, 16 bp, Artificial Sequence
  Synthetic
cccggtggtgcagttg

SEQ ID NO: 12937 - DNA, 19 bp, Artificial Sequence
  Synthetic
gaaccgccggtcaaaacac

SEQ ID NO: 12938 - DNA, 16 bp, Artificial Sequence
  Synthetic
acaggcgcgcgtatgg

SEQ ID NO: 12939 - DNA, 17 bp, Artificial Sequence
  Synthetic
cttcggcaccggtttcc

SEQ ID NO: 12940 - DNA, 20 bp, Artificial Sequence
  Synthetic
ccccgtatatgtccaacggg

SEQ ID NO: 12941 - DNA, 18 bp, Artificial Sequence
  Synthetic
aacccgccacgtaaagga

SEQ ID NO: 12942 - DNA, 20 bp, Artificial Sequence
  Synthetic
tcttgtgaggcctctttgtg

SEQ ID NO: 12943 - DNA, 20 bp, Artificial Sequence
  Synthetic
tacggtggaaacaaaggacg

SEQ ID NO: 12944 - DNA, 19 bp, Artificial Sequence
  Synthetic
aaactcggcataccaacgg

SEQ ID NO: 12945 - DNA, 18 bp, Artificial Sequence
  Synthetic
gctaccgaccccgaaacc

SEQ ID NO: 12946 - DNA, 20 bp, Artificial Sequence
  Synthetic
aaacaactcccccatccacg

SEQ ID NO: 12947 - DNA, 19 bp, Artificial Sequence
  Synthetic
agtggagatcgaacagggc

SEQ ID NO: 12948 - DNA, 17 bp, Artificial Sequence
  Synthetic
cgcagggggagagaaca

SEQ ID NO: 12949 - DNA, 18 bp, Artificial Sequence
  Synthetic
agcacctgttctgcgacc

SEQ ID NO: 12950 - DNA, 18 bp, Artificial Sequence
  Synthetic
tgctgctcctgctcctcc

SEQ ID NO: 12951 - DNA, 20 bp, Artificial Sequence
  Synthetic
gaatgagtatccgtggtccc

SEQ ID NO: 12952 - DNA, 16 bp, Artificial Sequence
  Synthetic
ttgtccctcggggcca

SEQ ID NO: 12953 - DNA, 18 bp, Artificial Sequence
  Synthetic
gaaggtggacccggctat

SEQ ID NO: 12954 - DNA, 16 bp, Artificial Sequence
  Synthetic
gcacatggcgctccga

SEQ ID NO: 12955 - DNA, 19 bp, Artificial Sequence
  Synthetic
tgtgtaggaggttggccat

SEQ ID NO: 12956 - DNA, 19 bp, Artificial Sequence
  Synthetic
cgggtcatgcgatctgttt

SEQ ID NO: 12957 - DNA, 23 bp, Artificial Sequence
  Synthetic
cgaattcggttgtatataaacag

SEQ ID NO: 12958 - DNA, 18 bp, Artificial Sequence
  Synthetic
accagatgtgcaggccta

SEQ ID NO: 12959 - DNA, 20 bp, Artificial Sequence
  Synthetic
cgaagaggcgcttattcgag

SEQ ID NO: 12960 - DNA, 19 bp, Artificial Sequence
  Synthetic
atgctgctaaacattcccg

SEQ ID NO: 12961 - DNA, 18 bp, Artificial Sequence
  Synthetic
gggactggaagcccatag

SEQ ID NO: 12962 - DNA, 21 bp, Artificial Sequence
  Synthetic
gaaatcttttggatggacacc

SEQ ID NO: 12963 - DNA, 20 bp, Artificial Sequence
  Synthetic
ggtccggctagaaaatgtca

SEQ ID NO: 12964 - DNA, 16 bp, Artificial Sequence
  Synthetic
ggacgtgggaggtgca

SEQ ID NO: 12965 - DNA, 19 bp, Artificial Sequence
  Synthetic
tgggaacggtgataagaca

SEQ ID NO: 12966 - DNA, 21 bp, Artificial Sequence
  Synthetic
ggaacatatcctgtggtactg

SEQ ID NO: 12967 - DNA, 20 bp, Artificial Sequence
  Synthetic
tttggtggaggactctagca

SEQ ID NO: 12968 - DNA, 20 bp, Artificial Sequence
  Synthetic
actgaggagttggagatgga

SEQ ID NO: 12969 - DNA, 22 bp, Artificial Sequence
  Synthetic
aaacgtgtccactatttctttg

SEQ ID NO: 12970 - DNA, 21 bp, Artificial Sequence
  Synthetic
cccctccaatttactaacaca

SEQ ID NO: 12971 - DNA, 25 bp, Artificial Sequence
  Synthetic
gtctgatactaattataaggctacc

SEQ ID NO: 12972 - DNA, 21 bp, Artificial Sequence
  Synthetic
tgtttatgttgttgttgtgct

SEQ ID NO: 12973 - DNA, 25 bp, Artificial Sequence
  Synthetic
aggaaagtgatggatctatagtttc

SEQ ID NO: 12974 - DNA, 20 bp, Artificial Sequence
  Synthetic
cagaaggcgactatttgatg

SEQ ID NO: 12975 - DNA, 25 bp, Artificial Sequence
  Synthetic
acagcttaatgtcatttttagaagg

SEQ ID NO: 12976 - DNA, 24 bp, Artificial Sequence
  Synthetic
tgaggaccaaatattgtattggaa

SEQ ID NO: 12977 - DNA, 20 bp, Artificial Sequence
  Synthetic
ccagtactggtgggaagtct

SEQ ID NO: 12978 - DNA, 19 bp, Artificial Sequence
  Synthetic
gaagctgtcctgatgatgt

SEQ ID NO: 12979 - DNA, 24 bp, Artificial Sequence
  Synthetic
tccaggaactagtagtatagtacc

SEQ ID NO: 12980 - DNA, 18 bp, Artificial Sequence
  Synthetic
ctcaggcggttcagtttg

SEQ ID NO: 12981 - DNA, 18 bp, Artificial Sequence
  Synthetic
tgtccctacacttccacc

SEQ ID NO: 12982 - DNA, 18 bp, Artificial Sequence
  Synthetic
cgaaccagggtaaggtgt

SEQ ID NO: 12983 - DNA, 22 bp, Artificial Sequence
  Synthetic
catcaacacaacgattagtttg

SEQ ID NO: 12984 - DNA, 18 bp, Artificial Sequence
  Synthetic
ctgagcctccacaagaca

SEQ ID NO: 12985 - DNA, 19 bp, Artificial Sequence
  Synthetic
tgctaggcattttttcacc

SEQ ID NO: 12986 - DNA, 22 bp, Artificial Sequence
  Synthetic
gccattgaggatcattacagat

SEQ ID NO: 12987 - DNA, 18 bp, Artificial Sequence
  Synthetic
gggcttaaggggtcttac

SEQ ID NO: 12988 - DNA, 22 bp, Artificial Sequence
  Synthetic
tgcattctatagttcagaagcc

SEQ ID NO: 12989 - DNA, 25 bp, Artificial Sequence
  Synthetic
agttgctttattattactgaagctg

SEQ ID NO: 12990 - DNA, 25 bp, Artificial Sequence
  Synthetic
aagcaataaagttaactcctgaaag

SEQ ID NO: 12991 - DNA, 19 bp, Artificial Sequence
  Synthetic
gaagtgtacctgcagcatt

SEQ ID NO: 12992 - DNA, 18 bp, Artificial Sequence
  Synthetic
ctaccagcaggtcgccaa

SEQ ID NO: 12993 - DNA, 19 bp, Artificial Sequence
  Synthetic
gctatgagcacagtatggc

SEQ ID NO: 12994 - DNA, 18 bp, Artificial Sequence
  Synthetic
gtacacagccaggaggtt

SEQ ID NO: 12995 - DNA, 22 bp, Artificial Sequence
  Synthetic
gtccatagtacctttagctgaa

SEQ ID NO: 12996 - DNA, 25 bp, Artificial Sequence
  Synthetic
agatccctctattagtaaaactaca

SEQ ID NO: 12997 - DNA, 18 bp, Artificial Sequence
  Synthetic
caacacgtcctgctgaat

SEQ ID NO: 12998 - DNA, 23 bp, Artificial Sequence
  Synthetic
gcctaggtttaaaagtttacagt

SEQ ID NO: 12999 - DNA, 22 bp, Artificial Sequence
  Synthetic
gtggctaaagttttgtctacag

SEQ ID NO: 13000 - DNA, 18 bp, Artificial Sequence
  Synthetic
ccagaacatgaacgcctt

SEQ ID NO: 13001 - DNA, 18 bp, Artificial Sequence
  Synthetic
ggggacgctattccagat

SEQ ID NO: 13002 - DNA, 25 bp, Artificial Sequence
  Synthetic
ctagtaaaagaaagaagtcttctgc

SEQ ID NO: 13003 - DNA, 23 bp, Artificial Sequence
  Synthetic
aagcagagcatattcttagaact

SEQ ID NO: 13004 - DNA, 20 bp, Artificial Sequence
  Synthetic
ataccctcgtttatcttgcc

SEQ ID NO: 13005 - DNA, 20 bp, Artificial Sequence
  Synthetic
gctgaggcatctagtatcag

SEQ ID NO: 13006 - DNA, 21 bp, Artificial Sequence
  Synthetic
cttatgataacagacggctca

SEQ ID NO: 13007 - DNA, 23 bp, Artificial Sequence
  Synthetic
tgcacaaagacttatctagacac

SEQ ID NO: 13008 - DNA, 21 bp, Artificial Sequence
  Synthetic
ggtattcttttggcttcgaaa

SEQ ID NO: 13009 - DNA, 18 bp, Artificial Sequence
  Synthetic
ccacattcgttccagcta

SEQ ID NO: 13010 - DNA, 19 bp, Artificial Sequence
  Synthetic
cagcacagagagtttcaca

SEQ ID NO: 13011 - DNA, 18 bp, Artificial Sequence
  Synthetic
cgagtcttcgtgttagcc

SEQ ID NO: 13012 - DNA, 20 bp, Artificial Sequence
  Synthetic
atttgatgaaagcccaaagt

SEQ ID NO: 13013 - DNA, 21 bp, Artificial Sequence
  Synthetic
ctcatctgtgtatgctcatgg

SEQ ID NO: 13014 - DNA, 23 bp, Artificial Sequence
  Synthetic
aaacataagttcccattcaaaga

SEQ ID NO: 13015 - DNA, 22 bp, Artificial Sequence
  Synthetic
aacattggaaactgttaagaca

SEQ ID NO: 13016 - DNA, 25 bp, Artificial Sequence
  Synthetic
ctaatggtatatactgcttggaaag

SEQ ID NO: 13017 - DNA, 18 bp, Artificial Sequence
  Synthetic
ctagctccaccccaccat

SEQ ID NO: 13018 - DNA, 19 bp, Artificial Sequence
  Synthetic
ggtctagaaccaggacccg

SEQ ID NO: 13019 - DNA, 18 bp, Artificial Sequence
  Synthetic
cctgacaaggtgggatca

SEQ ID NO: 13020 - DNA, 25 bp, Artificial Sequence
  Synthetic
tcaaatattaactgaatctacaccc

SEQ ID NO: 13021 - DNA, 22 bp, Artificial Sequence
  Synthetic
ctcaacaagtaaatgtccagga

SEQ ID NO: 13022 - DNA, 18 bp, Artificial Sequence
  Synthetic
gagctacagtaggggctc

SEQ ID NO: 13023 - DNA, 21 bp, Artificial Sequence
  Synthetic
agttagtttatggtagtggca

SEQ ID NO: 13024 - DNA, 20 bp, Artificial Sequence
  Synthetic
agatgacctcgctatggtta

SEQ ID NO: 13025 - DNA, 21 bp, Artificial Sequence
  Synthetic
atcccaacagatttgcactag

SEQ ID NO: 13026 - DNA, 21 bp, Artificial Sequence
  Synthetic
tcttctatgctagacgtgaac

SEQ ID NO: 13027 - DNA, 25 bp, Artificial Sequence
  Synthetic
taatcctatacatgacacatatagg

SEQ ID NO: 13028 - DNA, 22 bp, Artificial Sequence
  Synthetic
attggttaatgctcattcccaa

SEQ ID NO: 13029 - DNA, 25 bp, Artificial Sequence
  Synthetic
ttacgctgaacatctaaataaaacc

SEQ ID NO: 13030 - DNA, 20 bp, Artificial Sequence
  Synthetic
ctaagagagtcagcaaaggc

SEQ ID NO: 13031 - DNA, 22 bp, Artificial Sequence
  Synthetic
atatgatgggcaaagagtgtac

SEQ ID NO: 13032 - DNA, 19 bp, Artificial Sequence
  Synthetic
ccctggcattattcaacga

SEQ ID NO: 13033 - DNA, 24 bp, Artificial Sequence
  Synthetic
acataccacctctaaaaatttcag

SEQ ID NO: 13034 - DNA, 21 bp, Artificial Sequence
  Synthetic
tggcataaagttaaaggggaa

SEQ ID NO: 13035 - DNA, 18 bp, Artificial Sequence
  Synthetic
cctgaaacagctgacaca

SEQ ID NO: 13036 - DNA, 20 bp, Artificial Sequence
  Synthetic
acaccaatcacaagtcgagc

SEQ ID NO: 13037 - DNA, 19 bp, Artificial Sequence
  Synthetic
gttgcttataactgctggc

SEQ ID NO: 13038 - DNA, 19 bp, Artificial Sequence
  Synthetic
tattgttggttgtgctcca

SEQ ID NO: 13039 - DNA, 22 bp, Artificial Sequence
  Synthetic
gtgatcgtttgtttttctttgg

SEQ ID NO: 13040 - DNA, 21 bp, Artificial Sequence
  Synthetic
tgaactcagctattttggatg

SEQ ID NO: 13041 - DNA, 19 bp, Artificial Sequence
  Synthetic
ctgaatctttgtcacccga

SEQ ID NO: 13042 - DNA, 25 bp, Artificial Sequence
  Synthetic
agtctttggatgatctatttgaaga

SEQ ID NO: 13043 - DNA, 19 bp, Artificial Sequence
  Synthetic
ggatttctcctcgcaaacc

SEQ ID NO: 13044 - DNA, 24 bp, Artificial Sequence
  Synthetic
taagaagtcgtttactaatacctc

SEQ ID NO: 13045 - DNA, 21 bp, Artificial Sequence
  Synthetic
ccaaatctccatcaagaagac

SEQ ID NO: 13046 - DNA, 20 bp, Artificial Sequence
  Synthetic
cgtttgcaagtgtttggaag

SEQ ID NO: 13047 - DNA, 20 bp, Artificial Sequence
  Synthetic
cccatctgttgtacccctta

SEQ ID NO: 13048 - DNA, 21 bp, Artificial Sequence
  Synthetic
atttgaaattgaaaatcccgc

SEQ ID NO: 13049 - DNA, 20 bp, Artificial Sequence
  Synthetic
ttagtatggcagcttaaggg

SEQ ID NO: 13050 - DNA, 23 bp, Artificial Sequence
  Synthetic
gtgattgtccagctatagaatta

SEQ ID NO: 13051 - DNA, 25 bp, Artificial Sequence
  Synthetic
tgcctgatagttataaatatactgc

SEQ ID NO: 13052 - DNA, 22 bp, Artificial Sequence
  Synthetic
gccaaaatctgttaacaactgt

SEQ ID NO: 13053 - DNA, 21 bp, Artificial Sequence
  Synthetic
cacttttgaagcaaaaaaggc

SEQ ID NO: 13054 - DNA, 23 bp, Artificial Sequence
  Synthetic
tttagcttctctagttgaaaagc

SEQ ID NO: 13055 - DNA, 24 bp, Artificial Sequence
  Synthetic
gagcaacgactatttagaattgac

SEQ ID NO: 13056 - DNA, 21 bp, Artificial Sequence
  Synthetic
gtctaatacaccgagacaaca

SEQ ID NO: 13057 - DNA, 24 bp, Artificial Sequence
  Synthetic
gcactgttcttttatagaaaatcg

SEQ ID NO: 13058 - DNA, 20 bp, Artificial Sequence
  Synthetic
taccactctttctccccctg

SEQ ID NO: 13059 - DNA, 18 bp, Artificial Sequence
  Synthetic
gagaggtgggaggaagac

SEQ ID NO: 13060 - DNA, 23 bp, Artificial Sequence
  Synthetic
agtattttattctttgggggatt

SEQ ID NO: 13061 - DNA, 21 bp, Artificial Sequence
  Synthetic
cccttagttgaattaggccaa

SEQ ID NO: 13062 - DNA, 21 bp, Artificial Sequence
  Synthetic
tgtggattctcattttgatgg

SEQ ID NO: 13063 - DNA, 22 bp, Artificial Sequence
  Synthetic
agttaggtgacactgaaaatcc

SEQ ID NO: 13064 - DNA, 21 bp, Artificial Sequence
  Synthetic
ggcgatatgtgtgatataggc

SEQ ID NO: 13065 - DNA, 20 bp, Artificial Sequence
  Synthetic
cctgcaaaagagaaggtaga

SEQ ID NO: 13066 - DNA, 25 bp, Artificial Sequence
  Synthetic
attctgtatgaaggcattattatgc

SEQ ID NO: 13067 - DNA, 19 bp, Artificial Sequence
  Synthetic
cgatttcggtaccaaaagg

SEQ ID NO: 13068 - DNA, 22 bp, Artificial Sequence
  Synthetic
aagcagggttaataatcactca

SEQ ID NO: 13069 - DNA, 19 bp, Artificial Sequence
  Synthetic
gagcaatggtggatcaagt

SEQ ID NO: 13070 - DNA, 18 bp, Artificial Sequence
  Synthetic
acgagaatccagcacaca

SEQ ID NO: 13071 - DNA, 19 bp, Artificial Sequence
  Synthetic
caaaccagtgtgcaaccta

SEQ ID NO: 13072 - DNA, 24 bp, Artificial Sequence
  Synthetic
caagcatagtttatagaaagggag

SEQ ID NO: 13073 - DNA, 22 bp, Artificial Sequence
  Synthetic
tgagacagcagtataatcatgc

SEQ ID NO: 13074 - DNA, 23 bp, Artificial Sequence
  Synthetic
agtaatgtaataacaacacaggc

SEQ ID NO: 13075 - DNA, 19 bp, Artificial Sequence
  Synthetic
tggtagtggtaaacagcaa

SEQ ID NO: 13076 - DNA, 19 bp, Artificial Sequence
  Synthetic
ggatacagcgacaaacaca

SEQ ID NO: 13077 - DNA, 22 bp, Artificial Sequence
  Synthetic
acaaatgaacatgaaacaatgg

SEQ ID NO: 13078 - DNA, 25 bp, Artificial Sequence
  Synthetic
aaggtatatattatgtacatgacgg

SEQ ID NO: 13079 - DNA, 24 bp, Artificial Sequence
  Synthetic
ctatagttatacaacaacaaacgc

SEQ ID NO: 13080 - DNA, 25 bp, Artificial Sequence
  Synthetic
atacctttattacttgtatatgccc

SEQ ID NO: 13081 - DNA, 22 bp, Artificial Sequence
  Synthetic
attagacattacacctaccact

SEQ ID NO: 13082 - DNA, 20 bp, Artificial Sequence
  Synthetic
ccccacattccttaccaaac

SEQ ID NO: 13083 - DNA, 18 bp, Artificial Sequence
  Synthetic
aggccccatttgacacta

SEQ ID NO: 13084 - DNA, 23 bp, Artificial Sequence
  Synthetic
ccaatatattttatcatgcaggc

SEQ ID NO: 13085 - DNA, 23 bp, Artificial Sequence
  Synthetic
aggctcagttgtttaataaacct

SEQ ID NO: 13086 - DNA, 19 bp, Artificial Sequence
  Synthetic
tgtctgcagaaactatggc

SEQ ID NO: 13087 - DNA, 20 bp, Artificial Sequence
  Synthetic
gggttcgtactaaaccttct

SEQ ID NO: 13088 - DNA, 22 bp, Artificial Sequence
  Synthetic
cgtgtggttacataaactaagg

SEQ ID NO: 13089 - DNA, 23 bp, Artificial Sequence
  Synthetic
ctgcactttatgtttttttttgc

SEQ ID NO: 13090 - DNA, 21 bp, Artificial Sequence
  Synthetic
tatagggtgtaaccgaaaacg

SEQ ID NO: 13091 - DNA, 23 bp, Artificial Sequence
  Synthetic
gtaagaatgcatggaaaaaaacc

SEQ ID NO: 13092 - DNA, 18 bp, Artificial Sequence
  Synthetic
ctgcttatgggtgcacta

SEQ ID NO: 13093 - DNA, 20 bp, Artificial Sequence
  Synthetic
aacattagtgaaacggtggg

SEQ ID NO: 13094 - DNA, 21 bp, Artificial Sequence
  Synthetic
agtttatgcaaggtgtggtta

SEQ ID NO: 13095 - DNA, 23 bp, Artificial Sequence
  Synthetic
ggaaatatttgcacagtagaatg

SEQ ID NO: 13096 - DNA, 18 bp, Artificial Sequence
  Synthetic
cgtgcgactggaaaatgt

SEQ ID NO: 13097 - DNA, 18 bp, Artificial Sequence
  Synthetic
gtaaacgtgcatcagcca

SEQ ID NO: 13098 - DNA, 23 bp, Artificial Sequence
  Synthetic
cctcctgttattacatctgtagg

SEQ ID NO: 13099 - DNA, 18 bp, Artificial Sequence
  Synthetic
gcctgcaagataccacat

SEQ ID NO: 13100 - DNA, 18 bp, Artificial Sequence
  Synthetic
acctgtacagccttctgg

SEQ ID NO: 13101 - DNA, 23 bp, Artificial Sequence
  Synthetic
gtggaaacatagcagatagtagg

SEQ ID NO: 13102 - DNA, 25 bp, Artificial Sequence
  Synthetic
tccaacactatatgtaaatatccag

SEQ ID NO: 13103 - DNA, 25 bp, Artificial Sequence
  Synthetic
taaactatatatgttgtgtgagtgg

SEQ ID NO: 13104 - DNA, 22 bp, Artificial Sequence
  Synthetic
tcttgcaatagtcagtcttgtc

SEQ ID NO: 13105 - DNA, 19 bp, Artificial Sequence
  Synthetic
ctcggaaaccctatgtgtg

SEQ ID NO: 13106 - DNA, 23 bp, Artificial Sequence
  Synthetic
gcttatcaaaaagaacagtgcat

SEQ ID NO: 13107 - DNA, 23 bp, Artificial Sequence
  Synthetic
ttcttctggacaattttaaagcc

SEQ ID NO: 13108 - DNA, 18 bp, Artificial Sequence
  Synthetic
cttgcgactggactcaga

SEQ ID NO: 13109 - DNA, 24 bp, Artificial Sequence
  Synthetic
gttggaagggaatttaataacttg

SEQ ID NO: 13110 - DNA, 23 bp, Artificial Sequence
  Synthetic
tgtatggaaagtgtaaaaaacgg

SEQ ID NO: 13111 - DNA, 21 bp, Artificial Sequence
  Synthetic
agcaaaagcagggtagataat

SEQ ID NO: 13112 - DNA, 19 bp, Artificial Sequence
  Synthetic
tgcttttgacgaaaggaga

SEQ ID NO: 13113 - DNA, 19 bp, Artificial Sequence
  Synthetic
tctgatgcaaggttcaact

SEQ ID NO: 13114 - DNA, 19 bp, Artificial Sequence
  Synthetic
atgagaatccagcacacaa

SEQ ID NO: 13115 - DNA, 19 bp, Artificial Sequence
  Synthetic
atgagaggacaaaaggcaa

SEQ ID NO: 13116 - DNA, 23 bp, Artificial Sequence
  Synthetic
cagcagcttaagattctaaaacg

SEQ ID NO: 13117 - DNA, 18 bp, Artificial Sequence
  Synthetic
aatactggaggcagcaaa

SEQ ID NO: 13118 - DNA, 20 bp, Artificial Sequence
  Synthetic
cctgatacgggcaaatcaat

SEQ ID NO: 13119 - DNA, 25 bp, Artificial Sequence
  Synthetic
ccaataataacaattactgatgcag

SEQ ID NO: 13120 - DNA, 23 bp, Artificial Sequence
  Synthetic
tatgaactgtttatgacacctcc

SEQ ID NO: 13121 - DNA, 23 bp, Artificial Sequence
  Synthetic
cgaatccaacaaagaaaacataa

SEQ ID NO: 13122 - DNA, 19 bp, Artificial Sequence
  Synthetic
acaagtgccgttattgagg

SEQ ID NO: 13123 - DNA, 24 bp, Artificial Sequence
  Synthetic
ttatgatttcagctctatagatgc

SEQ ID NO: 13124 - DNA, 20 bp, Artificial Sequence
  Synthetic
cctttttctgtgccttctgt

SEQ ID NO: 13125 - DNA, 22 bp, Artificial Sequence
  Synthetic
tcctaatggatatcaaaagggt

SEQ ID NO: 13126 - DNA, 19 bp, Artificial Sequence
  Synthetic
ccataatggcactgttggt

SEQ ID NO: 13127 - DNA, 22 bp, Artificial Sequence
  Synthetic
caccgtctacctctattgaaac

SEQ ID NO: 13128 - DNA, 21 bp, Artificial Sequence
  Synthetic
ggctctgctacatatttttcg

SEQ ID NO: 13129 - DNA, 18 bp, Artificial Sequence
  Synthetic
tacctgaagaggaggagc

SEQ ID NO: 13130 - DNA, 25 bp, Artificial Sequence
  Synthetic
actaactcatcatttaagtttggag

SEQ ID NO: 13131 - DNA, 23 bp, Artificial Sequence
  Synthetic
tgtatctttcatgaataggcaaa

SEQ ID NO: 13132 - DNA, 19 bp, Artificial Sequence
  Synthetic
tgctaaaacagtggaagca

SEQ ID NO: 13133 - DNA, 20 bp, Artificial Sequence
  Synthetic
gcactccactatttcctccc

SEQ ID NO: 13134 - DNA, 19 bp, Artificial Sequence
  Synthetic
accagagaagctcccagaa

SEQ ID NO: 13135 - DNA, 18 bp, Artificial Sequence
  Synthetic
tggggaagaggaagatgt

SEQ ID NO: 13136 - DNA, 22 bp, Artificial Sequence
  Synthetic
cctaatgtaaatgtgtttgtgg

SEQ ID NO: 13137 - DNA, 18 bp, Artificial Sequence
  Synthetic
cgcctttacggatgacat

SEQ ID NO: 13138 - DNA, 21 bp, Artificial Sequence
  Synthetic
aggctggagaaatagaaatgc

SEQ ID NO: 13139 - DNA, 18 bp, Artificial Sequence
  Synthetic
tgtggaggttggaaggta

SEQ ID NO: 13140 - DNA, 18 bp, Artificial Sequence
  Synthetic
agcgggtattgatggtga

SEQ ID NO: 13141 - DNA, 19 bp, Artificial Sequence
  Synthetic
aaatgtcctccagatgctg

SEQ ID NO: 13142 - DNA, 21 bp, Artificial Sequence
  Synthetic
catggggtcaatatttttgcc

SEQ ID NO: 13143 - DNA, 21 bp, Artificial Sequence
  Synthetic
tgtattgttcaacaacagctg

SEQ ID NO: 13144 - DNA, 25 bp, Artificial Sequence
  Synthetic
aagacatttgctattagacttttgg

SEQ ID NO: 13145 - DNA, 18 bp, Artificial Sequence
  Synthetic
ggaaattccctggcattg

SEQ ID NO: 13146 - DNA, 25 bp, Artificial Sequence
  Synthetic
atgcattaccatttgataatgaagg

SEQ ID NO: 13147 - DNA, 19 bp, Artificial Sequence
  Synthetic
aaccccagaagactccgtg

SEQ ID NO: 13148 - DNA, 18 bp, Artificial Sequence
  Synthetic
gatttgtcccgtctccag

SEQ ID NO: 13149 - DNA, 18 bp, Artificial Sequence
  Synthetic
ggtctcgggattggtact

SEQ ID NO: 13150 - DNA, 21 bp, Artificial Sequence
  Synthetic
aggttgtaacaacacctgatc

SEQ ID NO: 13151 - DNA, 19 bp, Artificial Sequence
  Synthetic
tgcacattttacaggtgac

SEQ ID NO: 13152 - DNA, 20 bp, Artificial Sequence
  Synthetic
tgaccctgatgtaacaatga

SEQ ID NO: 13153 - DNA, 22 bp, Artificial Sequence
  Synthetic
gtactcctctagaaccttatgc

SEQ ID NO: 13154 - DNA, 20 bp, Artificial Sequence
  Synthetic
ttccatatacttccacgctg

SEQ ID NO: 13155 - DNA, 20 bp, Artificial Sequence
  Synthetic
taggagacacagaaaatccc

SEQ ID NO: 13156 - DNA, 22 bp, Artificial Sequence
  Synthetic
taataggagctcaagacaatca

SEQ ID NO: 13157 - DNA, 18 bp, Artificial Sequence
  Synthetic
ctcccctgcgaggaacca

SEQ ID NO: 13158 - DNA, 20 bp, Artificial Sequence
  Synthetic
accaaaagaaacaccgtccg

SEQ ID NO: 13159 - DNA, 20 bp, Artificial Sequence
  Synthetic
cctcggtaaggtgatcgaca

SEQ ID NO: 13160 - DNA, 20 bp, Artificial Sequence
  Synthetic
aacagacaacgccatcctac

SEQ ID NO: 13161 - DNA, 15 bp, Artificial Sequence
  Synthetic
acgtcaccggccaca

SEQ ID NO: 13162 - DNA, 20 bp, Artificial Sequence
  Synthetic
atgactctttgcagacaggg

SEQ ID NO: 13163 - DNA, 20 bp, Artificial Sequence
  Synthetic
gctcatggatgaacacaacg

SEQ ID NO: 13164 - DNA, 16 bp, Artificial Sequence
  Synthetic
tgcaattggacgcggg

SEQ ID NO: 13165 - DNA, 20 bp, Artificial Sequence
  Synthetic
tgatgatgcttatggcccag

SEQ ID NO: 13166 - DNA, 20 bp, Artificial Sequence
  Synthetic
agcccttattctctggtggg

SEQ ID NO: 13167 - DNA, 16 bp, Artificial Sequence
  Synthetic
cgctggaccggcactt

SEQ ID NO: 13168 - DNA, 19 bp, Artificial Sequence
  Synthetic
ctacccttgtcgtgagcct

SEQ ID NO: 13169 - DNA, 19 bp, Artificial Sequence
  Synthetic
tacagcgtccctactgtcc

SEQ ID NO: 13170 - DNA, 20 bp, Artificial Sequence
  Synthetic
gcttaatccatcagtcgcgg

SEQ ID NO: 13171 - DNA, 18 bp, Artificial Sequence
  Synthetic
cttggcaacgatggggaa

SEQ ID NO: 13172 - DNA, 19 bp, Artificial Sequence
  Synthetic
gacttctccttggacccca

SEQ ID NO: 13173 - DNA, 20 bp, Artificial Sequence
  Synthetic
tactggcagtgttgttgtgg

SEQ ID NO: 13174 - DNA, 20 bp, Artificial Sequence
  Synthetic
actgccaggtaatccaactg

SEQ ID NO: 13175 - DNA, 20 bp, Artificial Sequence
  Synthetic
ctggcaaacctcttacctgc

SEQ ID NO: 13176 - DNA, 19 bp, Artificial Sequence
  Synthetic
tgcatggtcctatccgact

SEQ ID NO: 13177 - DNA, 20 bp, Artificial Sequence
  Synthetic
tcgtcacaatgaccagcatt

SEQ ID NO: 13178 - DNA, 18 bp, Artificial Sequence
  Synthetic
cgagtacgcacctcccca

SEQ ID NO: 13179 - DNA, 18 bp, Artificial Sequence
  Synthetic
ctgcccactcagccagat

SEQ ID NO: 13180 - DNA, 20 bp, Artificial Sequence
  Synthetic
ggcttctcatatgacacccg

SEQ ID NO: 13181 - DNA, 16 bp, Artificial Sequence
  Synthetic
aaagcggctgcagcag

SEQ ID NO: 13182 - DNA, 20 bp, Artificial Sequence
  Synthetic
tgcggtctctacctcttcaa

SEQ ID NO: 13183 - DNA, 23 bp, Artificial Sequence
  Synthetic
atttctaaaaaatgttgctcctg

SEQ ID NO: 13184 - DNA, 25 bp, Artificial Sequence
  Synthetic
cttctagtttgaaaaaatcagaagg

SEQ ID NO: 13185 - DNA, 18 bp, Artificial Sequence
  Synthetic
aacattcccatacaccgg

SEQ ID NO: 13186 - DNA, 24 bp, Artificial Sequence
  Synthetic
ctttggatagaatggatgaagaac

SEQ ID NO: 13187 - DNA, 23 bp, Artificial Sequence
  Synthetic
aaacttggctaaaaatatctgtg

SEQ ID NO: 13188 - DNA, 18 bp, Artificial Sequence
  Synthetic
gagtcgctggagtgaatg

SEQ ID NO: 13189 - DNA, 22 bp, Artificial Sequence
  Synthetic
agagatggtctattagtagcag

SEQ ID NO: 13190 - DNA, 25 bp, Artificial Sequence
  Synthetic
aaaggaacagatctatactaaacac

SEQ ID NO: 13191 - DNA, 20 bp, Artificial Sequence
  Synthetic
ccaaaagcataacaatggcc

SEQ ID NO: 13192 - DNA, 20 bp, Artificial Sequence
  Synthetic
ccagaatgtgataggcttct

SEQ ID NO: 13193 - DNA, 18 bp, Artificial Sequence
  Synthetic
gtctggctgacacgtaaa

SEQ ID NO: 13194 - DNA, 21 bp, Artificial Sequence
  Synthetic
gggacaccataaattttgaga

SEQ ID NO: 13195 - DNA, 21 bp, Artificial Sequence
  Synthetic
gttccccagattgaatcaaga

SEQ ID NO: 13196 - DNA, 21 bp, Artificial Sequence
  Synthetic
gcaaataaatcaattcagccg

SEQ ID NO: 13197 - DNA, 24 bp, Artificial Sequence
  Synthetic
ttaaggagagacataagatgaaag

SEQ ID NO: 13198 - DNA, 21 bp, Artificial Sequence
  Synthetic
ggatagatctggtcttacagc

SEQ ID NO: 13199 - DNA, 22 bp, Artificial Sequence
  Synthetic
agcatcattattgtctttgact

SEQ ID NO: 13200 - DNA, 21 bp, Artificial Sequence
  Synthetic
acacattagtagtagcgagtg

SEQ ID NO: 13201 - DNA, 23 bp, Artificial Sequence
  Synthetic
tgatttctgatcagttaccaatc

SEQ ID NO: 13202 - DNA, 25 bp, Artificial Sequence
  Synthetic
ccagcagatttacttataaaagaac

SEQ ID NO: 13203 - DNA, 23 bp, Artificial Sequence
  Synthetic
acacacttgaaaatataacaacc

SEQ ID NO: 13204 - DNA, 21 bp, Artificial Sequence
  Synthetic
tgtggttcaactaatcaaaca

SEQ ID NO: 13205 - DNA, 19 bp, Artificial Sequence
  Synthetic
tccaaaaacaaggaccaac

SEQ ID NO: 13206 - DNA, 18 bp, Artificial Sequence
  Synthetic
agcccaccacaaaacaac

SEQ ID NO: 13207 - DNA, 20 bp, Artificial Sequence
  Synthetic
atcagaactacactgctcac

SEQ ID NO: 13208 - DNA, 25 bp, Artificial Sequence
  Synthetic
caaatcaaccagaatcaaaatcaac

SEQ ID NO: 13209 - DNA, 20 bp, Artificial Sequence
  Synthetic
ctagaaggggaagtgaacaa

SEQ ID NO: 13210 - DNA, 19 bp, Artificial Sequence
  Synthetic
aagggtccaacatctgttt

SEQ ID NO: 13211 - DNA, 19 bp, Artificial Sequence
  Synthetic
actgctcctatactgcaag

SEQ ID NO: 13212 - DNA, 19 bp, Artificial Sequence
  Synthetic
aaataagtggagctgcaga

SEQ ID NO: 13213 - DNA, 23 bp, Artificial Sequence
  Synthetic
atcaaagttatcttaacaaccct

SEQ ID NO: 13214 - DNA, 22 bp, Artificial Sequence
  Synthetic
caatagactggcagttactgag

SEQ ID NO: 13215 - DNA, 21 bp, Artificial Sequence
  Synthetic
cttagcataggaattcttggg

SEQ ID NO: 13216 - DNA, 20 bp, Artificial Sequence
  Synthetic
atcactcccctgtgaggaac

SEQ ID NO: 13217 - DNA, 20 bp, Artificial Sequence
  Synthetic
accaaacgtaacaccaaccg

SEQ ID NO: 13218 - DNA, 20 bp, Artificial Sequence
  Synthetic
catcgatacccttacgtgcg

SEQ ID NO: 13219 - DNA, 16 bp, Artificial Sequence
  Synthetic
gccgatgccatcctgc

SEQ ID NO: 13220 - DNA, 20 bp, Artificial Sequence
  Synthetic
tgatgatgaactggtcccct

SEQ ID NO: 13221 - DNA, 20 bp, Artificial Sequence
  Synthetic
ttcaactcttcaggctgtcc

SEQ ID NO: 13222 - DNA, 20 bp, Artificial Sequence
  Synthetic
tccttaacaacaccaggcca

SEQ ID NO: 13223 - DNA, 16 bp, Artificial Sequence
  Synthetic
gcacaggctggaagcg

SEQ ID NO: 13224 - DNA, 18 bp, Artificial Sequence
  Synthetic
cggctttggagaacctcg

SEQ ID NO: 13225 - DNA, 19 bp, Artificial Sequence
  Synthetic
tgtgtagtacacccgaccc

SEQ ID NO: 13226 - DNA, 17 bp, Artificial Sequence
  Synthetic
agactgggcgcacaacg

SEQ ID NO: 13227 - DNA, 20 bp, Artificial Sequence
  Synthetic
aactgctacccaaaccttcc

SEQ ID NO: 13228 - DNA, 16 bp, Artificial Sequence
  Synthetic
cacgccgtgggcctat

SEQ ID NO: 13229 - DNA, 20 bp, Artificial Sequence
  Synthetic
cctaatatcaggaccggggt

SEQ ID NO: 13230 - DNA, 19 bp, Artificial Sequence
  Synthetic
ggtgatcaaggggggaaga

SEQ ID NO: 13231 - DNA, 18 bp, Artificial Sequence
  Synthetic
caggactggcagggggaa

SEQ ID NO: 13232 - DNA, 19 bp, Artificial Sequence
  Synthetic
ccatcgtgggaccagatgt

SEQ ID NO: 13233 - DNA, 20 bp, Artificial Sequence
  Synthetic
gatggaagagtgctctcagc

SEQ ID NO: 13234 - DNA, 20 bp, Artificial Sequence
  Synthetic
tcaacatattgggggggtgg

SEQ ID NO: 13235 - DNA, 19 bp, Artificial Sequence
  Synthetic
gctaatagccttcgcctcc

SEQ ID NO: 13236 - DNA, 18 bp, Artificial Sequence
  Synthetic
ttatgcacactcgctgcc

SEQ ID NO: 13237 - DNA, 18 bp, Artificial Sequence
  Synthetic
gcgcctacacaggtttgc

SEQ ID NO: 13238 - DNA, 16 bp, Artificial Sequence
  Synthetic
caggagatgggcggca

SEQ ID NO: 13239 - DNA, 20 bp, Artificial Sequence
  Synthetic
cctatctactgccttggccg

SEQ ID NO: 13240 - DNA, 18 bp, Artificial Sequence
  Synthetic
caactcgttgctacgcca

SEQ ID NO: 13241 - DNA, 20 bp, Artificial Sequence
  Synthetic
gaacgaggttttctgcgttc

SEQ ID NO: 13242 - DNA, 20 bp, Artificial Sequence
  Synthetic
accaatgttgtgacctggac

SEQ ID NO: 13243 - DNA, 19 bp, Artificial Sequence
  Synthetic
acatcatgctcctccaacg

SEQ ID NO: 13244 - DNA, 20 bp, Artificial Sequence
  Synthetic
ttcaaagactccatggcctc

SEQ ID NO: 13245 - DNA, 18 bp, Artificial Sequence
  Synthetic
actttgtgcgacaatgct

SEQ ID NO: 13246 - DNA, 18 bp, Artificial Sequence
  Synthetic
gaacaatggcctggacag

SEQ ID NO: 13247 - DNA, 18 bp, Artificial Sequence
  Synthetic
attacctcctggcttgga

SEQ ID NO: 13248 - DNA, 22 bp, Artificial Sequence
  Synthetic
ttgacagattcaagttggattg

SEQ ID NO: 13249 - DNA, 25 bp, Artificial Sequence
  Synthetic
ttataaaaggaagatcccatttgag

SEQ ID NO: 13250 - DNA, 19 bp, Artificial Sequence
  Synthetic
gcccttttcaatcccttca

SEQ ID NO: 13251 - DNA, 21 bp, Artificial Sequence
  Synthetic
tattgaggaattgtcaaggga

SEQ ID NO: 13252 - DNA, 20 bp, Artificial Sequence
  Synthetic
ctcatcggaggacttgaatg

SEQ ID NO: 13253 - DNA, 22 bp, Artificial Sequence
  Synthetic
cgaaaccggtacatataaaagc

SEQ ID NO: 13254 - DNA, 18 bp, Artificial Sequence
  Synthetic
atgcatggaaatgtggct

SEQ ID NO: 13255 - DNA, 18 bp, Artificial Sequence
  Synthetic
catggcggataaccaagg

SEQ ID NO: 13256 - DNA, 20 bp, Artificial Sequence
  Synthetic
ggcagtccgtatgtaagtcc

SEQ ID NO: 13257 - DNA, 19 bp, Artificial Sequence
  Synthetic
tgctacaacacaatgctgg

SEQ ID NO: 13258 - DNA, 18 bp, Artificial Sequence
  Synthetic
gtcacgtttagcgctgaa

SEQ ID NO: 13259 - DNA, 18 bp, Artificial Sequence
  Synthetic
gcacaaggccattgaact

SEQ ID NO: 13260 - DNA, 22 bp, Artificial Sequence
  Synthetic
aggtgtgcagtaatatagatgc

SEQ ID NO: 13261 - DNA, 19 bp, Artificial Sequence
  Synthetic
caggaccctgcctttttac

SEQ ID NO: 13262 - DNA, 21 bp, Artificial Sequence
  Synthetic
atacacctatacccacatcct

SEQ ID NO: 13263 - DNA, 21 bp, Artificial Sequence
  Synthetic
ggctatggattttaaaaccct

SEQ ID NO: 13264 - DNA, 20 bp, Artificial Sequence
  Synthetic
aactcctagtggctctatgg

SEQ ID NO: 13265 - DNA, 23 bp, Artificial Sequence
  Synthetic
agatgttatggcctatattcatg

SEQ ID NO: 13266 - DNA, 16 bp, Artificial Sequence
  Synthetic
ccgccgccttacctga

SEQ ID NO: 13267 - DNA, 17 bp, Artificial Sequence
  Synthetic
caactctgctggctcgg

SEQ ID NO: 13268 - DNA, 18 bp, Artificial Sequence
  Synthetic
ccctcctagccagcctac

SEQ ID NO: 13269 - DNA, 19 bp, Artificial Sequence
  Synthetic
ggaagcccccagtttatgc

SEQ ID NO: 13270 - DNA, 20 bp, Artificial Sequence
  Synthetic
aaggcgagaataccagcaac

SEQ ID NO: 13271 - DNA, 18 bp, Artificial Sequence
  Synthetic
cctggacccccaaagaca

SEQ ID NO: 13272 - DNA, 20 bp, Artificial Sequence
  Synthetic
ggtcgtgatgccttacaaca

SEQ ID NO: 13273 - DNA, 18 bp, Artificial Sequence
  Synthetic
ggaggcaggccatatcga

SEQ ID NO: 13274 - DNA, 18 bp, Artificial Sequence
  Synthetic
ccggcactagatacgcct

SEQ ID NO: 13275 - DNA, 18 bp, Artificial Sequence
  Synthetic
ctgggcgctacctgaact

SEQ ID NO: 13276 - DNA, 19 bp, Artificial Sequence
  Synthetic
ccactgtggtgttccagtc

SEQ ID NO: 13277 - DNA, 18 bp, Artificial Sequence
  Synthetic
aaggcaggtcctctcagg

SEQ ID NO: 13278 - DNA, 21 bp, Artificial Sequence
  Synthetic
taggcaagcctagctacataa

SEQ ID NO: 13279 - DNA, 19 bp, Artificial Sequence
  Synthetic
tggaaaggaccacaggagg

SEQ ID NO: 13280 - DNA, 20 bp, Artificial Sequence
  Synthetic
catcctcggtgattacagcc

SEQ ID NO: 13281 - DNA, 21 bp, Artificial Sequence
  Synthetic
ctcttattcagacccttgttc

SEQ ID NO: 13282 - DNA, 20 bp, Artificial Sequence
  Synthetic
cataactccctcatcctgcc

SEQ ID NO: 13283 - DNA, 20 bp, Artificial Sequence
  Synthetic
aaaccctgagtcatccctgt

SEQ ID NO: 13284 - DNA, 15 bp, Artificial Sequence
  Synthetic
tgcgccgtgccttct

SEQ ID NO: 13285 - DNA, 20 bp, Artificial Sequence
  Synthetic
ccaaggataatagcccgtcc

SEQ ID NO: 13286 - DNA, 20 bp, Artificial Sequence
  Synthetic
gagcatcagatcacctggga

SEQ ID NO: 13287 - DNA, 20 bp, Artificial Sequence
  Synthetic
tttggacatttaccgatggc

SEQ ID NO: 13288 - DNA, 19 bp, Artificial Sequence
  Synthetic
taaggctctgacgtctccc

SEQ ID NO: 13289 - DNA, 20 bp, Artificial Sequence
  Synthetic
ataaaagcgtggggacagtt

SEQ ID NO: 13290 - DNA, 19 bp, Artificial Sequence
  Synthetic
aatctgatgtcgcagtctc

SEQ ID NO: 13291 - DNA, 19 bp, Artificial Sequence
  Synthetic
ggtcagatcgagtaatggt

SEQ ID NO: 13292 - DNA, 21 bp, Artificial Sequence
  Synthetic
ggatactaacgtcggaatcac

SEQ ID NO: 13293 - DNA, 22 bp, Artificial Sequence
  Synthetic
caaagtctaattattgcagcca

SEQ ID NO: 13294 - DNA, 19 bp, Artificial Sequence
  Synthetic
agcgggtcatcaatcaaga

SEQ ID NO: 13295 - DNA, 22 bp, Artificial Sequence
  Synthetic
gacctgaatttcgttaataggg

SEQ ID NO: 13296 - DNA, 19 bp, Artificial Sequence
  Synthetic
ttgaccggtttttgagagt

SEQ ID NO: 13297 - DNA, 21 bp, Artificial Sequence
  Synthetic
tctttagttcctaaggccatt

SEQ ID NO: 13298 - DNA, 20 bp, Artificial Sequence
  Synthetic
aacaattctcggaaaggatg

SEQ ID NO: 13299 - DNA, 20 bp, Artificial Sequence
  Synthetic
cttgaggaaatgtcaaggga

SEQ ID NO: 13300 - DNA, 19 bp, Artificial Sequence
  Synthetic
cttccaggacatactgctg

SEQ ID NO: 13301 - DNA, 18 bp, Artificial Sequence
  Synthetic
ccagcgcaaaatgccata

SEQ ID NO: 13302 - DNA, 22 bp, Artificial Sequence
  Synthetic
tatggctttccttgaagaatcc

SEQ ID NO: 13303 - DNA, 21 bp, Artificial Sequence
  Synthetic
aaggagagtaagagacaacat

SEQ ID NO: 13304 - DNA, 18 bp, Artificial Sequence
  Synthetic
gcgaaaagcttgaacagt

SEQ ID NO: 13305 - DNA, 21 bp, Artificial Sequence
  Synthetic
tgttctcaaacaaaatggcaa

SEQ ID NO: 13306 - DNA, 23 bp, Artificial Sequence
  Synthetic
caaaagaaatacaccaagacaat

SEQ ID NO: 13307 - DNA, 21 bp, Artificial Sequence
  Synthetic
tctggagtaaatgaatcagct

SEQ ID NO: 13308 - DNA, 17 bp, Artificial Sequence
  Synthetic
gctggtgcatgtgggga

SEQ ID NO: 13309 - DNA, 19 bp, Artificial Sequence
  Synthetic
ttttactcggaggccacgg

SEQ ID NO: 13310 - DNA, 20 bp, Artificial Sequence
  Synthetic
cagatcacacgctctttcct

SEQ ID NO: 13311 - DNA, 20 bp, Artificial Sequence
  Synthetic
gtagacggggtagggagatc

SEQ ID NO: 13312 - DNA, 18 bp, Artificial Sequence
  Synthetic
aacggataacgcggtggc

SEQ ID NO: 13313 - DNA, 20 bp, Artificial Sequence
  Synthetic
caactcttactgctctctcc

SEQ ID NO: 13314 - DNA, 20 bp, Artificial Sequence
  Synthetic
tcataaagctgttgaccggc

SEQ ID NO: 13315 - DNA, 20 bp, Artificial Sequence
  Synthetic
tacgggagatacaaggagcg

SEQ ID NO: 13316 - DNA, 16 bp, Artificial Sequence
  Synthetic
gcagccggcagaggat

SEQ ID NO: 13317 - DNA, 17 bp, Artificial Sequence
  Synthetic
tgttacatcgccggcgg

SEQ ID NO: 13318 - DNA, 16 bp, Artificial Sequence
  Synthetic
cactcggaccgctcct

SEQ ID NO: 13319 - DNA, 16 bp, Artificial Sequence
  Synthetic
gcgaactgtgcgtgcc

SEQ ID NO: 13320 - DNA, 18 bp, Artificial Sequence
  Synthetic
cctgctgtgctactggtg

SEQ ID NO: 13321 - DNA, 18 bp, Artificial Sequence
  Synthetic
ggtgagctggggaacagg

SEQ ID NO: 13322 - DNA, 20 bp, Artificial Sequence
  Synthetic
ttccacgctgttttcgaaac

SEQ ID NO: 13323 - DNA, 18 bp, Artificial Sequence
  Synthetic
caggtagcgcatgcagtg

SEQ ID NO: 13324 - DNA, 18 bp, Artificial Sequence
  Synthetic
tgcgcttcagatcgtgga

SEQ ID NO: 13325 - DNA, 18 bp, Artificial Sequence
  Synthetic
gggctccagaaacaggca

SEQ ID NO: 13326 - DNA, 16 bp, Artificial Sequence
  Synthetic
tggatgggctccgggt

SEQ ID NO: 13327 - DNA, 19 bp, Artificial Sequence
  Synthetic
aactcctgctgctcactgt

SEQ ID NO: 13328 - DNA, 18 bp, Artificial Sequence
  Synthetic
caggacgtggtgacctcg

SEQ ID NO: 13329 - DNA, 16 bp, Artificial Sequence
  Synthetic
tcaccaagggcgggct

SEQ ID NO: 13330 - DNA, 18 bp, Artificial Sequence
  Synthetic
ctcggacaagatcacggc

SEQ ID NO: 13331 - DNA, 17 bp, Artificial Sequence
  Synthetic
cctgcggggaaacgaga

SEQ ID NO: 13332 - DNA, 17 bp, Artificial Sequence
  Synthetic
tctggccgatggctgtg

SEQ ID NO: 13333 - DNA, 15 bp, Artificial Sequence
  Synthetic
cgtgtgcgcgctctt

SEQ ID NO: 13334 - DNA, 18 bp, Artificial Sequence
  Synthetic
agggctgctccaactttg

SEQ ID NO: 13335 - DNA, 16 bp, Artificial Sequence
  Synthetic
attgcgggacctgcgc

SEQ ID NO: 13336 - DNA, 17 bp, Artificial Sequence
  Synthetic
ggtgcacagcgacagtg

SEQ ID NO: 13337 - DNA, 16 bp, Artificial Sequence
  Synthetic
cgccgcggtagagcat

SEQ ID NO: 13338 - DNA, 18 bp, Artificial Sequence
  Synthetic
gccgctcagattccagga

SEQ ID NO: 13339 - DNA, 17 bp, Artificial Sequence
  Synthetic
ccaccgggaacaaagcg

SEQ ID NO: 13340 - DNA, 20 bp, Artificial Sequence
  Synthetic
actacatcaaagggtcggct

SEQ ID NO: 13341 - DNA, 20 bp, Artificial Sequence
  Synthetic
atcagcaacgtgttatcggc

SEQ ID NO: 13342 - DNA, 16 bp, Artificial Sequence
  Synthetic
gcagtacgggggtcga

SEQ ID NO: 13343 - DNA, 16 bp, Artificial Sequence
  Synthetic
gaactcgcgacccacg

SEQ ID NO: 13344 - DNA, 16 bp, Artificial Sequence
  Synthetic
ggtgccgcctggaaca

SEQ ID NO: 13345 - DNA, 17 bp, Artificial Sequence
  Synthetic
cgaagcccacactgacg

SEQ ID NO: 13346 - DNA, 16 bp, Artificial Sequence
  Synthetic
cacgccgatgtgcagc

SEQ ID NO: 13347 - DNA, 16 bp, Artificial Sequence
  Synthetic
cgggctctcgtcctgt

SEQ ID NO: 13348 - DNA, 20 bp, Artificial Sequence
  Synthetic
ccagcccagcttttgtatga

SEQ ID NO: 13349 - DNA, 17 bp, Artificial Sequence
  Synthetic
gcttcctgcgacaccag

SEQ ID NO: 13350 - DNA, 18 bp, Artificial Sequence
  Synthetic
tacccaccacgcgtttcg

SEQ ID NO: 13351 - DNA, 18 bp, Artificial Sequence
  Synthetic
ccgacaccgatcacgaag

SEQ ID NO: 13352 - DNA, 16 bp, Artificial Sequence
  Synthetic
ggcaccaccgagacgt

SEQ ID NO: 13353 - DNA, 18 bp, Artificial Sequence
  Synthetic
cggaatgtcacaacgccg

SEQ ID NO: 13354 - DNA, 20 bp, Artificial Sequence
  Synthetic
gacattcacgacctagacgc

SEQ ID NO: 13355 - DNA, 18 bp, Artificial Sequence
  Synthetic
ggccttggtacaggagca

SEQ ID NO: 13356 - DNA, 18 bp, Artificial Sequence
  Synthetic
cgcaccaaccactggagg

SEQ ID NO: 13357 - DNA, 15 bp, Artificial Sequence
  Synthetic
tgagcacggcgcaga

SEQ ID NO: 13358 - DNA, 19 bp, Artificial Sequence
  Synthetic
gctggcttttctggaggaa

SEQ ID NO: 13359 - DNA, 16 bp, Artificial Sequence
  Synthetic
acgtggcaggcggtct

SEQ ID NO: 13360 - DNA, 19 bp, Artificial Sequence
  Synthetic
agcctggtggaactcatca

SEQ ID NO: 13361 - DNA, 19 bp, Artificial Sequence
  Synthetic
ggctttcttggcgtacagc

SEQ ID NO: 13362 - DNA, 16 bp, Artificial Sequence
  Synthetic
tccgcgtcctcgtcga

SEQ ID NO: 13363 - DNA, 16 bp, Artificial Sequence
  Synthetic
gtccacgccgcctcat

SEQ ID NO: 13364 - DNA, 17 bp, Artificial Sequence
  Synthetic
tagttgcacacggccga

SEQ ID NO: 13365 - DNA, 16 bp, Artificial Sequence
  Synthetic
tggcgccctggtacga

SEQ ID NO: 13366 - DNA, 16 bp, Artificial Sequence
  Synthetic
aagggcggcgacatct

SEQ ID NO: 13367 - DNA, 18 bp, Artificial Sequence
  Synthetic
cgggtgacgttgtggatg

SEQ ID NO: 13368 - DNA, 16 bp, Artificial Sequence
  Synthetic
gtccgtcgccgctgtt

SEQ ID NO: 13369 - DNA, 19 bp, Artificial Sequence
  Synthetic
aacttgtccatcagcgacg

SEQ ID NO: 13370 - DNA, 16 bp, Artificial Sequence
  Synthetic
aggcgcacctccgaaa

SEQ ID NO: 13371 - DNA, 16 bp, Artificial Sequence
  Synthetic
tcggtaggcacgcgat

SEQ ID NO: 13372 - DNA, 20 bp, Artificial Sequence
  Synthetic
cgtcgtaacaaagcacaggc

SEQ ID NO: 13373 - DNA, 17 bp, Artificial Sequence
  Synthetic
acaaccgcaacgatccc

SEQ ID NO: 13374 - DNA, 18 bp, Artificial Sequence
  Synthetic
ctggaggggtccggaaca

SEQ ID NO: 13375 - DNA, 18 bp, Artificial Sequence
  Synthetic
gtcttcttgcggtaccgg

SEQ ID NO: 13376 - DNA, 19 bp, Artificial Sequence
  Synthetic
actgttgacggatgtgcaa

SEQ ID NO: 13377 - DNA, 19 bp, Artificial Sequence
  Synthetic
gtcgtcgtcatcgaaaggc

SEQ ID NO: 13378 - DNA, 17 bp, Artificial Sequence
  Synthetic
cgagaaacggctgtcgg

SEQ ID NO: 13379 - DNA, 16 bp, Artificial Sequence
  Synthetic
ggcggcccagaaaacc

SEQ ID NO: 13380 - DNA, 20 bp, Artificial Sequence
  Synthetic
cacgcgtcctatgatgagtt

SEQ ID NO: 13381 - DNA, 18 bp, Artificial Sequence
  Synthetic
gattcgacggggaacgct

SEQ ID NO: 13382 - DNA, 17 bp, Artificial Sequence
  Synthetic
gacacgcgctttgggag

SEQ ID NO: 13383 - DNA, 18 bp, Artificial Sequence
  Synthetic
acgctactacatgcccct

SEQ ID NO: 13384 - DNA, 17 bp, Artificial Sequence
  Synthetic
gaatttgcccgtgcgga

SEQ ID NO: 13385 - DNA, 17 bp, Artificial Sequence
  Synthetic
acgaccagtctccggac

SEQ ID NO: 13386 - DNA, 16 bp, Artificial Sequence
  Synthetic
ccgttcttcccgcgga

SEQ ID NO: 13387 - DNA, 20 bp, Artificial Sequence
  Synthetic
acgtggatccccattatccc

SEQ ID NO: 13388 - DNA, 17 bp, Artificial Sequence
  Synthetic
tggtcaccgtggtcagt

SEQ ID NO: 13389 - DNA, 16 bp, Artificial Sequence
  Synthetic
agcgtgagagccccgt

SEQ ID NO: 13390 - DNA, 19 bp, Artificial Sequence
  Synthetic
cggaaaaagtggatgcggc

SEQ ID NO: 13391 - DNA, 15 bp, Artificial Sequence
  Synthetic
gcagcgcaaaggcca

SEQ ID NO: 13392 - DNA, 20 bp, Artificial Sequence
  Synthetic
aaaacagcagagaaccgagg

SEQ ID NO: 13393 - DNA, 18 bp, Artificial Sequence
  Synthetic
actggttctgctgacgcg

SEQ ID NO: 13394 - DNA, 19 bp, Artificial Sequence
  Synthetic
agcgcgtacacatagatcg

SEQ ID NO: 13395 - DNA, 16 bp, Artificial Sequence
  Synthetic
ggacgccagtcgcatg

SEQ ID NO: 13396 - DNA, 20 bp, Artificial Sequence
  Synthetic
agatacgtaacgtgtgcgag

SEQ ID NO: 13397 - DNA, 18 bp, Artificial Sequence
  Synthetic
tacggctggtgagtccac

SEQ ID NO: 13398 - DNA, 18 bp, Artificial Sequence
  Synthetic
tcctggcacttgacgagc

SEQ ID NO: 13399 - DNA, 20 bp, Artificial Sequence
  Synthetic
aagtaatggtctgcagctgc

SEQ ID NO: 13400 - DNA, 18 bp, Artificial Sequence
  Synthetic
atcgagtcttcgggggtg

SEQ ID NO: 13401 - DNA, 18 bp, Artificial Sequence
  Synthetic
ttccatgttacgcggcag

SEQ ID NO: 13402 - DNA, 16 bp, Artificial Sequence
  Synthetic
gcaccgcccatgggtt

SEQ ID NO: 13403 - DNA, 16 bp, Artificial Sequence
  Synthetic
ccggcgctggtcttga

SEQ ID NO: 13404 - DNA, 18 bp, Artificial Sequence
  Synthetic
gcctgtccgatacacgtg

SEQ ID NO: 13405 - DNA, 19 bp, Artificial Sequence
  Synthetic
gacgttgttgttgcggatc

SEQ ID NO: 13406 - DNA, 18 bp, Artificial Sequence
  Synthetic
accgtcagaatcgacggt

SEQ ID NO: 13407 - DNA, 16 bp, Artificial Sequence
  Synthetic
gtcaacggcggtcgga

SEQ ID NO: 13408 - DNA, 19 bp, Artificial Sequence
  Synthetic
gaagggctgttcgatgtgg

SEQ ID NO: 13409 - DNA, 17 bp, Artificial Sequence
  Synthetic
cacctgcgagttgaggc

SEQ ID NO: 13410 - DNA, 18 bp, Artificial Sequence
  Synthetic
cgtgttcgagcacctgac

SEQ ID NO: 13411 - DNA, 20 bp, Artificial Sequence
  Synthetic
cgtagccacctgttggaacc

SEQ ID NO: 13412 - DNA, 17 bp, Artificial Sequence
  Synthetic
ccgcagaaggccatgag

SEQ ID NO: 13413 - DNA, 16 bp, Artificial Sequence
  Synthetic
tggcggccgaatctcc

SEQ ID NO: 13414 - DNA, 19 bp, Artificial Sequence
  Synthetic
cgtcttcgtcgtccctagt

SEQ ID NO: 13415 - DNA, 17 bp, Artificial Sequence
  Synthetic
cgtgatgcgtgacggag

SEQ ID NO: 13416 - DNA, 18 bp, Artificial Sequence
  Synthetic
gcgcgaatgttaccaccc

SEQ ID NO: 13417 - DNA, 17 bp, Artificial Sequence
  Synthetic
catgggtacggaggcgt

SEQ ID NO: 13418 - DNA, 20 bp, Artificial Sequence
  Synthetic
gcataatctgcgaggaggac

SEQ ID NO: 13419 - DNA, 20 bp, Artificial Sequence
  Synthetic
gtctctacgctcctacgaca

SEQ ID NO: 13420 - DNA, 17 bp, Artificial Sequence
  Synthetic
gcactgggcgtggaaac

SEQ ID NO: 13421 - DNA, 20 bp, Artificial Sequence
  Synthetic
cctacgatttggccatgtcg

SEQ ID NO: 13422 - DNA, 20 bp, Artificial Sequence
  Synthetic
attggcgcaaactttttggc

SEQ ID NO: 13423 - DNA, 16 bp, Artificial Sequence
  Synthetic
cgcgaagtgcagcagg

SEQ ID NO: 13424 - DNA, 17 bp, Artificial Sequence
  Synthetic
tggaaaccagcagcccg

SEQ ID NO: 13425 - DNA, 18 bp, Artificial Sequence
  Synthetic
tggcggtcaccactttca

SEQ ID NO: 13426 - DNA, 17 bp, Artificial Sequence
  Synthetic
gcgctccacaccaacag

SEQ ID NO: 13427 - DNA, 16 bp, Artificial Sequence
  Synthetic
tccagcgcctgcagat

SEQ ID NO: 13428 - DNA, 20 bp, Artificial Sequence
  Synthetic
ccttatgctgcgctacatgc

SEQ ID NO: 13429 - DNA, 16 bp, Artificial Sequence
  Synthetic
ccagagcgtgccggta

SEQ ID NO: 13430 - DNA, 18 bp, Artificial Sequence
  Synthetic
ggcgctgctttctttcga

SEQ ID NO: 13431 - DNA, 16 bp, Artificial Sequence
  Synthetic
ggctccttcgtgggca

SEQ ID NO: 13432 - DNA, 20 bp, Artificial Sequence
  Synthetic
ctttgtgctcgacgttaacg

SEQ ID NO: 13433 - DNA, 18 bp, Artificial Sequence
  Synthetic
gcctccggatcacatggt

SEQ ID NO: 13434 - DNA, 16 bp, Artificial Sequence
  Synthetic
tgtacacggccggcga

SEQ ID NO: 13435 - DNA, 18 bp, Artificial Sequence
  Synthetic
gtaggagcgacgctgacg

SEQ ID NO: 13436 - DNA, 20 bp, Artificial Sequence
  Synthetic
tgaagtgacgttaggggagg

SEQ ID NO: 13437 - DNA, 20 bp, Artificial Sequence
  Synthetic
ccacatctggtatacacccg

SEQ ID NO: 13438 - DNA, 20 bp, Artificial Sequence
  Synthetic
tacttttcactcccgggtgc

SEQ ID NO: 13439 - DNA, 19 bp, Artificial Sequence
  Synthetic
gcgtacaggagtcctaggt

SEQ ID NO: 13440 - DNA, 17 bp, Artificial Sequence
  Synthetic
tgcaagcccattccccg

SEQ ID NO: 13441 - DNA, 16 bp, Artificial Sequence
  Synthetic
acgcagcccagcctag

SEQ ID NO: 13442 - DNA, 18 bp, Artificial Sequence
  Synthetic
acaggaagcttacagggt

SEQ ID NO: 13443 - DNA, 21 bp, Artificial Sequence
  Synthetic
atatgtgcggtatgattttgc

SEQ ID NO: 13444 - DNA, 19 bp, Artificial Sequence
  Synthetic
tgattccgtagacgccagg

SEQ ID NO: 13445 - DNA, 18 bp, Artificial Sequence
  Synthetic
tgcgcgaatggaaaccat

SEQ ID NO: 13446 - DNA, 20 bp, Artificial Sequence
  Synthetic
ggatctacgtcccagtctct

SEQ ID NO: 13447 - DNA, 18 bp, Artificial Sequence
  Synthetic
cgacgtcgtacgagtcgc

SEQ ID NO: 13448 - DNA, 19 bp, Artificial Sequence
  Synthetic
cgagagattctccagcccg

SEQ ID NO: 13449 - DNA, 18 bp, Artificial Sequence
  Synthetic
ttgcaacagcttcgacgg

SEQ ID NO: 13450 - DNA, 17 bp, Artificial Sequence
  Synthetic
gcggatgctggtcgttg

SEQ ID NO: 13451 - DNA, 16 bp, Artificial Sequence
  Synthetic
cagctccaagcgccgt

SEQ ID NO: 13452 - DNA, 19 bp, Artificial Sequence
  Synthetic
gaaagccgtcccggtcatt

SEQ ID NO: 13453 - DNA, 15 bp, Artificial Sequence
  Synthetic
tgtggtgcacggcgt

SEQ ID NO: 13454 - DNA, 16 bp, Artificial Sequence
  Synthetic
ggatcggtcgtcgcgt

SEQ ID NO: 13455 - DNA, 16 bp, Artificial Sequence
  Synthetic
tggcgtgcgaggaaga

SEQ ID NO: 13456 - DNA, 19 bp, Artificial Sequence
  Synthetic
gatgtcgggcgtccaccta

SEQ ID NO: 13457 - DNA, 19 bp, Artificial Sequence
  Synthetic
aaagcctggttggatctcg

SEQ ID NO: 13458 - DNA, 18 bp, Artificial Sequence
  Synthetic
tagcctcctccaccacgg

SEQ ID NO: 13459 - DNA, 20 bp, Artificial Sequence
  Synthetic
cttgaagtacagcatgccca

SEQ ID NO: 13460 - DNA, 19 bp, Artificial Sequence
  Synthetic
aaaccgcgactttccacac

SEQ ID NO: 13461 - DNA, 18 bp, Artificial Sequence
  Synthetic
gcccacccccattacacg

SEQ ID NO: 13462 - DNA, 18 bp, Artificial Sequence
  Synthetic
acggatcaagaggtccat

SEQ ID NO: 13463 - DNA, 16 bp, Artificial Sequence
  Synthetic
gctctcggggccgtat

SEQ ID NO: 13464 - DNA, 20 bp, Artificial Sequence
  Synthetic
agcgttcataacaatcccgg

SEQ ID NO: 13465 - DNA, 17 bp, Artificial Sequence
  Synthetic
gttgcaggccacgaaca

SEQ ID NO: 13466 - DNA, 18 bp, Artificial Sequence
  Synthetic
accggtgtgcagctaagc

SEQ ID NO: 13467 - DNA, 17 bp, Artificial Sequence
  Synthetic
gacccaagccagactgc

SEQ ID NO: 13468 - DNA, 18 bp, Artificial Sequence
  Synthetic
ggccggcgagtaatagca

SEQ ID NO: 13469 - DNA, 16 bp, Artificial Sequence
  Synthetic
agccgccgaaacacga

SEQ ID NO: 13470 - DNA, 18 bp, Artificial Sequence
  Synthetic
ccgaaagcgtcgtgagca

SEQ ID NO: 13471 - DNA, 19 bp, Artificial Sequence
  Synthetic
taggggactacctcctcga

SEQ ID NO: 13472 - DNA, 18 bp, Artificial Sequence
  Synthetic
ccaatcggcgtcgcttag

SEQ ID NO: 13473 - DNA, 18 bp, Artificial Sequence
  Synthetic
gggacctgtttcagcgtg

SEQ ID NO: 13474 - DNA, 20 bp, Artificial Sequence
  Synthetic
gcgtaaatctgcgggatagc

SEQ ID NO: 13475 - DNA, 16 bp, Artificial Sequence
  Synthetic
tcgcctcgacagagcc

SEQ ID NO: 13476 - DNA, 17 bp, Artificial Sequence
  Synthetic
aagttcacgtcgcgtcc

SEQ ID NO: 13477 - DNA, 16 bp, Artificial Sequence
  Synthetic
tccggcatggtgctgc

SEQ ID NO: 13478 - DNA, 20 bp, Artificial Sequence
  Synthetic
ataacgccatgggatcctca

SEQ ID NO: 13479 - DNA, 19 bp, Artificial Sequence
  Synthetic
cctgaacagaccgctaacc

SEQ ID NO: 13480 - DNA, 19 bp, Artificial Sequence
  Synthetic
ctgatgctgttgtcgtgca

SEQ ID NO: 13481 - DNA, 18 bp, Artificial Sequence
  Synthetic
ccaccaccgcattaaccg

SEQ ID NO: 13482 - DNA, 18 bp, Artificial Sequence
  Synthetic
ggaccttctgggaccagt

SEQ ID NO: 13483 - DNA, 20 bp, Artificial Sequence
  Synthetic
ataggcagcgacgtgtatgg

SEQ ID NO: 13484 - DNA, 16 bp, Artificial Sequence
  Synthetic
ggacgcccgacatcca

SEQ ID NO: 13485 - DNA, 18 bp, Artificial Sequence
  Synthetic
ctttgtgcgacagtgctt

SEQ ID NO: 13486 - DNA, 19 bp, Artificial Sequence
  Synthetic
tggacagtggtgaatagca

SEQ ID NO: 13487 - DNA, 20 bp, Artificial Sequence
  Synthetic
taagacaggaaatggcaagc

SEQ ID NO: 13488 - DNA, 21 bp, Artificial Sequence
  Synthetic
aaacaagccaattaatgtggg

SEQ ID NO: 13489 - DNA, 20 bp, Artificial Sequence
  Synthetic
gattcgagctggatagaact

SEQ ID NO: 13490 - DNA, 23 bp, Artificial Sequence
  Synthetic
gttcattataaaaggaaggtccc

SEQ ID NO: 13491 - DNA, 20 bp, Artificial Sequence
  Synthetic
ctgccttcttcaatctcttc

SEQ ID NO: 13492 - DNA, 22 bp, Artificial Sequence
  Synthetic
gatcctatgaacagatggaaac

SEQ ID NO: 13493 - DNA, 20 bp, Artificial Sequence
  Synthetic
aggtccaatttacaggagaa

SEQ ID NO: 13494 - DNA, 19 bp, Artificial Sequence
  Synthetic
atggaactgattcggatga

SEQ ID NO: 13495 - DNA, 21 bp, Artificial Sequence
  Synthetic
attagagggacaagaatggtc

SEQ ID NO: 13496 - DNA, 20 bp, Artificial Sequence
  Synthetic
gaaatgatgttttttgggcg

SEQ ID NO: 13497 - DNA, 18 bp, Artificial Sequence
  Synthetic
ggcgccattatgagaact

SEQ ID NO: 13498 - DNA, 19 bp, Artificial Sequence
  Synthetic
cacaactgcaccctgaaga

SEQ ID NO: 13499 - DNA, 18 bp, Artificial Sequence
  Synthetic
gaagtgcggttccagaag

SEQ ID NO: 13500 - DNA, 22 bp, Artificial Sequence
  Synthetic
tcttagtaatggagttggaaac

SEQ ID NO: 13501 - DNA, 20 bp, Artificial Sequence
  Synthetic
acatgtcaatgcagctgtgg

SEQ ID NO: 13502 - DNA, 19 bp, Artificial Sequence
  Synthetic
gcttttgctaaattggcct

SEQ ID NO: 13503 - DNA, 24 bp, Artificial Sequence
  Synthetic
gtgtacttgctttaattgtagagg

SEQ ID NO: 13504 - DNA, 20 bp, Artificial Sequence
  Synthetic
gtaacttcagccactcaaac

SEQ ID NO: 13505 - DNA, 20 bp, Artificial Sequence
  Synthetic
aggatctacagtggacggtc

SEQ ID NO: 13506 - DNA, 18 bp, Artificial Sequence
  Synthetic
gtaagctcttgaccaccg

SEQ ID NO: 13507 - DNA, 23 bp, Artificial Sequence
  Synthetic
tgattgtattttgagattggcaa

SEQ ID NO: 13508 - DNA, 20 bp, Artificial Sequence
  Synthetic
acagtttctggagcaggtgt

SEQ ID NO: 13509 - DNA, 18 bp, Artificial Sequence
  Synthetic
gcttcagcagttgcaagc

SEQ ID NO: 13510 - DNA, 19 bp, Artificial Sequence
  Synthetic
aagacaaagcctctgtagc

SEQ ID NO: 13511 - DNA, 22 bp, Artificial Sequence
  Synthetic
tccgtatacagatttaaggggt

SEQ ID NO: 13512 - DNA, 19 bp, Artificial Sequence
  Synthetic
cttggtcttcatcgctttc

SEQ ID NO: 13513 - DNA, 20 bp, Artificial Sequence
  Synthetic
ttgcggcaatattgagttgc

SEQ ID NO: 13514 - DNA, 18 bp, Artificial Sequence
  Synthetic
gcccgctcataggggtta

SEQ ID NO: 13515 - DNA, 21 bp, Artificial Sequence
  Synthetic
aggtattcctccttatccttc

SEQ ID NO: 13516 - DNA, 23 bp, Artificial Sequence
  Synthetic
aaataatattttgccagctcttg

SEQ ID NO: 13517 - DNA, 22 bp, Artificial Sequence
  Synthetic
tgtaagcggtttctataggtac

SEQ ID NO: 13518 - DNA, 20 bp, Artificial Sequence
  Synthetic
aagtagaaatctcgtcggcg

SEQ ID NO: 13519 - DNA, 19 bp, Artificial Sequence
  Synthetic
tgcattgccactaccgttt

SEQ ID NO: 13520 - DNA, 16 bp, Artificial Sequence
  Synthetic
acggttccacggtgca

SEQ ID NO: 13521 - DNA, 23 bp, Artificial Sequence
  Synthetic
gttatcttggtaggcaatttctg

SEQ ID NO: 13522 - DNA, 19 bp, Artificial Sequence
  Synthetic
gtgggggttgtcttcttcg

SEQ ID NO: 13523 - DNA, 18 bp, Artificial Sequence
  Synthetic
cagtcacagtcacaaggt

SEQ ID NO: 13524 - DNA, 18 bp, Artificial Sequence
  Synthetic
caagcactgcctgttgaa

SEQ ID NO: 13525 - DNA, 19 bp, Artificial Sequence
  Synthetic
cttccaacatgaggcggtg

SEQ ID NO: 13526 - DNA, 20 bp, Artificial Sequence
  Synthetic
ccgtggtttggtggaaaagt

SEQ ID NO: 13527 - DNA, 17 bp, Artificial Sequence
  Synthetic
ctcctgagcgtcaccca

SEQ ID NO: 13528 - DNA, 18 bp, Artificial Sequence
  Synthetic
gcacactaatagcgcgag

SEQ ID NO: 13529 - DNA, 18 bp, Artificial Sequence
  Synthetic
gacgggagcaggaacaga

SEQ ID NO: 13530 - DNA, 18 bp, Artificial Sequence
  Synthetic
cagtagtgccgtctcgta

SEQ ID NO: 13531 - DNA, 18 bp, Artificial Sequence
  Synthetic
gccttgcgactaatggtt

SEQ ID NO: 13532 - DNA, 19 bp, Artificial Sequence
  Synthetic
tcgagctttcattaatcgc

SEQ ID NO: 13533 - DNA, 20 bp, Artificial Sequence
  Synthetic
gaatgggaggaaagacagcc

SEQ ID NO: 13534 - DNA, 20 bp, Artificial Sequence
  Synthetic
tggcacgcaaactattaact

SEQ ID NO: 13535 - DNA, 19 bp, Artificial Sequence
  Synthetic
tgctggaaagtgacattgg

SEQ ID NO: 13536 - DNA, 23 bp, Artificial Sequence
  Synthetic
ccttaaataaggctgctaggatt

SEQ ID NO: 13537 - DNA, 18 bp, Artificial Sequence
  Synthetic
gtaacaacacgggctggg

SEQ ID NO: 13538 - DNA, 16 bp, Artificial Sequence
  Synthetic
cggccagagcgttggt

SEQ ID NO: 13539 - DNA, 20 bp, Artificial Sequence
  Synthetic
caagcgcgatatcaagcatg

SEQ ID NO: 13540 - DNA, 19 bp, Artificial Sequence
  Synthetic
ttaaaagggaagccatgga

SEQ ID NO: 13541 - DNA, 18 bp, Artificial Sequence
  Synthetic
gggtaccgtgggacaact

SEQ ID NO: 13542 - DNA, 18 bp, Artificial Sequence
  Synthetic
gcccgacgaggtaatggt

SEQ ID NO: 13543 - DNA, 20 bp, Artificial Sequence
  Synthetic
cctatgttagcgccagagga

SEQ ID NO: 13544 - DNA, 18 bp, Artificial Sequence
  Synthetic
ctttacgctggctgtggg

SEQ ID NO: 13545 - DNA, 20 bp, Artificial Sequence
  Synthetic
gacaatccaaggatgacaac

SEQ ID NO: 13546 - DNA, 20 bp, Artificial Sequence
  Synthetic
cagttaatgctggatgcttt

SEQ ID NO: 13547 - DNA, 22 bp, Artificial Sequence
  Synthetic
gaagcttcttgtactcaaatgt

SEQ ID NO: 13548 - DNA, 18 bp, Artificial Sequence
  Synthetic
cccggttcctacacttac

SEQ ID NO: 13549 - DNA, 18 bp, Artificial Sequence
  Synthetic
ctgggttcagggtttgac

SEQ ID NO: 13550 - DNA, 18 bp, Artificial Sequence
  Synthetic
gagtaggcaagttgtgga

SEQ ID NO: 13551 - DNA, 18 bp, Artificial Sequence
  Synthetic
ccctcccagactgctgta

SEQ ID NO: 13552 - DNA, 20 bp, Artificial Sequence
  Synthetic
taccctagaaaagtcaaccc

SEQ ID NO: 13553 - DNA, 18 bp, Artificial Sequence
  Synthetic
ggttggtgggcagggata

SEQ ID NO: 13554 - DNA, 18 bp, Artificial Sequence
  Synthetic
cactggcataaggagacg

SEQ ID NO: 13555 - DNA, 20 bp, Artificial Sequence
  Synthetic
caccatctccattccatgca

SEQ ID NO: 13556 - DNA, 18 bp, Artificial Sequence
  Synthetic
gcttccatgcctttttcc

SEQ ID NO: 13557 - DNA, 20 bp, Artificial Sequence
  Synthetic
ctactcataccccaagacgc

SEQ ID NO: 13558 - DNA, 18 bp, Artificial Sequence
  Synthetic
agtttttgcagtgccaga

SEQ ID NO: 13559 - DNA, 20 bp, Artificial Sequence
  Synthetic
tgagcgcagtgatgaatcag

SEQ ID NO: 13560 - DNA, 20 bp, Artificial Sequence
  Synthetic
ctgcatttaccttttcctgt

SEQ ID NO: 13561 - DNA, 23 bp, Artificial Sequence
  Synthetic
actgaactattaagtgaaagtca

SEQ ID NO: 13562 - DNA, 20 bp, Artificial Sequence
  Synthetic
ttccatcacctttgtgtgct

SEQ ID NO: 13563 - DNA, 20 bp, Artificial Sequence
  Synthetic
tgggacaccattgaaaccag

SEQ ID NO: 13564 - DNA, 20 bp, Artificial Sequence
  Synthetic
gaaaacgcatttttcccact

SEQ ID NO: 13565 - DNA, 19 bp, Artificial Sequence
  Synthetic
ccccacatgatttccaggg

SEQ ID NO: 13566 - DNA, 21 bp, Artificial Sequence
  Synthetic
gctattggtggaaaaagatca

SEQ ID NO: 13567 - DNA, 22 bp, Artificial Sequence
  Synthetic
atttcaacctattaacctggga

SEQ ID NO: 13568 - DNA, 22 bp, Artificial Sequence
  Synthetic
ctaacttgtttctagtgcaaca

SEQ ID NO: 13569 - DNA, 23 bp, Artificial Sequence
  Synthetic
ttgtcacattacaattaactgca

SEQ ID NO: 13570 - DNA, 24 bp, Artificial Sequence
  Synthetic
tttctaaaacagaacctcttatgc

SEQ ID NO: 13571 - DNA, 24 bp, Artificial Sequence
  Synthetic
ctcctctgtagtttctttacaact

SEQ ID NO: 13572 - DNA, 20 bp, Artificial Sequence
  Synthetic
aaaaggacttttttgcctgg

SEQ ID NO: 13573 - DNA, 18 bp, Artificial Sequence
  Synthetic
catggtctccgtgtactc

SEQ ID NO: 13574 - DNA, 21 bp, Artificial Sequence
  Synthetic
cggaataaaacttaatgccca

SEQ ID NO: 13575 - DNA, 20 bp, Artificial Sequence
  Synthetic
tgtaaattctagcggtgccc

SEQ ID NO: 13576 - DNA, 21 bp, Artificial Sequence
  Synthetic
gggtcatgaaagtaaacgttg

SEQ ID NO: 13577 - DNA, 25 bp, Artificial Sequence
  Synthetic
cctaaatatccaaagtactactacc

SEQ ID NO: 13578 - DNA, 21 bp, Artificial Sequence
  Synthetic
aaatcagcctttctctacacc

SEQ ID NO: 13579 - DNA, 18 bp, Artificial Sequence
  Synthetic
gtcactcaagcggcattc

SEQ ID NO: 13580 - DNA, 22 bp, Artificial Sequence
  Synthetic
acaccttttgttaattaaggcg

SEQ ID NO: 13581 - DNA, 24 bp, Artificial Sequence
  Synthetic
atgtaaagtcagactattacactc

SEQ ID NO: 13582 - DNA, 25 bp, Artificial Sequence
  Synthetic
caaggtagaggcataaaaacttaat

SEQ ID NO: 13583 - DNA, 21 bp, Artificial Sequence
  Synthetic
agatttacattaggctccaca

SEQ ID NO: 13584 - DNA, 18 bp, Artificial Sequence
  Synthetic
gttccgtaaagactccgg

SEQ ID NO: 13585 - DNA, 23 bp, Artificial Sequence
  Synthetic
ccatgtggaggtataacaaaatt

SEQ ID NO: 13586 - DNA, 20 bp, Artificial Sequence
  Synthetic
ccggtacccttgtatacgct

SEQ ID NO: 13587 - DNA, 20 bp, Artificial Sequence
  Synthetic
tttctcaagacccgtccaag

SEQ ID NO: 13588 - DNA, 18 bp, Artificial Sequence
  Synthetic
gccatggggagatctgga

SEQ ID NO: 13589 - DNA, 22 bp, Artificial Sequence
  Synthetic
tccattgctcctatcaaatcag

SEQ ID NO: 13590 - DNA, 20 bp, Artificial Sequence
  Synthetic
gccttcaatcatcatgtcac

SEQ ID NO: 13591 - DNA, 22 bp, Artificial Sequence
  Synthetic
aatgaatgataacacaaatgcc

SEQ ID NO: 13592 - DNA, 21 bp, Artificial Sequence
  Synthetic
gctaagccaaaacatacaaca

SEQ ID NO: 13593 - DNA, 19 bp, Artificial Sequence
  Synthetic
ggtgaaggaccatgttctc

SEQ ID NO: 13594 - DNA, 22 bp, Artificial Sequence
  Synthetic
tggttgaaaaagtttactgagt

SEQ ID NO: 13595 - DNA, 18 bp, Artificial Sequence
  Synthetic
tggctacaaccaacagga

SEQ ID NO: 13596 - DNA, 20 bp, Artificial Sequence
  Synthetic
agtgtgtggagtacaatctc

SEQ ID NO: 13597 - DNA, 21 bp, Artificial Sequence
  Synthetic
agtagaggacacaattctgat

SEQ ID NO: 13598 - DNA, 20 bp, Artificial Sequence
  Synthetic
taaagcctatcaacacacca

SEQ ID NO: 13599 - DNA, 20 bp, Artificial Sequence
  Synthetic
agggaaaacaagagctatcg

SEQ ID NO: 13600 - DNA, 21 bp, Artificial Sequence
  Synthetic
tgatgtgatagcttcataccc

SEQ ID NO: 13601 - DNA, 22 bp, Artificial Sequence
  Synthetic
acagtgcatttctactaaatcc

SEQ ID NO: 13602 - DNA, 21 bp, Artificial Sequence
  Synthetic
aaatgacttagtgttaccagc

SEQ ID NO: 13603 - DNA, 22 bp, Artificial Sequence
  Synthetic
aagaagtcttaacagaaatggc

SEQ ID NO: 13604 - DNA, 23 bp, Artificial Sequence
  Synthetic
cgaaagtataacaaaagtccaga

SEQ ID NO: 13605 - DNA, 24 bp, Artificial Sequence
  Synthetic
atatcaaatgttatgtgatcctcc

SEQ ID NO: 13606 - DNA, 20 bp, Artificial Sequence
  Synthetic
cctgaagaggaaaacaatgg

SEQ ID NO: 13607 - DNA, 22 bp, Artificial Sequence
  Synthetic
cgggagaaagagcttattttac

SEQ ID NO: 13608 - DNA, 18 bp, Artificial Sequence
  Synthetic
ccaccacgtcccctgaaa

SEQ ID NO: 13609 - DNA, 20 bp, Artificial Sequence
  Synthetic
tattgttaaagggcacagca

SEQ ID NO: 13610 - DNA, 19 bp, Artificial Sequence
  Synthetic
gcaattgcctacctgatgt

SEQ ID NO: 13611 - DNA, 19 bp, Artificial Sequence
  Synthetic
tacagtgcctgtggaaagt

SEQ ID NO: 13612 - DNA, 18 bp, Artificial Sequence
  Synthetic
taacgccattgcagtgtt

SEQ ID NO: 13613 - DNA, 20 bp, Artificial Sequence
  Synthetic
caccacgtgacgttttaaat

SEQ ID NO: 13614 - DNA, 19 bp, Artificial Sequence
  Synthetic
tttcagagacagatgctgg

SEQ ID NO: 13615 - DNA, 23 bp, Artificial Sequence
  Synthetic
cacaaagtattagttcctaaggt

SEQ ID NO: 13616 - DNA, 21 bp, Artificial Sequence
  Synthetic
attgccacagtttgtaaatgg

SEQ ID NO: 13617 - DNA, 25 bp, Artificial Sequence
  Synthetic
tcctaatattttggataattggcag

SEQ ID NO: 13618 - DNA, 25 bp, Artificial Sequence
  Synthetic
tgtgaactatagtgaaataaactgc

SEQ ID NO: 13619 - DNA, 19 bp, Artificial Sequence
  Synthetic
tgtccacgacctactcacc

SEQ ID NO: 13620 - DNA, 21 bp, Artificial Sequence
  Synthetic
ttggtaatggtcattcagttc

SEQ ID NO: 13621 - DNA, 23 bp, Artificial Sequence
  Synthetic
aacctgataaatactcatgaagg

SEQ ID NO: 13622 - DNA, 17 bp, Artificial Sequence
  Synthetic
cgcgccttcagacctga

SEQ ID NO: 13623 - DNA, 22 bp, Artificial Sequence
  Synthetic
tcaacccatatttgatgtttct

SEQ ID NO: 13624 - DNA, 21 bp, Artificial Sequence
  Synthetic
ttgatatcagttccttgttgg

SEQ ID NO: 13625 - DNA, 21 bp, Artificial Sequence
  Synthetic
gtgagaaattgaaagaaagcg

SEQ ID NO: 13626 - DNA, 20 bp, Artificial Sequence
  Synthetic
tgtccaatcttgctatggaa

SEQ ID NO: 13627 - DNA, 24 bp, Artificial Sequence
  Synthetic
accctattgaatacagatatgaga

SEQ ID NO: 13628 - DNA, 20 bp, Artificial Sequence
  Synthetic
gccctaaaatttagcaaacg

SEQ ID NO: 13629 - DNA, 20 bp, Artificial Sequence
  Synthetic
gtgctgcctagaatttcatg

SEQ ID NO: 13630 - DNA, 22 bp, Artificial Sequence
  Synthetic
aggatattgtattagacctgca

SEQ ID NO: 13631 - DNA, 19 bp, Artificial Sequence
  Synthetic
ggacgattcaggtacagaa

SEQ ID NO: 13632 - DNA, 25 bp, Artificial Sequence
  Synthetic
gaaagtatttaggtagtccatatgt

SEQ ID NO: 13633 - DNA, 18 bp, Artificial Sequence
  Synthetic
aagggacatagaggggga

SEQ ID NO: 13634 - DNA, 20 bp, Artificial Sequence
  Synthetic
ggcagacagtcagtttaaat

SEQ ID NO: 13635 - DNA, 23 bp, Artificial Sequence
  Synthetic
ggaaatgtttttttgaaagactg

SEQ ID NO: 13636 - DNA, 18 bp, Artificial Sequence
  Synthetic
gtccgaagcaaaaggaca

SEQ ID NO: 13637 - DNA, 18 bp, Artificial Sequence
  Synthetic
gagtccaacagtcccctt

SEQ ID NO: 13638 - DNA, 20 bp, Artificial Sequence
  Synthetic
aaacatgccattgtaactgt

SEQ ID NO: 13639 - DNA, 25 bp, Artificial Sequence
  Synthetic
atggatatctgagtttattgtgtac

SEQ ID NO: 13640 - DNA, 20 bp, Artificial Sequence
  Synthetic
tcatctagtgatagcggtcc

SEQ ID NO: 13641 - DNA, 18 bp, Artificial Sequence
  Synthetic
ggggtaacaccacagttc

SEQ ID NO: 13642 - DNA, 18 bp, Artificial Sequence
  Synthetic
cctcctcctaaccctgta

SEQ ID NO: 13643 - DNA, 18 bp, Artificial Sequence
  Synthetic
acaggatggcgatatggt

SEQ ID NO: 13644 - DNA, 18 bp, Artificial Sequence
  Synthetic
ggctctttggtgtcctct

SEQ ID NO: 13645 - DNA, 18 bp, Artificial Sequence
  Synthetic
ccaagttgcttgccaagt

SEQ ID NO: 13646 - DNA, 19 bp, Artificial Sequence
  Synthetic
gtgttgtacagcctccagg

SEQ ID NO: 13647 - DNA, 20 bp, Artificial Sequence
  Synthetic
aatggacgttaagttcccgg

SEQ ID NO: 13648 - DNA, 18 bp, Artificial Sequence
  Synthetic
cgccgacctcatgggata

SEQ ID NO: 13649 - DNA, 15 bp, Artificial Sequence
  Synthetic
ttgcgtgccctgcgt

SEQ ID NO: 13650 - DNA, 19 bp, Artificial Sequence
  Synthetic
accttagttctcgcccagg

SEQ ID NO: 13651 - DNA, 19 bp, Artificial Sequence
  Synthetic
acagctcagggtgttccga

SEQ ID NO: 13652 - DNA, 20 bp, Artificial Sequence
  Synthetic
ttttgaactcgaccagaccg

SEQ ID NO: 13653 - DNA, 18 bp, Artificial Sequence
  Synthetic
ggcatgcaactggaccag

SEQ ID NO: 13654 - DNA, 20 bp, Artificial Sequence
  Synthetic
tctgcattgtctggcatgtc

SEQ ID NO: 13655 - DNA, 20 bp, Artificial Sequence
  Synthetic
tatagctaggaccgaggctg

SEQ ID NO: 13656 - DNA, 18 bp, Artificial Sequence
  Synthetic
gtgttcacgcccatggag

SEQ ID NO: 13657 - DNA, 20 bp, Artificial Sequence
  Synthetic
agaattgtggcgaagtgcag

SEQ ID NO: 13658 - DNA, 16 bp, Artificial Sequence
  Synthetic
gcgccggcatattccg

SEQ ID NO: 13659 - DNA, 20 bp, Artificial Sequence
  Synthetic
acatgtccaaggcatatggc

SEQ ID NO: 13660 - DNA, 18 bp, Artificial Sequence
  Synthetic
gccaacaacgggggaaat

SEQ ID NO: 13661 - DNA, 20 bp, Artificial Sequence
  Synthetic
gattacaaccgttccccagg

SEQ ID NO: 13662 - DNA, 20 bp, Artificial Sequence
  Synthetic
atcgggtgagaatttcccgt

SEQ ID NO: 13663 - DNA, 20 bp, Artificial Sequence
  Synthetic
gtgattgttgggagagtcgt

SEQ ID NO: 13664 - DNA, 20 bp, Artificial Sequence
  Synthetic
cattgcttccctcatgtcct

SEQ ID NO: 13665 - DNA, 18 bp, Artificial Sequence
  Synthetic
cattctatcgcccggagc

SEQ ID NO: 13666 - DNA, 20 bp, Artificial Sequence
  Synthetic
tgctgagtgacttcaagacg

SEQ ID NO: 13667 - DNA, 20 bp, Artificial Sequence
  Synthetic
acaacatcaagttcccctgc

SEQ ID NO: 13668 - DNA, 18 bp, Artificial Sequence
  Synthetic
cgaccctcgctagctagt

SEQ ID NO: 13669 - DNA, 20 bp, Artificial Sequence
  Synthetic
aagcagcaggactaccaagc

SEQ ID NO: 13670 - DNA, 20 bp, Artificial Sequence
  Synthetic
tcagactcttggtccactgt

SEQ ID NO: 13671 - DNA, 18 bp, Artificial Sequence
  Synthetic
ccccactcagccagatca

SEQ ID NO: 13672 - DNA, 20 bp, Artificial Sequence
  Synthetic
agcgggtggaatttcttctg

SEQ ID NO: 13673 - DNA, 16 bp, Artificial Sequence
  Synthetic
gcggcgctgagagact

SEQ ID NO: 13674 - DNA, 20 bp, Artificial Sequence
  Synthetic
tacctctttaactgggcggt

SEQ ID NO: 13675 - DNA, 19 bp, Artificial Sequence
  Synthetic
tcgtaatgagcaattccgg

SEQ ID NO: 13676 - DNA, 22 bp, Artificial Sequence
  Synthetic
agaaccagttaaagatctcatg

SEQ ID NO: 13677 - DNA, 21 bp, Artificial Sequence
  Synthetic
ttggatagtaagacatggaca

SEQ ID NO: 13678 - DNA, 23 bp, Artificial Sequence
  Synthetic
agttacctcataccactaaatgc

SEQ ID NO: 13679 - DNA, 20 bp, Artificial Sequence
  Synthetic
agcaatgctaggtactcatg

SEQ ID NO: 13680 - DNA, 23 bp, Artificial Sequence
  Synthetic
ttaggctgatgaaagatactcaa

SEQ ID NO: 13681 - DNA, 19 bp, Artificial Sequence
  Synthetic
aagccatgtatgttccaca

SEQ ID NO: 13682 - DNA, 18 bp, Artificial Sequence
  Synthetic
ttatcacagggcaaagct

SEQ ID NO: 13683 - DNA, 19 bp, Artificial Sequence
  Synthetic
tagtctcaacaggaggaca

SEQ ID NO: 13684 - DNA, 19 bp, Artificial Sequence
  Synthetic
atgcatacatggtcccatt

SEQ ID NO: 13685 - DNA, 21 bp, Artificial Sequence
  Synthetic
agaaatcatgatgacttggtc

SEQ ID NO: 13686 - DNA, 22 bp, Artificial Sequence
  Synthetic
agtgtgtgtattaatccatggt

SEQ ID NO: 13687 - DNA, 24 bp, Artificial Sequence
  Synthetic
ccaatggctagtttagataacaag

SEQ ID NO: 13688 - DNA, 25 bp, Artificial Sequence
  Synthetic
actttaccaacactatcttagaagt

SEQ ID NO: 13689 - DNA, 23 bp, Artificial Sequence
  Synthetic
ggagtttaacataaatccagtca

SEQ ID NO: 13690 - DNA, 21 bp, Artificial Sequence
  Synthetic
aaagtccgattagggaaaagt

SEQ ID NO: 13691 - DNA, 18 bp, Artificial Sequence
  Synthetic
tggatccacaagtgttgg

SEQ ID NO: 13692 - DNA, 18 bp, Artificial Sequence
  Synthetic
tgcaaagccgctatgtcc

SEQ ID NO: 13693 - DNA, 20 bp, Artificial Sequence
  Synthetic
accacaaaagatgctcgact

SEQ ID NO: 13694 - DNA, 18 bp, Artificial Sequence
  Synthetic
acgcgtctcggaaaaacg

SEQ ID NO: 13695 - DNA, 19 bp, Artificial Sequence
  Synthetic
aaaccaaattcttccgcgc

SEQ ID NO: 13696 - DNA, 18 bp, Artificial Sequence
  Synthetic
caccatgtccaccccatg

SEQ ID NO: 13697 - DNA, 19 bp, Artificial Sequence
  Synthetic
tactgcgactacttcaaca

SEQ ID NO: 13698 - DNA, 19 bp, Artificial Sequence
  Synthetic
ccagaggaggagttactgt

SEQ ID NO: 13699 - DNA, 22 bp, Artificial Sequence
  Synthetic
tggaagcaattagtctttctcc

SEQ ID NO: 13700 - DNA, 20 bp, Artificial Sequence
  Synthetic
cggctgcgctatatttttac

SEQ ID NO: 13701 - DNA, 25 bp, Artificial Sequence
  Synthetic
agaggtaaagtagtatcatacatga

SEQ ID NO: 13702 - DNA, 19 bp, Artificial Sequence
  Synthetic
gtcttcacctgtctccccg

SEQ ID NO: 13703 - DNA, 20 bp, Artificial Sequence
  Synthetic
agaacgtcatatcctctctg

SEQ ID NO: 13704 - DNA, 19 bp, Artificial Sequence
  Synthetic
tgcaaacagtaatcaacgc

SEQ ID NO: 13705 - DNA, 20 bp, Artificial Sequence
  Synthetic
acttgggtattggtacggga

SEQ ID NO: 13706 - DNA, 22 bp, Artificial Sequence
  Synthetic
acattggtgatccagaatacat

SEQ ID NO: 13707 - DNA, 24 bp, Artificial Sequence
  Synthetic
ggtgatttgacagacatattcaat

SEQ ID NO: 13708 - DNA, 19 bp, Artificial Sequence
  Synthetic
aaactgggtgacactgaaa

SEQ ID NO: 13709 - DNA, 22 bp, Artificial Sequence
  Synthetic
tttagtactttttcagcgagtc

SEQ ID NO: 13710 - DNA, 24 bp, Artificial Sequence
  Synthetic
cctaaaaatggattagggaatcac

SEQ ID NO: 13711 - DNA, 24 bp, Artificial Sequence
  Synthetic
ccatataagggcttaaatttttgg

SEQ ID NO: 13712 - DNA, 24 bp, Artificial Sequence
  Synthetic
ggtttctatttgaagtttgtacac

SEQ ID NO: 13713 - DNA, 18 bp, Artificial Sequence
  Synthetic
ctctagcagcggccaact

SEQ ID NO: 13714 - DNA, 20 bp, Artificial Sequence
  Synthetic
aaccctaatgtggtccaccg

SEQ ID NO: 13715 - DNA, 18 bp, Artificial Sequence
  Synthetic
cgaggctatgttccgcca

SEQ ID NO: 13716 - DNA, 18 bp, Artificial Sequence
  Synthetic
gccattggctgccacttt

SEQ ID NO: 13717 - DNA, 20 bp, Artificial Sequence
  Synthetic
gctacaaggttactgtgggc

SEQ ID NO: 13718 - DNA, 18 bp, Artificial Sequence
  Synthetic
tacgctcagtgtaggcgc

SEQ ID NO: 13719 - DNA, 17 bp, Artificial Sequence
  Synthetic
atgtcgaccccgctgaa

SEQ ID NO: 13720 - DNA, 20 bp, Artificial Sequence
  Synthetic
ttttgatgccagtcagagca

SEQ ID NO: 13721 - DNA, 17 bp, Artificial Sequence
  Synthetic
ccggccataacccacca

SEQ ID NO: 13722 - DNA, 19 bp, Artificial Sequence
  Synthetic
atacattaaccccccggcc

SEQ ID NO: 13723 - DNA, 18 bp, Artificial Sequence
  Synthetic
ccaataggccgacctgcc

SEQ ID NO: 13724 - DNA, 17 bp, Artificial Sequence
  Synthetic
cggcttcgctgctttca

SEQ ID NO: 13725 - DNA, 20 bp, Artificial Sequence
  Synthetic
ctgcggatgtatgtgagctg

SEQ ID NO: 13726 - DNA, 18 bp, Artificial Sequence
  Synthetic
gcgccacactgagaagtg

SEQ ID NO: 13727 - DNA, 20 bp, Artificial Sequence
  Synthetic
ttgtacgagctagtggaggc

SEQ ID NO: 13728 - DNA, 16 bp, Artificial Sequence
  Synthetic
ccttggcgcgcttcct

SEQ ID NO: 13729 - DNA, 16 bp, Artificial Sequence
  Synthetic
gggctggacctcgtgt

SEQ ID NO: 13730 - DNA, 20 bp, Artificial Sequence
  Synthetic
ctttgccctcgaacttgagt

SEQ ID NO: 13731 - DNA, 20 bp, Artificial Sequence
  Synthetic
tgtgctttggctttctctca

SEQ ID NO: 13732 - DNA, 20 bp, Artificial Sequence
  Synthetic
actgctagtgaccaactgct

SEQ ID NO: 13733 - DNA, 20 bp, Artificial Sequence
  Synthetic
aacaatataccaaaacggcg

SEQ ID NO: 13734 - DNA, 19 bp, Artificial Sequence
  Synthetic
taccgaaagacacagtgtt

SEQ ID NO: 13735 - DNA, 25 bp, Artificial Sequence
  Synthetic
gggttgtttattaagtttaaatcgg

SEQ ID NO: 13736 - DNA, 24 bp, Artificial Sequence
  Synthetic
gattcgggctatagagtattttac

SEQ ID NO: 13737 - DNA, 19 bp, Artificial Sequence
  Synthetic
gtggaaacgaaaaaccgtc

SEQ ID NO: 13738 - DNA, 20 bp, Artificial Sequence
  Synthetic
tgtttactgctattggacga

SEQ ID NO: 13739 - DNA, 18 bp, Artificial Sequence
  Synthetic
ggctatgttacctgcact

SEQ ID NO: 13740 - DNA, 20 bp, Artificial Sequence
  Synthetic
aggggtatgtatattagcgc

SEQ ID NO: 13741 - DNA, 21 bp, Artificial Sequence
  Synthetic
tttttcatcgtcgttacttcc

SEQ ID NO: 13742 - DNA, 21 bp, Artificial Sequence
  Synthetic
ttgctgggttatttaacatcc

SEQ ID NO: 13743 - DNA, 20 bp, Artificial Sequence
  Synthetic
cagaaactatccgacagaga

SEQ ID NO: 13744 - DNA, 18 bp, Artificial Sequence
  Synthetic
cgtttcctccttgcagac

SEQ ID NO: 13745 - DNA, 18 bp, Artificial Sequence
  Synthetic
acgaaccgtgttccgtcg

SEQ ID NO: 13746 - DNA, 18 bp, Artificial Sequence
  Synthetic
cccagaccccgagactgt

SEQ ID NO: 13747 - DNA, 18 bp, Artificial Sequence
  Synthetic
catcctcccagtgaccct

SEQ ID NO: 13748 - DNA, 17 bp, Artificial Sequence
  Synthetic
tctaggtttgccccccg

SEQ ID NO: 13749 - DNA, 24 bp, Artificial Sequence
  Synthetic
attagatcgatgggaaaaaattcg

SEQ ID NO: 13750 - DNA, 23 bp, Artificial Sequence
  Synthetic
tttagacaagatagaggaagagc

SEQ ID NO: 13751 - DNA, 19 bp, Artificial Sequence
  Synthetic
ccatcaatgaggaagctgc

SEQ ID NO: 13752 - DNA, 18 bp, Artificial Sequence
  Synthetic
gagcaagcttcacaggag

SEQ ID NO: 13753 - DNA, 21 bp, Artificial Sequence
  Synthetic
caccagggattagatatcagt

SEQ ID NO: 13754 - DNA, 21 bp, Artificial Sequence
  Synthetic
ccatcctgataaatggacagt

SEQ ID NO: 13755 - DNA, 20 bp, Artificial Sequence
  Synthetic
atatgcaagaatgaggggtg

SEQ ID NO: 13756 - DNA, 25 bp, Artificial Sequence
  Synthetic
tcaggaaagtactatttttagatgg

SEQ ID NO: 13757 - DNA, 22 bp, Artificial Sequence
  Synthetic
tagaagcagaagttattccagc

SEQ ID NO: 13758 - DNA, 18 bp, Artificial Sequence
  Synthetic
ggaaagctaggggatggt

SEQ ID NO: 13759 - DNA, 21 bp, Artificial Sequence
  Synthetic
attaggacacatagttagccc

SEQ ID NO: 13760 - DNA, 24 bp, Artificial Sequence
  Synthetic
cttagggcaacatatctatgaaac

SEQ ID NO: 13761 - DNA, 22 bp, Artificial Sequence
  Synthetic
tgtagtgctacagaaaaattgt

SEQ ID NO: 13762 - DNA, 20 bp, Artificial Sequence
  Synthetic
tggaacaggaccatgtacaa

SEQ ID NO: 13763 - DNA, 18 bp, Artificial Sequence
  Synthetic
caatgtatgcccctccca

SEQ ID NO: 13764 - DNA, 19 bp, Artificial Sequence
  Synthetic
caatgacgctgacggtaca

SEQ ID NO: 13765 - DNA, 20 bp, Artificial Sequence
  Synthetic
tggatggcctactgtaaggg

SEQ ID NO: 13766 - DNA, 20 bp, Artificial Sequence
  Synthetic
tagcatttcatcacgtggcc

SEQ ID NO: 13767 - DNA, 18 bp, Artificial Sequence
  Synthetic
caacgacatgcagtggct

SEQ ID NO: 13768 - DNA, 19 bp, Artificial Sequence
  Synthetic
gtttaggcgcaggtttccg

SEQ ID NO: 13769 - DNA, 16 bp, Artificial Sequence
  Synthetic
gagccggtcagcagct

SEQ ID NO: 13770 - DNA, 18 bp, Artificial Sequence
  Synthetic
cttcgagggcgtagtggc

SEQ ID NO: 13771 - DNA, 17 bp, Artificial Sequence
  Synthetic
gcgaactccaccgaggt

SEQ ID NO: 13772 - DNA, 20 bp, Artificial Sequence
  Synthetic
acacaacaaactccccctcg

SEQ ID NO: 13773 - DNA, 20 bp, Artificial Sequence
  Synthetic
taacgtacatgttctgcgcc

SEQ ID NO: 13774 - DNA, 18 bp, Artificial Sequence
  Synthetic
agtacatccccgcgtacg

SEQ ID NO: 13775 - DNA, 18 bp, Artificial Sequence
  Synthetic
ggacctccgggacttcga

SEQ ID NO: 13776 - DNA, 20 bp, Artificial Sequence
  Synthetic
tcctgaacacgctaatgtgc

SEQ ID NO: 13777 - DNA, 19 bp, Artificial Sequence
  Synthetic
ctctcctccacccaaacga

SEQ ID NO: 13778 - DNA, 16 bp, Artificial Sequence
  Synthetic
accgcgtcctccgaca

SEQ ID NO: 13779 - DNA, 18 bp, Artificial Sequence
  Synthetic
cagacggaacagctccca

SEQ ID NO: 13780 - DNA, 18 bp, Artificial Sequence
  Synthetic
atgggcgtaaagacgggc

SEQ ID NO: 13781 - DNA, 18 bp, Artificial Sequence
  Synthetic
ctaaggcccaccgtcacg

SEQ ID NO: 13782 - DNA, 16 bp, Artificial Sequence
  Synthetic
tgggcggtcagcgaga

SEQ ID NO: 13783 - DNA, 18 bp, Artificial Sequence
  Synthetic
cgctaaccagcagctcca

SEQ ID NO: 13784 - DNA, 16 bp, Artificial Sequence
  Synthetic
cacgatctggcgctgc

SEQ ID NO: 13785 - DNA, 19 bp, Artificial Sequence
  Synthetic
catcatctctaagcgcgcg

SEQ ID NO: 13786 - DNA, 19 bp, Artificial Sequence
  Synthetic
tacagcgtcctgaacacgt

SEQ ID NO: 13787 - DNA, 16 bp, Artificial Sequence
  Synthetic
cgggtggaccacgtca

SEQ ID NO: 13788 - DNA, 18 bp, Artificial Sequence
  Synthetic
gccagcgcgtgtatgagt

SEQ ID NO: 13789 - DNA, 19 bp, Artificial Sequence
  Synthetic
cggaaagaccactagcccg

SEQ ID NO: 13790 - DNA, 16 bp, Artificial Sequence
  Synthetic
ccaggggcaggacgaa

SEQ ID NO: 13791 - DNA, 18 bp, Artificial Sequence
  Synthetic
cttgggggattcgcaggc

SEQ ID NO: 13792 - DNA, 20 bp, Artificial Sequence
  Synthetic
taggtgataaacagcgggcg

SEQ ID NO: 13793 - DNA, 17 bp, Artificial Sequence
  Synthetic
cagggcgttgtagtgcg

SEQ ID NO: 13794 - DNA, 17 bp, Artificial Sequence
  Synthetic
cgccggccaattcttcc

SEQ ID NO: 13795 - DNA, 19 bp, Artificial Sequence
  Synthetic
gtcctgtctctgcagtcgt

SEQ ID NO: 13796 - DNA, 16 bp, Artificial Sequence
  Synthetic
tgcttcggcggctcct

SEQ ID NO: 13797 - DNA, 18 bp, Artificial Sequence
  Synthetic
gtgtagacctccaggggc

SEQ ID NO: 13798 - DNA, 17 bp, Artificial Sequence
  Synthetic
ccaatcagcgcccgaac

SEQ ID NO: 13799 - DNA, 20 bp, Artificial Sequence
  Synthetic
acgcgatggtctctatgtcc

SEQ ID NO: 13800 - DNA, 17 bp, Artificial Sequence
  Synthetic
tttgccccccacaaccc

SEQ ID NO: 13801 - DNA, 17 bp, Artificial Sequence
  Synthetic
tggtaccgcctcaagcc

SEQ ID NO: 13802 - DNA, 18 bp, Artificial Sequence
  Synthetic
agacgaactcgaaggcgg

SEQ ID NO: 13803 - DNA, 17 bp, Artificial Sequence
  Synthetic
catgaacgactgggccg

SEQ ID NO: 13804 - DNA, 16 bp, Artificial Sequence
  Synthetic
acgacgtcaaggggcg

SEQ ID NO: 13805 - DNA, 18 bp, Artificial Sequence
  Synthetic
cacaacaggtgggtgctt

SEQ ID NO: 13806 - DNA, 16 bp, Artificial Sequence
  Synthetic
gatgcgacgcctgtgc

SEQ ID NO: 13807 - DNA, 16 bp, Artificial Sequence
  Synthetic
ggcgttcaacgacgcc

SEQ ID NO: 13808 - DNA, 16 bp, Artificial Sequence
  Synthetic
aacccacgccccagtg

SEQ ID NO: 13809 - DNA, 16 bp, Artificial Sequence
  Synthetic
acagcgctccgatcgg

SEQ ID NO: 13810 - DNA, 17 bp, Artificial Sequence
  Synthetic
caaccaccttcgctccc

SEQ ID NO: 13811 - DNA, 17 bp, Artificial Sequence
  Synthetic
cagctcggcgatggtca

SEQ ID NO: 13812 - DNA, 17 bp, Artificial Sequence
  Synthetic
ccttgtcgcggtggttc

SEQ ID NO: 13813 - DNA, 17 bp, Artificial Sequence
  Synthetic
cgatggcgtccaccaga

SEQ ID NO: 13814 - DNA, 17 bp, Artificial Sequence
  Synthetic
tccagacggacagcacc

SEQ ID NO: 13815 - DNA, 18 bp, Artificial Sequence
  Synthetic
actgcgatcacgaagggc

SEQ ID NO: 13816 - DNA, 16 bp, Artificial Sequence
  Synthetic
tcctgcgccgacaaga

SEQ ID NO: 13817 - DNA, 17 bp, Artificial Sequence
  Synthetic
cccatgttttccgcggc

SEQ ID NO: 13818 - DNA, 17 bp, Artificial Sequence
  Synthetic
ctgcgcttcaagcacgg

SEQ ID NO: 13819 - DNA, 17 bp, Artificial Sequence
  Synthetic
gacacccagatgcgcct

SEQ ID NO: 13820 - DNA, 18 bp, Artificial Sequence
  Synthetic
acacgaaaatcacccgcc

SEQ ID NO: 13821 - DNA, 20 bp, Artificial Sequence
  Synthetic
tcgaacctgtttttacgggc

SEQ ID NO: 13822 - DNA, 16 bp, Artificial Sequence
  Synthetic
catgcccagcccccaa

SEQ ID NO: 13823 - DNA, 16 bp, Artificial Sequence
  Synthetic
gcggaaggaaacgggc

SEQ ID NO: 13824 - DNA, 16 bp, Artificial Sequence
  Synthetic
ccaccggggtgttgca

SEQ ID NO: 13825 - DNA, 16 bp, Artificial Sequence
  Synthetic
gtcgccccatgcacgt

SEQ ID NO: 13826 - DNA, 16 bp, Artificial Sequence
  Synthetic
gtttccgggagcgctg

SEQ ID NO: 13827 - DNA, 16 bp, Artificial Sequence
  Synthetic
tgggactccgcgtcgt

SEQ ID NO: 13828 - DNA, 20 bp, Artificial Sequence
  Synthetic
cccgatcactgtgtactacg

SEQ ID NO: 13829 - DNA, 18 bp, Artificial Sequence
  Synthetic
cggtctgtatgtcctgcg

SEQ ID NO: 13830 - DNA, 18 bp, Artificial Sequence
  Synthetic
gctggttgggtgggggta

SEQ ID NO: 13831 - DNA, 20 bp, Artificial Sequence
  Synthetic
acttatcctggggagaaggg

SEQ ID NO: 13832 - DNA, 18 bp, Artificial Sequence
  Synthetic
gatctggaggggaacttg

SEQ ID NO: 13833 - DNA, 20 bp, Artificial Sequence
  Synthetic
tcagtgtccattttgccagg

SEQ ID NO: 13834 - DNA, 20 bp, Artificial Sequence
  Synthetic
gacaaaacaacatcacagca

SEQ ID NO: 13835 - DNA, 24 bp, Artificial Sequence
  Synthetic
tgctgctttattcttctatcatag

SEQ ID NO: 13836 - DNA, 18 bp, Artificial Sequence
  Synthetic
agacactacaagacagcg

SEQ ID NO: 13837 - DNA, 23 bp, Artificial Sequence
  Synthetic
cttaacaaatttttggatggaca

SEQ ID NO: 13838 - DNA, 18 bp, Artificial Sequence
  Synthetic
ggcagccagttaccctaa

SEQ ID NO: 13839 - DNA, 18 bp, Artificial Sequence
  Synthetic
cagcgccctggtaaatgt

SEQ ID NO: 13840 - DNA, 22 bp, Artificial Sequence
  Synthetic
caagattcctaaaaacattggg

SEQ ID NO: 13841 - DNA, 17 bp, Artificial Sequence
  Synthetic
gggcattggcacaggac

SEQ ID NO: 13842 - DNA, 20 bp, Artificial Sequence
  Synthetic
ccgtaggtgacaatgctgaa

SEQ ID NO: 13843 - DNA, 19 bp, Artificial Sequence
  Synthetic
cgtagtgacacagacctgc

SEQ ID NO: 13844 - DNA, 20 bp, Artificial Sequence
  Synthetic
gaactagatgtactgggtga

SEQ ID NO: 13845 - DNA, 20 bp, Artificial Sequence
  Synthetic
atacaacggacattgaacac

SEQ ID NO: 13846 - DNA, 20 bp, Artificial Sequence
  Synthetic
gattgaggtttctaggggac

SEQ ID NO: 13847 - DNA, 20 bp, Artificial Sequence
  Synthetic
aagcagatgacaaatgtcct

SEQ ID NO: 13848 - DNA, 22 bp, Artificial Sequence
  Synthetic
ctaactttaccatcagtgttcc

SEQ ID NO: 13849 - DNA, 20 bp, Artificial Sequence
  Synthetic
aaatgtccctctaaggatgc

SEQ ID NO: 13850 - DNA, 20 bp, Artificial Sequence
  Synthetic
ccaacattggcaaacgtctc

SEQ ID NO: 13851 - DNA, 23 bp, Artificial Sequence
  Synthetic
tatgccaattaatttactgtgtg

SEQ ID NO: 13852 - DNA, 22 bp, Artificial Sequence
  Synthetic
cgaaagtatgtgataagtccac

SEQ ID NO: 13853 - DNA, 19 bp, Artificial Sequence
  Synthetic
tggaaacacaacagacact

SEQ ID NO: 13854 - DNA, 25 bp, Artificial Sequence
  Synthetic
tataggaattgtcaaatatctggtg

SEQ ID NO: 13855 - DNA, 23 bp, Artificial Sequence
  Synthetic
tattcagcaagttaaaacaacca

SEQ ID NO: 13856 - DNA, 22 bp, Artificial Sequence
  Synthetic
taagggaactattcataccaga

SEQ ID NO: 13857 - DNA, 22 bp, Artificial Sequence
  Synthetic
gaatctggaaaattgtatctgc

SEQ ID NO: 13858 - DNA, 25 bp, Artificial Sequence
  Synthetic
atcctaatagagaacgtttagtctg

SEQ ID NO: 13859 - DNA, 25 bp, Artificial Sequence
  Synthetic
ctctttacaatgtatattttgtggc

SEQ ID NO: 13860 - DNA, 21 bp, Artificial Sequence
  Synthetic
atggcaatgttagatcttgtt

SEQ ID NO: 13861 - DNA, 18 bp, Artificial Sequence
  Synthetic
acacctgttgtcacactt

SEQ ID NO: 13862 - DNA, 23 bp, Artificial Sequence
  Synthetic
atgcgtagattttaattctctgg

SEQ ID NO: 13863 - DNA, 21 bp, Artificial Sequence
  Synthetic
ttaaactttcaggacagtgga

SEQ ID NO: 13864 - DNA, 22 bp, Artificial Sequence
  Synthetic
atatggtgagtttccatcatgg

SEQ ID NO: 13865 - DNA, 25 bp, Artificial Sequence
  Synthetic
tttccaaataaattacctgtcactg

SEQ ID NO: 13866 - DNA, 20 bp, Artificial Sequence
  Synthetic
gggaacccaccaaaaggaaa

SEQ ID NO: 13867 - DNA, 18 bp, Artificial Sequence
  Synthetic
gccaactgctgtcccaac

SEQ ID NO: 13868 - DNA, 20 bp, Artificial Sequence
  Synthetic
ttaaacctccaaaacacacg

SEQ ID NO: 13869 - DNA, 18 bp, Artificial Sequence
  Synthetic
ggtccggaagaggatcag

SEQ ID NO: 13870 - DNA, 18 bp, Artificial Sequence
  Synthetic
cttcctgatccagcactt

SEQ ID NO: 13871 - DNA, 22 bp, Artificial Sequence
  Synthetic
tccggactttaatgtatttgtg

SEQ ID NO: 13872 - DNA, 21 bp, Artificial Sequence
  Synthetic
tttgaatttgaaaatcccgcg

SEQ ID NO: 13873 - DNA, 19 bp, Artificial Sequence
  Synthetic
gaccctgatgtgtctgatg

SEQ ID NO: 13874 - DNA, 20 bp, Artificial Sequence
  Synthetic
gagggtaagaggtatccaaa

SEQ ID NO: 13875 - DNA, 20 bp, Artificial Sequence
  Synthetic
tgattgtcctccaattcagc

SEQ ID NO: 13876 - DNA, 22 bp, Artificial Sequence
  Synthetic
actgtgaactagtatactgtga

SEQ ID NO: 13877 - DNA, 18 bp, Artificial Sequence
  Synthetic
cctagggctactttccga

SEQ ID NO: 13878 - DNA, 22 bp, Artificial Sequence
  Synthetic
aaggaatacaaaagactatgcc

SEQ ID NO: 13879 - DNA, 18 bp, Artificial Sequence
  Synthetic
ggcccatgctactcaaga

SEQ ID NO: 13880 - DNA, 23 bp, Artificial Sequence
  Synthetic
tctctgataatcttgaagcattt

SEQ ID NO: 13881 - DNA, 21 bp, Artificial Sequence
  Synthetic
gtcatggaatagcgataaggg

SEQ ID NO: 13882 - DNA, 20 bp, Artificial Sequence
  Synthetic
ctaggctttctgctaggtat

SEQ ID NO: 13883 - DNA, 25 bp, Artificial Sequence
  Synthetic
aatgatctagaaataaagctggaag

SEQ ID NO: 13884 - DNA, 18 bp, Artificial Sequence
  Synthetic
taagcgccctaaaacgaa

SEQ ID NO: 13885 - DNA, 20 bp, Artificial Sequence
  Synthetic
ctttcttacagggtgttcca

SEQ ID NO: 13886 - DNA, 19 bp, Artificial Sequence
  Synthetic
cacaggaaactctgacaga

SEQ ID NO: 13887 - DNA, 19 bp, Artificial Sequence
  Synthetic
cggcccacaatcttcgatc

SEQ ID NO: 13888 - DNA, 24 bp, Artificial Sequence
  Synthetic
gaatttgtatagacactgtaaagc

SEQ ID NO: 13889 - DNA, 19 bp, Artificial Sequence
  Synthetic
cagtccctatgaacctcct

SEQ ID NO: 13890 - DNA, 23 bp, Artificial Sequence
  Synthetic
gttacattcaacaaatcagaaca

SEQ ID NO: 13891 - DNA, 19 bp, Artificial Sequence
  Synthetic
ttagtaccagaagcggtac

SEQ ID NO: 13892 - DNA, 21 bp, Artificial Sequence
  Synthetic
tgttttgatgttttgcagatg

SEQ ID NO: 13893 - DNA, 20 bp, Artificial Sequence
  Synthetic
ccaatatcgagtgtttaggc

SEQ ID NO: 13894 - DNA, 21 bp, Artificial Sequence
  Synthetic
tattgggatgttgctaaacca

SEQ ID NO: 13895 - DNA, 24 bp, Artificial Sequence
  Synthetic
gatgtttatggcgataaatgtttc

SEQ ID NO: 13896 - DNA, 21 bp, Artificial Sequence
  Synthetic
gaatggcaattagcttttgtg

SEQ ID NO: 13897 - DNA, 20 bp, Artificial Sequence
  Synthetic
gctggacaggtagtattgtc

SEQ ID NO: 13898 - DNA, 18 bp, Artificial Sequence
  Synthetic
tcgttggatgatgctgaa

SEQ ID NO: 13899 - DNA, 18 bp, Artificial Sequence
  Synthetic
tggagccagcaaatcctt

SEQ ID NO: 13900 - DNA, 23 bp, Artificial Sequence
  Synthetic
agtttaacagctttagatgactt

SEQ ID NO: 13901 - DNA, 22 bp, Artificial Sequence
  Synthetic
gtggaattgtagaagatgaagc

SEQ ID NO: 13902 - DNA, 18 bp, Artificial Sequence
  Synthetic
ggtcctctccagtctctc

SEQ ID NO: 13903 - DNA, 21 bp, Artificial Sequence
  Synthetic
tttggcaatttaggaataggg

SEQ ID NO: 13904 - DNA, 21 bp, Artificial Sequence
  Synthetic
agaagaaattgaattaggccc

SEQ ID NO: 13905 - DNA, 19 bp, Artificial Sequence
  Synthetic
gatcgcctcttaacagtgg

SEQ ID NO: 13906 - DNA, 23 bp, Artificial Sequence
  Synthetic
aattagttgatgtagaaaaccct

SEQ ID NO: 13907 - DNA, 25 bp, Artificial Sequence
  Synthetic
tccttataaagacctaaagttttgg

SEQ ID NO: 13908 - DNA, 22 bp, Artificial Sequence
  Synthetic
atttccatcaagcaatactgac

SEQ ID NO: 13909 - DNA, 21 bp, Artificial Sequence
  Synthetic
cgacaaaacagtcaaatcaac

SEQ ID NO: 13910 - DNA, 19 bp, Artificial Sequence
  Synthetic
cgtccgtagaaatgaaggg

SEQ ID NO: 13911 - DNA, 21 bp, Artificial Sequence
  Synthetic
aagaagatctgtggatacctc

SEQ ID NO: 13912 - DNA, 20 bp, Artificial Sequence
  Synthetic
ccctccactagtttggtcga

SEQ ID NO: 13913 - DNA, 20 bp, Artificial Sequence
  Synthetic
tccatctaagttcacagagc

SEQ ID NO: 13914 - DNA, 19 bp, Artificial Sequence
  Synthetic
aaagctacttccaaaggct

SEQ ID NO: 13915 - DNA, 19 bp, Artificial Sequence
  Synthetic
atccaggagatcgaggtat

SEQ ID NO: 13916 - DNA, 18 bp, Artificial Sequence
  Synthetic
acccactggatcttctcc

SEQ ID NO: 13917 - DNA, 21 bp, Artificial Sequence
  Synthetic
caaattacctcataccactgc

SEQ ID NO: 13918 - DNA, 21 bp, Artificial Sequence
  Synthetic
gtggtccagaagatagaaagg

SEQ ID NO: 13919 - DNA, 19 bp, Artificial Sequence
  Synthetic
gatgtagagagcttcctcg

SEQ ID NO: 13920 - DNA, 18 bp, Artificial Sequence
  Synthetic
aggcaatgtatgtgcctc

SEQ ID NO: 13921 - DNA, 21 bp, Artificial Sequence
  Synthetic
tgatgttcataccacgattgt

SEQ ID NO: 13922 - DNA, 18 bp, Artificial Sequence
  Synthetic
ctactggagcacatggag

SEQ ID NO: 13923 - DNA, 20 bp, Artificial Sequence
  Synthetic
tagatgtatacatggcccca

SEQ ID NO: 13924 - DNA, 18 bp, Artificial Sequence
  Synthetic
aagccagggaaaagcttg

SEQ ID NO: 13925 - DNA, 19 bp, Artificial Sequence
  Synthetic
aaagaactgagccagtgtg

SEQ ID NO: 13926 - DNA, 25 bp, Artificial Sequence
  Synthetic
gttgtttactagtaactttgtgttg

SEQ ID NO: 13927 - DNA, 18 bp, Artificial Sequence
  Synthetic
caccacagagaaagggga

SEQ ID NO: 13928 - DNA, 21 bp, Artificial Sequence
  Synthetic
ctactttagtagtgcactcca

SEQ ID NO: 13929 - DNA, 25 bp, Artificial Sequence
  Synthetic
attgtatctaaacaaaaggtgagag

SEQ ID NO: 13930 - DNA, 18 bp, Artificial Sequence
  Synthetic
attttgtgcgacaatgct

SEQ ID NO: 13931 - DNA, 23 bp, Artificial Sequence
  Synthetic
gaagtaaatgctagaattgaacc

SEQ ID NO: 13932 - DNA, 19 bp, Artificial Sequence
  Synthetic
gctggatagagcttgatga

SEQ ID NO: 13933 - DNA, 20 bp, Artificial Sequence
  Synthetic
atcccacttaaggaatgaca

SEQ ID NO: 13934 - DNA, 18 bp, Artificial Sequence
  Synthetic
cgttgtctcctccagtca

SEQ ID NO: 13935 - DNA, 18 bp, Artificial Sequence
  Synthetic
cactcgcgagatactgac

SEQ ID NO: 13936 - DNA, 21 bp, Artificial Sequence
  Synthetic
caagcacagtccattatccaa

SEQ ID NO: 13937 - DNA, 21 bp, Artificial Sequence
  Synthetic
acatcagagtcacagttaacg

SEQ ID NO: 13938 - DNA, 24 bp, Artificial Sequence
  Synthetic
gctgctagaaatattgttagaaga

SEQ ID NO: 13939 - DNA, 19 bp, Artificial Sequence
  Synthetic
aggcaacctccaaacattg

SEQ ID NO: 13940 - DNA, 18 bp, Artificial Sequence
  Synthetic
aaaccagcggctaaatcc

SEQ ID NO: 13941 - DNA, 18 bp, Artificial Sequence
  Synthetic
cagaggggaaacgtactc

SEQ ID NO: 13942 - DNA, 19 bp, Artificial Sequence
  Synthetic
cgtactgggaacatttgac

SEQ ID NO: 13943 - DNA, 23 bp, Artificial Sequence
  Synthetic
accattgcatcaaatttacatga

SEQ ID NO: 13944 - DNA, 23 bp, Artificial Sequence
  Synthetic
attgtatggatgacatagagact

SEQ ID NO: 13945 - DNA, 23 bp, Artificial Sequence
  Synthetic
aagaaagacaaagtaaaaggaga

SEQ ID NO: 13946 - DNA, 18 bp, Artificial Sequence
  Synthetic
aacagcaacggtcggagg

SEQ ID NO: 13947 - DNA, 18 bp, Artificial Sequence
  Synthetic
tgctgaggaagttggaag

SEQ ID NO: 13948 - DNA, 23 bp, Artificial Sequence
  Synthetic
ttggaagtattctttatttgggt

SEQ ID NO: 13949 - DNA, 18 bp, Artificial Sequence
  Synthetic
gtcctggtttgcctacag

SEQ ID NO: 13950 - DNA, 24 bp, Artificial Sequence
  Synthetic
cagcaatattttacctcttactcc

SEQ ID NO: 13951 - DNA, 22 bp, Artificial Sequence
  Synthetic
tctttattttcatgccaattcg

SEQ ID NO: 13952 - DNA, 18 bp, Artificial Sequence
  Synthetic
cctctaggcataggaacg

SEQ ID NO: 13953 - DNA, 19 bp, Artificial Sequence
  Synthetic
tcactcccctgtgaggaac

SEQ ID NO: 13954 - DNA, 20 bp, Artificial Sequence
  Synthetic
aaagaaacaccaaccgtcgc

SEQ ID NO: 13955 - DNA, 18 bp, Artificial Sequence
  Synthetic
tagtgctggaagcggagg

SEQ ID NO: 13956 - DNA, 20 bp, Artificial Sequence
  Synthetic
atgatgatgaactggtcgcc

SEQ ID NO: 13957 - DNA, 20 bp, Artificial Sequence
  Synthetic
accgcagcaatttcaactcc

SEQ ID NO: 13958 - DNA, 19 bp, Artificial Sequence
  Synthetic
tcatgctagagagcctgcg

SEQ ID NO: 13959 - DNA, 20 bp, Artificial Sequence
  Synthetic
gtcccctcctcttttcaacc

SEQ ID NO: 13960 - DNA, 17 bp, Artificial Sequence
  Synthetic
cggcaaggtcgaagcag

SEQ ID NO: 13961 - DNA, 17 bp, Artificial Sequence
  Synthetic
gccgtagctgttgagcc

SEQ ID NO: 13962 - DNA, 20 bp, Artificial Sequence
  Synthetic
aacagccactcagagtttcc

SEQ ID NO: 13963 - DNA, 20 bp, Artificial Sequence
  Synthetic
ccatcagggcacgtagtagg

SEQ ID NO: 13964 - DNA, 20 bp, Artificial Sequence
  Synthetic
atatgggaagtttctggccg

SEQ ID NO: 13965 - DNA, 20 bp, Artificial Sequence
  Synthetic
ttaggtctcaatgctgtcgc

SEQ ID NO: 13966 - DNA, 19 bp, Artificial Sequence
  Synthetic
aaagccgggggtgtatagg

SEQ ID NO: 13967 - DNA, 20 bp, Artificial Sequence
  Synthetic
gggacgtgatgtggaaatgt

SEQ ID NO: 13968 - DNA, 20 bp, Artificial Sequence
  Synthetic
gctctaagcacatcccctac

SEQ ID NO: 13969 - DNA, 19 bp, Artificial Sequence
  Synthetic
tcaacatattgggcggctg

SEQ ID NO: 13970 - DNA, 19 bp, Artificial Sequence
  Synthetic
atagcctttgcctccaggg

SEQ ID NO: 13971 - DNA, 19 bp, Artificial Sequence
  Synthetic
gtgtgtcacaccacttgct

SEQ ID NO: 13972 - DNA, 20 bp, Artificial Sequence
  Synthetic
aggatacatcgttatgcgcc

SEQ ID NO: 13973 - DNA, 20 bp, Artificial Sequence
  Synthetic
tcctcgactcgtttgatcct

SEQ ID NO: 13974 - DNA, 20 bp, Artificial Sequence
  Synthetic
caacagctggctgataaggt

SEQ ID NO: 13975 - DNA, 20 bp, Artificial Sequence
  Synthetic
agtcttctgtgtagacccgt

SEQ ID NO: 13976 - DNA, 18 bp, Artificial Sequence
  Synthetic
ccctcacagaacgcctct

SEQ ID NO: 13977 - DNA, 20 bp, Artificial Sequence
  Synthetic
aacatcatgctcgtccaacg

SEQ ID NO: 13978 - DNA, 20 bp, Artificial Sequence
  Synthetic
tggtatggcagctttttccc

SEQ ID NO: 13979 - DNA, 19 bp, Artificial Sequence
  Synthetic
gtcaaaacagaaagacgcc

SEQ ID NO: 13980 - DNA, 20 bp, Artificial Sequence
  Synthetic
gattccattgggatcagact

SEQ ID NO: 13981 - DNA, 20 bp, Artificial Sequence
  Synthetic
tctgctgaattgttcactct

SEQ ID NO: 13982 - DNA, 23 bp, Artificial Sequence
  Synthetic
gtaaaagcaaactacaatgatgc

SEQ ID NO: 13983 - DNA, 22 bp, Artificial Sequence
  Synthetic
gtattaatgatggcatgctttg

SEQ ID NO: 13984 - DNA, 21 bp, Artificial Sequence
  Synthetic
acaccctttctttttcgaatt

SEQ ID NO: 13985 - DNA, 18 bp, Artificial Sequence
  Synthetic
aacgtttggggtatcgtt

SEQ ID NO: 13986 - DNA, 18 bp, Artificial Sequence
  Synthetic
gaggaggagcagcaagaa

SEQ ID NO: 13987 - DNA, 25 bp, Artificial Sequence
  Synthetic
actttatcatctagaaagcaaactc

SEQ ID NO: 13988 - DNA, 22 bp, Artificial Sequence
  Synthetic
aaaattcgtagtgtacctgttg

SEQ ID NO: 13989 - DNA, 22 bp, Artificial Sequence
  Synthetic
agatagtaaacatagacagcct

SEQ ID NO: 13990 - DNA, 18 bp, Artificial Sequence
  Synthetic
cacgtcagcaaggcatta

SEQ ID NO: 13991 - DNA, 18 bp, Artificial Sequence
  Synthetic
tacagagccatcagggga

SEQ ID NO: 13992 - DNA, 20 bp, Artificial Sequence
  Synthetic
tctgtctagacttagagcgt

SEQ ID NO: 13993 - DNA, 19 bp, Artificial Sequence
  Synthetic
ggtacaggaggttctatgg

SEQ ID NO: 13994 - DNA, 20 bp, Artificial Sequence
  Synthetic
aatcaaagggaggagtttca

SEQ ID NO: 13995 - DNA, 18 bp, Artificial Sequence
  Synthetic
gttgatcagcttgccgaa

SEQ ID NO: 13996 - DNA, 23 bp, Artificial Sequence
  Synthetic
ttcattctgctactgatagactc

SEQ ID NO: 13997 - DNA, 23 bp, Artificial Sequence
  Synthetic
atggcctgatttacttaaaatgt

SEQ ID NO: 13998 - DNA, 25 bp, Artificial Sequence
  Synthetic
aacattatctcagacatgtagaaga

SEQ ID NO: 13999 - DNA, 24 bp, Artificial Sequence
  Synthetic
gattactactgtgaaactactctg

SEQ ID NO: 14000 - DNA, 19 bp, Artificial Sequence
  Synthetic
cctcaatgggaatggagat

SEQ ID NO: 14001 - DNA, 18 bp, Artificial Sequence
  Synthetic
ttgccgcgagtatcattg

SEQ ID NO: 14002 - DNA, 19 bp, Artificial Sequence
  Synthetic
ggtacgggatgtaatggat

SEQ ID NO: 14003 - DNA, 23 bp, Artificial Sequence
  Synthetic
aaaaaggagattatttgaaagcg

SEQ ID NO: 14004 - DNA, 18 bp, Artificial Sequence
  Synthetic
gaggacgaggacaaggaa

SEQ ID NO: 14005 - DNA, 20 bp, Artificial Sequence
  Synthetic
acattacaagacgttagcct

SEQ ID NO: 14006 - DNA, 21 bp, Artificial Sequence
  Synthetic
aacatctgtaccttccattcc

SEQ ID NO: 14007 - DNA, 21 bp, Artificial Sequence
  Synthetic
tttttcagatgtctctttggc

SEQ ID NO: 14008 - DNA, 20 bp, Artificial Sequence
  Synthetic
aagtttggttttcctgacac

SEQ ID NO: 14009 - DNA, 18 bp, Artificial Sequence
  Synthetic
aaggatccccatgtacca

SEQ ID NO: 14010 - DNA, 25 bp, Artificial Sequence
  Synthetic
ttagacatttatttaatagggctgg

SEQ ID NO: 14011 - DNA, 24 bp, Artificial Sequence
  Synthetic
ccccttaaaaaatacactttttgg

SEQ ID NO: 14012 - DNA, 18 bp, Artificial Sequence
  Synthetic
cggttgcatgctttttgg

SEQ ID NO: 14013 - DNA, 22 bp, Artificial Sequence
  Synthetic
caaaagagaactgcaatgtttc

SEQ ID NO: 14014 - DNA, 22 bp, Artificial Sequence
  Synthetic
gtgtattaactgtcaaaagcca

SEQ ID NO: 14015 - DNA, 23 bp, Artificial Sequence
  Synthetic
actgttatgagcaattaaatgac

SEQ ID NO: 14016 - DNA, 20 bp, Artificial Sequence
  Synthetic
gcttcaatccaatgatcgtc

SEQ ID NO: 14017 - DNA, 21 bp, Artificial Sequence
  Synthetic
ggtgaatagtatctgcaacac

SEQ ID NO: 14018 - DNA, 18 bp, Artificial Sequence
  Synthetic
ggtgctagcagaacttca

SEQ ID NO: 14019 - DNA, 21 bp, Artificial Sequence
  Synthetic
agaacttgatgaaatagggga

SEQ ID NO: 14020 - DNA, 21 bp, Artificial Sequence
  Synthetic
atttgaggaatgataccgacg

SEQ ID NO: 14021 - DNA, 22 bp, Artificial Sequence
  Synthetic
cagattgagagcatgattgaag

SEQ ID NO: 14022 - DNA, 22 bp, Artificial Sequence
  Synthetic
gattacaacacatttccagagg

SEQ ID NO: 14023 - DNA, 18 bp, Artificial Sequence
  Synthetic
cgaggagcatctgtgaga

SEQ ID NO: 14024 - DNA, 19 bp, Artificial Sequence
  Synthetic
tgttctcaaacaagatggc

SEQ ID NO: 14025 - DNA, 18 bp, Artificial Sequence
  Synthetic
atctcgggcagaagaagt

SEQ ID NO: 14026 - DNA, 20 bp, Artificial Sequence
  Synthetic
agtgtccgggattaatgagt

SEQ ID NO: 14027 - DNA, 18 bp, Artificial Sequence
  Synthetic
agggccaaacctgtacaa

SEQ ID NO: 14028 - DNA, 21 bp, Artificial Sequence
  Synthetic
gttctaacacgaacgtttacg

SEQ ID NO: 14029 - DNA, 18 bp, Artificial Sequence
  Synthetic
ttgcttgttgtcagtgct

SEQ ID NO: 14030 - DNA, 20 bp, Artificial Sequence
  Synthetic
agagcagccaaatataggtg

SEQ ID NO: 14031 - DNA, 18 bp, Artificial Sequence
  Synthetic
ctgtgtgccattcgacac

SEQ ID NO: 14032 - DNA, 18 bp, Artificial Sequence
  Synthetic
cagaacgagcaggaccta

SEQ ID NO: 14033 - DNA, 18 bp, Artificial Sequence
  Synthetic
gtacagtctctgggaggt

SEQ ID NO: 14034 - DNA, 22 bp, Artificial Sequence
  Synthetic
gcattttccttaacagacatca

SEQ ID NO: 14035 - DNA, 18 bp, Artificial Sequence
  Synthetic
caagttgtgccttccctt

SEQ ID NO: 14036 - DNA, 20 bp, Artificial Sequence
  Synthetic
aggacaatccacccaaactg

SEQ ID NO: 14037 - DNA, 22 bp, Artificial Sequence
  Synthetic
ttctgttattttaggggcattt

SEQ ID NO: 14038 - DNA, 21 bp, Artificial Sequence
  Synthetic
atctagttcagctgttcttca

SEQ ID NO: 14039 - DNA, 22 bp, Artificial Sequence
  Synthetic
aactgagttcacaactagtaca

SEQ ID NO: 14040 - DNA, 22 bp, Artificial Sequence
  Synthetic
gaagtggtgttactataggtgc

SEQ ID NO: 14041 - DNA, 23 bp, Artificial Sequence
  Synthetic
tttagataattcaacaggggatt

SEQ ID NO: 14042 - DNA, 19 bp, Artificial Sequence
  Synthetic
ccgtgcaaatgataacact

SEQ ID NO: 14043 - DNA, 21 bp, Artificial Sequence
  Synthetic
caaaatgttgcttttgatgca

SEQ ID NO: 14044 - DNA, 18 bp, Artificial Sequence
  Synthetic
ttcctttaggccgcaaat

SEQ ID NO: 14045 - DNA, 23 bp, Artificial Sequence
  Synthetic
ttgttaataaacgtttatgctgc

SEQ ID NO: 14046 - DNA, 23 bp, Artificial Sequence
  Synthetic
gatcatatgaacaaatggagact

SEQ ID NO: 14047 - DNA, 23 bp, Artificial Sequence
  Synthetic
gaacaatagcaatggagttaatc

SEQ ID NO: 14048 - DNA, 19 bp, Artificial Sequence
  Synthetic
tgaggggatcagttgcaca

SEQ ID NO: 14049 - DNA, 25 bp, Artificial Sequence
  Synthetic
caagtttcataagaggaaagaaagt

SEQ ID NO: 14050 - DNA, 23 bp, Artificial Sequence
  Synthetic
aagacaatagcataagaattggt

SEQ ID NO: 14051 - DNA, 19 bp, Artificial Sequence
  Synthetic
catgggctggctaacaatc

SEQ ID NO: 14052 - DNA, 23 bp, Artificial Sequence
  Synthetic
aattctcactatgaggaatgttc

SEQ ID NO: 14053 - DNA, 19 bp, Artificial Sequence
  Synthetic
tggtgtttggataggaagg

SEQ ID NO: 14054 - DNA, 20 bp, Artificial Sequence
  Synthetic
cagattgtgtattggaagca

SEQ ID NO: 14055 - DNA, 21 bp, Artificial Sequence
  Synthetic
tactttgtcgaaacactagcg

SEQ ID NO: 14056 - DNA, 24 bp, Artificial Sequence
  Synthetic
gtttagaaatgtcttaagcattgc

SEQ ID NO: 14057 - DNA, 21 bp, Artificial Sequence
  Synthetic
agtcttaggagtttcaatcct

SEQ ID NO: 14058 - DNA, 20 bp, Artificial Sequence
  Synthetic
agccaacttcagtatggagc

SEQ ID NO: 14059 - DNA, 25 bp, Artificial Sequence
  Synthetic
cgaaaacggtgtatataaaagatgt

SEQ ID NO: 14060 - DNA, 19 bp, Artificial Sequence
  Synthetic
tgctgcatgccataaatgt

SEQ ID NO: 14061 - DNA, 25 bp, Artificial Sequence
  Synthetic
aatattaagtatgcatggacctaag

SEQ ID NO: 14062 - DNA, 19 bp, Artificial Sequence
  Synthetic
aacattttgtgaacaggca

SEQ ID NO: 14063 - DNA, 18 bp, Artificial Sequence
  Synthetic
tgttctgaagtggaagca

SEQ ID NO: 14064 - DNA, 18 bp, Artificial Sequence
  Synthetic
gtgccacaatgtgcaaac

SEQ ID NO: 14065 - DNA, 22 bp, Artificial Sequence
  Synthetic
gacatagacagccaaatacagt

SEQ ID NO: 14066 - DNA, 22 bp, Artificial Sequence
  Synthetic
ggcaacaaagacaattgtatga

SEQ ID NO: 14067 - DNA, 19 bp, Artificial Sequence
  Synthetic
cggtatccgctactcagct

SEQ ID NO: 14068 - DNA, 23 bp, Artificial Sequence
  Synthetic
acagtttaaaatgtttacggtac

SEQ ID NO: 14069 - DNA, 18 bp, Artificial Sequence
  Synthetic
tatgtgtgctgccatgtc

SEQ ID NO: 14070 - DNA, 25 bp, Artificial Sequence
  Synthetic
tcctctttaattacatatgacaacc

SEQ ID NO: 14071 - DNA, 19 bp, Artificial Sequence
  Synthetic
tgcagcctttagtatctgc

SEQ ID NO: 14072 - DNA, 18 bp, Artificial Sequence
  Synthetic
tgaggacgttagggacaa

SEQ ID NO: 14073 - DNA, 20 bp, Artificial Sequence
  Synthetic
gggattccatgtttttttgc

SEQ ID NO: 14074 - DNA, 20 bp, Artificial Sequence
  Synthetic
tgtttgctggcataatcaat

SEQ ID NO: 14075 - DNA, 20 bp, Artificial Sequence
  Synthetic
atttgtgtttgtggtatggg

SEQ ID NO: 14076 - DNA, 18 bp, Artificial Sequence
  Synthetic
ggatgtcaatccgacctt

SEQ ID NO: 14077 - DNA, 20 bp, Artificial Sequence
  Synthetic
acagattgtgtattggaagc

SEQ ID NO: 14078 - DNA, 18 bp, Artificial Sequence
  Synthetic
ttgagacactggcaagga

SEQ ID NO: 14079 - DNA, 18 bp, Artificial Sequence
  Synthetic
ttaggcgtctccatcctg

SEQ ID NO: 14080 - DNA, 19 bp, Artificial Sequence
  Synthetic
tttgttgccaatttcagca

SEQ ID NO: 14081 - DNA, 22 bp, Artificial Sequence
  Synthetic
tgaatacaagtcaaagaggagt

SEQ ID NO: 14082 - DNA, 16 bp, Artificial Sequence
  Synthetic
cgccccaccacctcaa

SEQ ID NO: 14083 - DNA, 17 bp, Artificial Sequence
  Synthetic
tcggggacagctatgcg

SEQ ID NO: 14084 - DNA, 17 bp, Artificial Sequence
  Synthetic
tggagttgctacgcggc

SEQ ID NO: 14085 - DNA, 18 bp, Artificial Sequence
  Synthetic
ttggtgttggagcaacgc

SEQ ID NO: 14086 - DNA, 20 bp, Artificial Sequence
  Synthetic
ccgagagggaactgtgtgga

SEQ ID NO: 14087 - DNA, 20 bp, Artificial Sequence
  Synthetic
aaggccaaaatacctgggtc

SEQ ID NO: 14088 - DNA, 18 bp, Artificial Sequence
  Synthetic
gcgtggacgtctgcaatg

SEQ ID NO: 14089 - DNA, 19 bp, Artificial Sequence
  Synthetic
ccccactgtcaagcctttg

SEQ ID NO: 14090 - DNA, 19 bp, Artificial Sequence
  Synthetic
tggggttcctagcagtgtg

SEQ ID NO: 14091 - DNA, 19 bp, Artificial Sequence
  Synthetic
ctggtgcgtgttctaccaa

SEQ ID NO: 14092 - DNA, 16 bp, Artificial Sequence
  Synthetic
cagcggcagagcggtt

SEQ ID NO: 14093 - DNA, 19 bp, Artificial Sequence
  Synthetic
tcatggcactaacgggagg

SEQ ID NO: 14094 - DNA, 18 bp, Artificial Sequence
  Synthetic
tcttgtgtgacgagggcc

SEQ ID NO: 14095 - DNA, 20 bp, Artificial Sequence
  Synthetic
ggccatgacgtggtgatctg

SEQ ID NO: 14096 - DNA, 19 bp, Artificial Sequence
  Synthetic
ttgcaagatacgccactgg

SEQ ID NO: 14097 - DNA, 18 bp, Artificial Sequence
  Synthetic
tgaggatgcaacgcaggg

SEQ ID NO: 14098 - DNA, 16 bp, Artificial Sequence
  Synthetic
tgggcccccagctgat

SEQ ID NO: 14099 - DNA, 16 bp, Artificial Sequence
  Synthetic
cggcgaggagtcccaa

SEQ ID NO: 14100 - DNA, 19 bp, Artificial Sequence
  Synthetic
tttcaccaatggtcgctcg

SEQ ID NO: 14101 - DNA, 20 bp, Artificial Sequence
  Synthetic
ttgacctcctttctggcaag

SEQ ID NO: 14102 - DNA, 18 bp, Artificial Sequence
  Synthetic
gccttggtcgctacctgt

SEQ ID NO: 14103 - DNA, 17 bp, Artificial Sequence
  Synthetic
ccagcttggttgcgcag

SEQ ID NO: 14104 - DNA, 20 bp, Artificial Sequence
  Synthetic
ttgaggctatagggtctgca

SEQ ID NO: 14105 - DNA, 19 bp, Artificial Sequence
  Synthetic
atccgtgatgaggtgaggg

SEQ ID NO: 14106 - DNA, 20 bp, Artificial Sequence
  Synthetic
ccaaaccagcgtgtaaaagc

SEQ ID NO: 14107 - DNA, 20 bp, Artificial Sequence
  Synthetic
ttaaggctgctttggctgac

SEQ ID NO: 14108 - DNA, 19 bp, Artificial Sequence
  Synthetic
acccagtggtgagatacgt

SEQ ID NO: 14109 - DNA, 25 bp, Artificial Sequence
  Synthetic
tacctttaagtattagagacttagc

SEQ ID NO: 14110 - DNA, 22 bp, Artificial Sequence
  Synthetic
tagaaaagttagattgctgtgg

SEQ ID NO: 14111 - DNA, 25 bp, Artificial Sequence
  Synthetic
acaattatttgagagagatacagac

SEQ ID NO: 14112 - DNA, 18 bp, Artificial Sequence
  Synthetic
gtggaggtaccggctatt

SEQ ID NO: 14113 - DNA, 23 bp, Artificial Sequence
  Synthetic
catgatgatctatttgaaagctc

SEQ ID NO: 14114 - DNA, 23 bp, Artificial Sequence
  Synthetic
ggcaagtacttttgatttttcag

SEQ ID NO: 14115 - DNA, 23 bp, Artificial Sequence
  Synthetic
ttgcattttaatttatggtcctc

SEQ ID NO: 14116 - DNA, 23 bp, Artificial Sequence
  Synthetic
tatgaaagcagataatacacctc

SEQ ID NO: 14117 - DNA, 16 bp, Artificial Sequence
  Synthetic
cagctccacgcctcca

SEQ ID NO: 14118 - DNA, 17 bp, Artificial Sequence
  Synthetic
tcgggcccttacaagca

SEQ ID NO: 14119 - DNA, 18 bp, Artificial Sequence
  Synthetic
gagggtcacttcgatcag

SEQ ID NO: 14120 - DNA, 21 bp, Artificial Sequence
  Synthetic
aggagagattttgatgaagcg

SEQ ID NO: 14121 - DNA, 20 bp, Artificial Sequence
  Synthetic
tctaactgagtccacaggcg

SEQ ID NO: 14122 - DNA, 23 bp, Artificial Sequence
  Synthetic
ttcgttttgcatttgataatcct

SEQ ID NO: 14123 - DNA, 24 bp, Artificial Sequence
  Synthetic
catactatacacaagacacaaagg

SEQ ID NO: 14124 - DNA, 23 bp, Artificial Sequence
  Synthetic
aaagatacagaaaacagtaatgc

SEQ ID NO: 14125 - DNA, 24 bp, Artificial Sequence
  Synthetic
caaaaatcagttttacattccagg

SEQ ID NO: 14126 - DNA, 18 bp, Artificial Sequence
  Synthetic
ccaagctgggttacaaca

SEQ ID NO: 14127 - DNA, 23 bp, Artificial Sequence
  Synthetic
gacaatatgtttactcatgcaga

SEQ ID NO: 14128 - DNA, 20 bp, Artificial Sequence
  Synthetic
ctttctccaaggacaactca

SEQ ID NO: 14129 - DNA, 18 bp, Artificial Sequence
  Synthetic
atagcatggtccagctca

SEQ ID NO: 14130 - DNA, 18 bp, Artificial Sequence
  Synthetic
cacattggtccactgtca

SEQ ID NO: 14131 - DNA, 18 bp, Artificial Sequence
  Synthetic
ggtgggcctttgacaatg

SEQ ID NO: 14132 - DNA, 22 bp, Artificial Sequence
  Synthetic
gcttcgagcactaataaaactg

SEQ ID NO: 14133 - DNA, 22 bp, Artificial Sequence
  Synthetic
agagataaagaagagcgtctac

SEQ ID NO: 14134 - DNA, 22 bp, Artificial Sequence
  Synthetic
tgattcaatggcaaagaaaacc

SEQ ID NO: 14135 - DNA, 20 bp, Artificial Sequence
  Synthetic
aaacctttaagttttggcgc

SEQ ID NO: 14136 - DNA, 23 bp, Artificial Sequence
  Synthetic
aattgattgttgttatgctgaac

SEQ ID NO: 14137 - DNA, 18 bp, Artificial Sequence
  Synthetic
cttgtggagcaggtgtac

SEQ ID NO: 14138 - DNA, 20 bp, Artificial Sequence
  Synthetic
actgatggatctgatgtctc

SEQ ID NO: 14139 - DNA, 18 bp, Artificial Sequence
  Synthetic
gtcatgagtcagctgcta

SEQ ID NO: 14140 - DNA, 22 bp, Artificial Sequence
  Synthetic
acagatgtagtacattttggtt

SEQ ID NO: 14141 - DNA, 23 bp, Artificial Sequence
  Synthetic
tactaataaaacctggacatgtt

SEQ ID NO: 14142 - DNA, 20 bp, Artificial Sequence
  Synthetic
ctccggatctcttcaagggt

SEQ ID NO: 14143 - DNA, 22 bp, Artificial Sequence
  Synthetic
accagatacaatagtgacaact

SEQ ID NO: 14144 - DNA, 23 bp, Artificial Sequence
  Synthetic
taacatttggtgaggaaatacca

SEQ ID NO: 14145 - DNA, 23 bp, Artificial Sequence
  Synthetic
tacctctaatacctggaagatcc

SEQ ID NO: 14146 - DNA, 22 bp, Artificial Sequence
  Synthetic
ttaccgatgagtctaaagtagc

SEQ ID NO: 14147 - DNA, 23 bp, Artificial Sequence
  Synthetic
taataagtatgtggatgctgaga

SEQ ID NO: 14148 - DNA, 20 bp, Artificial Sequence
  Synthetic
tggaaatgcaaactttgagc

SEQ ID NO: 14149 - DNA, 18 bp, Artificial Sequence
  Synthetic
agtggctcacttgtctcc

SEQ ID NO: 14150 - DNA, 25 bp, Artificial Sequence
  Synthetic
taaacttgagtgaaaagttaactgg

SEQ ID NO: 14151 - DNA, 21 bp, Artificial Sequence
  Synthetic
gatgtcaatccgactctactg

SEQ ID NO: 14152 - DNA, 19 bp, Artificial Sequence
  Synthetic
acaaacagactgtgtcctg

SEQ ID NO: 14153 - DNA, 21 bp, Artificial Sequence
  Synthetic
aggatgtgatggaatcaatgg

SEQ ID NO: 14154 - DNA, 22 bp, Artificial Sequence
  Synthetic
cgttgaaactttagctagaagc

SEQ ID NO: 14155 - DNA, 20 bp, Artificial Sequence
  Synthetic
catcgcaccaataatgttct

SEQ ID NO: 14156 - DNA, 20 bp, Artificial Sequence
  Synthetic
agtctcggtactgaatcttg

SEQ ID NO: 14157 - DNA, 20 bp, Artificial Sequence
  Synthetic
tggagtgtctggaataaacg

SEQ ID NO: 14158 - DNA, 19 bp, Artificial Sequence
  Synthetic
ccaatcaagggcaggacta

SEQ ID NO: 14159 - DNA, 20 bp, Artificial Sequence
  Synthetic
tagccaaaggggaattcttg

SEQ ID NO: 14160 - DNA, 18 bp, Artificial Sequence
  Synthetic
agacgtgacaaccgacta

SEQ ID NO: 14161 - DNA, 23 bp, Artificial Sequence
  Synthetic
cctgatattgttttagaagagct

SEQ ID NO: 14162 - DNA, 18 bp, Artificial Sequence
  Synthetic
aagttttatgccaccccg

SEQ ID NO: 14163 - DNA, 18 bp, Artificial Sequence
  Synthetic
ttcaacctgatgccactg

SEQ ID NO: 14164 - DNA, 18 bp, Artificial Sequence
  Synthetic
gttgtagctctgcatgga

SEQ ID NO: 14165 - DNA, 21 bp, Artificial Sequence
  Synthetic
aatttgaaggcaacacaatcg

SEQ ID NO: 14166 - DNA, 24 bp, Artificial Sequence
  Synthetic
tcaatagttccattagtagaaggc

SEQ ID NO: 14167 - DNA, 23 bp, Artificial Sequence
  Synthetic
tgttaatgtattagttgacccca

SEQ ID NO: 14168 - DNA, 25 bp, Artificial Sequence
  Synthetic
tgttcagtttgaatatagaaatccc

SEQ ID NO: 14169 - DNA, 18 bp, Artificial Sequence
  Synthetic
aagtactcctgttgccag

SEQ ID NO: 14170 - DNA, 24 bp, Artificial Sequence
  Synthetic
ttggaaactagtaggtatagaagt

SEQ ID NO: 14171 - DNA, 20 bp, Artificial Sequence
  Synthetic
aagtgtcctccaatacaact

SEQ ID NO: 14172 - DNA, 23 bp, Artificial Sequence
  Synthetic
aggttgatattaaggacattgtc

SEQ ID NO: 14173 - DNA, 20 bp, Artificial Sequence
  Synthetic
agatgtagatttgagtccgc

SEQ ID NO: 14174 - DNA, 20 bp, Artificial Sequence
  Synthetic
gacgaagacccagatcatcc

SEQ ID NO: 14175 - DNA, 18 bp, Artificial Sequence
  Synthetic
ctacaagaagaggctcgg

SEQ ID NO: 14176 - DNA, 18 bp, Artificial Sequence
  Synthetic
ggaggtggtggaagagtc

SEQ ID NO: 14177 - DNA, 18 bp, Artificial Sequence
  Synthetic
cccgctgtttctacaact

SEQ ID NO: 14178 - DNA, 23 bp, Artificial Sequence
  Synthetic
aggaatttaatattgaagagcca

SEQ ID NO: 14179 - DNA, 19 bp, Artificial Sequence
  Synthetic
gaaaacagtgatgcacctt

SEQ ID NO: 14180 - DNA, 23 bp, Artificial Sequence
  Synthetic
gtattacatcccagtcatatccc

SEQ ID NO: 14181 - DNA, 23 bp, Artificial Sequence
  Synthetic
agacggtttgtttatcaaattgg

SEQ ID NO: 14182 - DNA, 22 bp, Artificial Sequence
  Synthetic
ttttccaatcttctcatctgac

SEQ ID NO: 14183 - DNA, 22 bp, Artificial Sequence
  Synthetic
ctactcctgtaactattaccga

SEQ ID NO: 14184 - DNA, 19 bp, Artificial Sequence
  Synthetic
acgaagttttgtcaccaga

SEQ ID NO: 14185 - DNA, 20 bp, Artificial Sequence
  Synthetic
gcagacatagatttgagtcc

SEQ ID NO: 14186 - DNA, 23 bp, Artificial Sequence
  Synthetic
tattcaaattatgtgtgaccctc

SEQ ID NO: 14187 - DNA, 24 bp, Artificial Sequence
  Synthetic
gtattcactaatacgttttctgga

SEQ ID NO: 14188 - DNA, 19 bp, Artificial Sequence
  Synthetic
ctcaccagaagaagagcag

SEQ ID NO: 14189 - DNA, 21 bp, Artificial Sequence
  Synthetic
ttgatgaaaaagcacaaacct

SEQ ID NO: 14190 - DNA, 25 bp, Artificial Sequence
  Synthetic
atgggtagattatgatagtagtagc

SEQ ID NO: 14191 - DNA, 19 bp, Artificial Sequence
  Synthetic
tggatcctttgggacctac

SEQ ID NO: 14192 - DNA, 20 bp, Artificial Sequence
  Synthetic
ctaaggcttttcaaagagca

SEQ ID NO: 14193 - DNA, 21 bp, Artificial Sequence
  Synthetic
atcacaatgccaactattcct

SEQ ID NO: 14194 - DNA, 18 bp, Artificial Sequence
  Synthetic
acaaggttgtggtgccta

SEQ ID NO: 14195 - DNA, 21 bp, Artificial Sequence
  Synthetic
gtgtacctttggacatagtgg

SEQ ID NO: 14196 - DNA, 19 bp, Artificial Sequence
  Synthetic
ttcctctggaacctgatgt

SEQ ID NO: 14197 - DNA, 19 bp, Artificial Sequence
  Synthetic
acatgttttgagcctctcc

SEQ ID NO: 14198 - DNA, 18 bp, Artificial Sequence
  Synthetic
acagtctttggctgcaac

SEQ ID NO: 14199 - DNA, 20 bp, Artificial Sequence
  Synthetic
ccatctcgggggtctctagc

SEQ ID NO: 14200 - DNA, 17 bp, Artificial Sequence
  Synthetic
atgctctggggcacaca

SEQ ID NO: 14201 - DNA, 16 bp, Artificial Sequence
  Synthetic
tggggctggacgttcg

SEQ ID NO: 14202 - DNA, 16 bp, Artificial Sequence
  Synthetic
gccacgtacgcgctgt

SEQ ID NO: 14203 - DNA, 18 bp, Artificial Sequence
  Synthetic
tgttggtgttgacgacgg

SEQ ID NO: 14204 - DNA, 16 bp, Artificial Sequence
  Synthetic
gccacgaccagctgct

SEQ ID NO: 14205 - DNA, 18 bp, Artificial Sequence
  Synthetic
cgtaagcacggggagggt

SEQ ID NO: 14206 - DNA, 16 bp, Artificial Sequence
  Synthetic
tctggcggacggaaca

SEQ ID NO: 14207 - DNA, 19 bp, Artificial Sequence
  Synthetic
ttctccctgttcaacccca

SEQ ID NO: 14208 - DNA, 18 bp, Artificial Sequence
  Synthetic
cagttgccactgggtcct

SEQ ID NO: 14209 - DNA, 18 bp, Artificial Sequence
  Synthetic
tgcttttggccatctgca

SEQ ID NO: 14210 - DNA, 18 bp, Artificial Sequence
  Synthetic
tcgaacaccagctgcatg

SEQ ID NO: 14211 - DNA, 16 bp, Artificial Sequence
  Synthetic
gtggtcacgtccccga

SEQ ID NO: 14212 - DNA, 18 bp, Artificial Sequence
  Synthetic
acactcgtgtccggagag

SEQ ID NO: 14213 - DNA, 19 bp, Artificial Sequence
  Synthetic
gcagatcaccgtcctgttg

SEQ ID NO: 14214 - DNA, 18 bp, Artificial Sequence
  Synthetic
cgttgtttcggcagcagc

SEQ ID NO: 14215 - DNA, 16 bp, Artificial Sequence
  Synthetic
ttgctgggtcctgcgg

SEQ ID NO: 14216 - DNA, 16 bp, Artificial Sequence
  Synthetic
gcccggggcttttcgt

SEQ ID NO: 14217 - DNA, 16 bp, Artificial Sequence
  Synthetic
acacaggcgggacacc

SEQ ID NO: 14218 - DNA, 16 bp, Artificial Sequence
  Synthetic
cagaccccccgaagct

SEQ ID NO: 14219 - DNA, 17 bp, Artificial Sequence
  Synthetic
tcgctgcttcctcgagt

SEQ ID NO: 14220 - DNA, 16 bp, Artificial Sequence
  Synthetic
cgcgcgggactttagc

SEQ ID NO: 14221 - DNA, 16 bp, Artificial Sequence
  Synthetic
tcgggggtttcctccg

SEQ ID NO: 14222 - DNA, 19 bp, Artificial Sequence
  Synthetic
gggcgcgtcagatacagaa

SEQ ID NO: 14223 - DNA, 16 bp, Artificial Sequence
  Synthetic
ccgtggccgagatcgt

SEQ ID NO: 14224 - DNA, 18 bp, Artificial Sequence
  Synthetic
ggccgattccttcatgca

SEQ ID NO: 14225 - DNA, 17 bp, Artificial Sequence
  Synthetic
tcccccaacactgacgt

SEQ ID NO: 14226 - DNA, 18 bp, Artificial Sequence
  Synthetic
gtctcctagttggcccgc

SEQ ID NO: 14227 - DNA, 16 bp, Artificial Sequence
  Synthetic
cggggtttctggggct

SEQ ID NO: 14228 - DNA, 16 bp, Artificial Sequence
  Synthetic
ctgtacgtcgctggcg

SEQ ID NO: 14229 - DNA, 16 bp, Artificial Sequence
  Synthetic
tggagctggcccagga

SEQ ID NO: 14230 - DNA, 16 bp, Artificial Sequence
  Synthetic
gttcacgaacgccgcg

SEQ ID NO: 14231 - DNA, 20 bp, Artificial Sequence
  Synthetic
tgcatcggcaacaacaaagc

SEQ ID NO: 14232 - DNA, 20 bp, Artificial Sequence
  Synthetic
agctccggaaacttggtaca

SEQ ID NO: 14233 - DNA, 16 bp, Artificial Sequence
  Synthetic
ggtgggcggcagcatt

SEQ ID NO: 14234 - DNA, 16 bp, Artificial Sequence
  Synthetic
acccacgcccacatcc

SEQ ID NO: 14235 - DNA, 17 bp, Artificial Sequence
  Synthetic
ggcgttgtagtgtgccc

SEQ ID NO: 14236 - DNA, 16 bp, Artificial Sequence
  Synthetic
gcagaccgcgccgttt

SEQ ID NO: 14237 - DNA, 16 bp, Artificial Sequence
  Synthetic
cgaatcgcggccagca

SEQ ID NO: 14238 - DNA, 16 bp, Artificial Sequence
  Synthetic
acgaagccatacgcgc

SEQ ID NO: 14239 - DNA, 16 bp, Artificial Sequence
  Synthetic
tcttctgcgtgcccgt

SEQ ID NO: 14240 - DNA, 19 bp, Artificial Sequence
  Synthetic
gacgtctgggaacacaggc

SEQ ID NO: 14241 - DNA, 20 bp, Artificial Sequence
  Synthetic
accatcacggactttcccct

SEQ ID NO: 14242 - DNA, 16 bp, Artificial Sequence
  Synthetic
tgcgctccatggcaga

SEQ ID NO: 14243 - DNA, 20 bp, Artificial Sequence
  Synthetic
caaactcgtgatcctccagc

SEQ ID NO: 14244 - DNA, 16 bp, Artificial Sequence
  Synthetic
acgtcgccgagcatcc

SEQ ID NO: 14245 - DNA, 19 bp, Artificial Sequence
  Synthetic
cgatcagaaagcccccatt

SEQ ID NO: 14246 - DNA, 19 bp, Artificial Sequence
  Synthetic
tggatatggcgtcggaaga

SEQ ID NO: 14247 - DNA, 17 bp, Artificial Sequence
  Synthetic
gccgtccagaaccactg

SEQ ID NO: 14248 - DNA, 18 bp, Artificial Sequence
  Synthetic
ccgacagaaacccgttgt

SEQ ID NO: 14249 - DNA, 16 bp, Artificial Sequence
  Synthetic
gcctcgcggttggtga

SEQ ID NO: 14250 - DNA, 17 bp, Artificial Sequence
  Synthetic
tgaacagctgcaacggg

SEQ ID NO: 14251 - DNA, 16 bp, Artificial Sequence
  Synthetic
ttcggacggacacgcg

SEQ ID NO: 14252 - DNA, 16 bp, Artificial Sequence
  Synthetic
ttcgaggcggaggtgg

SEQ ID NO: 14253 - DNA, 18 bp, Artificial Sequence
  Synthetic
agagcctcctcagcatcc

SEQ ID NO: 14254 - DNA, 20 bp, Artificial Sequence
  Synthetic
actccatctttgtgctgtgc

SEQ ID NO: 14255 - DNA, 16 bp, Artificial Sequence
  Synthetic
tagtgcaggtgggcgg

SEQ ID NO: 14256 - DNA, 17 bp, Artificial Sequence
  Synthetic
gggcggcacacctatca

SEQ ID NO: 14257 - DNA, 16 bp, Artificial Sequence
  Synthetic
ctcggcgacctggaca

SEQ ID NO: 14258 - DNA, 18 bp, Artificial Sequence
  Synthetic
taatgtcgcggatgctgc

SEQ ID NO: 14259 - DNA, 18 bp, Artificial Sequence
  Synthetic
ccctagggggccaatggt

SEQ ID NO: 14260 - DNA, 18 bp, Artificial Sequence
  Synthetic
gcatgcacgataccgacc

SEQ ID NO: 14261 - DNA, 17 bp, Artificial Sequence
  Synthetic
ggagatagcccagccca

SEQ ID NO: 14262 - DNA, 18 bp, Artificial Sequence
  Synthetic
tctatgcgctggaggtgc

SEQ ID NO: 14263 - DNA, 18 bp, Artificial Sequence
  Synthetic
tgtgtatacggacgcgcc

SEQ ID NO: 14264 - DNA, 19 bp, Artificial Sequence
  Synthetic
actcaggacatcggtgtgt

SEQ ID NO: 14265 - DNA, 16 bp, Artificial Sequence
  Synthetic
acaaggcgaccctgcg

SEQ ID NO: 14266 - DNA, 19 bp, Artificial Sequence
  Synthetic
tgttcaaagacgcggtgaa

SEQ ID NO: 14267 - DNA, 18 bp, Artificial Sequence
  Synthetic
tccttgtagaacgcgggt

SEQ ID NO: 14268 - DNA, 18 bp, Artificial Sequence
  Synthetic
agagctgggtctggagtc

SEQ ID NO: 14269 - DNA, 19 bp, Artificial Sequence
  Synthetic
ccggggcatccttatccat

SEQ ID NO: 14270 - DNA, 16 bp, Artificial Sequence
  Synthetic
tgacgaggccgcagct

SEQ ID NO: 14271 - DNA, 20 bp, Artificial Sequence
  Synthetic
ggtgtgtgatgatttcgcca

SEQ ID NO: 14272 - DNA, 17 bp, Artificial Sequence
  Synthetic
ggagggtcagccgttca

SEQ ID NO: 14273 - DNA, 16 bp, Artificial Sequence
  Synthetic
cgtacaggggctgggt

SEQ ID NO: 14274 - DNA, 18 bp, Artificial Sequence
  Synthetic
cgccgtctaagtggagct

SEQ ID NO: 14275 - DNA, 16 bp, Artificial Sequence
  Synthetic
ggaccggacggacctt

SEQ ID NO: 14276 - DNA, 16 bp, Artificial Sequence
  Synthetic
cgcagaacgccctcga

SEQ ID NO: 14277 - DNA, 17 bp, Artificial Sequence
  Synthetic
tgcgcggacaattaggc

SEQ ID NO: 14278 - DNA, 16 bp, Artificial Sequence
  Synthetic
tcctgatgggccgcca

SEQ ID NO: 14279 - DNA, 18 bp, Artificial Sequence
  Synthetic
cgacaagatcggactgcg

SEQ ID NO: 14280 - DNA, 16 bp, Artificial Sequence
  Synthetic
ttaagcacggccgggc

SEQ ID NO: 14281 - DNA, 17 bp, Artificial Sequence
  Synthetic
tccctgcagcacctctc

SEQ ID NO: 14282 - DNA, 17 bp, Artificial Sequence
  Synthetic
gtgcgtctggtggtcgt

SEQ ID NO: 14283 - DNA, 17 bp, Artificial Sequence
  Synthetic
tggacctctccgacagc

SEQ ID NO: 14284 - DNA, 16 bp, Artificial Sequence
  Synthetic
cgggccccggacataa

SEQ ID NO: 14285 - DNA, 16 bp, Artificial Sequence
  Synthetic
cgcgcccgagttttgc

SEQ ID NO: 14286 - DNA, 18 bp, Artificial Sequence
  Synthetic
attggcacggacaacagg

SEQ ID NO: 14287 - DNA, 16 bp, Artificial Sequence
  Synthetic
ggatgcgccccaaagc

SEQ ID NO: 14288 - DNA, 19 bp, Artificial Sequence
  Synthetic
cttcacccccagtaccctc

SEQ ID NO: 14289 - DNA, 16 bp, Artificial Sequence
  Synthetic
aggatgaagccccccg

SEQ ID NO: 14290 - DNA, 20 bp, Artificial Sequence
  Synthetic
accggatagcagatgtgagg

SEQ ID NO: 14291 - DNA, 16 bp, Artificial Sequence
  Synthetic
cggtgcagcagtcgga

SEQ ID NO: 14292 - DNA, 16 bp, Artificial Sequence
  Synthetic
tggccggacgaacgac

SEQ ID NO: 14293 - DNA, 17 bp, Artificial Sequence
  Synthetic
tacgggggggtaggtca

SEQ ID NO: 14294 - DNA, 16 bp, Artificial Sequence
  Synthetic
gccgtcccgggtgttt

SEQ ID NO: 14295 - DNA, 18 bp, Artificial Sequence
  Synthetic
ccccccggtatacgacga

SEQ ID NO: 14296 - DNA, 18 bp, Artificial Sequence
  Synthetic
tcggaggggtgtgtcttt

SEQ ID NO: 14297 - DNA, 20 bp, Artificial Sequence
  Synthetic
tctggtcctccccaagtacc

SEQ ID NO: 14298 - DNA, 17 bp, Artificial Sequence
  Synthetic
actgccgtccacaacgc

SEQ ID NO: 14299 - DNA, 18 bp, Artificial Sequence
  Synthetic
tcgtccctcgcatgaagc

SEQ ID NO: 14300 - DNA, 16 bp, Artificial Sequence
  Synthetic
cggggcggtcattgga

SEQ ID NO: 14301 - DNA, 17 bp, Artificial Sequence
  Synthetic
gcgcagtctggcatctg

SEQ ID NO: 14302 - DNA, 18 bp, Artificial Sequence
  Synthetic
ccccccaaaccatgtccg

SEQ ID NO: 14303 - DNA, 17 bp, Artificial Sequence
  Synthetic
ccagcctggttgtccgt

SEQ ID NO: 14304 - DNA, 17 bp, Artificial Sequence
  Synthetic
gcaacgcgggactatgc

SEQ ID NO: 14305 - DNA, 16 bp, Artificial Sequence
  Synthetic
gcggccgtggttaacc

SEQ ID NO: 14306 - DNA, 16 bp, Artificial Sequence
  Synthetic
tcagcgcgatccgaca

SEQ ID NO: 14307 - DNA, 18 bp, Artificial Sequence
  Synthetic
gatcgcctgtctcctcgt

SEQ ID NO: 14308 - DNA, 25 bp, Artificial Sequence
  Synthetic
atcagaagataataaccattggatc

SEQ ID NO: 14309 - DNA, 18 bp, Artificial Sequence
  Synthetic
aggtttgagtctgttgct

SEQ ID NO: 14310 - DNA, 25 bp, Artificial Sequence
  Synthetic
gaaaaagggaaagtagttaaatcag

SEQ ID NO: 14311 - DNA, 23 bp, Artificial Sequence
  Synthetic
aaagggttttcatttaaatacgg

SEQ ID NO: 14312 - DNA, 20 bp, Artificial Sequence
  Synthetic
tgtatccctcctgttgctgt

SEQ ID NO: 14313 - DNA, 23 bp, Artificial Sequence
  Synthetic
ctttgggtatacatttaaaccct

SEQ ID NO: 14314 - DNA, 20 bp, Artificial Sequence
  Synthetic
cgtctgtgccttctcatctg

SEQ ID NO: 14315 - DNA, 20 bp, Artificial Sequence
  Synthetic
ttagagtctcctgagcattg

SEQ ID NO: 14316 - DNA, 20 bp, Artificial Sequence
  Synthetic
gaaacaacacatagcgcctc

SEQ ID NO: 14317 - DNA, 22 bp, Artificial Sequence
  Synthetic
aataaaagaactacggaacctg

SEQ ID NO: 14318 - DNA, 19 bp, Artificial Sequence
  Synthetic
gatcagatcgagtgatggt

SEQ ID NO: 14319 - DNA, 19 bp, Artificial Sequence
  Synthetic
ctaattattgcggccagga

SEQ ID NO: 14320 - DNA, 18 bp, Artificial Sequence
  Synthetic
aagcgggtcatcagtcaa

SEQ ID NO: 14321 - DNA, 20 bp, Artificial Sequence
  Synthetic
gacctgaatttcgtcaacag

SEQ ID NO: 14322 - DNA, 20 bp, Artificial Sequence
  Synthetic
tgatcggtttttgagagttc

SEQ ID NO: 14323 - DNA, 18 bp, Artificial Sequence
  Synthetic
ccaaggccattagaagcc

SEQ ID NO: 14324 - DNA, 18 bp, Artificial Sequence
  Synthetic
gaaaagatgccggcactt

SEQ ID NO: 14325 - DNA, 23 bp, Artificial Sequence
  Synthetic
tattttgatgttactcctgatgt

SEQ ID NO: 14326 - DNA, 21 bp, Artificial Sequence
  Synthetic
aagagttaaatgtgaggtgtc

SEQ ID NO: 14327 - DNA, 24 bp, Artificial Sequence
  Synthetic
aggagcatccagtatataaagttg

SEQ ID NO: 14328 - DNA, 25 bp, Artificial Sequence
  Synthetic
gtggatgatatacaatgtattgatg

SEQ ID NO: 14329 - DNA, 20 bp, Artificial Sequence
  Synthetic
ttgaattttcaggacagtgg

SEQ ID NO: 14330 - DNA, 24 bp, Artificial Sequence
  Synthetic
tggactcccaaataaattattgga

SEQ ID NO: 14331 - DNA, 20 bp, Artificial Sequence
  Synthetic
cagctctgcaagttccttct

SEQ ID NO: 14332 - DNA, 19 bp, Artificial Sequence
  Synthetic
cgactcttgctgatcgatt

SEQ ID NO: 14333 - DNA, 23 bp, Artificial Sequence
  Synthetic
caacattaattgaatcaggagga

SEQ ID NO: 14334 - DNA, 19 bp, Artificial Sequence
  Synthetic
ctttagcactgacgtcact

SEQ ID NO: 14335 - DNA, 19 bp, Artificial Sequence
  Synthetic
ctataggttctgacgctgc

SEQ ID NO: 14336 - DNA, 18 bp, Artificial Sequence
  Synthetic
caagaccaatcgccagag

SEQ ID NO: 14337 - DNA, 23 bp, Artificial Sequence
  Synthetic
ttaagaggtattgaaataggtcg

SEQ ID NO: 14338 - DNA, 24 bp, Artificial Sequence
  Synthetic
tccacctgtgcaattaattaattc

SEQ ID NO: 14339 - DNA, 19 bp, Artificial Sequence
  Synthetic
ctaagtgtcctactgctgc

SEQ ID NO: 14340 - DNA, 25 bp, Artificial Sequence
  Synthetic
attgtgataaaatactgtgaatccc

SEQ ID NO: 14341 - DNA, 18 bp, Artificial Sequence
  Synthetic
gagggtcgatactgccaa

SEQ ID NO: 14342 - DNA, 22 bp, Artificial Sequence
  Synthetic
gggagataaggctactattcct

SEQ ID NO: 14343 - DNA, 21 bp, Artificial Sequence
  Synthetic
acagatctcagagctaagtcc

SEQ ID NO: 14344 - DNA, 20 bp, Artificial Sequence
  Synthetic
ccgagagaatctggaaccac

SEQ ID NO: 14345 - DNA, 23 bp, Artificial Sequence
  Synthetic
tttggaagtttggtatattttgg

SEQ ID NO: 14346 - DNA, 23 bp, Artificial Sequence
  Synthetic
gggcctgatatatcttttattgc

SEQ ID NO: 14347 - DNA, 25 bp, Artificial Sequence
  Synthetic
gtgatactaatgtgtttgtagatcc

SEQ ID NO: 14348 - DNA, 20 bp, Artificial Sequence
  Synthetic
tttgagtttgaaaatcccgc

SEQ ID NO: 14349 - DNA, 19 bp, Artificial Sequence
  Synthetic
cctactgctgaaccagaag

SEQ ID NO: 14350 - DNA, 21 bp, Artificial Sequence
  Synthetic
tgaatattttaccgtggtgtc

SEQ ID NO: 14351 - DNA, 20 bp, Artificial Sequence
  Synthetic
aggaggagacatagaatcct

SEQ ID NO: 14352 - DNA, 18 bp, Artificial Sequence
  Synthetic
ctgaggctgcagggactt

SEQ ID NO: 14353 - DNA, 20 bp, Artificial Sequence
  Synthetic
tctgttaggacccttctcgc

SEQ ID NO: 14354 - DNA, 18 bp, Artificial Sequence
  Synthetic
gcgagaaactccgtcttg

SEQ ID NO: 14355 - DNA, 20 bp, Artificial Sequence
  Synthetic
acaagtagaccaacagcacc

SEQ ID NO: 14356 - DNA, 19 bp, Artificial Sequence
  Synthetic
caagagggtctgacatagc

SEQ ID NO: 14357 - DNA, 18 bp, Artificial Sequence
  Synthetic
ggaccaagccctatccca

SEQ ID NO: 14358 - DNA, 21 bp, Artificial Sequence
  Synthetic
accataatgacaggagatacc

SEQ ID NO: 14359 - DNA, 24 bp, Artificial Sequence
  Synthetic
aaataaggtgactcaagatttcac

SEQ ID NO: 14360 - DNA, 19 bp, Artificial Sequence
  Synthetic
gacaggacaggtttagagc

SEQ ID NO: 14361 - DNA, 18 bp, Artificial Sequence
  Synthetic
cagaagaagtgcagtgga

SEQ ID NO: 14362 - DNA, 21 bp, Artificial Sequence
  Synthetic
gagtgggactttgtatctacc

SEQ ID NO: 14363 - DNA, 19 bp, Artificial Sequence
  Synthetic
agtctatgttgcatgggtc

SEQ ID NO: 14364 - DNA, 20 bp, Artificial Sequence
  Synthetic
gaagcagaagtcatcccaca

SEQ ID NO: 14365 - DNA, 19 bp, Artificial Sequence
  Synthetic
aagaaggggaggaataggg

SEQ ID NO: 14366 - DNA, 21 bp, Artificial Sequence
  Synthetic
gaacctaacaccagaaaaagg

SEQ ID NO: 14367 - DNA, 21 bp, Artificial Sequence
  Synthetic
ccatagaagccttaaacaggg

SEQ ID NO: 14368 - DNA, 20 bp, Artificial Sequence
  Synthetic
aggaagaagccttaagacat

SEQ ID NO: 14369 - DNA, 18 bp, Artificial Sequence
  Synthetic
agacgaagaaggactcca

SEQ ID NO: 14370 - DNA, 22 bp, Artificial Sequence
  Synthetic
tggaataatacagtgacagaac

SEQ ID NO: 14371 - DNA, 22 bp, Artificial Sequence
  Synthetic
catggtatttagaagatgtggt

SEQ ID NO: 14372 - DNA, 23 bp, Artificial Sequence
  Synthetic
gtaagagaccaggaaataagaca

SEQ ID NO: 14373 - DNA, 21 bp, Artificial Sequence
  Synthetic
caattgggtagaagacaagaa

SEQ ID NO: 14374 - DNA, 19 bp, Artificial Sequence
  Synthetic
aagagtcactgctatcgag

SEQ ID NO: 14375 - DNA, 20 bp, Artificial Sequence
  Synthetic
actatccaagaactccccga

SEQ ID NO: 14376 - DNA, 18 bp, Artificial Sequence
  Synthetic
agagtacatgaacagccc

SEQ ID NO: 14377 - DNA, 21 bp, Artificial Sequence
  Synthetic
aacaagcagacatgatgatga

SEQ ID NO: 14378 - DNA, 18 bp, Artificial Sequence
  Synthetic
gagaggctggcagatcga

SEQ ID NO: 14379 - DNA, 24 bp, Artificial Sequence
  Synthetic
gaaggcaataattgtactactcat

SEQ ID NO: 14380 - DNA, 19 bp, Artificial Sequence
  Synthetic
cctaggcagaccaaaatgc

SEQ ID NO: 14381 - DNA, 18 bp, Artificial Sequence
  Synthetic
atgggaacggcttcttca

SEQ ID NO: 14382 - DNA, 20 bp, Artificial Sequence
  Synthetic
ccaaatcaaacagaagacga

SEQ ID NO: 14383 - DNA, 20 bp, Artificial Sequence
  Synthetic
ccaatatgggtgaaaacacc

SEQ ID NO: 14384 - DNA, 18 bp, Artificial Sequence
  Synthetic
cggagcaatgaatgagct

SEQ ID NO: 14385 - DNA, 19 bp, Artificial Sequence
  Synthetic
tgctttgaaaccaaacaca

SEQ ID NO: 14386 - DNA, 22 bp, Artificial Sequence
  Synthetic
tggagatccaaacaatatggat

SEQ ID NO: 14387 - DNA, 20 bp, Artificial Sequence
  Synthetic
tgagaacagaatggtgctgg

SEQ ID NO: 14388 - DNA, 18 bp, Artificial Sequence
  Synthetic
gcagcgattcaagtgatc

SEQ ID NO: 14389 - DNA, 19 bp, Artificial Sequence
  Synthetic
gtgtaagggtttgtgttgc

SEQ ID NO: 14390 - DNA, 24 bp, Artificial Sequence
  Synthetic
ctaacgtttcccaattaatagacg

SEQ ID NO: 14391 - DNA, 22 bp, Artificial Sequence
  Synthetic
aaaattactgatgctgaatgga

SEQ ID NO: 14392 - DNA, 22 bp, Artificial Sequence
  Synthetic
tgggattggatatactatcagg

SEQ ID NO: 14393 - DNA, 25 bp, Artificial Sequence
  Synthetic
tgacagtttataatgtatagagctg

SEQ ID NO: 14394 - DNA, 19 bp, Artificial Sequence
  Synthetic
gaggtacaacaaggcctat

SEQ ID NO: 14395 - DNA, 25 bp, Artificial Sequence
  Synthetic
atgatactgcagctatattagatgt

SEQ ID NO: 14396 - DNA, 22 bp, Artificial Sequence
  Synthetic
tggctgaatttgaaataatgga

SEQ ID NO: 14397 - DNA, 25 bp, Artificial Sequence
  Synthetic
attacataggcctacttatactaca

SEQ ID NO: 14398 - DNA, 25 bp, Artificial Sequence
  Synthetic
catcagatgactattttctacatcc

SEQ ID NO: 14399 - DNA, 22 bp, Artificial Sequence
  Synthetic
gaacacagtctgtagtagtacc

SEQ ID NO: 14400 - DNA, 25 bp, Artificial Sequence
  Synthetic
gatgaaaatgatcacagattgaatg

SEQ ID NO: 14401 - DNA, 19 bp, Artificial Sequence
  Synthetic
agatctggtgttcctttgg

SEQ ID NO: 14402 - DNA, 21 bp, Artificial Sequence
  Synthetic
tttgcaaagtttctctggatc

SEQ ID NO: 14403 - DNA, 20 bp, Artificial Sequence
  Synthetic
cgccgctttctatatcaaac

SEQ ID NO: 14404 - DNA, 18 bp, Artificial Sequence
  Synthetic
aaacagctgagtctggtt

SEQ ID NO: 14405 - DNA, 19 bp, Artificial Sequence
  Synthetic
agcccatctattgtgtgaa

SEQ ID NO: 14406 - DNA, 23 bp, Artificial Sequence
  Synthetic
ttggaagcaataagaatttctcc

SEQ ID NO: 14407 - DNA, 25 bp, Artificial Sequence
  Synthetic
ctgggaaatcatatatttatggaac

SEQ ID NO: 14408 - DNA, 21 bp, Artificial Sequence
  Synthetic
acccgaagataatgaatcaga

SEQ ID NO: 14409 - DNA, 20 bp, Artificial Sequence
  Synthetic
gtctctatccgactcccctg

SEQ ID NO: 14410 - DNA, 21 bp, Artificial Sequence
  Synthetic
taaacgaataaagcgagcttc

SEQ ID NO: 14411 - DNA, 20 bp, Artificial Sequence
  Synthetic
ccccaagaccttctattcca

SEQ ID NO: 14412 - DNA, 18 bp, Artificial Sequence
  Synthetic
agggccctttaaggagta

SEQ ID NO: 14413 - DNA, 20 bp, Artificial Sequence
  Synthetic
tataggagggttcagggatg

SEQ ID NO: 14414 - DNA, 23 bp, Artificial Sequence
  Synthetic
taataatgtccaagttccaaagg

SEQ ID NO: 14415 - DNA, 25 bp, Artificial Sequence
  Synthetic
attaattctacatgtaaatggccag

SEQ ID NO: 14416 - DNA, 19 bp, Artificial Sequence
  Synthetic
cctttagaggctgatgtgt

SEQ ID NO: 14417 - DNA, 23 bp, Artificial Sequence
  Synthetic
tttacatatcagtcgttcaaagg

SEQ ID NO: 14418 - DNA, 18 bp, Artificial Sequence
  Synthetic
cactcgcgagatactgac

SEQ ID NO: 14419 - DNA, 18 bp, Artificial Sequence
  Synthetic
gctggatcagacagggta

SEQ ID NO: 14420 - DNA, 20 bp, Artificial Sequence
  Synthetic
gtcgttttcccaaatgaagt

SEQ ID NO: 14421 - DNA, 22 bp, Artificial Sequence
  Synthetic
gggaggtaagaaatgatgatgt

SEQ ID NO: 14422 - DNA, 21 bp, Artificial Sequence
  Synthetic
aagagaggaagaagtgcttac

SEQ ID NO: 14423 - DNA, 20 bp, Artificial Sequence
  Synthetic
ccgaggtgatttgaatttcg

SEQ ID NO: 14424 - DNA, 18 bp, Artificial Sequence
  Synthetic
cgtttcttaagggtccga

SEQ ID NO: 14425 - DNA, 20 bp, Artificial Sequence
  Synthetic
gccagaagccaatatagtgg

SEQ ID NO: 14426 - DNA, 21 bp, Artificial Sequence
  Synthetic
ttacaatacttgggaaggacg

SEQ ID NO: 14427 - DNA, 20 bp, Artificial Sequence
  Synthetic
gcgatcattccaacaaatgc

SEQ ID NO: 14428 - DNA, 22 bp, Artificial Sequence
  Synthetic
ccgatttaattattgagaggcg

SEQ ID NO: 14429 - DNA, 19 bp, Artificial Sequence
  Synthetic
gggatccatcattccgtat

SEQ ID NO: 14430 - DNA, 18 bp, Artificial Sequence
  Synthetic
tccagagtggagtacagg

SEQ ID NO: 14431 - DNA, 18 bp, Artificial Sequence
  Synthetic
tttggtgctatagcgggt

SEQ ID NO: 14432 - DNA, 20 bp, Artificial Sequence
  Synthetic
ctgaactcttggtagcaatg

SEQ ID NO: 14433 - DNA, 19 bp, Artificial Sequence
  Synthetic
ggtttaaccgaaaacggtg

SEQ ID NO: 14434 - DNA, 22 bp, Artificial Sequence
  Synthetic
attttggcatacagtagaacaa

SEQ ID NO: 14435 - DNA, 22 bp, Artificial Sequence
  Synthetic
aatttgacacctcagatgaaga

SEQ ID NO: 14436 - DNA, 18 bp, Artificial Sequence
  Synthetic
acgggagtatgggtaacg

SEQ ID NO: 14437 - DNA, 22 bp, Artificial Sequence
  Synthetic
catacaatggttaacctgtacc

SEQ ID NO: 14438 - DNA, 25 bp, Artificial Sequence
  Synthetic
gcatatgataatgatttaaccgaag

SEQ ID NO: 14439 - DNA, 22 bp, Artificial Sequence
  Synthetic
gaatttcaagaatcagaggacg

SEQ ID NO: 14440 - DNA, 19 bp, Artificial Sequence
  Synthetic
ccatggacattgcaagaga

SEQ ID NO: 14441 - DNA, 20 bp, Artificial Sequence
  Synthetic
cacctacacccacaaccatc

SEQ ID NO: 14442 - DNA, 22 bp, Artificial Sequence
  Synthetic
ttactgtgagtccactattgtg

SEQ ID NO: 14443 - DNA, 25 bp, Artificial Sequence
  Synthetic
ttgtacatacgtgataatatggtac

SEQ ID NO: 14444 - DNA, 22 bp, Artificial Sequence
  Synthetic
attgattctagcataccagtgc

SEQ ID NO: 14445 - DNA, 18 bp, Artificial Sequence
  Synthetic
gggctcgtattgggtcta

SEQ ID NO: 14446 - DNA, 23 bp, Artificial Sequence
  Synthetic
taccatatttttttgcagatgtc

SEQ ID NO: 14447 - DNA, 18 bp, Artificial Sequence
  Synthetic
ctgcttgctctgcacaat

SEQ ID NO: 14448 - DNA, 25 bp, Artificial Sequence
  Synthetic
tgcaaaattacattatctgtagagg

SEQ ID NO: 14449 - DNA, 23 bp, Artificial Sequence
  Synthetic
caatcctccattttagtacatgc

SEQ ID NO: 14450 - DNA, 19 bp, Artificial Sequence
  Synthetic
gtgtgttacctgaatgggt

SEQ ID NO: 14451 - DNA, 22 bp, Artificial Sequence
  Synthetic
acaggtcaagtttgtaaaagac

SEQ ID NO: 14452 - DNA, 19 bp, Artificial Sequence
  Synthetic
ctgaatcccagagcaacgg

SEQ ID NO: 14453 - DNA, 19 bp, Artificial Sequence
  Synthetic
ctgctgacattactgctga

SEQ ID NO: 14454 - DNA, 18 bp, Artificial Sequence
  Synthetic
gcccaggtcttgatgttg

SEQ ID NO: 14455 - DNA, 23 bp, Artificial Sequence
  Synthetic
acttttcagcattttcagaaagt

SEQ ID NO: 14456 - DNA, 18 bp, Artificial Sequence
  Synthetic
gacaatgctacacctcca

SEQ ID NO: 14457 - DNA, 19 bp, Artificial Sequence
  Synthetic
tttgaagtggagcttgtga

SEQ ID NO: 14458 - DNA, 23 bp, Artificial Sequence
  Synthetic
atttgcgagataaatttacctcc

SEQ ID NO: 14459 - DNA, 23 bp, Artificial Sequence
  Synthetic
aacatatggtgctatgtatcctg

SEQ ID NO: 14460 - DNA, 21 bp, Artificial Sequence
  Synthetic
ttgaacttagaccgaatttgg

SEQ ID NO: 14461 - DNA, 18 bp, Artificial Sequence
  Synthetic
ggcagatggcgactacca

SEQ ID NO: 14462 - DNA, 20 bp, Artificial Sequence
  Synthetic
gcaaatgcagagattcaagt

SEQ ID NO: 14463 - DNA, 22 bp, Artificial Sequence
  Synthetic
tggataatgagaaacaacatgc

SEQ ID NO: 14464 - DNA, 21 bp, Artificial Sequence
  Synthetic
tcaacaattgaagaccttgtc

SEQ ID NO: 14465 - DNA, 21 bp, Artificial Sequence
  Synthetic
caactatcctgccatatggag

SEQ ID NO: 14466 - DNA, 20 bp, Artificial Sequence
  Synthetic
tttagagtttgcttgcaact

SEQ ID NO: 14467 - DNA, 20 bp, Artificial Sequence
  Synthetic
gaaactgtacagagaggacc

SEQ ID NO: 14468 - DNA, 23 bp, Artificial Sequence
  Synthetic
gaaaatctcaaaaacaacaacca

SEQ ID NO: 14469 - DNA, 25 bp, Artificial Sequence
  Synthetic
gaaaagatcaagaaaactaggtttg

SEQ ID NO: 14470 - DNA, 22 bp, Artificial Sequence
  Synthetic
atacacattcccagaatcatca

SEQ ID NO: 14471 - DNA, 23 bp, Artificial Sequence
  Synthetic
ataaaaccagaactatacccatg

SEQ ID NO: 14472 - DNA, 21 bp, Artificial Sequence
  Synthetic
caagagtggatgcaattttcc

SEQ ID NO: 14473 - DNA, 22 bp, Artificial Sequence
  Synthetic
tagaagactctaactcttgtgg

SEQ ID NO: 14474 - DNA, 21 bp, Artificial Sequence
  Synthetic
tgattactcaatcaccctcca

SEQ ID NO: 14475 - DNA, 21 bp, Artificial Sequence
  Synthetic
tgcaaactgtataacaaccac

SEQ ID NO: 14476 - DNA, 24 bp, Artificial Sequence
  Synthetic
aatccaactctactcatacaattg

SEQ ID NO: 14477 - DNA, 25 bp, Artificial Sequence
  Synthetic
taacacatgatgtaggtataaaacc

SEQ ID NO: 14478 - DNA, 20 bp, Artificial Sequence
  Synthetic
tatgctgcactatacccatc

SEQ ID NO: 14479 - DNA, 18 bp, Artificial Sequence
  Synthetic
cacagggagcattgtgtc

SEQ ID NO: 14480 - DNA, 18 bp, Artificial Sequence
  Synthetic
gcctcctgtgacattacc

SEQ ID NO: 14481 - DNA, 25 bp, Artificial Sequence
  Synthetic
tagcaaaagaatctattatgatggg

SEQ ID NO: 14482 - DNA, 23 bp, Artificial Sequence
  Synthetic
atcaatccaactataacacagaa

SEQ ID NO: 14483 - DNA, 25 bp, Artificial Sequence
  Synthetic
atcagatatgaagatatgtgttcag

SEQ ID NO: 14484 - DNA, 21 bp, Artificial Sequence
  Synthetic
atgggcatttggtaatgatga

SEQ ID NO: 14485 - DNA, 22 bp, Artificial Sequence
  Synthetic
gactttgtgtctacttttctca

SEQ ID NO: 14486 - DNA, 20 bp, Artificial Sequence
  Synthetic
aatttctgcaaatggctgtt

SEQ ID NO: 14487 - DNA, 20 bp, Artificial Sequence
  Synthetic
ttatggcagtttgttgacca

SEQ ID NO: 14488 - DNA, 21 bp, Artificial Sequence
  Synthetic
tctcctgttatgacaaatggt

SEQ ID NO: 14489 - DNA, 20 bp, Artificial Sequence
  Synthetic
agagtgattgctcttcagag

SEQ ID NO: 14490 - DNA, 21 bp, Artificial Sequence
  Synthetic
tgcctgagaagtttttgaatg

SEQ ID NO: 14491 - DNA, 23 bp, Artificial Sequence
  Synthetic
aaagttaagtatgcaacagttgt

SEQ ID NO: 14492 - DNA, 23 bp, Artificial Sequence
  Synthetic
actttatgtgagagactatgttg

SEQ ID NO: 14493 - DNA, 18 bp, Artificial Sequence
  Synthetic
gaacatgtgcaaagcgtt

SEQ ID NO: 14494 - DNA, 25 bp, Artificial Sequence
  Synthetic
caggattaagtcttttagtactttc

SEQ ID NO: 14495 - DNA, 23 bp, Artificial Sequence
  Synthetic
tgagtttgaagatgaaaaacttg

SEQ ID NO: 14496 - DNA, 25 bp, Artificial Sequence
  Synthetic
tactcaaacaattggataacaactg

SEQ ID NO: 14497 - DNA, 21 bp, Artificial Sequence
  Synthetic
aaatgtagttgtaccagtggt

SEQ ID NO: 14498 - DNA, 23 bp, Artificial Sequence
  Synthetic
aagttgaaatatctgttacacca

SEQ ID NO: 14499 - DNA, 22 bp, Artificial Sequence
  Synthetic
aaggttaaggattttgtgtctg

SEQ ID NO: 14500 - DNA, 22 bp, Artificial Sequence
  Synthetic
gttctgttgttgtctacatgtg

SEQ ID NO: 14501 - DNA, 22 bp, Artificial Sequence
  Synthetic
taaggacaaagatctttctggt

SEQ ID NO: 14502 - DNA, 18 bp, Artificial Sequence
  Synthetic
tgtgctagtgtcaaacgt

SEQ ID NO: 14503 - DNA, 22 bp, Artificial Sequence
  Synthetic
gttaaaataatggccaaagcac

SEQ ID NO: 14504 - DNA, 22 bp, Artificial Sequence
  Synthetic
tcaaggatgattactgtgatgg

SEQ ID NO: 14505 - DNA, 19 bp, Artificial Sequence
  Synthetic
tgtgctttttggttgtgaa

SEQ ID NO: 14506 - DNA, 19 bp, Artificial Sequence
  Synthetic
tatgtctttagccgagtgc

SEQ ID NO: 14507 - DNA, 24 bp, Artificial Sequence
  Synthetic
cgcaagtatattgtaaaaactagc

SEQ ID NO: 14508 - DNA, 21 bp, Artificial Sequence
  Synthetic
ggcttcacacctttaaacaag

SEQ ID NO: 14509 - DNA, 21 bp, Artificial Sequence
  Synthetic
caaggctttggttttagaaca

SEQ ID NO: 14510 - DNA, 25 bp, Artificial Sequence
  Synthetic
attgtatttctttgctactagaagc

SEQ ID NO: 14511 - DNA, 22 bp, Artificial Sequence
  Synthetic
cttttcgcgtgatcataatgac

SEQ ID NO: 14512 - DNA, 23 bp, Artificial Sequence
  Synthetic
tgcatggagtaactcttaaaatt

SEQ ID NO: 14513 - DNA, 21 bp, Artificial Sequence
  Synthetic
ggttttgaagaccaacctaat

SEQ ID NO: 14514 - DNA, 22 bp, Artificial Sequence
  Synthetic
aatccataagcttatttgctgg

SEQ ID NO: 14515 - DNA, 21 bp, Artificial Sequence
  Synthetic
atttgtctttttgttgcactg

SEQ ID NO: 14516 - DNA, 23 bp, Artificial Sequence
  Synthetic
gctgtatgtactatggtttgttg

SEQ ID NO: 14517 - DNA, 20 bp, Artificial Sequence
  Synthetic
acaaacgtcgttctaatggg

SEQ ID NO: 14518 - DNA, 22 bp, Artificial Sequence
  Synthetic
ttgaagaaggctatgaatgttg

SEQ ID NO: 14519 - DNA, 23 bp, Artificial Sequence
  Synthetic
aaatgatggtagatggttttgtg

SEQ ID NO: 14520 - DNA, 18 bp, Artificial Sequence
  Synthetic
ggtggacgtgcattcatg

SEQ ID NO: 14521 - DNA, 18 bp, Artificial Sequence
  Synthetic
cagctgcagcctatcttg

SEQ ID NO: 14522 - DNA, 22 bp, Artificial Sequence
  Synthetic
taatcatggctgtacatgtgac

SEQ ID NO: 14523 - DNA, 23 bp, Artificial Sequence
  Synthetic
tatggtaatgttagtagacagga

SEQ ID NO: 14524 - DNA, 25 bp, Artificial Sequence
  Synthetic
tcttaatgggaatttctatgacttc

SEQ ID NO: 14525 - DNA, 19 bp, Artificial Sequence
  Synthetic
tcttcgcaaccacaattcc

SEQ ID NO: 14526 - DNA, 23 bp, Artificial Sequence
  Synthetic
gctttgagtacaggattaacatc

SEQ ID NO: 14527 - DNA, 25 bp, Artificial Sequence
  Synthetic
tgactcagttaaatcttaaatacgc

SEQ ID NO: 14528 - DNA, 23 bp, Artificial Sequence
  Synthetic
gcaaaagcatttttctatgatga

SEQ ID NO: 14529 - DNA, 20 bp, Artificial Sequence
  Synthetic
catcactaagactgatgctg

SEQ ID NO: 14530 - DNA, 20 bp, Artificial Sequence
  Synthetic
accacaaaccacatctttca

SEQ ID NO: 14531 - DNA, 23 bp, Artificial Sequence
  Synthetic
catgcttccaaattacaaaagac

SEQ ID NO: 14532 - DNA, 18 bp, Artificial Sequence
  Synthetic
tcctcctggtagtggaaa

SEQ ID NO: 14533 - DNA, 22 bp, Artificial Sequence
  Synthetic
tctatgtgcactaactatgact

SEQ ID NO: 14534 - DNA, 25 bp, Artificial Sequence
  Synthetic
agcgatttatacataaaaactccac

SEQ ID NO: 14535 - DNA, 19 bp, Artificial Sequence
  Synthetic
gtttaaggattgtgcacgt

SEQ ID NO: 14536 - DNA, 20 bp, Artificial Sequence
  Synthetic
tcatgtcagaggttggttag

SEQ ID NO: 14537 - DNA, 18 bp, Artificial Sequence
  Synthetic
ggtgtttgtactttgggc

SEQ ID NO: 14538 - DNA, 23 bp, Artificial Sequence
  Synthetic
gtatgactgctttgttaagaatg

SEQ ID NO: 14539 - DNA, 22 bp, Artificial Sequence
  Synthetic
tgaattctcaattgtttgcagg

SEQ ID NO: 14540 - DNA, 23 bp, Artificial Sequence
  Synthetic
ataacatttttactcaagctggt

SEQ ID NO: 14541 - DNA, 21 bp, Artificial Sequence
  Synthetic
ttgtcgccacatataagtttg

SEQ ID NO: 14542 - DNA, 22 bp, Artificial Sequence
  Synthetic
ttaactggtttgtttacgtacg

SEQ ID NO: 14543 - DNA, 22 bp, Artificial Sequence
  Synthetic
tcctagttctaagactgtttgt

SEQ ID NO: 14544 - DNA, 25 bp, Artificial Sequence
  Synthetic
tgtgtcaatattttaacagtaccac

SEQ ID NO: 14545 - DNA, 23 bp, Artificial Sequence
  Synthetic
gttgtcggaattaactatcttgg

SEQ ID NO: 14546 - DNA, 19 bp, Artificial Sequence
  Synthetic
tgccttgttgcatattgct

SEQ ID NO: 14547 - DNA, 20 bp, Artificial Sequence
  Synthetic
gatgctcacataccatttgg

SEQ ID NO: 14548 - DNA, 23 bp, Artificial Sequence
  Synthetic
agatggtttttattctacaagcc

SEQ ID NO: 14549 - DNA, 25 bp, Artificial Sequence
  Synthetic
aatatttatgatgtatctggtgtgg

SEQ ID NO: 14550 - DNA, 25 bp, Artificial Sequence
  Synthetic
gttttaacttattctagttttggcg

SEQ ID NO: 14551 - DNA, 20 bp, Artificial Sequence
  Synthetic
ctgcagatgttagtgagatg

SEQ ID NO: 14552 - DNA, 22 bp, Artificial Sequence
  Synthetic
ttctttaattggtggaattgct

SEQ ID NO: 14553 - DNA, 22 bp, Artificial Sequence
  Synthetic
tctatgacagacttgacactat

SEQ ID NO: 14554 - DNA, 18 bp, Artificial Sequence
  Synthetic
ggttgtgcgttgatggta

SEQ ID NO: 14555 - DNA, 22 bp, Artificial Sequence
  Synthetic
tacaaattgccaaattacactg

SEQ ID NO: 14556 - DNA, 20 bp, Artificial Sequence
  Synthetic
ggcttctttagttgttttgc

SEQ ID NO: 14557 - DNA, 24 bp, Artificial Sequence
  Synthetic
ttctaatccttttcgtttatgtgc

SEQ ID NO: 14558 - DNA, 19 bp, Artificial Sequence
  Synthetic
agctagtggatgatcatgc

SEQ ID NO: 14559 - DNA, 20 bp, Artificial Sequence
  Synthetic
ttgaagatgcttgtactgtg

SEQ ID NO: 14560 - DNA, 24 bp, Artificial Sequence
  Synthetic
taatttatagtagagtcggaaggt

SEQ ID NO: 14561 - DNA, 21 bp, Artificial Sequence
  Synthetic
tacccatcaacaagaaagaca

SEQ ID NO: 14562 - DNA, 20 bp, Artificial Sequence
  Synthetic
ggaatccttcaagtgacaga

SEQ ID NO: 14563 - DNA, 18 bp, Artificial Sequence
  Synthetic
aaatgcaaaagccacggt

SEQ ID NO: 14564 - DNA, 22 bp, Artificial Sequence
  Synthetic
attcactagagaaatgcaacaa

SEQ ID NO: 14565 - DNA, 24 bp, Artificial Sequence
  Synthetic
tcagagctgcttttaattaacatg

SEQ ID NO: 14566 - DNA, 20 bp, Artificial Sequence
  Synthetic
ctcatgtcctgtttctgtgt

SEQ ID NO: 14567 - DNA, 19 bp, Artificial Sequence
  Synthetic
gcgatgagtgtctagactc

SEQ ID NO: 14568 - DNA, 20 bp, Artificial Sequence
  Synthetic
aaaagacggctgtttgaggg

SEQ ID NO: 14569 - DNA, 18 bp, Artificial Sequence
  Synthetic
ccgcggcataaaagtgtt

SEQ ID NO: 14570 - DNA, 22 bp, Artificial Sequence
  Synthetic
gcatggctaaaaagtaacaatc

SEQ ID NO: 14571 - DNA, 22 bp, Artificial Sequence
  Synthetic
agtcatgaactgtatacaacac

SEQ ID NO: 14572 - DNA, 21 bp, Artificial Sequence
  Synthetic
agaaagaaaacatagatcgcg

SEQ ID NO: 14573 - DNA, 24 bp, Artificial Sequence
  Synthetic
atatatatagacattgtgtggggt

SEQ ID NO: 14574 - DNA, 19 bp, Artificial Sequence
  Synthetic
cttaggccaagtgtggtgg

SEQ ID NO: 14575 - DNA, 18 bp, Artificial Sequence
  Synthetic
cacttccacgcctaaacg

SEQ ID NO: 14576 - DNA, 18 bp, Artificial Sequence
  Synthetic
tccaaagggcaagggacc

SEQ ID NO: 14577 - DNA, 23 bp, Artificial Sequence
  Synthetic
ttagaagatacttatgctgagga

SEQ ID NO: 14578 - DNA, 19 bp, Artificial Sequence
  Synthetic
cttggtacgtaaacgcaaa

SEQ ID NO: 14579 - DNA, 20 bp, Artificial Sequence
  Synthetic
atctgggaatcagtacagag

SEQ ID NO: 14580 - DNA, 19 bp, Artificial Sequence
  Synthetic
tgccatgtttttctttggt

SEQ ID NO: 14581 - DNA, 25 bp, Artificial Sequence
  Synthetic
tctcatattaatgtaatggatccag

SEQ ID NO: 14582 - DNA, 17 bp, Artificial Sequence
  Synthetic
gtccgcggaaatccagc

SEQ ID NO: 14583 - DNA, 19 bp, Artificial Sequence
  Synthetic
gcatggacatctctccgtc

SEQ ID NO: 14584 - DNA, 20 bp, Artificial Sequence
  Synthetic
agtgtcgttggatctgaggg

SEQ ID NO: 14585 - DNA, 16 bp, Artificial Sequence
  Synthetic
gcctggtgacctgcct

SEQ ID NO: 14586 - DNA, 19 bp, Artificial Sequence
  Synthetic
aacatgtacccggcagtcc

SEQ ID NO: 14587 - DNA, 18 bp, Artificial Sequence
  Synthetic
aacattagcatcccggcg

SEQ ID NO: 14588 - DNA, 19 bp, Artificial Sequence
  Synthetic
accatccttttgccaatca

SEQ ID NO: 14589 - DNA, 20 bp, Artificial Sequence
  Synthetic
ccaggggggactttatgtga

SEQ ID NO: 14590 - DNA, 16 bp, Artificial Sequence
  Synthetic
gtcgctgactccgcca

SEQ ID NO: 14591 - DNA, 19 bp, Artificial Sequence
  Synthetic
cagctcctaagaaggcacc

SEQ ID NO: 14592 - DNA, 16 bp, Artificial Sequence
  Synthetic
accctaggcgtcccct

SEQ ID NO: 14593 - DNA, 17 bp, Artificial Sequence
  Synthetic
cacacacccacccgtct

SEQ ID NO: 14594 - DNA, 18 bp, Artificial Sequence
  Synthetic
aaaggtcagggcccaagg

SEQ ID NO: 14595 - DNA, 17 bp, Artificial Sequence
  Synthetic
acacccaggcacacact

SEQ ID NO: 14596 - DNA, 20 bp, Artificial Sequence
  Synthetic
ccaaaattggtgccttgctc

SEQ ID NO: 14597 - DNA, 16 bp, Artificial Sequence
  Synthetic
acacgttagggggcgc

SEQ ID NO: 14598 - DNA, 18 bp, Artificial Sequence
  Synthetic
ttgtcggaggtggagagg

SEQ ID NO: 14599 - DNA, 20 bp, Artificial Sequence
  Synthetic
aaactctaggcctgtggagc

SEQ ID NO: 14600 - DNA, 19 bp, Artificial Sequence
  Synthetic
gctccagggaatctttggg

SEQ ID NO: 14601 - DNA, 16 bp, Artificial Sequence
  Synthetic
tccccgctgaccagtc

SEQ ID NO: 14602 - DNA, 19 bp, Artificial Sequence
  Synthetic
gcagcttgtccttgaggag

SEQ ID NO: 14603 - DNA, 16 bp, Artificial Sequence
  Synthetic
tcgggagaggcgcctt

SEQ ID NO: 14604 - DNA, 16 bp, Artificial Sequence
  Synthetic
agagggccggtctcga

SEQ ID NO: 14605 - DNA, 16 bp, Artificial Sequence
  Synthetic
gccgaggccaccttgt

SEQ ID NO: 14606 - DNA, 17 bp, Artificial Sequence
  Synthetic
cctgttgtctggccacg

SEQ ID NO: 14607 - DNA, 20 bp, Artificial Sequence
  Synthetic
tctaggtcagacaggtagcg

SEQ ID NO: 14608 - DNA, 18 bp, Artificial Sequence
  Synthetic
gagaatggccgcgagttt

SEQ ID NO: 14609 - DNA, 18 bp, Artificial Sequence
  Synthetic
ctggatgccctccacgac

SEQ ID NO: 14610 - DNA, 16 bp, Artificial Sequence
  Synthetic
agctgcccccgtcaag

SEQ ID NO: 14611 - DNA, 18 bp, Artificial Sequence
  Synthetic
agctcgttggagaggacc

SEQ ID NO: 14612 - DNA, 19 bp, Artificial Sequence
  Synthetic
gagaaccacgagaggtgcc

SEQ ID NO: 14613 - DNA, 20 bp, Artificial Sequence
  Synthetic
gacagcgggcaagttttgtg

SEQ ID NO: 14614 - DNA, 16 bp, Artificial Sequence
  Synthetic
gtgctgcagccctcga

SEQ ID NO: 14615 - DNA, 17 bp, Artificial Sequence
  Synthetic
gccttcactggccctgt

SEQ ID NO: 14616 - DNA, 18 bp, Artificial Sequence
  Synthetic
cacctccgccacctccta

SEQ ID NO: 14617 - DNA, 20 bp, Artificial Sequence
  Synthetic
acgtgacatggagaaactgg

SEQ ID NO: 14618 - DNA, 16 bp, Artificial Sequence
  Synthetic
ccaggcccgcatgagt

SEQ ID NO: 14619 - DNA, 16 bp, Artificial Sequence
  Synthetic
cagccgcttcttgggc

SEQ ID NO: 14620 - DNA, 18 bp, Artificial Sequence
  Synthetic
ggggtactgggggtggtt

SEQ ID NO: 14621 - DNA, 19 bp, Artificial Sequence
  Synthetic
caacatgagacgtgaccgg

SEQ ID NO: 14622 - DNA, 18 bp, Artificial Sequence
  Synthetic
cacctggcttctgaccgg

SEQ ID NO: 14623 - DNA, 20 bp, Artificial Sequence
  Synthetic
tatagcctcagccatctacc

SEQ ID NO: 14624 - DNA, 18 bp, Artificial Sequence
  Synthetic
agcagctcagggaatggc

SEQ ID NO: 14625 - DNA, 16 bp, Artificial Sequence
  Synthetic
gcattagacgcgcgcg

SEQ ID NO: 14626 - DNA, 20 bp, Artificial Sequence
  Synthetic
tttgtcaatccatggcaggc

SEQ ID NO: 14627 - DNA, 18 bp, Artificial Sequence
  Synthetic
gtatgggttaccgcacgc

SEQ ID NO: 14628 - DNA, 20 bp, Artificial Sequence
  Synthetic
caacttagcagttcggcacc

SEQ ID NO: 14629 - DNA, 17 bp, Artificial Sequence
  Synthetic
cgagtcactgctgctgg

SEQ ID NO: 14630 - DNA, 20 bp, Artificial Sequence
  Synthetic
gcatcgcttaagtatgagtg

SEQ ID NO: 14631 - DNA, 19 bp, Artificial Sequence
  Synthetic
agggaatgaaagctcacgg

SEQ ID NO: 14632 - DNA, 18 bp, Artificial Sequence
  Synthetic
tgagggcagtgatagcga

SEQ ID NO: 14633 - DNA, 16 bp, Artificial Sequence
  Synthetic
gcagttcgcccagctc

SEQ ID NO: 14634 - DNA, 17 bp, Artificial Sequence
  Synthetic
gcgttccagcttcgtcc

SEQ ID NO: 14635 - DNA, 16 bp, Artificial Sequence
  Synthetic
cgccgctggagttcct

SEQ ID NO: 14636 - DNA, 19 bp, Artificial Sequence
  Synthetic
aggagcgacgagtatgtgg

SEQ ID NO: 14637 - DNA, 18 bp, Artificial Sequence
  Synthetic
cgaaaatactgccccgcg

SEQ ID NO: 14638 - DNA, 20 bp, Artificial Sequence
  Synthetic
ttctacaatgccagggggga

SEQ ID NO: 14639 - DNA, 17 bp, Artificial Sequence
  Synthetic
gcttggtgcctctgtgg

SEQ ID NO: 14640 - DNA, 18 bp, Artificial Sequence
  Synthetic
ggcatgtctgttccccct

SEQ ID NO: 14641 - DNA, 21 bp, Artificial Sequence
  Synthetic
actggaccctttaaaacatcc

SEQ ID NO: 14642 - DNA, 20 bp, Artificial Sequence
  Synthetic
attgtctgcgtacgctttcc

SEQ ID NO: 14643 - DNA, 18 bp, Artificial Sequence
  Synthetic
gacagcacctccaacagc

SEQ ID NO: 14644 - DNA, 20 bp, Artificial Sequence
  Synthetic
aatgcctctatgttggcaca

SEQ ID NO: 14645 - DNA, 17 bp, Artificial Sequence
  Synthetic
gcaccgagctgatgggt

SEQ ID NO: 14646 - DNA, 19 bp, Artificial Sequence
  Synthetic
aatctggttgtcggcctcc

SEQ ID NO: 14647 - DNA, 19 bp, Artificial Sequence
  Synthetic
cagacggatgtcaggtcgg

SEQ ID NO: 14648 - DNA, 19 bp, Artificial Sequence
  Synthetic
ctcaagtgtaagcagcccg

SEQ ID NO: 14649 - DNA, 19 bp, Artificial Sequence
  Synthetic
gtgctctcatccctgcaac

SEQ ID NO: 14650 - DNA, 20 bp, Artificial Sequence
  Synthetic
aaccagaaagatacccagag

SEQ ID NO: 14651 - DNA, 19 bp, Artificial Sequence
  Synthetic
cacgcatccctgtcttctc

SEQ ID NO: 14652 - DNA, 16 bp, Artificial Sequence
  Synthetic
ggctagcccccgcaaa

SEQ ID NO: 14653 - DNA, 17 bp, Artificial Sequence
  Synthetic
gaaaagggggtggcggt

SEQ ID NO: 14654 - DNA, 19 bp, Artificial Sequence
  Synthetic
ggtgtcttgggcatcatcc

SEQ ID NO: 14655 - DNA, 16 bp, Artificial Sequence
  Synthetic
gccccaagccttcgca

SEQ ID NO: 14656 - DNA, 20 bp, Artificial Sequence
  Synthetic
gacaaggcagtagaggacac

SEQ ID NO: 14657 - DNA, 20 bp, Artificial Sequence
  Synthetic
caggcaccgtctgtatacgt

SEQ ID NO: 14658 - DNA, 18 bp, Artificial Sequence
  Synthetic
gccaccacagcacaagtg

SEQ ID NO: 14659 - DNA, 18 bp, Artificial Sequence
  Synthetic
ccttccccgggaatgtgt

SEQ ID NO: 14660 - DNA, 19 bp, Artificial Sequence
  Synthetic
tctcctaggaatgccgagc

SEQ ID NO: 14661 - DNA, 17 bp, Artificial Sequence
  Synthetic
gttgcgctcgacgaact

SEQ ID NO: 14662 - DNA, 16 bp, Artificial Sequence
  Synthetic
cgtcagcacccccaca

SEQ ID NO: 14663 - DNA, 18 bp, Artificial Sequence
  Synthetic
gggaaagaggccgttggc

SEQ ID NO: 14664 - DNA, 18 bp, Artificial Sequence
  Synthetic
cccagtaggtgcctggct

SEQ ID NO: 14665 - DNA, 19 bp, Artificial Sequence
  Synthetic
accccctctatgtcttcgc

SEQ ID NO: 14666 - DNA, 19 bp, Artificial Sequence
  Synthetic
gaaggcccgtctgtagagg

SEQ ID NO: 14667 - DNA, 18 bp, Artificial Sequence
  Synthetic
gtcccctctgccgtggaa

SEQ ID NO: 14668 - DNA, 16 bp, Artificial Sequence
  Synthetic
gccgcatccacgtcct

SEQ ID NO: 14669 - DNA, 19 bp, Artificial Sequence
  Synthetic
gcaaagatctgcgtggaca

SEQ ID NO: 14670 - DNA, 16 bp, Artificial Sequence
  Synthetic
acctgtggcccgcgta

SEQ ID NO: 14671 - DNA, 18 bp, Artificial Sequence
  Synthetic
cgatgtcggctgtcctgc

SEQ ID NO: 14672 - DNA, 16 bp, Artificial Sequence
  Synthetic
cgggaggccgtgcttt

SEQ ID NO: 14673 - DNA, 20 bp, Artificial Sequence
  Synthetic
gagcggtctgtataaaaacg

SEQ ID NO: 14674 - DNA, 25 bp, Artificial Sequence
  Synthetic
agacaaatatgattggaaatagacc

SEQ ID NO: 14675 - DNA, 23 bp, Artificial Sequence
  Synthetic
gttagtgcaagattccaataacg

SEQ ID NO: 14676 - DNA, 23 bp, Artificial Sequence
  Synthetic
actgtactgaattccaaatgatt

SEQ ID NO: 14677 - DNA, 25 bp, Artificial Sequence
  Synthetic
agtttatgaaataactaatgccacc

SEQ ID NO: 14678 - DNA, 20 bp, Artificial Sequence
  Synthetic
tattttgaggatgcaaacgg

SEQ ID NO: 14679 - DNA, 18 bp, Artificial Sequence
  Synthetic
aacaattgcaccgactcg

SEQ ID NO: 14680 - DNA, 24 bp, Artificial Sequence
  Synthetic
tggagaagaaattcctttagatcc

SEQ ID NO: 14681 - DNA, 19 bp, Artificial Sequence
  Synthetic
atcttccacctcaaaagcc

SEQ ID NO: 14682 - DNA, 23 bp, Artificial Sequence
  Synthetic
gagattgtcctcctattgaatta

SEQ ID NO: 14683 - DNA, 19 bp, Artificial Sequence
  Synthetic
gggaacttgcctttgtacc

SEQ ID NO: 14684 - DNA, 25 bp, Artificial Sequence
  Synthetic
cacgtatattttatttttcaaccgc

SEQ ID NO: 14685 - DNA, 20 bp, Artificial Sequence
  Synthetic
ctactggtcctgttatgtgc

SEQ ID NO: 14686 - DNA, 18 bp, Artificial Sequence
  Synthetic
ctgcttccagtgagatca

SEQ ID NO: 14687 - DNA, 18 bp, Artificial Sequence
  Synthetic
atttgctatggctgacgg

SEQ ID NO: 14688 - DNA, 18 bp, Artificial Sequence
  Synthetic
ttgctaaaacccggagac

SEQ ID NO: 14689 - DNA, 22 bp, Artificial Sequence
  Synthetic
gttacaggactaaggaacattc

SEQ ID NO: 14690 - DNA, 25 bp, Artificial Sequence
  Synthetic
tgattatcccaaatattcagaagag

SEQ ID NO: 14691 - DNA, 18 bp, Artificial Sequence
  Synthetic
caaggttcgttggcagac

SEQ ID NO: 14692 - DNA, 23 bp, Artificial Sequence
  Synthetic
tgagctacttaattttgatcaca

SEQ ID NO: 14693 - DNA, 25 bp, Artificial Sequence
  Synthetic
taagttattagacttagtggagaag

SEQ ID NO: 14694 - DNA, 21 bp, Artificial Sequence
  Synthetic
cgtgcttgctacaaatttagg

SEQ ID NO: 14695 - DNA, 19 bp, Artificial Sequence
  Synthetic
atttgacgaagggacagac

SEQ ID NO: 14696 - DNA, 23 bp, Artificial Sequence
  Synthetic
aaatgaagctgaagatctttctg

SEQ ID NO: 14697 - DNA, 23 bp, Artificial Sequence
  Synthetic
tgaatgatgacttaattgaaagc

SEQ ID NO: 14698 - DNA, 21 bp, Artificial Sequence
  Synthetic
tcctgaatggatacttacaca

SEQ ID NO: 14699 - DNA, 21 bp, Artificial Sequence
  Synthetic
cagcagagttaaatcctttgc

SEQ ID NO: 14700 - DNA, 22 bp, Artificial Sequence
  Synthetic
agactttaagacaagagcaaat

SEQ ID NO: 14701 - DNA, 18 bp, Artificial Sequence
  Synthetic
tcttcgccaccaactgga

SEQ ID NO: 14702 - DNA, 16 bp, Artificial Sequence
  Synthetic
aaaggggaggggagcg

SEQ ID NO: 14703 - DNA, 18 bp, Artificial Sequence
  Synthetic
cacgattactggctgagg

SEQ ID NO: 14704 - DNA, 23 bp, Artificial Sequence
  Synthetic
atgatctgtaagctttactaacg

SEQ ID NO: 14705 - DNA, 19 bp, Artificial Sequence
  Synthetic
ataagtacaggccgtggca

SEQ ID NO: 14706 - DNA, 22 bp, Artificial Sequence
  Synthetic
agaatcaattgctgagatacac

SEQ ID NO: 14707 - DNA, 24 bp, Artificial Sequence
  Synthetic
tgaggtcacacaaatatttgaaag

SEQ ID NO: 14708 - DNA, 20 bp, Artificial Sequence
  Synthetic
gaaatgcaattattggggga

SEQ ID NO: 14709 - DNA, 19 bp, Artificial Sequence
  Synthetic
cagtggcgagagttcaaag

SEQ ID NO: 14710 - DNA, 18 bp, Artificial Sequence
  Synthetic
gtttgggcctgtagaggt

SEQ ID NO: 14711 - DNA, 22 bp, Artificial Sequence
  Synthetic
ttatgttagaggaggttcagtt

SEQ ID NO: 14712 - DNA, 20 bp, Artificial Sequence
  Synthetic
agatcactgaaagccagaga

SEQ ID NO: 14713 - DNA, 20 bp, Artificial Sequence
  Synthetic
ctttcttctagcatggacca

SEQ ID NO: 14714 - DNA, 20 bp, Artificial Sequence
  Synthetic
ctcaagggcgttatattgga

SEQ ID NO: 14715 - DNA, 18 bp, Artificial Sequence
  Synthetic
gcaagaagcttgtggatg

SEQ ID NO: 14716 - DNA, 18 bp, Artificial Sequence
  Synthetic
ggcaggagaaatcccatc

SEQ ID NO: 14717 - DNA, 18 bp, Artificial Sequence
  Synthetic
atgggggttaaagggaga

SEQ ID NO: 14718 - DNA, 19 bp, Artificial Sequence
  Synthetic
gcatggtatcaacagtggg

SEQ ID NO: 14719 - DNA, 18 bp, Artificial Sequence
  Synthetic
gtgtagctgcttctggtg

SEQ ID NO: 14720 - DNA, 19 bp, Artificial Sequence
  Synthetic
cagttagtctggacggatg

SEQ ID NO: 14721 - DNA, 24 bp, Artificial Sequence
  Synthetic
ctaccttcctttagtaaagaatgt

SEQ ID NO: 14722 - DNA, 19 bp, Artificial Sequence
  Synthetic
attgggttgattggtttgg

SEQ ID NO: 14723 - DNA, 20 bp, Artificial Sequence
  Synthetic
ttctcaaaagggattgacgg

SEQ ID NO: 14724 - DNA, 20 bp, Artificial Sequence
  Synthetic
tgaagctaacagaacattgc

SEQ ID NO: 14725 - DNA, 20 bp, Artificial Sequence
  Synthetic
catcgcaatcgtaagtatcc

SEQ ID NO: 14726 - DNA, 19 bp, Artificial Sequence
  Synthetic
cctctttgtgaacagtgtc

SEQ ID NO: 14727 - DNA, 20 bp, Artificial Sequence
  Synthetic
tacagggtgttatgttttgc

SEQ ID NO: 14728 - DNA, 22 bp, Artificial Sequence
  Synthetic
aactttttggatatctgccttc

SEQ ID NO: 14729 - DNA, 25 bp, Artificial Sequence
  Synthetic
gaagaagataaaactaagaatcagg

SEQ ID NO: 14730 - DNA, 20 bp, Artificial Sequence
  Synthetic
ggctcttttgttgagtttga

SEQ ID NO: 14731 - DNA, 22 bp, Artificial Sequence
  Synthetic
caatgttctgttatctccagat

SEQ ID NO: 14732 - DNA, 19 bp, Artificial Sequence
  Synthetic
atgcggttttaaagatggc

SEQ ID NO: 14733 - DNA, 22 bp, Artificial Sequence
  Synthetic
tctgattgagggacttctatca

SEQ ID NO: 14734 - DNA, 21 bp, Artificial Sequence
  Synthetic
gtttctcggaaatcacaaact

SEQ ID NO: 14735 - DNA, 21 bp, Artificial Sequence
  Synthetic
ctgaataggaattcctcgacc

SEQ ID NO: 14736 - DNA, 18 bp, Artificial Sequence
  Synthetic
cttcgccaagctttgagt

SEQ ID NO: 14737 - DNA, 22 bp, Artificial Sequence
  Synthetic
cttcgcattcttattaccaatg

SEQ ID NO: 14738 - DNA, 19 bp, Artificial Sequence
  Synthetic
ttacagtttgtggagggtt

SEQ ID NO: 14739 - DNA, 22 bp, Artificial Sequence
  Synthetic
taaacaatatgctcaatacggg

SEQ ID NO: 14740 - DNA, 19 bp, Artificial Sequence
  Synthetic
ctttcggaacaacaactgc

SEQ ID NO: 14741 - DNA, 22 bp, Artificial Sequence
  Synthetic
aaagcctgtacagaatacaaga

SEQ ID NO: 14742 - DNA, 23 bp, Artificial Sequence
  Synthetic
gtttaacagtagatcaactttcc

SEQ ID NO: 14743 - DNA, 19 bp, Artificial Sequence
  Synthetic
cttgccctttatgtggtct

SEQ ID NO: 14744 - DNA, 25 bp, Artificial Sequence
  Synthetic
tcctacttaacctattttacagatg

SEQ ID NO: 14745 - DNA, 19 bp, Artificial Sequence
  Synthetic
tggctatggcttttatggg

SEQ ID NO: 14746 - DNA, 19 bp, Artificial Sequence
  Synthetic
aagcactcctcctatcaca

SEQ ID NO: 14747 - DNA, 21 bp, Artificial Sequence
  Synthetic
ccaacaacattatactcccct

SEQ ID NO: 14748 - DNA, 19 bp, Artificial Sequence
  Synthetic
ctgttgaagtacgtccctt

SEQ ID NO: 14749 - DNA, 20 bp, Artificial Sequence
  Synthetic
aggctgataaatgttttcgg

SEQ ID NO: 14750 - DNA, 18 bp, Artificial Sequence
  Synthetic
ttgtcgcgaatagtcaca

SEQ ID NO: 14751 - DNA, 23 bp, Artificial Sequence
  Synthetic
tttgattttctctactaagtcgt

SEQ ID NO: 14752 - DNA, 18 bp, Artificial Sequence
  Synthetic
gttatccccaggcatgac

SEQ ID NO: 14753 - DNA, 18 bp, Artificial Sequence
  Synthetic
gtttggcaagcaaacaac

SEQ ID NO: 14754 - DNA, 19 bp, Artificial Sequence
  Synthetic
cctcttacaaaccgcattt

SEQ ID NO: 14755 - DNA, 21 bp, Artificial Sequence
  Synthetic
attgcttctctcttttccaaa

SEQ ID NO: 14756 - DNA, 18 bp, Artificial Sequence
  Synthetic
gagcctgtgcagaatgtg

SEQ ID NO: 14757 - DNA, 22 bp, Artificial Sequence
  Synthetic
taaagtaacaggactatcccct

SEQ ID NO: 14758 - DNA, 18 bp, Artificial Sequence
  Synthetic
accggtactttgcaacac

SEQ ID NO: 14759 - DNA, 25 bp, Artificial Sequence
  Synthetic
gaaacaagaagttctttttcaacac

SEQ ID NO: 14760 - DNA, 23 bp, Artificial Sequence
  Synthetic
gaccttatctttgggatacagat

SEQ ID NO: 14761 - DNA, 18 bp, Artificial Sequence
  Synthetic
agaaaacaggcaagccat

SEQ ID NO: 14762 - DNA, 21 bp, Artificial Sequence
  Synthetic
ccaacataaaactggagttct

SEQ ID NO: 14763 - DNA, 23 bp, Artificial Sequence
  Synthetic
atatcattctctgtaacaacctc

SEQ ID NO: 14764 - DNA, 25 bp, Artificial Sequence
  Synthetic
cggtcttaattccattaataagact

SEQ ID NO: 14765 - DNA, 18 bp, Artificial Sequence
  Synthetic
gcagacactacatgccaa

SEQ ID NO: 14766 - DNA, 18 bp, Artificial Sequence
  Synthetic
ttgttgtgtccttccgtt

SEQ ID NO: 14767 - DNA, 19 bp, Artificial Sequence
  Synthetic
cgtagcaaaaatctcccca

SEQ ID NO: 14768 - DNA, 20 bp, Artificial Sequence
  Synthetic
tcttcccaaaagacttcaga

SEQ ID NO: 14769 - DNA, 18 bp, Artificial Sequence
  Synthetic
aactgacaaaagctgccg

SEQ ID NO: 14770 - DNA, 18 bp, Artificial Sequence
  Synthetic
ccgtagtggttcgggatt

SEQ ID NO: 14771 - DNA, 18 bp, Artificial Sequence
  Synthetic
aaacggtgcaactcgatc

SEQ ID NO: 14772 - DNA, 25 bp, Artificial Sequence
  Synthetic
caaaaataggattagaagaacttcc

SEQ ID NO: 14773 - DNA, 23 bp, Artificial Sequence
  Synthetic
gctggattcacaatagtaaatgc

SEQ ID NO: 14774 - DNA, 21 bp, Artificial Sequence
  Synthetic
cagaacacatcacttcagaag

SEQ ID NO: 14775 - DNA, 21 bp, Artificial Sequence
  Synthetic
taatccagactcttcctcatc

SEQ ID NO: 14776 - DNA, 19 bp, Artificial Sequence
  Synthetic
aaggcagaaggatcttgtt

SEQ ID NO: 14777 - DNA, 19 bp, Artificial Sequence
  Synthetic
cttgcttgcgttattttcg

SEQ ID NO: 14778 - DNA, 21 bp, Artificial Sequence
  Synthetic
cctttaattacagctgggatg

SEQ ID NO: 14779 - DNA, 21 bp, Artificial Sequence
  Synthetic
atttcaacattgcgatcatca

SEQ ID NO: 14780 - DNA, 21 bp, Artificial Sequence
  Synthetic
ttaaacacgtacagaaagcaa

SEQ ID NO: 14781 - DNA, 18 bp, Artificial Sequence
  Synthetic
tgactgcgctatgaggat

SEQ ID NO: 14782 - DNA, 23 bp, Artificial Sequence
  Synthetic
tcaaatcaatgatttccacttca

SEQ ID NO: 14783 - DNA, 19 bp, Artificial Sequence
  Synthetic
ttggacaataaaatgcgcg

SEQ ID NO: 14784 - DNA, 24 bp, Artificial Sequence
  Synthetic
taccgaatctctaataatggatca

SEQ ID NO: 14785 - DNA, 18 bp, Artificial Sequence
  Synthetic
gtgctgctatccccgata

SEQ ID NO: 14786 - DNA, 18 bp, Artificial Sequence
  Synthetic
atccaccatccctgcttc

SEQ ID NO: 14787 - DNA, 20 bp, Artificial Sequence
  Synthetic
aaattcactgctttagcctg

SEQ ID NO: 14788 - DNA, 18 bp, Artificial Sequence
  Synthetic
aaaacgacgaggacccta

SEQ ID NO: 14789 - DNA, 21 bp, Artificial Sequence
  Synthetic
gtgctgcttgagaattcttac

SEQ ID NO: 14790 - DNA, 22 bp, Artificial Sequence
  Synthetic
gaaaactcgaatccaaactttc

SEQ ID NO: 14791 - DNA, 20 bp, Artificial Sequence
  Synthetic
gacgctgtagcataatcaat

SEQ ID NO: 14792 - DNA, 20 bp, Artificial Sequence
  Synthetic
agaacgcaaagattttcacg

SEQ ID NO: 14793 - DNA, 19 bp, Artificial Sequence
  Synthetic
gtgtgcccaatcatttcag

SEQ ID NO: 14794 - DNA, 22 bp, Artificial Sequence
  Synthetic
atatgctgatcaaattttggct

SEQ ID NO: 14795 - DNA, 25 bp, Artificial Sequence
  Synthetic
agaatccccttagaagttacttaaa

SEQ ID NO: 14796 - DNA, 21 bp, Artificial Sequence
  Synthetic
aggattaaccagcaaatacac

SEQ ID NO: 14797 - DNA, 19 bp, Artificial Sequence
  Synthetic
ttcctgctttcatcatggg

SEQ ID NO: 14798 - DNA, 19 bp, Artificial Sequence
  Synthetic
aaaattgggatagcgctct

SEQ ID NO: 14799 - DNA, 20 bp, Artificial Sequence
  Synthetic
ttgattaaccaaaagagcgc

SEQ ID NO: 14800 - DNA, 19 bp, Artificial Sequence
  Synthetic
tagctttcgatgctcaacc

SEQ ID NO: 14801 - DNA, 20 bp, Artificial Sequence
  Synthetic
atcgcagaagaaaaattccc

SEQ ID NO: 14802 - DNA, 19 bp, Artificial Sequence
  Synthetic
acctatgaagaagctcgtc

SEQ ID NO: 14803 - DNA, 20 bp, Artificial Sequence
  Synthetic
agactttaggagatcgtgtg

SEQ ID NO: 14804 - DNA, 25 bp, Artificial Sequence
  Synthetic
ttatcctttatctaacagtctctct

SEQ ID NO: 14805 - DNA, 25 bp, Artificial Sequence
  Synthetic
gtctctttactattaggaattaacg

SEQ ID NO: 14806 - DNA, 21 bp, Artificial Sequence
  Synthetic
tcaatgaccttcctatgtctc

SEQ ID NO: 14807 - DNA, 19 bp, Artificial Sequence
  Synthetic
catcgacaagattccctcc

SEQ ID NO: 14808 - DNA, 19 bp, Artificial Sequence
  Synthetic
aaagcagtgaaaacttgcc

SEQ ID NO: 14809 - DNA, 20 bp, Artificial Sequence
  Synthetic
ctttcaatcttcgggacaac

SEQ ID NO: 14810 - DNA, 19 bp, Artificial Sequence
  Synthetic
tcgtgcaagtatgttcaac

SEQ ID NO: 14811 - DNA, 24 bp, Artificial Sequence
  Synthetic
acgtttagaaattctagaagatgc

SEQ ID NO: 14812 - DNA, 22 bp, Artificial Sequence
  Synthetic
ctaaaaattcgtctaactgctg

SEQ ID NO: 14813 - DNA, 20 bp, Artificial Sequence
  Synthetic
aacttctacaatagcgtgca

SEQ ID NO: 14814 - DNA, 18 bp, Artificial Sequence
  Synthetic
tcttgaacgcaacgagaa

SEQ ID NO: 14815 - DNA, 19 bp, Artificial Sequence
  Synthetic
aacaggaaaatggagaggt

SEQ ID NO: 14816 - DNA, 18 bp, Artificial Sequence
  Synthetic
ccatttgttcgcgagtca

SEQ ID NO: 14817 - DNA, 18 bp, Artificial Sequence
  Synthetic
ttgtctcggacgttttgc

SEQ ID NO: 14818 - DNA, 21 bp, Artificial Sequence
  Synthetic
acatttctcgcatatgaacag

SEQ ID NO: 14819 - DNA, 21 bp, Artificial Sequence
  Synthetic
tgtgcgatcaaaaatacgttt

SEQ ID NO: 14820 - DNA, 21 bp, Artificial Sequence
  Synthetic
ccattttcaccatttcacaga

SEQ ID NO: 14821 - DNA, 22 bp, Artificial Sequence
  Synthetic
tatcacagatacatcaagagct

SEQ ID NO: 14822 - DNA, 18 bp, Artificial Sequence
  Synthetic
ccaaagcgacgaagaact

SEQ ID NO: 14823 - DNA, 19 bp, Artificial Sequence
  Synthetic
caagagatgcaaccagaag

SEQ ID NO: 14824 - DNA, 21 bp, Artificial Sequence
  Synthetic
tcggacaataaactcgtaacg

SEQ ID NO: 14825 - DNA, 19 bp, Artificial Sequence
  Synthetic
agcttcatcttgagcttct

SEQ ID NO: 14826 - DNA, 21 bp, Artificial Sequence
  Synthetic
gtcattttctgttcatttcgg

SEQ ID NO: 14827 - DNA, 18 bp, Artificial Sequence
  Synthetic
cgctatcgtcaacagcat

SEQ ID NO: 14828 - DNA, 18 bp, Artificial Sequence
  Synthetic
tttagtgcaccgttacga

SEQ ID NO: 14829 - DNA, 23 bp, Artificial Sequence
  Synthetic
tcgtctattaatccttctaacga

SEQ ID NO: 14830 - DNA, 21 bp, Artificial Sequence
  Synthetic
ttacgctcttttgaacatgtc

SEQ ID NO: 14831 - DNA, 22 bp, Artificial Sequence
  Synthetic
attagttgctatgtctacctct

SEQ ID NO: 14832 - DNA, 18 bp, Artificial Sequence
  Synthetic
agctctgtttggttcctt

SEQ ID NO: 14833 - DNA, 19 bp, Artificial Sequence
  Synthetic
ccaagaggttccttctcaa

SEQ ID NO: 14834 - DNA, 22 bp, Artificial Sequence
  Synthetic
aaggaattcgatacttggattc

SEQ ID NO: 14835 - DNA, 23 bp, Artificial Sequence
  Synthetic
atgacttttttcaagctaacatc

SEQ ID NO: 14836 - DNA, 25 bp, Artificial Sequence
  Synthetic
tcttagatagtcgcttattagtgaa

SEQ ID NO: 14837 - DNA, 18 bp, Artificial Sequence
  Synthetic
gttgacaatggcttgagc

SEQ ID NO: 14838 - DNA, 23 bp, Artificial Sequence
  Synthetic
ttttcaggttgagtatatggaag

SEQ ID NO: 14839 - DNA, 25 bp, Artificial Sequence
  Synthetic
tagaaactattgatcaaagtatccg

SEQ ID NO: 14840 - DNA, 21 bp, Artificial Sequence
  Synthetic
agagttagtggtcatacaagg

SEQ ID NO: 14841 - DNA, 22 bp, Artificial Sequence
  Synthetic
caaaaaaattatcaggacgctt

SEQ ID NO: 14842 - DNA, 20 bp, Artificial Sequence
  Synthetic
ccatcacacacagcttttac

SEQ ID NO: 14843 - DNA, 22 bp, Artificial Sequence
  Synthetic
actggaatatacacttcttccg

SEQ ID NO: 14844 - DNA, 21 bp, Artificial Sequence
  Synthetic
aaggaagtgatgattcgaaga

SEQ ID NO: 14845 - DNA, 18 bp, Artificial Sequence
  Synthetic
agaaatccccgccagaaa

SEQ ID NO: 14846 - DNA, 19 bp, Artificial Sequence
  Synthetic
cccatggatcgtttagagc

SEQ ID NO: 14847 - DNA, 21 bp, Artificial Sequence
  Synthetic
ctagctttgatcaattccgta

SEQ ID NO: 14848 - DNA, 18 bp, Artificial Sequence
  Synthetic
tttggcagtcattgagga

SEQ ID NO: 14849 - DNA, 20 bp, Artificial Sequence
  Synthetic
ttgctgattttgtggttctt

SEQ ID NO: 14850 - DNA, 18 bp, Artificial Sequence
  Synthetic
agcagagcaatacgttgg

SEQ ID NO: 14851 - DNA, 19 bp, Artificial Sequence
  Synthetic
tattcccccttaggtctgg

SEQ ID NO: 14852 - DNA, 22 bp, Artificial Sequence
  Synthetic
agcttttcttctttcagttctg

SEQ ID NO: 14853 - DNA, 19 bp, Artificial Sequence
  Synthetic
tattcatgcttcgatccca

SEQ ID NO: 14854 - DNA, 19 bp, Artificial Sequence
  Synthetic
tttctcggaagggagttgt

SEQ ID NO: 14855 - DNA, 18 bp, Artificial Sequence
  Synthetic
tttttgggcttctctgcg

SEQ ID NO: 14856 - DNA, 19 bp, Artificial Sequence
  Synthetic
gtgaaagcacaggttcatg

SEQ ID NO: 14857 - DNA, 21 bp, Artificial Sequence
  Synthetic
atgacaatgctctttatcgac

SEQ ID NO: 14858 - DNA, 25 bp, Artificial Sequence
  Synthetic
agaattattaagcaaggatttaccg

SEQ ID NO: 14859 - DNA, 20 bp, Artificial Sequence
  Synthetic
ttgcaaccgatagattctga

SEQ ID NO: 14860 - DNA, 18 bp, Artificial Sequence
  Synthetic
ccggaagtggctactacc

SEQ ID NO: 14861 - DNA, 21 bp, Artificial Sequence
  Synthetic
aatgtttgttcctttcgatcg

SEQ ID NO: 14862 - DNA, 18 bp, Artificial Sequence
  Synthetic
ttatgcctttgttgctgc

SEQ ID NO: 14863 - DNA, 21 bp, Artificial Sequence
  Synthetic
tcaaagagcatcatacgaaga

SEQ ID NO: 14864 - DNA, 19 bp, Artificial Sequence
  Synthetic
tgtcgttcggaaaatctcc

SEQ ID NO: 14865 - DNA, 18 bp, Artificial Sequence
  Synthetic
ccttatggctcagcttca

SEQ ID NO: 14866 - DNA, 18 bp, Artificial Sequence
  Synthetic
atttgttttcctccggga

SEQ ID NO: 14867 - DNA, 20 bp, Artificial Sequence
  Synthetic
ttggagattgaaagacacga

SEQ ID NO: 14868 - DNA, 21 bp, Artificial Sequence
  Synthetic
gtgtcagtcttttttctggat

SEQ ID NO: 14869 - DNA, 22 bp, Artificial Sequence
  Synthetic
tccgaataattacatctgttgc

SEQ ID NO: 14870 - DNA, 22 bp, Artificial Sequence
  Synthetic
gtgctttggttaaaattgctac

SEQ ID NO: 14871 - DNA, 18 bp, Artificial Sequence
  Synthetic
accacaggatacggcata

SEQ ID NO: 14872 - DNA, 25 bp, Artificial Sequence
  Synthetic
agcttagtctatttgtaaagtagtg

SEQ ID NO: 14873 - DNA, 19 bp, Artificial Sequence
  Synthetic
tagtttggttggtgagtga

SEQ ID NO: 14874 - DNA, 19 bp, Artificial Sequence
  Synthetic
tgaaatggcgttatgttcc

SEQ ID NO: 14875 - DNA, 25 bp, Artificial Sequence
  Synthetic
gataagactatcatgattaaagctg

SEQ ID NO: 14876 - DNA, 23 bp, Artificial Sequence
  Synthetic
gcccattaaagataatcattgga

SEQ ID NO: 14877 - DNA, 20 bp, Artificial Sequence
  Synthetic
aactctggatcagtttcctt

SEQ ID NO: 14878 - DNA, 18 bp, Artificial Sequence
  Synthetic
gcgagtagcttctttggt

SEQ ID NO: 14879 - DNA, 18 bp, Artificial Sequence
  Synthetic
atttgttcggagatgcgt

SEQ ID NO: 14880 - DNA, 18 bp, Artificial Sequence
  Synthetic
gcttccggactatcgaag

SEQ ID NO: 14881 - DNA, 23 bp, Artificial Sequence
  Synthetic
acagccttgtttttattaaaccc

SEQ ID NO: 14882 - DNA, 22 bp, Artificial Sequence
  Synthetic
aatgcaagaagatataatcgcc

SEQ ID NO: 14883 - DNA, 19 bp, Artificial Sequence
  Synthetic
agatggaaactgatgggga

SEQ ID NO: 14884 - DNA, 21 bp, Artificial Sequence
  Synthetic
aggacccatatacaagagagt

SEQ ID NO: 14885 - DNA, 19 bp, Artificial Sequence
  Synthetic
gacaatggtgatggagttg

SEQ ID NO: 14886 - DNA, 24 bp, Artificial Sequence
  Synthetic
caaatgaaaacatggatactatgg

SEQ ID NO: 14887 - DNA, 18 bp, Artificial Sequence
  Synthetic
ctctgccctgttagtgga

SEQ ID NO: 14888 - DNA, 19 bp, Artificial Sequence
  Synthetic
caagtgcttgtcatgatgg

SEQ ID NO: 14889 - DNA, 25 bp, Artificial Sequence
  Synthetic
gaaaagggaaagatagtcaaatcag

SEQ ID NO: 14890 - DNA, 22 bp, Artificial Sequence
  Synthetic
ggagtaaaagggttttcattca

SEQ ID NO: 14891 - DNA, 21 bp, Artificial Sequence
  Synthetic
tattgtggattcttgatcgtc

SEQ ID NO: 14892 - DNA, 25 bp, Artificial Sequence
  Synthetic
agaggctgaaaaaataaagatatgc

SEQ ID NO: 14893 - DNA, 19 bp, Artificial Sequence
  Synthetic
tctttgtctggtggatcct

SEQ ID NO: 14894 - DNA, 18 bp, Artificial Sequence
  Synthetic
cttggtgaatgccttgga

SEQ ID NO: 14895 - DNA, 21 bp, Artificial Sequence
  Synthetic
tgtgacaactactttcaagtg

SEQ ID NO: 14896 - DNA, 21 bp, Artificial Sequence
  Synthetic
catacattggagaagctgatg

SEQ ID NO: 14897 - DNA, 21 bp, Artificial Sequence
  Synthetic
aatccattccaaaaatcccag

SEQ ID NO: 14898 - DNA, 24 bp, Artificial Sequence
  Synthetic
gaatgacagaatttctcatgatga

SEQ ID NO: 14899 - DNA, 23 bp, Artificial Sequence
  Synthetic
tattttcaagttcaacgaaactg

SEQ ID NO: 14900 - DNA, 22 bp, Artificial Sequence
  Synthetic
atacaagaagctcaaaagagaa

SEQ ID NO: 14901 - DNA, 19 bp, Artificial Sequence
  Synthetic
tagcactacggcaaaggct

SEQ ID NO: 14902 - DNA, 21 bp, Artificial Sequence
  Synthetic
gccatagaaaaacacgtaacc

SEQ ID NO: 14903 - DNA, 20 bp, Artificial Sequence
  Synthetic
ggaaacaggctactatacca

SEQ ID NO: 14904 - DNA, 21 bp, Artificial Sequence
  Synthetic
gcaaaaatggcagataaaggt

SEQ ID NO: 14905 - DNA, 23 bp, Artificial Sequence
  Synthetic
aagtattttagtcctaaagctgt

SEQ ID NO: 14906 - DNA, 18 bp, Artificial Sequence
  Synthetic
aaatgttggggatgcaca

SEQ ID NO: 14907 - DNA, 21 bp, Artificial Sequence
  Synthetic
ggcaattagatctaagtgacc

SEQ ID NO: 14908 - DNA, 24 bp, Artificial Sequence
  Synthetic
tatcatggtgcctattttatggat

SEQ ID NO: 14909 - DNA, 20 bp, Artificial Sequence
  Synthetic
tctaaaggaaggtacgggcg

SEQ ID NO: 14910 - DNA, 18 bp, Artificial Sequence
  Synthetic
cgggagcaggagaaggag

SEQ ID NO: 14911 - DNA, 24 bp, Artificial Sequence
  Synthetic
aatactcttaagtgttatcgctac

SEQ ID NO: 14912 - DNA, 18 bp, Artificial Sequence
  Synthetic
ggtgaagggacgagtgta

SEQ ID NO: 14913 - DNA, 20 bp, Artificial Sequence
  Synthetic
acaaaaacttggtaggccta

SEQ ID NO: 14914 - DNA, 25 bp, Artificial Sequence
  Synthetic
gataataccccaacagtaataattc

SEQ ID NO: 14915 - DNA, 22 bp, Artificial Sequence
  Synthetic
gttggacacccttattttgaag

SEQ ID NO: 14916 - DNA, 21 bp, Artificial Sequence
  Synthetic
caatactggaacaaaggatga

SEQ ID NO: 14917 - DNA, 23 bp, Artificial Sequence
  Synthetic
ttggatatagtagactccacatg

SEQ ID NO: 14918 - DNA, 24 bp, Artificial Sequence
  Synthetic
aaattgccagttctatctatttcc

SEQ ID NO: 14919 - DNA, 25 bp, Artificial Sequence
  Synthetic
aaactttataaaaacatccactccc

SEQ ID NO: 14920 - DNA, 21 bp, Artificial Sequence
  Synthetic
aaaatcatgtgatggtggatt

SEQ ID NO: 14921 - DNA, 18 bp, Artificial Sequence
  Synthetic
gtgtctgtcttggtgcag

SEQ ID NO: 14922 - DNA, 19 bp, Artificial Sequence
  Synthetic
tcctacttggagtcaggaa

SEQ ID NO: 14923 - DNA, 20 bp, Artificial Sequence
  Synthetic
ggttttgttatgcagtttgg

SEQ ID NO: 14924 - DNA, 20 bp, Artificial Sequence
  Synthetic
gttttaggttgcaaggctat

SEQ ID NO: 14925 - DNA, 19 bp, Artificial Sequence
  Synthetic
gcacaagcatttcagagtg

SEQ ID NO: 14926 - DNA, 21 bp, Artificial Sequence
  Synthetic
attctgaaccacctaaagttg

SEQ ID NO: 14927 - DNA, 23 bp, Artificial Sequence
  Synthetic
tcctgaagatgatgactttcttg

SEQ ID NO: 14928 - DNA, 23 bp, Artificial Sequence
  Synthetic
ataaaaatttgcaggatctttgg

SEQ ID NO: 14929 - DNA, 23 bp, Artificial Sequence
  Synthetic
ccgatatggttaagtctaaagga

SEQ ID NO: 14930 - DNA, 18 bp, Artificial Sequence
  Synthetic
gggcactaagaaattggc

SEQ ID NO: 14931 - DNA, 23 bp, Artificial Sequence
  Synthetic
aagccttgtttttggataaagtg

SEQ ID NO: 14932 - DNA, 19 bp, Artificial Sequence
  Synthetic
gcaggttgttgttaatggt

SEQ ID NO: 14933 - DNA, 21 bp, Artificial Sequence
  Synthetic
atgtaaatgtggtgtaaagca

SEQ ID NO: 14934 - DNA, 23 bp, Artificial Sequence
  Synthetic
aatattattgtgacggaggtaag

SEQ ID NO: 14935 - DNA, 23 bp, Artificial Sequence
  Synthetic
taatagaccttcattggttgatg

SEQ ID NO: 14936 - DNA, 21 bp, Artificial Sequence
  Synthetic
tgcccttatcagtattcagat

SEQ ID NO: 14937 - DNA, 22 bp, Artificial Sequence
  Synthetic
actggcttttgttcaaaacatc

SEQ ID NO: 14938 - DNA, 19 bp, Artificial Sequence
  Synthetic
gcatgtgcagggtaatgtt

SEQ ID NO: 14939 - DNA, 23 bp, Artificial Sequence
  Synthetic
gctgtaatagatcaggattttgg

SEQ ID NO: 14940 - DNA, 21 bp, Artificial Sequence
  Synthetic
atgctaaaggttttatccgtt

SEQ ID NO: 14941 - DNA, 18 bp, Artificial Sequence
  Synthetic
gcctgtggattttttggc

SEQ ID NO: 14942 - DNA, 18 bp, Artificial Sequence
  Synthetic
tgcatatagggaggctgc

SEQ ID NO: 14943 - DNA, 20 bp, Artificial Sequence
  Synthetic
tttagctgcttataacggca

SEQ ID NO: 14944 - DNA, 25 bp, Artificial Sequence
  Synthetic
gtgttctgtagaagattttaatgtg

SEQ ID NO: 14945 - DNA, 21 bp, Artificial Sequence
  Synthetic
ttgtgttataagtttggccat

SEQ ID NO: 14946 - DNA, 22 bp, Artificial Sequence
  Synthetic
aagggttctaacttagaggaag

SEQ ID NO: 14947 - DNA, 23 bp, Artificial Sequence
  Synthetic
ccctcctaagaatagttttgaag

SEQ ID NO: 14948 - DNA, 19 bp, Artificial Sequence
  Synthetic
cgatgattacgcaaaggac

SEQ ID NO: 14949 - DNA, 19 bp, Artificial Sequence
  Synthetic
tggcagcaaatactctgaa

SEQ ID NO: 14950 - DNA, 23 bp, Artificial Sequence
  Synthetic
ttttgtaaaaggttgtaacacac

SEQ ID NO: 14951 - DNA, 21 bp, Artificial Sequence
  Synthetic
tctgtttgtatatattgccgc

SEQ ID NO: 14952 - DNA, 23 bp, Artificial Sequence
  Synthetic
aagggcatttgatatttacaatg

SEQ ID NO: 14953 - DNA, 18 bp, Artificial Sequence
  Synthetic
ccctagttagcgctactg

SEQ ID NO: 14954 - DNA, 22 bp, Artificial Sequence
  Synthetic
attgtgatgaatatggatgtgg

SEQ ID NO: 14955 - DNA, 25 bp, Artificial Sequence
  Synthetic
agtattttgagatttatgatggtgg

SEQ ID NO: 14956 - DNA, 23 bp, Artificial Sequence
  Synthetic
aaatgtttgaaaagtatagcagc

SEQ ID NO: 14957 - DNA, 20 bp, Artificial Sequence
  Synthetic
gccaatgtatgtgccttaat

SEQ ID NO: 14958 - DNA, 21 bp, Artificial Sequence
  Synthetic
gttgggttgaacatgacataa

SEQ ID NO: 14959 - DNA, 21 bp, Artificial Sequence
  Synthetic
atcttggatagctacagtgtt

SEQ ID NO: 14960 - DNA, 25 bp, Artificial Sequence
  Synthetic
taatcgtatagctagttgtaaatgg

SEQ ID NO: 14961 - DNA, 22 bp, Artificial Sequence
  Synthetic
agctaatttaagtgctcctacg

SEQ ID NO: 14962 - DNA, 18 bp, Artificial Sequence
  Synthetic
tattgttccggccaaggt

SEQ ID NO: 14963 - DNA, 24 bp, Artificial Sequence
  Synthetic
taataagtttttgaaggctaaccc

SEQ ID NO: 14964 - DNA, 21 bp, Artificial Sequence
  Synthetic
ccttagataaagtgccacagg

SEQ ID NO: 14965 - DNA, 18 bp, Artificial Sequence
  Synthetic
gcgtgatagcattgggac

SEQ ID NO: 14966 - DNA, 18 bp, Artificial Sequence
  Synthetic
agttacatgggcagccaa

SEQ ID NO: 14967 - DNA, 23 bp, Artificial Sequence
  Synthetic
actttgtgttatgatattggcaa

SEQ ID NO: 14968 - DNA, 18 bp, Artificial Sequence
  Synthetic
ggcagcctttgagcattt

SEQ ID NO: 14969 - DNA, 22 bp, Artificial Sequence
  Synthetic
tcaagactggtcattatacagg

SEQ ID NO: 14970 - DNA, 22 bp, Artificial Sequence
  Synthetic
aattgaatgtcctttttgatgg

SEQ ID NO: 14971 - DNA, 23 bp, Artificial Sequence
  Synthetic
tattcagaagtatggtttggagg

SEQ ID NO: 14972 - DNA, 23 bp, Artificial Sequence
  Synthetic
gtaacgatgagaaagttatgact

SEQ ID NO: 14973 - DNA, 25 bp, Artificial Sequence
  Synthetic
acatacatttgtcatatgattcgag

SEQ ID NO: 14974 - DNA, 23 bp, Artificial Sequence
  Synthetic
aggtttacaatttcaaattctcg

SEQ ID NO: 14975 - DNA, 18 bp, Artificial Sequence
  Synthetic
gatgcagcactgtccatt

SEQ ID NO: 14976 - DNA, 20 bp, Artificial Sequence
  Synthetic
aggagttttcactttaccga

SEQ ID NO: 14977 - DNA, 21 bp, Artificial Sequence
  Synthetic
ccctctggtaattatttagcc

SEQ ID NO: 14978 - DNA, 24 bp, Artificial Sequence
  Synthetic
gtgagttccctgctataactatag

SEQ ID NO: 14979 - DNA, 24 bp, Artificial Sequence
  Synthetic
gtttaatgtttatttaggcatggc

SEQ ID NO: 14980 - DNA, 22 bp, Artificial Sequence
  Synthetic
cgtaaacctaatcttcccaatt

SEQ ID NO: 14981 - DNA, 21 bp, Artificial Sequence
  Synthetic
ctgctaatgtttctgttagca

SEQ ID NO: 14982 - DNA, 19 bp, Artificial Sequence
  Synthetic
acttataagtgcccccaaa

SEQ ID NO: 14983 - DNA, 23 bp, Artificial Sequence
  Synthetic
caaacagaacttttatgattcgt

SEQ ID NO: 14984 - DNA, 24 bp, Artificial Sequence
  Synthetic
accttcagagtttactataggtaa

SEQ ID NO: 14985 - DNA, 25 bp, Artificial Sequence
  Synthetic
gttgaggcttataataattgtacag

SEQ ID NO: 14986 - DNA, 25 bp, Artificial Sequence
  Synthetic
caagaaattctatctagacttgatg

SEQ ID NO: 14987 - DNA, 18 bp, Artificial Sequence
  Synthetic
tatgtcacagcgagggtt

SEQ ID NO: 14988 - DNA, 21 bp, Artificial Sequence
  Synthetic
tgttacattcttggacctaca

SEQ ID NO: 14989 - DNA, 22 bp, Artificial Sequence
  Synthetic
agacctgagaagaaatatctcc

SEQ ID NO: 14990 - DNA, 22 bp, Artificial Sequence
  Synthetic
attagaactggaagtttttgga

SEQ ID NO: 14991 - DNA, 18 bp, Artificial Sequence
  Synthetic
ccaaaagggttctggcat

SEQ ID NO: 14992 - DNA, 19 bp, Artificial Sequence
  Synthetic
gaacaggaccgcatgctaa

SEQ ID NO: 14993 - DNA, 18 bp, Artificial Sequence
  Synthetic
cgcgtagtagagccaatt

SEQ ID NO: 14994 - DNA, 19 bp, Artificial Sequence
  Synthetic
tatctgggaatcctgacga

SEQ ID NO: 14995 - DNA, 21 bp, Artificial Sequence
  Synthetic
atactgaagacacctcagaaa

SEQ ID NO: 14996 - DNA, 21 bp, Artificial Sequence
  Synthetic
aactgacatgactattgagga

SEQ ID NO: 14997 - DNA, 23 bp, Artificial Sequence
  Synthetic
ttttccaggacatactattgagg

SEQ ID NO: 14998 - DNA, 20 bp, Artificial Sequence
  Synthetic
ctgctttctttggcatgtcc

SEQ ID NO: 14999 - DNA, 21 bp, Artificial Sequence
  Synthetic
gctacctaactgaaatgactc

SEQ ID NO: 15000 - DNA, 19 bp, Artificial Sequence
  Synthetic
cttccaggacatactgacg

SEQ ID NO: 15001 - DNA, 20 bp, Artificial Sequence
  Synthetic
gatcactcccctgtgaggaa

SEQ ID NO: 15002 - DNA, 20 bp, Artificial Sequence
  Synthetic
aaagaaacaccatccgtcgc

SEQ ID NO: 15003 - DNA, 18 bp, Artificial Sequence
  Synthetic
ggaggtcccgcaatttgg

SEQ ID NO: 15004 - DNA, 18 bp, Artificial Sequence
  Synthetic
cattctgcacacacccgg

SEQ ID NO: 15005 - DNA, 19 bp, Artificial Sequence
  Synthetic
ggacatcgaatggcttggg

SEQ ID NO: 15006 - DNA, 18 bp, Artificial Sequence
  Synthetic
agctgcaagcccatcact

SEQ ID NO: 15007 - DNA, 17 bp, Artificial Sequence
  Synthetic
gcgtgccaacctacacc

SEQ ID NO: 15008 - DNA, 20 bp, Artificial Sequence
  Synthetic
tgaacatcgatttaccgccg

SEQ ID NO: 15009 - DNA, 19 bp, Artificial Sequence
  Synthetic
ccctttggctgatgctgat

SEQ ID NO: 15010 - DNA, 20 bp, Artificial Sequence
  Synthetic
acctatacgaccacctagcg

SEQ ID NO: 15011 - DNA, 20 bp, Artificial Sequence
  Synthetic
gagacaagaacgtggtgacc

SEQ ID NO: 15012 - DNA, 19 bp, Artificial Sequence
  Synthetic
gctcagtcctaggcctctc

SEQ ID NO: 15013 - DNA, 19 bp, Artificial Sequence
  Synthetic
ccacattaggcttcggctc

SEQ ID NO: 15014 - DNA, 20 bp, Artificial Sequence
  Synthetic
accttttccattgagacccg

SEQ ID NO: 15015 - DNA, 19 bp, Artificial Sequence
  Synthetic
agactaagcagcagggact

SEQ ID NO: 15016 - DNA, 18 bp, Artificial Sequence
  Synthetic
tcggctgcgttgtgattg

SEQ ID NO: 15017 - DNA, 17 bp, Artificial Sequence
  Synthetic
ttgcctggcaaccctgc

SEQ ID NO: 15018 - DNA, 19 bp, Artificial Sequence
  Synthetic
gcccgccatactatctccg

SEQ ID NO: 15019 - DNA, 18 bp, Artificial Sequence
  Synthetic
ccgacttcaaggcatggc

SEQ ID NO: 15020 - DNA, 18 bp, Artificial Sequence
  Synthetic
gggtgggggacttccatt

SEQ ID NO: 15021 - DNA, 19 bp, Artificial Sequence
  Synthetic
atccgccagccaactatca

SEQ ID NO: 15022 - DNA, 20 bp, Artificial Sequence
  Synthetic
tgtaccaccaactgtccatg

SEQ ID NO: 15023 - DNA, 19 bp, Artificial Sequence
  Synthetic
accgttagtgacagcgagg

SEQ ID NO: 15024 - DNA, 18 bp, Artificial Sequence
  Synthetic
tcactctgcccgatcgaa

SEQ ID NO: 15025 - DNA, 20 bp, Artificial Sequence
  Synthetic
cactgaacaggacatcaggg

SEQ ID NO: 15026 - DNA, 18 bp, Artificial Sequence
  Synthetic
caaaggccgcaaacctcc

SEQ ID NO: 15027 - DNA, 25 bp, Artificial Sequence
  Synthetic
aaagaactaagaaatctaatgtcgc

SEQ ID NO: 15028 - DNA, 18 bp, Artificial Sequence
  Synthetic
ggatcagaccgagtgatg

SEQ ID NO: 15029 - DNA, 21 bp, Artificial Sequence
  Synthetic
aagttgttttccctaacgaag

SEQ ID NO: 15030 - DNA, 22 bp, Artificial Sequence
  Synthetic
aatgatgatgttgatcaaagct

SEQ ID NO: 15031 - DNA, 18 bp, Artificial Sequence
  Synthetic
acaagcggatcatcagtc

SEQ ID NO: 15032 - DNA, 22 bp, Artificial Sequence
  Synthetic
gatctgaatttcgtcaataggg

SEQ ID NO: 15033 - DNA, 19 bp, Artificial Sequence
  Synthetic
attgaccggttcttgagag

SEQ ID NO: 15034 - DNA, 22 bp, Artificial Sequence
  Synthetic
tagtacctaaggccattagagg

SEQ ID NO: 15035 - DNA, 20 bp, Artificial Sequence
  Synthetic
ggcactttaaccgaagaccc

SEQ ID NO: 15036 - DNA, 20 bp, Artificial Sequence
  Synthetic
atgaaagccttaacaccggc

SEQ ID NO: 15037 - DNA, 20 bp, Artificial Sequence
  Synthetic
tccttaacaacaccaggcca

SEQ ID NO: 15038 - DNA, 16 bp, Artificial Sequence
  Synthetic
gcctgcaactggacgc

SEQ ID NO: 15039 - DNA, 20 bp, Artificial Sequence
  Synthetic
tactcaatgcagcatccctg

SEQ ID NO: 15040 - DNA, 20 bp, Artificial Sequence
  Synthetic
tgtgttgtacacccgactct

SEQ ID NO: 15041 - DNA, 17 bp, Artificial Sequence
  Synthetic
ctgcgagatctggccgt

SEQ ID NO: 15042 - DNA, 19 bp, Artificial Sequence
  Synthetic
caacgtgcatcaatggggt

SEQ ID NO: 15043 - DNA, 16 bp, Artificial Sequence
  Synthetic
ggtgtgcacccgtgga

SEQ ID NO: 15044 - DNA, 18 bp, Artificial Sequence
  Synthetic
gcagccccatcacgtact

SEQ ID NO: 15045 - DNA, 20 bp, Artificial Sequence
  Synthetic
tcaaagaagaagtgcgacga

SEQ ID NO: 15046 - DNA, 20 bp, Artificial Sequence
  Synthetic
tctacagatttgtggcaccg

SEQ ID NO: 15047 - DNA, 18 bp, Artificial Sequence
  Synthetic
ggccaacacccctgctat

SEQ ID NO: 15048 - DNA, 19 bp, Artificial Sequence
  Synthetic
aagggatgatgctcgctga

SEQ ID NO: 15049 - DNA, 16 bp, Artificial Sequence
  Synthetic
tgggcgctggcttagc

SEQ ID NO: 15050 - DNA, 19 bp, Artificial Sequence
  Synthetic
ggaaccatgtttcccccac

SEQ ID NO: 15051 - DNA, 20 bp, Artificial Sequence
  Synthetic
tggacatgtcaaaaacggga

SEQ ID NO: 15052 - DNA, 16 bp, Artificial Sequence
  Synthetic
tgctgcgggaggaggt

SEQ ID NO: 15053 - DNA, 17 bp, Artificial Sequence
  Synthetic
tcgatccgcttgtggca

SEQ ID NO: 15054 - DNA, 17 bp, Artificial Sequence
  Synthetic
ggcattacgggcgacaa

SEQ ID NO: 15055 - DNA, 20 bp, Artificial Sequence
  Synthetic
attaccaggacgtgctcaag

SEQ ID NO: 15056 - DNA, 18 bp, Artificial Sequence
  Synthetic
cctgagaaggggggtcgt

SEQ ID NO: 15057 - DNA, 19 bp, Artificial Sequence
  Synthetic
ttatgttgggggccctctt

SEQ ID NO: 15058 - DNA, 18 bp, Artificial Sequence
  Synthetic
gcgctggaaagagggtct

SEQ ID NO: 15059 - DNA, 20 bp, Artificial Sequence
  Synthetic
tgaaatcaatagggtggccg

SEQ ID NO: 15060 - DNA, 24 bp, Artificial Sequence
  Synthetic
cgaatggggtacatataaaacaag

SEQ ID NO: 15061 - DNA, 25 bp, Artificial Sequence
  Synthetic
tattcatattatgtagaaggtgtgg

SEQ ID NO: 15062 - DNA, 21 bp, Artificial Sequence
  Synthetic
ggatatccctgtatgcaatgt

SEQ ID NO: 15063 - DNA, 18 bp, Artificial Sequence
  Synthetic
atttcagccccgtgtgtg

SEQ ID NO: 15064 - DNA, 22 bp, Artificial Sequence
  Synthetic
gcataaagaccctaatacaacc

SEQ ID NO: 15065 - DNA, 22 bp, Artificial Sequence
  Synthetic
aggagtaccaaaaaaaagttgt

SEQ ID NO: 15066 - DNA, 19 bp, Artificial Sequence
  Synthetic
tgacaacacaaggagaacc

SEQ ID NO: 15067 - DNA, 22 bp, Artificial Sequence
  Synthetic
ttatgtgcagaactatagtgac

SEQ ID NO: 15068 - DNA, 19 bp, Artificial Sequence
  Synthetic
aaagcgacagcgactcgag

SEQ ID NO: 15069 - DNA, 22 bp, Artificial Sequence
  Synthetic
tggatttttacttgtgtcgact

SEQ ID NO: 15070 - DNA, 19 bp, Artificial Sequence
  Synthetic
ataggacctgcaaggcctc

SEQ ID NO: 15071 - DNA, 18 bp, Artificial Sequence
  Synthetic
agggtccaccatacctac

SEQ ID NO: 15072 - DNA, 20 bp, Artificial Sequence
  Synthetic
cccgggtacattactatcag

SEQ ID NO: 15073 - DNA, 18 bp, Artificial Sequence
  Synthetic
gcgctctagtgacaactt

SEQ ID NO: 15074 - DNA, 22 bp, Artificial Sequence
  Synthetic
ctattcaggatggtgatatggt

SEQ ID NO: 15075 - DNA, 22 bp, Artificial Sequence
  Synthetic
aggaatatgatttgcagttcat

SEQ ID NO: 15076 - DNA, 21 bp, Artificial Sequence
  Synthetic
tgttatgagcatgtatgtgtg

SEQ ID NO: 15077 - DNA, 18 bp, Artificial Sequence
  Synthetic
ctgaggaggaggagcaat

SEQ ID NO: 15078 - DNA, 20 bp, Artificial Sequence
  Synthetic
cactctggaggatttgtttg

SEQ ID NO: 15079 - DNA, 21 bp, Artificial Sequence
  Synthetic
tttcaaaaaacatggctacac

SEQ ID NO: 15080 - DNA, 20 bp, Artificial Sequence
  Synthetic
tctagttctaccaggcagcc

SEQ ID NO: 15081 - DNA, 18 bp, Artificial Sequence
  Synthetic
acgaaccaccgagacaga

SEQ ID NO: 15082 - DNA, 18 bp, Artificial Sequence
  Synthetic
atttgggcaacttgggta

SEQ ID NO: 15083 - DNA, 20 bp, Artificial Sequence
  Synthetic
gagctcttcaattgttcctt

SEQ ID NO: 15084 - DNA, 19 bp, Artificial Sequence
  Synthetic
attttgtaaggcaaccgtc

SEQ ID NO: 15085 - DNA, 21 bp, Artificial Sequence
  Synthetic
acattggcctctaatattcct

SEQ ID NO: 15086 - DNA, 22 bp, Artificial Sequence
  Synthetic
aatcgtggaaagttatatctgc

SEQ ID NO: 15087 - DNA, 24 bp, Artificial Sequence
  Synthetic
gttggtttggaaattgataggatt

SEQ ID NO: 15088 - DNA, 20 bp, Artificial Sequence
  Synthetic
aaaggtttgcgaaaatgtcc

SEQ ID NO: 15089 - DNA, 19 bp, Artificial Sequence
  Synthetic
tttacgcgaggcactttta

SEQ ID NO: 15090 - DNA, 18 bp, Artificial Sequence
  Synthetic
atgctgccttttaagcca

SEQ ID NO: 15091 - DNA, 20 bp, Artificial Sequence
  Synthetic
actaaagcagctgttaaggg

SEQ ID NO: 15092 - DNA, 20 bp, Artificial Sequence
  Synthetic
ttcaatagcagcagttacct

SEQ ID NO: 15093 - DNA, 23 bp, Artificial Sequence
  Synthetic
aataccaagagaatctacttgga

SEQ ID NO: 15094 - DNA, 19 bp, Artificial Sequence
  Synthetic
atgattgtagcttgcagga

SEQ ID NO: 15095 - DNA, 18 bp, Artificial Sequence
  Synthetic
tatgggacggagaagagg

SEQ ID NO: 15096 - DNA, 18 bp, Artificial Sequence
  Synthetic
gccaacttttatccccca

SEQ ID NO: 15097 - DNA, 22 bp, Artificial Sequence
  Synthetic
gaagttataatgggagccaatg

SEQ ID NO: 15098 - DNA, 20 bp, Artificial Sequence
  Synthetic
ggtcagtacagtggatttgc

SEQ ID NO: 15099 - DNA, 18 bp, Artificial Sequence
  Synthetic
atggggaatgcagtactg

SEQ ID NO: 15100 - DNA, 22 bp, Artificial Sequence
  Synthetic
gtctatcagcttacgatctctt

SEQ ID NO: 15101 - DNA, 18 bp, Artificial Sequence
  Synthetic
gttatgcccctctactgg

SEQ ID NO: 15102 - DNA, 25 bp, Artificial Sequence
  Synthetic
gataattgtgatttttatggttggg

SEQ ID NO: 15103 - DNA, 22 bp, Artificial Sequence
  Synthetic
ttatgttcaatgtaagtgtggt

SEQ ID NO: 15104 - DNA, 21 bp, Artificial Sequence
  Synthetic
tgagtattgtcaaccacctaa

SEQ ID NO: 15105 - DNA, 21 bp, Artificial Sequence
  Synthetic
acctcaattgtatggtttgtg

SEQ ID NO: 15106 - DNA, 23 bp, Artificial Sequence
  Synthetic
cggtccatttttttcttttgaac

SEQ ID NO: 15107 - DNA, 21 bp, Artificial Sequence
  Synthetic
ttggtacattagcaaagactg

SEQ ID NO: 15108 - DNA, 23 bp, Artificial Sequence
  Synthetic
ttaaaccatttgctaaagttgac

SEQ ID NO: 15109 - DNA, 23 bp, Artificial Sequence
  Synthetic
cggttttatatagttgttactgc

SEQ ID NO: 15110 - DNA, 20 bp, Artificial Sequence
  Synthetic
gggtgtgcaattagaaaagg

SEQ ID NO: 15111 - DNA, 25 bp, Artificial Sequence
  Synthetic
ctttgtgtactatgtttaaaagagg

SEQ ID NO: 15112 - DNA, 19 bp, Artificial Sequence
  Synthetic
taatgtctggtcggatgag

SEQ ID NO: 15113 - DNA, 22 bp, Artificial Sequence
  Synthetic
ttatggtccatatagagatgct

SEQ ID NO: 15114 - DNA, 21 bp, Artificial Sequence
  Synthetic
tgtatgaacgtgataaagctg

SEQ ID NO: 15115 - DNA, 20 bp, Artificial Sequence
  Synthetic
atcatgctggtactggtatg

SEQ ID NO: 15116 - DNA, 21 bp, Artificial Sequence
  Synthetic
tactgtcatttttgcagacac

SEQ ID NO: 15117 - DNA, 21 bp, Artificial Sequence
  Synthetic
ccgtttgttgtttctattggt

SEQ ID NO: 15118 - DNA, 22 bp, Artificial Sequence
  Synthetic
aagccagactttattatgaggc

SEQ ID NO: 15119 - DNA, 19 bp, Artificial Sequence
  Synthetic
cctgttcttatgggttggg

SEQ ID NO: 15120 - DNA, 24 bp, Artificial Sequence
  Synthetic
tccagatccttctagaattttagg

SEQ ID NO: 15121 - DNA, 18 bp, Artificial Sequence
  Synthetic
aatcttgcacgggttcac

SEQ ID NO: 15122 - DNA, 18 bp, Artificial Sequence
  Synthetic
gtgcacctacacttgtcc

SEQ ID NO: 15123 - DNA, 18 bp, Artificial Sequence
  Synthetic
tgttagaggttgggttgg

SEQ ID NO: 15124 - DNA, 18 bp, Artificial Sequence
  Synthetic
ggttattgcagcgtgtca

SEQ ID NO: 15125 - DNA, 25 bp, Artificial Sequence
  Synthetic
ccttttttctattattcagatacgc

SEQ ID NO: 15126 - DNA, 25 bp, Artificial Sequence
  Synthetic
agtaggttatcaatgattaaaggtc

SEQ ID NO: 15127 - DNA, 20 bp, Artificial Sequence
  Synthetic
acaggctgtatgatgaatgt

SEQ ID NO: 15128 - DNA, 20 bp, Artificial Sequence
  Synthetic
aaccttcttttgcttcaagt

SEQ ID NO: 15129 - DNA, 24 bp, Artificial Sequence
  Synthetic
ctgattattctgtttcttcttgtg

SEQ ID NO: 15130 - DNA, 25 bp, Artificial Sequence
  Synthetic
ttacaagaaattttatctcgtctcg

SEQ ID NO: 15131 - DNA, 22 bp, Artificial Sequence
  Synthetic
attgatatgaaaggcaagatgt

SEQ ID NO: 15132 - DNA, 19 bp, Artificial Sequence
  Synthetic
cggtcattatgctggaagt

SEQ ID NO: 15133 - DNA, 22 bp, Artificial Sequence
  Synthetic
gtaaagattctaaacctcagca

SEQ ID NO: 15134 - DNA, 21 bp, Artificial Sequence
  Synthetic
cagaacactgattctgattcg

SEQ ID NO: 15135 - DNA, 19 bp, Artificial Sequence
  Synthetic
agattttgtgcgacaatgc

SEQ ID NO: 15136 - DNA, 18 bp, Artificial Sequence
  Synthetic
gaaagcagggctaggatt

SEQ ID NO: 15137 - DNA, 20 bp, Artificial Sequence
  Synthetic
atgtccaaagaagtgaatgc

SEQ ID NO: 15138 - DNA, 20 bp, Artificial Sequence
  Synthetic
tggaagcaagtattgtcaga

SEQ ID NO: 15139 - DNA, 21 bp, Artificial Sequence
  Synthetic
gatagagctcgatgaaattgg

SEQ ID NO: 15140 - DNA, 21 bp, Artificial Sequence
  Synthetic
cacagatgtggtaaactttgt

SEQ ID NO: 15141 - DNA, 19 bp, Artificial Sequence
  Synthetic
tcgagagcatgattgaagc

SEQ ID NO: 15142 - DNA, 18 bp, Artificial Sequence
  Synthetic
gaaactggtggagaacgc

SEQ ID NO: 15143 - DNA, 20 bp, Artificial Sequence
  Synthetic
gggacaatggtaatggaact

SEQ ID NO: 15144 - DNA, 20 bp, Artificial Sequence
  Synthetic
agcagaaatcctgggaatgc

SEQ ID NO: 15145 - DNA, 18 bp, Artificial Sequence
  Synthetic
catgccattctgcagcat

SEQ ID NO: 15146 - DNA, 23 bp, Artificial Sequence
  Synthetic
gatacttattgctttgattgctc

SEQ ID NO: 15147 - DNA, 19 bp, Artificial Sequence
  Synthetic
tctcaaggtccgttccaga

SEQ ID NO: 15148 - DNA, 18 bp, Artificial Sequence
  Synthetic
gggcaggaactagatcag

SEQ ID NO: 15149 - DNA, 20 bp, Artificial Sequence
  Synthetic
ctttaccaaaaggcacatca

SEQ ID NO: 15150 - DNA, 23 bp, Artificial Sequence
  Synthetic
ctggtggttcattaggatatagg

SEQ ID NO: 15151 - DNA, 19 bp, Artificial Sequence
  Synthetic
ggtgattcaatagggggga

SEQ ID NO: 15152 - DNA, 19 bp, Artificial Sequence
  Synthetic
ggactcaggatttggtcag

SEQ ID NO: 15153 - DNA, 21 bp, Artificial Sequence
  Synthetic
ccaatgaagattttgctgaca

SEQ ID NO: 15154 - DNA, 18 bp, Artificial Sequence
  Synthetic
cagaacagcggatggatt

SEQ ID NO: 15155 - DNA, 20 bp, Artificial Sequence
  Synthetic
gcaggaagacagatctagtg

SEQ ID NO: 15156 - DNA, 21 bp, Artificial Sequence
  Synthetic
atgtaaggtaaagcttgaacc

SEQ ID NO: 15157 - DNA, 23 bp, Artificial Sequence
  Synthetic
aacggttttcttcagatttaagc

SEQ ID NO: 15158 - DNA, 25 bp, Artificial Sequence
  Synthetic
tgtcataatacactataaaaggctg

SEQ ID NO: 15159 - DNA, 22 bp, Artificial Sequence
  Synthetic
aaaggcaatgaaagaatatggg

SEQ ID NO: 15160 - DNA, 23 bp, Artificial Sequence
  Synthetic
tggtgaacagtatatgtaacaca

SEQ ID NO: 15161 - DNA, 25 bp, Artificial Sequence
  Synthetic
cttttcactataagacaagaaatgg

SEQ ID NO: 15162 - DNA, 20 bp, Artificial Sequence
  Synthetic
agatcccaaggacaaagaac

SEQ ID NO: 15163 - DNA, 23 bp, Artificial Sequence
  Synthetic
tgatgaaataggagaagatgttg

SEQ ID NO: 15164 - DNA, 23 bp, Artificial Sequence
  Synthetic
tgaactttgtaagtatggagttc

SEQ ID NO: 15165 - DNA, 19 bp, Artificial Sequence
  Synthetic
ttgagagcatgattgaggc

SEQ ID NO: 15166 - DNA, 19 bp, Artificial Sequence
  Synthetic
cgataacctcgtttcaggt

SEQ ID NO: 15167 - DNA, 21 bp, Artificial Sequence
  Synthetic
ggtatatcaccgatatgagca

SEQ ID NO: 15168 - DNA, 22 bp, Artificial Sequence
  Synthetic
ttacagaggatgtcaaaaatgc

SEQ ID NO: 15169 - DNA, 24 bp, Artificial Sequence
  Synthetic
gtaatggaatcaatggataaggaa

SEQ ID NO: 15170 - DNA, 18 bp, Artificial Sequence
  Synthetic
aggattcgtgcactttgt

SEQ ID NO: 15171 - DNA, 25 bp, Artificial Sequence
  Synthetic
ttaggagtctcaatcttaaatcttg

SEQ ID NO: 15172 - DNA, 18 bp, Artificial Sequence
  Synthetic
tagccaacttcagcatgg

SEQ ID NO: 15173 - DNA, 19 bp, Artificial Sequence
  Synthetic
attcccaagagaaatcgct

SEQ ID NO: 15174 - DNA, 24 bp, Artificial Sequence
  Synthetic
gaaatcggtgcatatatataaccc

SEQ ID NO: 15175 - DNA, 18 bp, Artificial Sequence
  Synthetic
ccgcagagaaacacaagt

SEQ ID NO: 15176 - DNA, 25 bp, Artificial Sequence
  Synthetic
ctagtaatacaaattatatgcaggc

SEQ ID NO: 15177 - DNA, 23 bp, Artificial Sequence
  Synthetic
gcactatattggtataggacagg

SEQ ID NO: 15178 - DNA, 25 bp, Artificial Sequence
  Synthetic
gtagggtaacagtatttacatttcc

SEQ ID NO: 15179 - DNA, 25 bp, Artificial Sequence
  Synthetic
gtctggaaaatgcaatatattatgc

SEQ ID NO: 15180 - DNA, 25 bp, Artificial Sequence
  Synthetic
tacaatgttctgaatctatgtacag

SEQ ID NO: 15181 - DNA, 19 bp, Artificial Sequence
  Synthetic
gtggcagacctaatactgt

SEQ ID NO: 15182 - DNA, 18 bp, Artificial Sequence
  Synthetic
tgcatttaccgacccttc

SEQ ID NO: 15183 - DNA, 25 bp, Artificial Sequence
  Synthetic
atagacactacattaaccttttcac

SEQ ID NO: 15184 - DNA, 18 bp, Artificial Sequence
  Synthetic
cgcaagcaagacattcct

SEQ ID NO: 15185 - DNA, 19 bp, Artificial Sequence
  Synthetic
cccatgttgctacttctgt

SEQ ID NO: 15186 - DNA, 21 bp, Artificial Sequence
  Synthetic
aggttcccttagacatttgtc

SEQ ID NO: 15187 - DNA, 20 bp, Artificial Sequence
  Synthetic
ggcacatatatgggaaagac

SEQ ID NO: 15188 - DNA, 20 bp, Artificial Sequence
  Synthetic
gtggtcaagtactagttgcc

SEQ ID NO: 15189 - DNA, 20 bp, Artificial Sequence
  Synthetic
actggaactgctaagcatat

SEQ ID NO: 15190 - DNA, 21 bp, Artificial Sequence
  Synthetic
gagtcaagggattctcatacc

SEQ ID NO: 15191 - DNA, 19 bp, Artificial Sequence
  Synthetic
agatctaatgtcgcagtcc

SEQ ID NO: 15192 - DNA, 18 bp, Artificial Sequence
  Synthetic
gtatcacctctggccgta

SEQ ID NO: 15193 - DNA, 25 bp, Artificial Sequence
  Synthetic
ataacaaaagagaagaaagaagagc

SEQ ID NO: 15194 - DNA, 21 bp, Artificial Sequence
  Synthetic
agtttgattatcgctgctaga

SEQ ID NO: 15195 - DNA, 21 bp, Artificial Sequence
  Synthetic
aagaagaagaagtgctaacgg

SEQ ID NO: 15196 - DNA, 20 bp, Artificial Sequence
  Synthetic
gaacgtactattgtctcccg

SEQ ID NO: 15197 - DNA, 18 bp, Artificial Sequence
  Synthetic
ggacactgttccagcaaa

SEQ ID NO: 15198 - DNA, 18 bp, Artificial Sequence
  Synthetic
gatgaaggcacatctggg

SEQ ID NO: 15199 - DNA, 18 bp, Artificial Sequence
  Synthetic
atttgtgaccgggagaga

SEQ ID NO: 15200 - DNA, 22 bp, Artificial Sequence
  Synthetic
ttaagcaatgaatctctgtcac

SEQ ID NO: 15201 - DNA, 18 bp, Artificial Sequence
  Synthetic
ggatcgctcatttgcaga

SEQ ID NO: 15202 - DNA, 19 bp, Artificial Sequence
  Synthetic
acaacaaggagaacgttcc

SEQ ID NO: 15203 - DNA, 19 bp, Artificial Sequence
  Synthetic
tttgggaattggatctggg

SEQ ID NO: 15204 - DNA, 23 bp, Artificial Sequence
  Synthetic
tttagattttgtagctcctgatg

SEQ ID NO: 15205 - DNA, 19 bp, Artificial Sequence
  Synthetic
aatttgaaaatgccgccta

SEQ ID NO: 15206 - DNA, 21 bp, Artificial Sequence
  Synthetic
agaattgcagactatagctgg

SEQ ID NO: 15207 - DNA, 23 bp, Artificial Sequence
  Synthetic
tatcaggtgtagaaattaaacgt

SEQ ID NO: 15208 - DNA, 22 bp, Artificial Sequence
  Synthetic
taatagccctattcaggatggt

SEQ ID NO: 15209 - DNA, 25 bp, Artificial Sequence
  Synthetic
ttcattaacctgctatgtatttgtc

SEQ ID NO: 15210 - DNA, 19 bp, Artificial Sequence
  Synthetic
gtggtgacagattgcaagt

SEQ ID NO: 15211 - DNA, 18 bp, Artificial Sequence
  Synthetic
aggtggaaaaggtagcgt

SEQ ID NO: 15212 - DNA, 25 bp, Artificial Sequence
  Synthetic
atgtagagatactgtacaaaaactg

SEQ ID NO: 15213 - DNA, 22 bp, Artificial Sequence
  Synthetic
ccactaacagatgctaaattgg

SEQ ID NO: 15214 - DNA, 20 bp, Artificial Sequence
  Synthetic
ccaaatacaacactgggatc

SEQ ID NO: 15215 - DNA, 25 bp, Artificial Sequence
  Synthetic
atatattatcaagatgcagatgagc

SEQ ID NO: 15216 - DNA, 21 bp, Artificial Sequence
  Synthetic
cattgaaatgttggaggtaca

SEQ ID NO: 15217 - DNA, 19 bp, Artificial Sequence
  Synthetic
actttgggggtctgggtat

SEQ ID NO: 15218 - DNA, 18 bp, Artificial Sequence
  Synthetic
aaagggtctctgtaggca

SEQ ID NO: 15219 - DNA, 21 bp, Artificial Sequence
  Synthetic
ctgaaggccacattagactaa

SEQ ID NO: 15220 - DNA, 25 bp, Artificial Sequence
  Synthetic
actacattttatttacatcctggac

SEQ ID NO: 15221 - DNA, 21 bp, Artificial Sequence
  Synthetic
gacaaagtgtctctatggacc

SEQ ID NO: 15222 - DNA, 23 bp, Artificial Sequence
  Synthetic
attacattggttgataacacaca

SEQ ID NO: 15223 - DNA, 20 bp, Artificial Sequence
  Synthetic
tacagaacgtttgtcctctg

SEQ ID NO: 15224 - DNA, 21 bp, Artificial Sequence
  Synthetic
tcaacaacaagattactcagc

SEQ ID NO: 15225 - DNA, 21 bp, Artificial Sequence
  Synthetic
tttacctgtcagtcttttagc

SEQ ID NO: 15226 - DNA, 18 bp, Artificial Sequence
  Synthetic
ctgtttgaggtgctccag

SEQ ID NO: 15227 - DNA, 25 bp, Artificial Sequence
  Synthetic
gttaactaaaacacctttgaaaagc

SEQ ID NO: 15228 - DNA, 22 bp, Artificial Sequence
  Synthetic
aaagaatactttggtgtagcat

SEQ ID NO: 15229 - DNA, 24 bp, Artificial Sequence
  Synthetic
atggaaatagagcatattttctcc

SEQ ID NO: 15230 - DNA, 20 bp, Artificial Sequence
  Synthetic
tctctagctctaccacgtcg

SEQ ID NO: 15231 - DNA, 18 bp, Artificial Sequence
  Synthetic
cagatgtggtcggtgttg

SEQ ID NO: 15232 - DNA, 19 bp, Artificial Sequence
  Synthetic
aggccctattaatcagcct

SEQ ID NO: 15233 - DNA, 18 bp, Artificial Sequence
  Synthetic
gccagaccaggattttgc

SEQ ID NO: 15234 - DNA, 24 bp, Artificial Sequence
  Synthetic
aatacctgacaatatactagagga

SEQ ID NO: 15235 - DNA, 24 bp, Artificial Sequence
  Synthetic
tatggcagtagatgtttatgatga

SEQ ID NO: 15236 - DNA, 23 bp, Artificial Sequence
  Synthetic
gtagtggaaatcagtttagagtt

SEQ ID NO: 15237 - DNA, 20 bp, Artificial Sequence
  Synthetic
ccgcatatcctttaaagcag

SEQ ID NO: 15238 - DNA, 21 bp, Artificial Sequence
  Synthetic
ggggtctacatttttgtctac

SEQ ID NO: 15239 - DNA, 18 bp, Artificial Sequence
  Synthetic
ccgcggaaatccagcaat

SEQ ID NO: 15240 - DNA, 19 bp, Artificial Sequence
  Synthetic
aacatgtacccggcagtcc

SEQ ID NO: 15241 - DNA, 20 bp, Artificial Sequence
  Synthetic
tccactaaccatccttttgc

SEQ ID NO: 15242 - DNA, 20 bp, Artificial Sequence
  Synthetic
ggggggactttatgtgaccc

SEQ ID NO: 15243 - DNA, 16 bp, Artificial Sequence
  Synthetic
gtcgctgactccgcca

SEQ ID NO: 15244 - DNA, 16 bp, Artificial Sequence
  Synthetic
tccaaggactcgggcc

SEQ ID NO: 15245 - DNA, 18 bp, Artificial Sequence
  Synthetic
gccacttcctgggtcatg

SEQ ID NO: 15246 - DNA, 18 bp, Artificial Sequence
  Synthetic
caatccaacacgaggcaa

SEQ ID NO: 15247 - DNA, 16 bp, Artificial Sequence
  Synthetic
tatgcgccgaggcctt

SEQ ID NO: 15248 - DNA, 19 bp, Artificial Sequence
  Synthetic
cgagttacgctccttggag

SEQ ID NO: 15249 - DNA, 18 bp, Artificial Sequence
  Synthetic
aagctgtgtgacggtccc

SEQ ID NO: 15250 - DNA, 19 bp, Artificial Sequence
  Synthetic
cgatcgtaagccgcaatgt

SEQ ID NO: 15251 - DNA, 19 bp, Artificial Sequence
  Synthetic
cctgagaggaggcttgtgt

SEQ ID NO: 15252 - DNA, 16 bp, Artificial Sequence
  Synthetic
ctcgtttcggccccga

SEQ ID NO: 15253 - DNA, 20 bp, Artificial Sequence
  Synthetic
gagtccgacaggaggtctcc

SEQ ID NO: 15254 - DNA, 18 bp, Artificial Sequence
  Synthetic
tgtagttgagcggctcct

SEQ ID NO: 15255 - DNA, 17 bp, Artificial Sequence
  Synthetic
ttcgtcgcgtgacctgg

SEQ ID NO: 15256 - DNA, 19 bp, Artificial Sequence
  Synthetic
gggtgttccagtcatcggg

SEQ ID NO: 15257 - DNA, 20 bp, Artificial Sequence
  Synthetic
tttcagccagcatcttagca

SEQ ID NO: 15258 - DNA, 16 bp, Artificial Sequence
  Synthetic
acgcagttgctgacgc

SEQ ID NO: 15259 - DNA, 16 bp, Artificial Sequence
  Synthetic
gggcgtttgtcccacg

SEQ ID NO: 15260 - DNA, 18 bp, Artificial Sequence
  Synthetic
gcggggggaggatgaaac

SEQ ID NO: 15261 - DNA, 18 bp, Artificial Sequence
  Synthetic
cctttatgcgctttgccg

SEQ ID NO: 15262 - DNA, 20 bp, Artificial Sequence
  Synthetic
ttctctatcgtcaactgcgc

SEQ ID NO: 15263 - DNA, 18 bp, Artificial Sequence
  Synthetic
ccaacatctgcctcccgc

SEQ ID NO: 15264 - DNA, 17 bp, Artificial Sequence
  Synthetic
gagtcccgctgagcaga

SEQ ID NO: 15265 - DNA, 16 bp, Artificial Sequence
  Synthetic
ccgttgaggcccacgt

SEQ ID NO: 15266 - DNA, 18 bp, Artificial Sequence
  Synthetic
caaggccagagacaccct

SEQ ID NO: 15267 - DNA, 16 bp, Artificial Sequence
  Synthetic
acgtgtctgggaggcg

SEQ ID NO: 15268 - DNA, 19 bp, Artificial Sequence
  Synthetic
aaaagcctcggtctgctcc

SEQ ID NO: 15269 - DNA, 18 bp, Artificial Sequence
  Synthetic
gaactgggcctcgtggga

SEQ ID NO: 15270 - DNA, 17 bp, Artificial Sequence
  Synthetic
acgagagaacccgccac

SEQ ID NO: 15271 - DNA, 18 bp, Artificial Sequence
  Synthetic
gatctcggccgttgtctc

SEQ ID NO: 15272 - DNA, 18 bp, Artificial Sequence
  Synthetic
ggggggtggcatatctga

SEQ ID NO: 15273 - DNA, 16 bp, Artificial Sequence
  Synthetic
ctggctcgcctggagt

SEQ ID NO: 15274 - DNA, 16 bp, Artificial Sequence
  Synthetic
gtcatgtcgggggcct

SEQ ID NO: 15275 - DNA, 19 bp, Artificial Sequence
  Synthetic
attggtttcagcaatcgga

SEQ ID NO: 15276 - DNA, 18 bp, Artificial Sequence
  Synthetic
caggcagcgtcttcagga

SEQ ID NO: 15277 - DNA, 16 bp, Artificial Sequence
  Synthetic
cgggcttcaggggcat

SEQ ID NO: 15278 - DNA, 19 bp, Artificial Sequence
  Synthetic
tgtcgctgcagtactacga

SEQ ID NO: 15279 - DNA, 18 bp, Artificial Sequence
  Synthetic
ggaagaggacgaggacga

SEQ ID NO: 15280 - DNA, 18 bp, Artificial Sequence
  Synthetic
cggggtcgaggaggtagt

SEQ ID NO: 15281 - DNA, 20 bp, Artificial Sequence
  Synthetic
gaggttcagggacttgtcct

SEQ ID NO: 15282 - DNA, 17 bp, Artificial Sequence
  Synthetic
ccatagctgcccctggt

SEQ ID NO: 15283 - DNA, 18 bp, Artificial Sequence
  Synthetic
ccatgactgctgacccgc

SEQ ID NO: 15284 - DNA, 17 bp, Artificial Sequence
  Synthetic
catccggcaagcaccat

SEQ ID NO: 15285 - DNA, 20 bp, Artificial Sequence
  Synthetic
ttcgtgccaaaccaaaaagg

SEQ ID NO: 15286 - DNA, 18 bp, Artificial Sequence
  Synthetic
tcctctgaaggatgggcg

SEQ ID NO: 15287 - DNA, 19 bp, Artificial Sequence
  Synthetic
atcaacaggtgggggttgt

SEQ ID NO: 15288 - DNA, 19 bp, Artificial Sequence
  Synthetic
gtagcagaatagggcccct

SEQ ID NO: 15289 - DNA, 16 bp, Artificial Sequence
  Synthetic
tgcccatacctgcggg

SEQ ID NO: 15290 - DNA, 16 bp, Artificial Sequence
  Synthetic
tggccaggtggacgca

SEQ ID NO: 15291 - DNA, 18 bp, Artificial Sequence
  Synthetic
agaccctcgtgagacccg

SEQ ID NO: 15292 - DNA, 18 bp, Artificial Sequence
  Synthetic
tgtcggatctcggtccag

SEQ ID NO: 15293 - DNA, 17 bp, Artificial Sequence
  Synthetic
gtagcctgagccgcact

SEQ ID NO: 15294 - DNA, 20 bp, Artificial Sequence
  Synthetic
cctaacagggtcatcgtcct

SEQ ID NO: 15295 - DNA, 18 bp, Artificial Sequence
  Synthetic
agccggtcaacacgacat

SEQ ID NO: 15296 - DNA, 17 bp, Artificial Sequence
  Synthetic
caccagcccgttcacca

SEQ ID NO: 15297 - DNA, 18 bp, Artificial Sequence
  Synthetic
gcagaacgttgtcggtga

SEQ ID NO: 15298 - DNA, 18 bp, Artificial Sequence
  Synthetic
aagcggggtcttttggac

SEQ ID NO: 15299 - DNA, 20 bp, Artificial Sequence
  Synthetic
cgggacagattgtcttccac

SEQ ID NO: 15300 - DNA, 18 bp, Artificial Sequence
  Synthetic
cccccttttccgcatcag

SEQ ID NO: 15301 - DNA, 18 bp, Artificial Sequence
  Synthetic
attgccaaaacaacgtgt

SEQ ID NO: 15302 - DNA, 16 bp, Artificial Sequence
  Synthetic
ggcggtggacagcagt

SEQ ID NO: 15303 - DNA, 19 bp, Artificial Sequence
  Synthetic
caaaagaccctccccacct

SEQ ID NO: 15304 - DNA, 17 bp, Artificial Sequence
  Synthetic
taccacccccacccaca

SEQ ID NO: 15305 - DNA, 18 bp, Artificial Sequence
  Synthetic
cgggaggacaccaaccct

SEQ ID NO: 15306 - DNA, 18 bp, Artificial Sequence
  Synthetic
ttctggagtgcctttcgc

SEQ ID NO: 15307 - DNA, 19 bp, Artificial Sequence
  Synthetic
aggaaggcgctgtaggatt

SEQ ID NO: 15308 - DNA, 18 bp, Artificial Sequence
  Synthetic
tttctcgcccccttcact

SEQ ID NO: 15309 - DNA, 17 bp, Artificial Sequence
  Synthetic
ggtgatgcggaccttgg

SEQ ID NO: 15310 - DNA, 16 bp, Artificial Sequence
  Synthetic
ccttgccgtgccctct

SEQ ID NO: 15311 - DNA, 20 bp, Artificial Sequence
  Synthetic
ctggccatatcagggaagtc

SEQ ID NO: 15312 - DNA, 20 bp, Artificial Sequence
  Synthetic
cagggtctgggtaaacaggt

SEQ ID NO: 15313 - DNA, 16 bp, Artificial Sequence
  Synthetic
ccagcctgccggactt

SEQ ID NO: 15314 - DNA, 16 bp, Artificial Sequence
  Synthetic
gtcggcaaacaggggc

SEQ ID NO: 15315 - DNA, 20 bp, Artificial Sequence
  Synthetic
cacctccttgtcgtagagcg

SEQ ID NO: 15316 - DNA, 18 bp, Artificial Sequence
  Synthetic
cctgtgcagagccttgac

SEQ ID NO: 15317 - DNA, 17 bp, Artificial Sequence
  Synthetic
cacgtcacggggaactg

SEQ ID NO: 15318 - DNA, 16 bp, Artificial Sequence
  Synthetic
ctgagccgcgaccagt

SEQ ID NO: 15319 - DNA, 20 bp, Artificial Sequence
  Synthetic
gcaaaggcaggtctttctca

SEQ ID NO: 15320 - DNA, 16 bp, Artificial Sequence
  Synthetic
ggctgaccccggcaaa

SEQ ID NO: 15321 - DNA, 18 bp, Artificial Sequence
  Synthetic
gttttccgtttgctgcat

SEQ ID NO: 15322 - DNA, 20 bp, Artificial Sequence
  Synthetic
aaagacattgtcctgcagct

SEQ ID NO: 15323 - DNA, 22 bp, Artificial Sequence
  Synthetic
tgttaaactccagtaatcgaag

SEQ ID NO: 15324 - DNA, 22 bp, Artificial Sequence
  Synthetic
gtgtgctaaaaacagagatacc

SEQ ID NO: 15325 - DNA, 22 bp, Artificial Sequence
  Synthetic
tggctgatgtagatagtaatgc

SEQ ID NO: 15326 - DNA, 22 bp, Artificial Sequence
  Synthetic
tgtttagtattttatgggcctg

SEQ ID NO: 15327 - DNA, 25 bp, Artificial Sequence
  Synthetic
agaactgtatgaaaaagatagtgac

SEQ ID NO: 15328 - DNA, 19 bp, Artificial Sequence
  Synthetic
tatagcaacgaacgatgga

SEQ ID NO: 15329 - DNA, 20 bp, Artificial Sequence
  Synthetic
gtacatgtgggttcaagggt

SEQ ID NO: 15330 - DNA, 19 bp, Artificial Sequence
  Synthetic
atgatagtgtggaacagcg

SEQ ID NO: 15331 - DNA, 24 bp, Artificial Sequence
  Synthetic
gtttctagcactatatatacaggc

SEQ ID NO: 15332 - DNA, 18 bp, Artificial Sequence
  Synthetic
ggagcagatgttccagtg

SEQ ID NO: 15333 - DNA, 25 bp, Artificial Sequence
  Synthetic
atgctggtagttctagattacttac

SEQ ID NO: 15334 - DNA, 18 bp, Artificial Sequence
  Synthetic
cggacagcctttaggaat

SEQ ID NO: 15335 - DNA, 18 bp, Artificial Sequence
  Synthetic
cacaggttttggggcaat

SEQ ID NO: 15336 - DNA, 19 bp, Artificial Sequence
  Synthetic
tctttatgcatccacacct

SEQ ID NO: 15337 - DNA, 20 bp, Artificial Sequence
  Synthetic
catggatgctacattactgg

SEQ ID NO: 15338 - DNA, 20 bp, Artificial Sequence
  Synthetic
tgcgtgtcatgtatgtgtgt

SEQ ID NO: 15339 - DNA, 18 bp, Artificial Sequence
  Synthetic
tgcctggcagttatttgg

SEQ ID NO: 15340 - DNA, 25 bp, Artificial Sequence
  Synthetic
gtttctggtattgttagaaagatgg

SEQ ID NO: 15341 - DNA, 20 bp, Artificial Sequence
  Synthetic
gcctactgctgaaaatttgg

SEQ ID NO: 15342 - DNA, 18 bp, Artificial Sequence
  Synthetic
acgatgcttcacagggaa

SEQ ID NO: 15343 - DNA, 25 bp, Artificial Sequence
  Synthetic
actgtaggattatatgctttaatgc

SEQ ID NO: 15344 - DNA, 25 bp, Artificial Sequence
  Synthetic
caaagcaataatcaagctaaacatg

SEQ ID NO: 15345 - DNA, 18 bp, Artificial Sequence
  Synthetic
cgtatgcagcagaaacct

SEQ ID NO: 15346 - DNA, 18 bp, Artificial Sequence
  Synthetic
cgccacaccttccacatc

SEQ ID NO: 15347 - DNA, 23 bp, Artificial Sequence
  Synthetic
atttggcagtgttatttatttgg

SEQ ID NO: 15348 - DNA, 21 bp, Artificial Sequence
  Synthetic
atgtatttgaggacttgtcca

SEQ ID NO: 15349 - DNA, 20 bp, Artificial Sequence
  Synthetic
gtttggtacgttttagcaga

SEQ ID NO: 15350 - DNA, 22 bp, Artificial Sequence
  Synthetic
ctaactctataccgtacacacc

SEQ ID NO: 15351 - DNA, 19 bp, Artificial Sequence
  Synthetic
gccgatacagaaaatccca

SEQ ID NO: 15352 - DNA, 18 bp, Artificial Sequence
  Synthetic
acgagatgtcctccagaa

SEQ ID NO: 15353 - DNA, 21 bp, Artificial Sequence
  Synthetic
atcttcctattgtgcaaagtc

SEQ ID NO: 15354 - DNA, 20 bp, Artificial Sequence
  Synthetic
ctgtgcagtgaggaaaagga

SEQ ID NO: 15355 - DNA, 19 bp, Artificial Sequence
  Synthetic
cctacagaaccagcacagc

SEQ ID NO: 15356 - DNA, 20 bp, Artificial Sequence
  Synthetic
tagtgatgaggacgaggagg

SEQ ID NO: 15357 - DNA, 20 bp, Artificial Sequence
  Synthetic
acgtagactgtttgagctgc

SEQ ID NO: 15358 - DNA, 21 bp, Artificial Sequence
  Synthetic
aaaagtaataggaccacgtgt

SEQ ID NO: 15359 - DNA, 20 bp, Artificial Sequence
  Synthetic
ccaaaataagacatccagcg

SEQ ID NO: 15360 - DNA, 22 bp, Artificial Sequence
  Synthetic
gccaagcaaaatatgtaaagga

SEQ ID NO: 15361 - DNA, 22 bp, Artificial Sequence
  Synthetic
atacttttgtatgagcctgttg

SEQ ID NO: 15362 - DNA, 19 bp, Artificial Sequence
  Synthetic
tagaggaagacaggtggaa

SEQ ID NO: 15363 - DNA, 19 bp, Artificial Sequence
  Synthetic
acgttaagtttgatggcga

SEQ ID NO: 15364 - DNA, 15 bp, Artificial Sequence
  Synthetic
aacccgacgccacca

SEQ ID NO: 15365 - DNA, 23 bp, Artificial Sequence
  Synthetic
ttaaggtatagattgcacaaaca

SEQ ID NO: 15366 - DNA, 21 bp, Artificial Sequence
  Synthetic
agtgtggagacctttatttgc

SEQ ID NO: 15367 - DNA, 19 bp, Artificial Sequence
  Synthetic
cttgtgttgtagtgtgcaa

SEQ ID NO: 15368 - DNA, 18 bp, Artificial Sequence
  Synthetic
ttctttgggggtttgggc

SEQ ID NO: 15369 - DNA, 20 bp, Artificial Sequence
  Synthetic
ccaacaagtacatgtacagg

SEQ ID NO: 15370 - DNA, 19 bp, Artificial Sequence
  Synthetic
ttcccgactgttaactgtt

SEQ ID NO: 15371 - DNA, 20 bp, Artificial Sequence
  Synthetic
tgacactgaaaacaccaatt

SEQ ID NO: 15372 - DNA, 24 bp, Artificial Sequence
  Synthetic
gatgtgcctttagatattgtaacc

SEQ ID NO: 15373 - DNA, 20 bp, Artificial Sequence
  Synthetic
atcccagttgtttaacaagc

SEQ ID NO: 15374 - DNA, 19 bp, Artificial Sequence
  Synthetic
ccaaacgttcctaagcatg

SEQ ID NO: 15375 - DNA, 20 bp, Artificial Sequence
  Synthetic
gtggtgtcctgtatgtgacc

SEQ ID NO: 15376 - DNA, 19 bp, Artificial Sequence
  Synthetic
gccatgaatcactcccctg

SEQ ID NO: 15377 - DNA, 19 bp, Artificial Sequence
  Synthetic
aagaaacaccaaccgtcgc

SEQ ID NO: 15378 - DNA, 15 bp, Artificial Sequence
  Synthetic
tcgcgcaacgtgggt

SEQ ID NO: 15379 - DNA, 17 bp, Artificial Sequence
  Synthetic
gctgctgtcctccacgt

SEQ ID NO: 15380 - DNA, 20 bp, Artificial Sequence
  Synthetic
cacggctaccatgatcttgg

SEQ ID NO: 15381 - DNA, 18 bp, Artificial Sequence
  Synthetic
ccttgcacaccggcttta

SEQ ID NO: 15382 - DNA, 18 bp, Artificial Sequence
  Synthetic
gtcatggttcggctgcac

SEQ ID NO: 15383 - DNA, 18 bp, Artificial Sequence
  Synthetic
ttcactcgtggggatcgt

SEQ ID NO: 15384 - DNA, 18 bp, Artificial Sequence
  Synthetic
cagctagctgcaatggct

SEQ ID NO: 15385 - DNA, 19 bp, Artificial Sequence
  Synthetic
ccgtcgccatattctaccc

SEQ ID NO: 15386 - DNA, 19 bp, Artificial Sequence
  Synthetic
agacagctgcttgtgggga

SEQ ID NO: 15387 - DNA, 18 bp, Artificial Sequence
  Synthetic
tctcgggggttttgtgga

SEQ ID NO: 15388 - DNA, 20 bp, Artificial Sequence
  Synthetic
tttcatccccgttgagacac

SEQ ID NO: 15389 - DNA, 20 bp, Artificial Sequence
  Synthetic
atatggcaaattcctcgccg

SEQ ID NO: 15390 - DNA, 18 bp, Artificial Sequence
  Synthetic
tcggggtatgggcttgaa

SEQ ID NO: 15391 - DNA, 20 bp, Artificial Sequence
  Synthetic
gtgtagtgctctgtgagtgc

SEQ ID NO: 15392 - DNA, 16 bp, Artificial Sequence
  Synthetic
acactcgtgggcccca

SEQ ID NO: 15393 - DNA, 18 bp, Artificial Sequence
  Synthetic
gccgagatgctgaagtcc

SEQ ID NO: 15394 - DNA, 20 bp, Artificial Sequence
  Synthetic
aggtaaggtgctagtggaca

SEQ ID NO: 15395 - DNA, 18 bp, Artificial Sequence
  Synthetic
catgagaatcacggggcc

SEQ ID NO: 15396 - DNA, 17 bp, Artificial Sequence
  Synthetic
cagcttccttgcgaccc

SEQ ID NO: 15397 - DNA, 20 bp, Artificial Sequence
  Synthetic
cgaccttgagccttcgatac

SEQ ID NO: 15398 - DNA, 20 bp, Artificial Sequence
  Synthetic
cctgatgagttggccctttc

SEQ ID NO: 15399 - DNA, 20 bp, Artificial Sequence
  Synthetic
tgataggatgcaagtgctcg

SEQ ID NO: 15400 - DNA, 18 bp, Artificial Sequence
  Synthetic
tttaccctgacctcggcg

SEQ ID NO: 15401 - DNA, 20 bp, Artificial Sequence
  Synthetic
ggtgctcaccactagcatgg

SEQ ID NO: 15402 - DNA, 20 bp, Artificial Sequence
  Synthetic
tcctcaaatgtgtctgtggc

SEQ ID NO: 15403 - DNA, 20 bp, Artificial Sequence
  Synthetic
ctctgcacacatacactccc

SEQ ID NO: 15404 - DNA, 18 bp, Artificial Sequence
  Synthetic
gttgagggcagccagttg

SEQ ID NO: 15405 - DNA, 19 bp, Artificial Sequence
  Synthetic
gcggtaatgaggccgaagt

SEQ ID NO: 15406 - DNA, 20 bp, Artificial Sequence
  Synthetic
tcttcgtcaacggtcaagtc

SEQ ID NO: 15407 - DNA, 20 bp, Artificial Sequence
  Synthetic
agaggatgcggttttgttcg

SEQ ID NO: 15408 - DNA, 20 bp, Artificial Sequence
  Synthetic
cgaaaagaaaatcgccctcc

SEQ ID NO: 15409 - DNA, 20 bp, Artificial Sequence
  Synthetic
tggacggcttggattttcag

SEQ ID NO: 15410 - DNA, 20 bp, Artificial Sequence
  Synthetic
atgtcgcccaagttttcaga

SEQ ID NO: 15411 - DNA, 16 bp, Artificial Sequence
  Synthetic
acgaagccgccctggt

SEQ ID NO: 15412 - DNA, 18 bp, Artificial Sequence
  Synthetic
ggcttcgatgcccttgtt

SEQ ID NO: 15413 - DNA, 16 bp, Artificial Sequence
  Synthetic
cggctgccgtcttggt

SEQ ID NO: 15414 - DNA, 19 bp, Artificial Sequence
  Synthetic
ccgaacaggcggtatttgc

SEQ ID NO: 15415 - DNA, 20 bp, Artificial Sequence
  Synthetic
ttgttgcgatgtgatgacgc

SEQ ID NO: 15416 - DNA, 20 bp, Artificial Sequence
  Synthetic
cgggttctgccttttcaaac

SEQ ID NO: 15417 - DNA, 18 bp, Artificial Sequence
  Synthetic
aggcggacaccttgttgc

SEQ ID NO: 15418 - DNA, 20 bp, Artificial Sequence
  Synthetic
acaatttcagccacaactgc

SEQ ID NO: 15419 - DNA, 16 bp, Artificial Sequence
  Synthetic
cacaccagcgcaccga

SEQ ID NO: 15420 - DNA, 20 bp, Artificial Sequence
  Synthetic
gcaagataaaccacgtcgcc

SEQ ID NO: 15421 - DNA, 19 bp, Artificial Sequence
  Synthetic
ttccaatgcctgcgtttca

SEQ ID NO: 15422 - DNA, 17 bp, Artificial Sequence
  Synthetic
aactcttgccgcgttcc

SEQ ID NO: 15423 - DNA, 16 bp, Artificial Sequence
  Synthetic
tcagcggtgcaggcga

SEQ ID NO: 15424 - DNA, 17 bp, Artificial Sequence
  Synthetic
gtaacgcgcaaaccccg

SEQ ID NO: 15425 - DNA, 20 bp, Artificial Sequence
  Synthetic
aggttttgtggacataggcg

SEQ ID NO: 15426 - DNA, 17 bp, Artificial Sequence
  Synthetic
ttttgggcggcaggacg

SEQ ID NO: 15427 - DNA, 20 bp, Artificial Sequence
  Synthetic
gttcatgttcgtgccttccg

SEQ ID NO: 15428 - DNA, 18 bp, Artificial Sequence
  Synthetic
gttttccagtgcgaacgc

SEQ ID NO: 15429 - DNA, 15 bp, Artificial Sequence
  Synthetic
tttcttgggcgcggc

SEQ ID NO: 15430 - DNA, 17 bp, Artificial Sequence
  Synthetic
ggcatcggacggcaaag

SEQ ID NO: 15431 - DNA, 16 bp, Artificial Sequence
  Synthetic
cgaagctgcgttgggc

SEQ ID NO: 15432 - DNA, 17 bp, Artificial Sequence
  Synthetic
cataccgggttcgccga

SEQ ID NO: 15433 - DNA, 16 bp, Artificial Sequence
  Synthetic
gcacgcctgccgctat

SEQ ID NO: 15434 - DNA, 15 bp, Artificial Sequence
  Synthetic
ttcggcggcggcaat

SEQ ID NO: 15435 - DNA, 19 bp, Artificial Sequence
  Synthetic
cgccttgttctttcaggga

SEQ ID NO: 15436 - DNA, 18 bp, Artificial Sequence
  Synthetic
gggtttgaccgccgtaat

SEQ ID NO: 15437 - DNA, 18 bp, Artificial Sequence
  Synthetic
ccgcacctgtcagaatcg

SEQ ID NO: 15438 - DNA, 19 bp, Artificial Sequence
  Synthetic
atggacagatggatgtgcg

SEQ ID NO: 15439 - DNA, 20 bp, Artificial Sequence
  Synthetic
agaaaatcaccgccatcagc

SEQ ID NO: 15440 - DNA, 17 bp, Artificial Sequence
  Synthetic
cgccttaagccttgccg

SEQ ID NO: 15441 - DNA, 18 bp, Artificial Sequence
  Synthetic
gaacacctgccccggtat

SEQ ID NO: 15442 - DNA, 17 bp, Artificial Sequence
  Synthetic
attgcgccgcttccaac

SEQ ID NO: 15443 - DNA, 18 bp, Artificial Sequence
  Synthetic
tgctgcaaggctacgact

SEQ ID NO: 15444 - DNA, 20 bp, Artificial Sequence
  Synthetic
tcgttttcgaaccccaaccc

SEQ ID NO: 15445 - DNA, 19 bp, Artificial Sequence
  Synthetic
aatcgaacacagctacgcc

SEQ ID NO: 15446 - DNA, 19 bp, Artificial Sequence
  Synthetic
aaaaagccgaagccgaact

SEQ ID NO: 15447 - DNA, 18 bp, Artificial Sequence
  Synthetic
tgcctgcctcaacatcgg

SEQ ID NO: 15448 - DNA, 16 bp, Artificial Sequence
  Synthetic
aggcagtcggcgcagt

SEQ ID NO: 15449 - DNA, 18 bp, Artificial Sequence
  Synthetic
gcgttggcggctttttgg

SEQ ID NO: 15450 - DNA, 20 bp, Artificial Sequence
  Synthetic
cgaacttcaccaaacccacg

SEQ ID NO: 15451 - DNA, 16 bp, Artificial Sequence
  Synthetic
ccttttgggcgagccg

SEQ ID NO: 15452 - DNA, 20 bp, Artificial Sequence
  Synthetic
taatgttggggaacggcatt

SEQ ID NO: 15453 - DNA, 16 bp, Artificial Sequence
  Synthetic
tcgcggattgcctgct

SEQ ID NO: 15454 - DNA, 15 bp, Artificial Sequence
  Synthetic
tcagcgtcgggtgca

SEQ ID NO: 15455 - DNA, 20 bp, Artificial Sequence
  Synthetic
aaacggcatcggcttcttct

SEQ ID NO: 15456 - DNA, 20 bp, Artificial Sequence
  Synthetic
tgtgcatataaagcggcagg

SEQ ID NO: 15457 - DNA, 18 bp, Artificial Sequence
  Synthetic
cgatcggacgcgttttgc

SEQ ID NO: 15458 - DNA, 17 bp, Artificial Sequence
  Synthetic
caaggtttgccagcgcg

SEQ ID NO: 15459 - DNA, 19 bp, Artificial Sequence
  Synthetic
cggcatagtattcgcggac

SEQ ID NO: 15460 - DNA, 16 bp, Artificial Sequence
  Synthetic
gacgttgagccgggga

SEQ ID NO: 15461 - DNA, 20 bp, Artificial Sequence
  Synthetic
tcaatctgttcgggtgtcag

SEQ ID NO: 15462 - DNA, 17 bp, Artificial Sequence
  Synthetic
ccttgcgaggctttgcg

SEQ ID NO: 15463 - DNA, 20 bp, Artificial Sequence
  Synthetic
ccagttgttcggacaaacgc

SEQ ID NO: 15464 - DNA, 20 bp, Artificial Sequence
  Synthetic
tgcttttgtcttcttcgccc

SEQ ID NO: 15465 - DNA, 19 bp, Artificial Sequence
  Synthetic
ctacgagcttttgggcgag

SEQ ID NO: 15466 - DNA, 16 bp, Artificial Sequence
  Synthetic
ctgcccgcctgcatga

SEQ ID NO: 15467 - DNA, 17 bp, Artificial Sequence
  Synthetic
ggcgcgcaccataacca

SEQ ID NO: 15468 - DNA, 16 bp, Artificial Sequence
  Synthetic
cgttttcaggcggccc

SEQ ID NO: 15469 - DNA, 18 bp, Artificial Sequence
  Synthetic
ctggagctgttcgtcggt

SEQ ID NO: 15470 - DNA, 19 bp, Artificial Sequence
  Synthetic
cgaaatccgtgtcgatgca

SEQ ID NO: 15471 - DNA, 16 bp, Artificial Sequence
  Synthetic
cgctgcacgacacgct

SEQ ID NO: 15472 - DNA, 18 bp, Artificial Sequence
  Synthetic
aaaggccgaagtcatggc

SEQ ID NO: 15473 - DNA, 19 bp, Artificial Sequence
  Synthetic
gccaagctcgaagaagact

SEQ ID NO: 15474 - DNA, 16 bp, Artificial Sequence
  Synthetic
cgcctgacggatgctg

SEQ ID NO: 15475 - DNA, 16 bp, Artificial Sequence
  Synthetic
gcgtatcatcggcgcg

SEQ ID NO: 15476 - DNA, 16 bp, Artificial Sequence
  Synthetic
gcgtgggtcatgccgt

SEQ ID NO: 15477 - DNA, 17 bp, Artificial Sequence
  Synthetic
aaacctgcctcgtcggg

SEQ ID NO: 15478 - DNA, 18 bp, Artificial Sequence
  Synthetic
tctcggcaaagaacgtac

SEQ ID NO: 15479 - DNA, 17 bp, Artificial Sequence
  Synthetic
tttcggcggcacagaag

SEQ ID NO: 15480 - DNA, 20 bp, Artificial Sequence
  Synthetic
tttggaactgtggccaaaca

SEQ ID NO: 15481 - DNA, 20 bp, Artificial Sequence
  Synthetic
tgtttgagccagatttcgga

SEQ ID NO: 15482 - DNA, 19 bp, Artificial Sequence
  Synthetic
agacccaatgcgaggtagc

SEQ ID NO: 15483 - DNA, 20 bp, Artificial Sequence
  Synthetic
atacacgggataatcagcgc

SEQ ID NO: 15484 - DNA, 19 bp, Artificial Sequence
  Synthetic
caagcgtggcgataatcga

SEQ ID NO: 15485 - DNA, 16 bp, Artificial Sequence
  Synthetic
aatcgccgtctgccca

SEQ ID NO: 15486 - DNA, 20 bp, Artificial Sequence
  Synthetic
ttcatggcaacgtcaatcgg

SEQ ID NO: 15487 - DNA, 19 bp, Artificial Sequence
  Synthetic
tgtattccatcacgccgtc

SEQ ID NO: 15488 - DNA, 20 bp, Artificial Sequence
  Synthetic
acctgtcgttttattggggc

SEQ ID NO: 15489 - DNA, 17 bp, Artificial Sequence
  Synthetic
cgtttggcgcaggttgg

SEQ ID NO: 15490 - DNA, 16 bp, Artificial Sequence
  Synthetic
gggcgcaggtcatcga

SEQ ID NO: 15491 - DNA, 16 bp, Artificial Sequence
  Synthetic
ccgcaaaaagccgccg

SEQ ID NO: 15492 - DNA, 18 bp, Artificial Sequence
  Synthetic
aaaaaccgaccgttgggc

SEQ ID NO: 15493 - DNA, 17 bp, Artificial Sequence
  Synthetic
aatccggcatcgacgct

SEQ ID NO: 15494 - DNA, 16 bp, Artificial Sequence
  Synthetic
gccgagggcgaatgtg

SEQ ID NO: 15495 - DNA, 16 bp, Artificial Sequence
  Synthetic
ctgctgcgcgggttca

SEQ ID NO: 15496 - DNA, 20 bp, Artificial Sequence
  Synthetic
cctatcaggctcatacggcg

SEQ ID NO: 15497 - DNA, 20 bp, Artificial Sequence
  Synthetic
agttgctgttcaaaccacgg

SEQ ID NO: 15498 - DNA, 17 bp, Artificial Sequence
  Synthetic
gcatcccttgccgtcca

SEQ ID NO: 15499 - DNA, 19 bp, Artificial Sequence
  Synthetic
cggcactctgcatttttgc

SEQ ID NO: 15500 - DNA, 19 bp, Artificial Sequence
  Synthetic
ggatgacggtcagtgtgtg

SEQ ID NO: 15501 - DNA, 18 bp, Artificial Sequence
  Synthetic
ttggacggcgttatgggt

SEQ ID NO: 15502 - DNA, 16 bp, Artificial Sequence
  Synthetic
gcgggcaagctgacgt

SEQ ID NO: 15503 - DNA, 16 bp, Artificial Sequence
  Synthetic
tcgggacaggggtgga

SEQ ID NO: 15504 - DNA, 19 bp, Artificial Sequence
  Synthetic
ggattgcgctgaacagcct

SEQ ID NO: 15505 - DNA, 18 bp, Artificial Sequence
  Synthetic
ctttgacggatgcctggc

SEQ ID NO: 15506 - DNA, 20 bp, Artificial Sequence
  Synthetic
cgggggaaaaggagttaacc

SEQ ID NO: 15507 - DNA, 17 bp, Artificial Sequence
  Synthetic
tgtacgacaggtgcggc

SEQ ID NO: 15508 - DNA, 16 bp, Artificial Sequence
  Synthetic
ctgcaaccggggatgc

SEQ ID NO: 15509 - DNA, 20 bp, Artificial Sequence
  Synthetic
cgggttttttgacggttcag

SEQ ID NO: 15510 - DNA, 18 bp, Artificial Sequence
  Synthetic
tcggcaatggcatgcatg

SEQ ID NO: 15511 - DNA, 17 bp, Artificial Sequence
  Synthetic
gcgcaatgcctgctcga

SEQ ID NO: 15512 - DNA, 18 bp, Artificial Sequence
  Synthetic
gacgttactttgcgccaa

SEQ ID NO: 15513 - DNA, 18 bp, Artificial Sequence
  Synthetic
ttgaccgatggcacgacc

SEQ ID NO: 15514 - DNA, 16 bp, Artificial Sequence
  Synthetic
cgggtcggcgtggatt

SEQ ID NO: 15515 - DNA, 18 bp, Artificial Sequence
  Synthetic
atttcgaccgcccattcc

SEQ ID NO: 15516 - DNA, 19 bp, Artificial Sequence
  Synthetic
tgatgctgactttgtccgc

SEQ ID NO: 15517 - DNA, 15 bp, Artificial Sequence
  Synthetic
tgctgcgcttgggca

SEQ ID NO: 15518 - DNA, 16 bp, Artificial Sequence
  Synthetic
ccgcgagacaggtcgt

SEQ ID NO: 15519 - DNA, 19 bp, Artificial Sequence
  Synthetic
aaaccttccaatacgcccg

SEQ ID NO: 15520 - DNA, 20 bp, Artificial Sequence
  Synthetic
gatgccttcgatgacgaggt

SEQ ID NO: 15521 - DNA, 18 bp, Artificial Sequence
  Synthetic
ggatagcgtccggcaagt

SEQ ID NO: 15522 - DNA, 20 bp, Artificial Sequence
  Synthetic
cgtccgatgtgtattcccaa

SEQ ID NO: 15523 - DNA, 17 bp, Artificial Sequence
  Synthetic
gtaaacgacgacgcgcg

SEQ ID NO: 15524 - DNA, 19 bp, Artificial Sequence
  Synthetic
cgctgaatcggataggtcg

SEQ ID NO: 15525 - DNA, 18 bp, Artificial Sequence
  Synthetic
ggggtgaggatgtagcgt

SEQ ID NO: 15526 - DNA, 16 bp, Artificial Sequence
  Synthetic
gcctgttggacgggga

SEQ ID NO: 15527 - DNA, 17 bp, Artificial Sequence
  Synthetic
cggattcaaacgcgcca

SEQ ID NO: 15528 - DNA, 17 bp, Artificial Sequence
  Synthetic
tggaaaacccgcccagc

SEQ ID NO: 15529 - DNA, 20 bp, Artificial Sequence
  Synthetic
tcggctttgaataactgcgt

SEQ ID NO: 15530 - DNA, 18 bp, Artificial Sequence
  Synthetic
cggaaagggtaacggtcg

SEQ ID NO: 15531 - DNA, 16 bp, Artificial Sequence
  Synthetic
ccgtcagccagagggt

SEQ ID NO: 15532 - DNA, 20 bp, Artificial Sequence
  Synthetic
caaggcattggctttttcca

SEQ ID NO: 15533 - DNA, 18 bp, Artificial Sequence
  Synthetic
tcgcgttcgatttcgctg

SEQ ID NO: 15534 - DNA, 19 bp, Artificial Sequence
  Synthetic
ctcgggatggtttcgttcc

SEQ ID NO: 15535 - DNA, 19 bp, Artificial Sequence
  Synthetic
ggtcggcgaaaccaaatgg

SEQ ID NO: 15536 - DNA, 16 bp, Artificial Sequence
  Synthetic
cgttgcggctgactgc

SEQ ID NO: 15537 - DNA, 19 bp, Artificial Sequence
  Synthetic
cgaacggtattgcgcttcg

SEQ ID NO: 15538 - DNA, 20 bp, Artificial Sequence
  Synthetic
tgcaaagtgtgtatcaggct

SEQ ID NO: 15539 - DNA, 16 bp, Artificial Sequence
  Synthetic
ggtttgcgccccgatt

SEQ ID NO: 15540 - DNA, 20 bp, Artificial Sequence
  Synthetic
atgtattgaatgccgcgagc

SEQ ID NO: 15541 - DNA, 19 bp, Artificial Sequence
  Synthetic
cgctatgccgaaatgagcg

SEQ ID NO: 15542 - DNA, 20 bp, Artificial Sequence
  Synthetic
tgaattccgctttatcggcg

SEQ ID NO: 15543 - DNA, 18 bp, Artificial Sequence
  Synthetic
ccaacctcaaaccgccag

SEQ ID NO: 15544 - DNA, 17 bp, Artificial Sequence
  Synthetic
aacccgttttggcgcaa

SEQ ID NO: 15545 - DNA, 17 bp, Artificial Sequence
  Synthetic
tttctgcctgcccgtcc

SEQ ID NO: 15546 - DNA, 16 bp, Artificial Sequence
  Synthetic
gggcgggcgagttgaa

SEQ ID NO: 15547 - DNA, 17 bp, Artificial Sequence
  Synthetic
ttcaaaccgaccaccgc

SEQ ID NO: 15548 - DNA, 18 bp, Artificial Sequence
  Synthetic
tggcggggtcttttttgc

SEQ ID NO: 15549 - DNA, 19 bp, Artificial Sequence
  Synthetic
caaatcgtaggcaagcgca

SEQ ID NO: 15550 - DNA, 16 bp, Artificial Sequence
  Synthetic
cggcggcagaaggctt

SEQ ID NO: 15551 - DNA, 19 bp, Artificial Sequence
  Synthetic
agcgtccgggattttcaac

SEQ ID NO: 15552 - DNA, 17 bp, Artificial Sequence
  Synthetic
ccgcgccgattacttcg

SEQ ID NO: 15553 - DNA, 20 bp, Artificial Sequence
  Synthetic
ttggacgacctgataacaag

SEQ ID NO: 15554 - DNA, 23 bp, Artificial Sequence
  Synthetic
attggccgtaataaaaagtatgg

SEQ ID NO: 15555 - DNA, 16 bp, Artificial Sequence
  Synthetic
ggcaactggacgggga

SEQ ID NO: 15556 - DNA, 19 bp, Artificial Sequence
  Synthetic
tacatcgaatgctcgctcg

SEQ ID NO: 15557 - DNA, 16 bp, Artificial Sequence
  Synthetic
ggcggctttgccccaa

SEQ ID NO: 15558 - DNA, 16 bp, Artificial Sequence
  Synthetic
cgcaaaccgccgttgc

SEQ ID NO: 15559 - DNA, 16 bp, Artificial Sequence
  Synthetic
attcggcttgccgctg

SEQ ID NO: 15560 - DNA, 16 bp, Artificial Sequence
  Synthetic
tcggcagatacgccgt

SEQ ID NO: 15561 - DNA, 20 bp, Artificial Sequence
  Synthetic
ccttcctgaatcaggtcggc

SEQ ID NO: 15562 - DNA, 16 bp, Artificial Sequence
  Synthetic
cggtttgttgggcggt

SEQ ID NO: 15563 - DNA, 16 bp, Artificial Sequence
  Synthetic
aaggtaggcgggcagc

SEQ ID NO: 15564 - DNA, 16 bp, Artificial Sequence
  Synthetic
ggcgcatcagcagcat

SEQ ID NO: 15565 - DNA, 20 bp, Artificial Sequence
  Synthetic
aacgacgattcctgtgatgg

SEQ ID NO: 15566 - DNA, 16 bp, Artificial Sequence
  Synthetic
ccagccgttgcgtgca

SEQ ID NO: 15567 - DNA, 19 bp, Artificial Sequence
  Synthetic
gcaaaaatggttatcggcc

SEQ ID NO: 15568 - DNA, 21 bp, Artificial Sequence
  Synthetic
aaaagaagatttggctgaagt

SEQ ID NO: 15569 - DNA, 21 bp, Artificial Sequence
  Synthetic
aaaaagcggtaataaagggaa

SEQ ID NO: 15570 - DNA, 19 bp, Artificial Sequence
  Synthetic
ccgaacaacgccttttcct

SEQ ID NO: 15571 - DNA, 20 bp, Artificial Sequence
  Synthetic
acgcagttgttcggaaaacg

SEQ ID NO: 15572 - DNA, 20 bp, Artificial Sequence
  Synthetic
aggttgatgctgtcgaactg

SEQ ID NO: 15573 - DNA, 18 bp, Artificial Sequence
  Synthetic
catggcggcgacaaatgc

SEQ ID NO: 15574 - DNA, 20 bp, Artificial Sequence
  Synthetic
aaacagtttctcgaacggta

SEQ ID NO: 15575 - DNA, 16 bp, Artificial Sequence
  Synthetic
cgattgcggcatgggc

SEQ ID NO: 15576 - DNA, 18 bp, Artificial Sequence
  Synthetic
gctatctctctacgccac

SEQ ID NO: 15577 - DNA, 19 bp, Artificial Sequence
  Synthetic
tttctttttcggcgagcgt

SEQ ID NO: 15578 - DNA, 20 bp, Artificial Sequence
  Synthetic
ttcaaacccttgcccaaacc

SEQ ID NO: 15579 - DNA, 16 bp, Artificial Sequence
  Synthetic
ccgctccttcgcatgg

SEQ ID NO: 15580 - DNA, 23 bp, Artificial Sequence
  Synthetic
ttaaatcccaaaacagaaatgac

SEQ ID NO: 15581 - DNA, 16 bp, Artificial Sequence
  Synthetic
ggcaacgacagcgagg

SEQ ID NO: 15582 - DNA, 16 bp, Artificial Sequence
  Synthetic
ggtacgcgcatgacgg

SEQ ID NO: 15583 - DNA, 18 bp, Artificial Sequence
  Synthetic
cttctgctggcggaatcg

SEQ ID NO: 15584 - DNA, 18 bp, Artificial Sequence
  Synthetic
gatgtatctcggccggct

SEQ ID NO: 15585 - DNA, 16 bp, Artificial Sequence
  Synthetic
ggctacggacacggca

SEQ ID NO: 15586 - DNA, 25 bp, Artificial Sequence
  Synthetic
tcggattaatttgttcaatatcacc

SEQ ID NO: 15587 - DNA, 20 bp, Artificial Sequence
  Synthetic
cttcaggaaagctttgccgc

SEQ ID NO: 15588 - DNA, 20 bp, Artificial Sequence
  Synthetic
ccaatccgtgcaaaaacagg

SEQ ID NO: 15589 - DNA, 16 bp, Artificial Sequence
  Synthetic
gcattgtccgccacgc

SEQ ID NO: 15590 - DNA, 17 bp, Artificial Sequence
  Synthetic
tcggggatgatggcgac

SEQ ID NO: 15591 - DNA, 19 bp, Artificial Sequence
  Synthetic
attgtggctgccggtaatc

SEQ ID NO: 15592 - DNA, 16 bp, Artificial Sequence
  Synthetic
gttaggcggcgtggca

SEQ ID NO: 15593 - DNA, 16 bp, Artificial Sequence
  Synthetic
gccacgccgaagacga

SEQ ID NO: 15594 - DNA, 20 bp, Artificial Sequence
  Synthetic
gcttcccgattaccctgaaa

SEQ ID NO: 15595 - DNA, 16 bp, Artificial Sequence
  Synthetic
atgtcggtggcacggc

SEQ ID NO: 15596 - DNA, 18 bp, Artificial Sequence
  Synthetic
cgttcggcgcaataaagc

SEQ ID NO: 15597 - DNA, 18 bp, Artificial Sequence
  Synthetic
tcgaggtgtatgggcagg

SEQ ID NO: 15598 - DNA, 20 bp, Artificial Sequence
  Synthetic
ctttcagacggcattggtcg

SEQ ID NO: 15599 - DNA, 19 bp, Artificial Sequence
  Synthetic
ccgcccagccataaaacag

SEQ ID NO: 15600 - DNA, 18 bp, Artificial Sequence
  Synthetic
ttgggcggatatttcggc

SEQ ID NO: 15601 - DNA, 19 bp, Artificial Sequence
  Synthetic
attttgcgcctgattccga

SEQ ID NO: 15602 - DNA, 17 bp, Artificial Sequence
  Synthetic
gccttaccacatcgcgc

SEQ ID NO: 15603 - DNA, 19 bp, Artificial Sequence
  Synthetic
cgtcagcgtaaccatgtcg

SEQ ID NO: 15604 - DNA, 17 bp, Artificial Sequence
  Synthetic
ttgccggcaacaacgac

SEQ ID NO: 15605 - DNA, 20 bp, Artificial Sequence
  Synthetic
cgcatccccttcctttatgc

SEQ ID NO: 15606 - DNA, 18 bp, Artificial Sequence
  Synthetic
cgctcgttgatgtagcgg

SEQ ID NO: 15607 - DNA, 17 bp, Artificial Sequence
  Synthetic
gccaagcctttgcctgc

SEQ ID NO: 15608 - DNA, 20 bp, Artificial Sequence
  Synthetic
acaattacccgcaaacacgt

SEQ ID NO: 15609 - DNA, 18 bp, Artificial Sequence
  Synthetic
ccacaacaaccgcatcct

SEQ ID NO: 15610 - DNA, 20 bp, Artificial Sequence
  Synthetic
tatcgcgacgacttccatca

SEQ ID NO: 15611 - DNA, 16 bp, Artificial Sequence
  Synthetic
cgttggaacaggcgca

SEQ ID NO: 15612 - DNA, 20 bp, Artificial Sequence
  Synthetic
ggcaaatgtggcgacatagc

SEQ ID NO: 15613 - DNA, 19 bp, Artificial Sequence
  Synthetic
aactcaaacaggttgcggg

SEQ ID NO: 15614 - DNA, 18 bp, Artificial Sequence
  Synthetic
ggtcaaactcgaaggcgg

SEQ ID NO: 15615 - DNA, 16 bp, Artificial Sequence
  Synthetic
cagtgggcgaacgggt

SEQ ID NO: 15616 - DNA, 17 bp, Artificial Sequence
  Synthetic
ccgcagggattacgcca

SEQ ID NO: 15617 - DNA, 19 bp, Artificial Sequence
  Synthetic
ggcaggattttatgtgctg

SEQ ID NO: 15618 - DNA, 18 bp, Artificial Sequence
  Synthetic
tgtgatgaatgtcgcgca

SEQ ID NO: 15619 - DNA, 17 bp, Artificial Sequence
  Synthetic
cgcgaacatcatgcccg

SEQ ID NO: 15620 - DNA, 20 bp, Artificial Sequence
  Synthetic
cgatgtagtaggcgtgttcc

SEQ ID NO: 15621 - DNA, 18 bp, Artificial Sequence
  Synthetic
gggtaagaaggaacaggg

SEQ ID NO: 15622 - DNA, 18 bp, Artificial Sequence
  Synthetic
ttccgatacctttgcgcc

SEQ ID NO: 15623 - DNA, 19 bp, Artificial Sequence
  Synthetic
caatcggggtctgacaggt

SEQ ID NO: 15624 - DNA, 19 bp, Artificial Sequence
  Synthetic
ataagcggtttcgggatgg

SEQ ID NO: 15625 - DNA, 19 bp, Artificial Sequence
  Synthetic
gatggtacagaccgtgcgc

SEQ ID NO: 15626 - DNA, 16 bp, Artificial Sequence
  Synthetic
cggttgccaagcgtcc

SEQ ID NO: 15627 - DNA, 18 bp, Artificial Sequence
  Synthetic
ggacggtcgcagaaaagc

SEQ ID NO: 15628 - DNA, 16 bp, Artificial Sequence
  Synthetic
gcctgtggacgcaacc

SEQ ID NO: 15629 - DNA, 16 bp, Artificial Sequence
  Synthetic
ggcgcggttgccgtat

SEQ ID NO: 15630 - DNA, 16 bp, Artificial Sequence
  Synthetic
ccgcaacaagaggccg

SEQ ID NO: 15631 - DNA, 17 bp, Artificial Sequence
  Synthetic
gtccttgaccgcgaacc

SEQ ID NO: 15632 - DNA, 21 bp, Artificial Sequence
  Synthetic
aaaacgctaatcataagaggg

SEQ ID NO: 15633 - DNA, 17 bp, Artificial Sequence
  Synthetic
caggcatcgggagggat

SEQ ID NO: 15634 - DNA, 16 bp, Artificial Sequence
  Synthetic
cgcggcaggggttgtt

SEQ ID NO: 15635 - DNA, 19 bp, Artificial Sequence
  Synthetic
ccgcctgaaagaatcccat

SEQ ID NO: 15636 - DNA, 18 bp, Artificial Sequence
  Synthetic
cgagatgcacggctcaaa

SEQ ID NO: 15637 - DNA, 19 bp, Artificial Sequence
  Synthetic
gttccgcccgaaaatctgc

SEQ ID NO: 15638 - DNA, 19 bp, Artificial Sequence
  Synthetic
gcaggacaatccgaacctg

SEQ ID NO: 15639 - DNA, 20 bp, Artificial Sequence
  Synthetic
gacgatttcttcctcagcgt

SEQ ID NO: 15640 - DNA, 20 bp, Artificial Sequence
  Synthetic
tcgatacgaacgtccgttac

SEQ ID NO: 15641 - DNA, 20 bp, Artificial Sequence
  Synthetic
tcggcaacatgaacgaagtg

SEQ ID NO: 15642 - DNA, 18 bp, Artificial Sequence
  Synthetic
cgcccgattacaggcttg

SEQ ID NO: 15643 - DNA, 20 bp, Artificial Sequence
  Synthetic
tgacgtgaaatccgacatcg

SEQ ID NO: 15644 - DNA, 18 bp, Artificial Sequence
  Synthetic
cctgacggctggttttcg

SEQ ID NO: 15645 - DNA, 18 bp, Artificial Sequence
  Synthetic
tgggcgtggaaatttcgg

SEQ ID NO: 15646 - DNA, 16 bp, Artificial Sequence
  Synthetic
cgtcgaggcagtccga

SEQ ID NO: 15647 - DNA, 19 bp, Artificial Sequence
  Synthetic
ttatcgtgaatgccgaccg

SEQ ID NO: 15648 - DNA, 17 bp, Artificial Sequence
  Synthetic
ttgccttgtgttgccgt

SEQ ID NO: 15649 - DNA, 19 bp, Artificial Sequence
  Synthetic
ggggtcgaaggcaagatgg

SEQ ID NO: 15650 - DNA, 17 bp, Artificial Sequence
  Synthetic
ggactggtatcgcgcca

SEQ ID NO: 15651 - DNA, 16 bp, Artificial Sequence
  Synthetic
ccggcgcgtggcaata

SEQ ID NO: 15652 - DNA, 17 bp, Artificial Sequence
  Synthetic
cgatgtgattcgggcgg

SEQ ID NO: 15653 - DNA, 17 bp, Artificial Sequence
  Synthetic
ttcacgaagccgatgcc

SEQ ID NO: 15654 - DNA, 16 bp, Artificial Sequence
  Synthetic
acgcatcgcacttgcc

SEQ ID NO: 15655 - DNA, 18 bp, Artificial Sequence
  Synthetic
cccgattcttgccgttgc

SEQ ID NO: 15656 - DNA, 18 bp, Artificial Sequence
  Synthetic
gcggcaggcatattgagg

SEQ ID NO: 15657 - DNA, 16 bp, Artificial Sequence
  Synthetic
cggcgggaaaatgcgc

SEQ ID NO: 15658 - DNA, 18 bp, Artificial Sequence
  Synthetic
caagcactgccatcaccg

SEQ ID NO: 15659 - DNA, 21 bp, Artificial Sequence
  Synthetic
ctagatcgtcaaagtttagca

SEQ ID NO: 15660 - DNA, 18 bp, Artificial Sequence
  Synthetic
cggcgagattctgaactt

SEQ ID NO: 15661 - DNA, 17 bp, Artificial Sequence
  Synthetic
acaataccgccaagccg

SEQ ID NO: 15662 - DNA, 16 bp, Artificial Sequence
  Synthetic
cgccacgcgttttcgg

SEQ ID NO: 15663 - DNA, 16 bp, Artificial Sequence
  Synthetic
tgccttgtccgagccg

SEQ ID NO: 15664 - DNA, 16 bp, Artificial Sequence
  Synthetic
gcagcatcgcggtgga

SEQ ID NO: 15665 - DNA, 20 bp, Artificial Sequence
  Synthetic
atctgtggcgcatcaaaacc

SEQ ID NO: 15666 - DNA, 17 bp, Artificial Sequence
  Synthetic
gcacaaggtgcggcagt

SEQ ID NO: 15667 - DNA, 19 bp, Artificial Sequence
  Synthetic
gcgttgacgtgatccatcg

SEQ ID NO: 15668 - DNA, 20 bp, Artificial Sequence
  Synthetic
gaaaacgctgcaaaatgaac

SEQ ID NO: 15669 - DNA, 20 bp, Artificial Sequence
  Synthetic
atacacccaaagccacttcc

SEQ ID NO: 15670 - DNA, 16 bp, Artificial Sequence
  Synthetic
tcggcctggatgtggc

SEQ ID NO: 15671 - DNA, 20 bp, Artificial Sequence
  Synthetic
aaagtcgaaaacgtcgtgcg

SEQ ID NO: 15672 - DNA, 18 bp, Artificial Sequence
  Synthetic
gaagaggtcagcgcgatg

SEQ ID NO: 15673 - DNA, 18 bp, Artificial Sequence
  Synthetic
gccgcgatttgttcatcg

SEQ ID NO: 15674 - DNA, 17 bp, Artificial Sequence
  Synthetic
gacaccatcgagcagcg

SEQ ID NO: 15675 - DNA, 16 bp, Artificial Sequence
  Synthetic
agtgtccctcgtcgcc

SEQ ID NO: 15676 - DNA, 19 bp, Artificial Sequence
  Synthetic
ttgaccgaatgctgcatca

SEQ ID NO: 15677 - DNA, 16 bp, Artificial Sequence
  Synthetic
gacggcatcgacgtgg

SEQ ID NO: 15678 - DNA, 16 bp, Artificial Sequence
  Synthetic
cgcggtacaccacgct

SEQ ID NO: 15679 - DNA, 18 bp, Artificial Sequence
  Synthetic
acagaaagccggtgtgga

SEQ ID NO: 15680 - DNA, 17 bp, Artificial Sequence
  Synthetic
cgccggagagtgcaatc

SEQ ID NO: 15681 - DNA, 20 bp, Artificial Sequence
  Synthetic
tttgtaggcaataagcgcgg

SEQ ID NO: 15682 - DNA, 16 bp, Artificial Sequence
  Synthetic
ccggcggcagcagttt

SEQ ID NO: 15683 - DNA, 18 bp, Artificial Sequence
  Synthetic
cctgacggtcttcagccc

SEQ ID NO: 15684 - DNA, 19 bp, Artificial Sequence
  Synthetic
gggaacatctttgaccagt

SEQ ID NO: 15685 - DNA, 21 bp, Artificial Sequence
  Synthetic
ttgagcgtttttgaattcagc

SEQ ID NO: 15686 - DNA, 16 bp, Artificial Sequence
  Synthetic
cctgcgcgagtgttgc

SEQ ID NO: 15687 - DNA, 19 bp, Artificial Sequence
  Synthetic
gttcaggttgttgaggcgt

SEQ ID NO: 15688 - DNA, 16 bp, Artificial Sequence
  Synthetic
gcggtattgacggcgg

SEQ ID NO: 15689 - DNA, 19 bp, Artificial Sequence
  Synthetic
cgacctgcatcatttcgcc

SEQ ID NO: 15690 - DNA, 18 bp, Artificial Sequence
  Synthetic
gggaaatcggcgaaacgg

SEQ ID NO: 15691 - DNA, 15 bp, Artificial Sequence
  Synthetic
ttcggcggctttgcg

SEQ ID NO: 15692 - DNA, 16 bp, Artificial Sequence
  Synthetic
ccccgccaaaaacggc

SEQ ID NO: 15693 - DNA, 20 bp, Artificial Sequence
  Synthetic
ttccgaagatgaagttgccg

SEQ ID NO: 15694 - DNA, 20 bp, Artificial Sequence
  Synthetic
ttgttttcggtaatgctgcg

SEQ ID NO: 15695 - DNA, 16 bp, Artificial Sequence
  Synthetic
cgttggagggcgacga

SEQ ID NO: 15696 - DNA, 19 bp, Artificial Sequence
  Synthetic
cgttgatggtgtcggtgag

SEQ ID NO: 15697 - DNA, 18 bp, Artificial Sequence
  Synthetic
tcttcggtggtcatgcgg

SEQ ID NO: 15698 - DNA, 17 bp, Artificial Sequence
  Synthetic
cgccgagtttcagcgtg

SEQ ID NO: 15699 - DNA, 21 bp, Artificial Sequence
  Synthetic
catagtaacggatgtggaaag

SEQ ID NO: 15700 - DNA, 16 bp, Artificial Sequence
  Synthetic
gcaaactgcccacgcc

SEQ ID NO: 15701 - DNA, 20 bp, Artificial Sequence
  Synthetic
gaacaagcctgttttcctgc

SEQ ID NO: 15702 - DNA, 18 bp, Artificial Sequence
  Synthetic
acaaattcacacgggcgg

SEQ ID NO: 15703 - DNA, 20 bp, Artificial Sequence
  Synthetic
gctttatcaggcgatggagg

SEQ ID NO: 15704 - DNA, 20 bp, Artificial Sequence
  Synthetic
gtatcggcatcgttaccagt

SEQ ID NO: 15705 - DNA, 17 bp, Artificial Sequence
  Synthetic
gattgtctgtcgcggcg

SEQ ID NO: 15706 - DNA, 18 bp, Artificial Sequence
  Synthetic
atcatcggcttctgcgtg

SEQ ID NO: 15707 - DNA, 19 bp, Artificial Sequence
  Synthetic
cgccatatccgacgcttac

SEQ ID NO: 15708 - DNA, 18 bp, Artificial Sequence
  Synthetic
ggcgtttaccggttcgac

SEQ ID NO: 15709 - DNA, 17 bp, Artificial Sequence
  Synthetic
cgtttcaaacggcgcgg

SEQ ID NO: 15710 - DNA, 16 bp, Artificial Sequence
  Synthetic
gagcagggcgcatcga

SEQ ID NO: 15711 - DNA, 18 bp, Artificial Sequence
  Synthetic
gcacgatggaagcaggaa

SEQ ID NO: 15712 - DNA, 15 bp, Artificial Sequence
  Synthetic
ttggcggcctgcagt

SEQ ID NO: 15713 - DNA, 19 bp, Artificial Sequence
  Synthetic
tccgtatctggttaaacgg

SEQ ID NO: 15714 - DNA, 19 bp, Artificial Sequence
  Synthetic
agggtcagtccgatttcgt

SEQ ID NO: 15715 - DNA, 19 bp, Artificial Sequence
  Synthetic
tcttcggtcaacacgatgg

SEQ ID NO: 15716 - DNA, 20 bp, Artificial Sequence
  Synthetic
atatattcgagtgcgcgctc

SEQ ID NO: 15717 - DNA, 17 bp, Artificial Sequence
  Synthetic
tcgccatcgtgtgttcg

SEQ ID NO: 15718 - DNA, 20 bp, Artificial Sequence
  Synthetic
tttggcaatccttttacgcg

SEQ ID NO: 15719 - DNA, 18 bp, Artificial Sequence
  Synthetic
cggcaggcgttttctacc

SEQ ID NO: 15720 - DNA, 19 bp, Artificial Sequence
  Synthetic
gaccaaatccgcctgtacg

SEQ ID NO: 15721 - DNA, 17 bp, Artificial Sequence
  Synthetic
ccgggtcggtatggaca

SEQ ID NO: 15722 - DNA, 16 bp, Artificial Sequence
  Synthetic
cggtggaaggcgggaa

SEQ ID NO: 15723 - DNA, 18 bp, Artificial Sequence
  Synthetic
cgcgccgtctgaaaatcc

SEQ ID NO: 15724 - DNA, 16 bp, Artificial Sequence
  Synthetic
gccgccgccaaatcca

SEQ ID NO: 15725 - DNA, 17 bp, Artificial Sequence
  Synthetic
ggtgtggtgcaggagga

SEQ ID NO: 15726 - DNA, 16 bp, Artificial Sequence
  Synthetic
gcatacgcgccatcgt

SEQ ID NO: 15727 - DNA, 19 bp, Artificial Sequence
  Synthetic
atcgattcaaaacactggc

SEQ ID NO: 15728 - DNA, 18 bp, Artificial Sequence
  Synthetic
aacccaaactcaaagcca

SEQ ID NO: 15729 - DNA, 16 bp, Artificial Sequence
  Synthetic
ccccggcaggagcatt

SEQ ID NO: 15730 - DNA, 18 bp, Artificial Sequence
  Synthetic
cggctttgtgcagattgc

SEQ ID NO: 15731 - DNA, 18 bp, Artificial Sequence
  Synthetic
tgagcgacgctttaccga

SEQ ID NO: 15732 - DNA, 19 bp, Artificial Sequence
  Synthetic
agagggctttgagcatcgc

SEQ ID NO: 15733 - DNA, 17 bp, Artificial Sequence
  Synthetic
ggaagccggcgaagagt

SEQ ID NO: 15734 - DNA, 16 bp, Artificial Sequence
  Synthetic
tcagggcttcgggcgt

SEQ ID NO: 15735 - DNA, 19 bp, Artificial Sequence
  Synthetic
cgacgcagataaaatcgcg

SEQ ID NO: 15736 - DNA, 20 bp, Artificial Sequence
  Synthetic
cactcttggggtcctgaagc

SEQ ID NO: 15737 - DNA, 18 bp, Artificial Sequence
  Synthetic
gcgctcaaacctttcggt

SEQ ID NO: 15738 - DNA, 18 bp, Artificial Sequence
  Synthetic
cacccccatcgacctgat

SEQ ID NO: 15739 - DNA, 20 bp, Artificial Sequence
  Synthetic
tttccgatagattcctgccg

SEQ ID NO: 15740 - DNA, 18 bp, Artificial Sequence
  Synthetic
cggtcggctttttcctgc

SEQ ID NO: 15741 - DNA, 20 bp, Artificial Sequence
  Synthetic
tgaacaggatgttgcggatg

SEQ ID NO: 15742 - DNA, 16 bp, Artificial Sequence
  Synthetic
cgacacgctcgtccgt

SEQ ID NO: 15743 - DNA, 16 bp, Artificial Sequence
  Synthetic
cggcgggggtttctgt

SEQ ID NO: 15744 - DNA, 17 bp, Artificial Sequence
  Synthetic
caaggatgcgggcgatg

SEQ ID NO: 15745 - DNA, 18 bp, Artificial Sequence
  Synthetic
ttgctgacgctttcggtc

SEQ ID NO: 15746 - DNA, 18 bp, Artificial Sequence
  Synthetic
aggtgtcagtgcgttgtg

SEQ ID NO: 15747 - DNA, 19 bp, Artificial Sequence
  Synthetic
gcagcccgcatgtttttcc

SEQ ID NO: 15748 - DNA, 19 bp, Artificial Sequence
  Synthetic
acgccgttgtttttcacgt

SEQ ID NO: 15749 - DNA, 20 bp, Artificial Sequence
  Synthetic
cgaaacgttttttgcagcgg

SEQ ID NO: 15750 - DNA, 17 bp, Artificial Sequence
  Synthetic
cagacgcgttcggcaac

SEQ ID NO: 15751 - DNA, 17 bp, Artificial Sequence
  Synthetic
gcttcggcgacaacagc

SEQ ID NO: 15752 - DNA, 21 bp, Artificial Sequence
  Synthetic
agccgtattgtttcatcatct

SEQ ID NO: 15753 - DNA, 18 bp, Artificial Sequence
  Synthetic
cgcttcgattacggcgtt

SEQ ID NO: 15754 - DNA, 18 bp, Artificial Sequence
  Synthetic
ttggacatcgcgcattgg

SEQ ID NO: 15755 - DNA, 18 bp, Artificial Sequence
  Synthetic
gtaggggaggttgttctg

SEQ ID NO: 15756 - DNA, 22 bp, Artificial Sequence
  Synthetic
tatcggataacatctccttcaa

SEQ ID NO: 15757 - DNA, 24 bp, Artificial Sequence
  Synthetic
aagtaatcattaaattcggatccg

SEQ ID NO: 15758 - DNA, 19 bp, Artificial Sequence
  Synthetic
caaatgtgggtgacaatcg

SEQ ID NO: 15759 - DNA, 19 bp, Artificial Sequence
  Synthetic
attgggtatctaggccact

SEQ ID NO: 15760 - DNA, 23 bp, Artificial Sequence
  Synthetic
ttgaaaccacttctgatttacct

SEQ ID NO: 15761 - DNA, 21 bp, Artificial Sequence
  Synthetic
tcctgattcatttttctctgg

SEQ ID NO: 15762 - DNA, 19 bp, Artificial Sequence
  Synthetic
ctccaaagtaatcggttcg

SEQ ID NO: 15763 - DNA, 18 bp, Artificial Sequence
  Synthetic
cacgccaaatcgcaaggt

SEQ ID NO: 15764 - DNA, 16 bp, Artificial Sequence
  Synthetic
cctccgcgctgatgca

SEQ ID NO: 15765 - DNA, 18 bp, Artificial Sequence
  Synthetic
cgtgcgttgggtcaaaga

SEQ ID NO: 15766 - DNA, 19 bp, Artificial Sequence
  Synthetic
ctgaccgccattcacaacg

SEQ ID NO: 15767 - DNA, 18 bp, Artificial Sequence
  Synthetic
taccaaggccgctcgtac

SEQ ID NO: 15768 - DNA, 16 bp, Artificial Sequence
  Synthetic
cgtccgccaagatgcc

SEQ ID NO: 15769 - DNA, 17 bp, Artificial Sequence
  Synthetic
ggacgcgataccgacga

SEQ ID NO: 15770 - DNA, 18 bp, Artificial Sequence
  Synthetic
gcctgaacatccccacca

SEQ ID NO: 15771 - DNA, 16 bp, Artificial Sequence
  Synthetic
gacctgcggctcgtgt

SEQ ID NO: 15772 - DNA, 20 bp, Artificial Sequence
  Synthetic
gtcttattcggcaacatcgc

SEQ ID NO: 15773 - DNA, 17 bp, Artificial Sequence
  Synthetic
gggcggacttcatcgtg

SEQ ID NO: 15774 - DNA, 20 bp, Artificial Sequence
  Synthetic
ggaaacgccgaaattttccg

SEQ ID NO: 15775 - DNA, 20 bp, Artificial Sequence
  Synthetic
tccgaaccgtctttctgtgc

SEQ ID NO: 15776 - DNA, 20 bp, Artificial Sequence
  Synthetic
atgtccaacaagaaatgcgc

SEQ ID NO: 15777 - DNA, 20 bp, Artificial Sequence
  Synthetic
acatcggatgctcttccaga

SEQ ID NO: 15778 - DNA, 17 bp, Artificial Sequence
  Synthetic
tgtccaactcgagggcg

SEQ ID NO: 15779 - DNA, 20 bp, Artificial Sequence
  Synthetic
ggtctgaccgtctttgaagg

SEQ ID NO: 15780 - DNA, 18 bp, Artificial Sequence
  Synthetic
cgacaaacgtgccttccg

SEQ ID NO: 15781 - DNA, 18 bp, Artificial Sequence
  Synthetic
tccaaatcaaacgcgccc

SEQ ID NO: 15782 - DNA, 18 bp, Artificial Sequence
  Synthetic
cgtctgaacaccctcccg

SEQ ID NO: 15783 - DNA, 17 bp, Artificial Sequence
  Synthetic
catcgcttttgccgccg

SEQ ID NO: 15784 - DNA, 17 bp, Artificial Sequence
  Synthetic
gcacggacagggatcgt

SEQ ID NO: 15785 - DNA, 18 bp, Artificial Sequence
  Synthetic
cgaccaaccgaccgattc

SEQ ID NO: 15786 - DNA, 16 bp, Artificial Sequence
  Synthetic
ggcgcaacggccttac

SEQ ID NO: 15787 - DNA, 19 bp, Artificial Sequence
  Synthetic
gctttggcactgaaaagcg

SEQ ID NO: 15788 - DNA, 18 bp, Artificial Sequence
  Synthetic
tcgcctcgggattgaaca

SEQ ID NO: 15789 - DNA, 19 bp, Artificial Sequence
  Synthetic
ctatctgaagtccgagcgc

SEQ ID NO: 15790 - DNA, 19 bp, Artificial Sequence
  Synthetic
aaaactgtacagcaggcgc

SEQ ID NO: 15791 - DNA, 20 bp, Artificial Sequence
  Synthetic
ttttcgtcatccgttaccgc

SEQ ID NO: 15792 - DNA, 20 bp, Artificial Sequence
  Synthetic
cctactggtacatcgacacg

SEQ ID NO: 15793 - DNA, 18 bp, Artificial Sequence
  Synthetic
cccgaacacctgcaacaa

SEQ ID NO: 15794 - DNA, 20 bp, Artificial Sequence
  Synthetic
aaaaccgttcgttacctccg

SEQ ID NO: 15795 - DNA, 18 bp, Artificial Sequence
  Synthetic
gcgacaaataccccgttt

SEQ ID NO: 15796 - DNA, 20 bp, Artificial Sequence
  Synthetic
tcgtttatgctgatccctcg

SEQ ID NO: 15797 - DNA, 20 bp, Artificial Sequence
  Synthetic
ttcaatatagccaaggggat

SEQ ID NO: 15798 - DNA, 18 bp, Artificial Sequence
  Synthetic
gcgactgcgtgtccattg

SEQ ID NO: 15799 - DNA, 18 bp, Artificial Sequence
  Synthetic
tcgtcaacagcgtcgtcg

SEQ ID NO: 15800 - DNA, 17 bp, Artificial Sequence
  Synthetic
cacgcgctgaaggaggt

SEQ ID NO: 15801 - DNA, 17 bp, Artificial Sequence
  Synthetic
attgccgggaaacacgc

SEQ ID NO: 15802 - DNA, 18 bp, Artificial Sequence
  Synthetic
actgcccaaaagcgtacc

SEQ ID NO: 15803 - DNA, 18 bp, Artificial Sequence
  Synthetic
gttctttggcggcttcgt

SEQ ID NO: 15804 - DNA, 19 bp, Artificial Sequence
  Synthetic
gcggcgattatcatctgca

SEQ ID NO: 15805 - DNA, 18 bp, Artificial Sequence
  Synthetic
aaaatcggtgcggacgtg

SEQ ID NO: 15806 - DNA, 18 bp, Artificial Sequence
  Synthetic
atgagtccgaggctgtgg

SEQ ID NO: 15807 - DNA, 16 bp, Artificial Sequence
  Synthetic
gccattgcaggcggtt

SEQ ID NO: 15808 - DNA, 16 bp, Artificial Sequence
  Synthetic
ttgccgatgttgccgc

SEQ ID NO: 15809 - DNA, 16 bp, Artificial Sequence
  Synthetic
cgagtatggtggcgcg

SEQ ID NO: 15810 - DNA, 20 bp, Artificial Sequence
  Synthetic
tggtgttccaaagcagtacc

SEQ ID NO: 15811 - DNA, 20 bp, Artificial Sequence
  Synthetic
tgtattcctgatttccggcc

SEQ ID NO: 15812 - DNA, 23 bp, Artificial Sequence
  Synthetic
ctttgttatcgacttcaatttgg

SEQ ID NO: 15813 - DNA, 17 bp, Artificial Sequence
  Synthetic
gcgccgcataacctctt

SEQ ID NO: 15814 - DNA, 19 bp, Artificial Sequence
  Synthetic
agcagtagggtcatcaggc

SEQ ID NO: 15815 - DNA, 16 bp, Artificial Sequence
  Synthetic
gacagccagcgcatcg

SEQ ID NO: 15816 - DNA, 17 bp, Artificial Sequence
  Synthetic
tcgccctgatagccgtc

SEQ ID NO: 15817 - DNA, 18 bp, Artificial Sequence
  Synthetic
gatatgggcggcgagtcc

SEQ ID NO: 15818 - DNA, 16 bp, Artificial Sequence
  Synthetic
ggggcgaacaacaccg

SEQ ID NO: 15819 - DNA, 16 bp, Artificial Sequence
  Synthetic
tgctctgcggcggaca

SEQ ID NO: 15820 - DNA, 19 bp, Artificial Sequence
  Synthetic
ttgaacccgtataccaacc

SEQ ID NO: 15821 - DNA, 20 bp, Artificial Sequence
  Synthetic
cggtagctaagacgacgtcc

SEQ ID NO: 15822 - DNA, 16 bp, Artificial Sequence
  Synthetic
catttcgcgcgcaccc

SEQ ID NO: 15823 - DNA, 16 bp, Artificial Sequence
  Synthetic
acctcttcgcgacgct

SEQ ID NO: 15824 - DNA, 20 bp, Artificial Sequence
  Synthetic
acgagcaaatgaaactggcg

SEQ ID NO: 15825 - DNA, 20 bp, Artificial Sequence
  Synthetic
cggaatcgtacaggaagacg

SEQ ID NO: 15826 - DNA, 16 bp, Artificial Sequence
  Synthetic
cgcgtggcaggaacac

SEQ ID NO: 15827 - DNA, 15 bp, Artificial Sequence
  Synthetic
aaaaggccgcgctcg

SEQ ID NO: 15828 - DNA, 20 bp, Artificial Sequence
  Synthetic
gaaactggtcgaatgcaacg

SEQ ID NO: 15829 - DNA, 18 bp, Artificial Sequence
  Synthetic
gatgcgcgtttcggcata

SEQ ID NO: 15830 - DNA, 19 bp, Artificial Sequence
  Synthetic
cgtatccgcactacctcgc

SEQ ID NO: 15831 - DNA, 16 bp, Artificial Sequence
  Synthetic
ggctgctgctgtccct

SEQ ID NO: 15832 - DNA, 18 bp, Artificial Sequence
  Synthetic
tttcgcaccctcttccgt

SEQ ID NO: 15833 - DNA, 18 bp, Artificial Sequence
  Synthetic
ccaaggcttcgatgaaga

SEQ ID NO: 15834 - DNA, 16 bp, Artificial Sequence
  Synthetic
tcagacggcaggcagc

SEQ ID NO: 15835 - DNA, 20 bp, Artificial Sequence
  Synthetic
ccgatttgcacaaattaacc

SEQ ID NO: 15836 - DNA, 21 bp, Artificial Sequence
  Synthetic
atttcggatttaattgacccg

SEQ ID NO: 15837 - DNA, 18 bp, Artificial Sequence
  Synthetic
gcgatgaagcgtgggatt

SEQ ID NO: 15838 - DNA, 21 bp, Artificial Sequence
  Synthetic
ctaccattgatattgtgtgct

SEQ ID NO: 15839 - DNA, 19 bp, Artificial Sequence
  Synthetic
aatttgggcaaagaccccg

SEQ ID NO: 15840 - DNA, 24 bp, Artificial Sequence
  Synthetic
tctttgattgataatggtgaaacg

SEQ ID NO: 15841 - DNA, 19 bp, Artificial Sequence
  Synthetic
aaacaattactggcgtgtc

SEQ ID NO: 15842 - DNA, 18 bp, Artificial Sequence
  Synthetic
aaagggatacgcaaccat

SEQ ID NO: 15843 - DNA, 16 bp, Artificial Sequence
  Synthetic
cgccgtactgctggct

SEQ ID NO: 15844 - DNA, 16 bp, Artificial Sequence
  Synthetic
acaccgacgctgacct

SEQ ID NO: 15845 - DNA, 19 bp, Artificial Sequence
  Synthetic
aatatttccgttgccgtcc

SEQ ID NO: 15846 - DNA, 20 bp, Artificial Sequence
  Synthetic
tatctgccagttttccttgt

SEQ ID NO: 15847 - DNA, 17 bp, Artificial Sequence
  Synthetic
ccgaaatgcgtaccggc

SEQ ID NO: 15848 - DNA, 16 bp, Artificial Sequence
  Synthetic
ggctcgcccgaatcca

SEQ ID NO: 15849 - DNA, 21 bp, Artificial Sequence
  Synthetic
ttgttttgcagtaaatcgaga

SEQ ID NO: 15850 - DNA, 19 bp, Artificial Sequence
  Synthetic
ttgtcctttgtaagcggcg

SEQ ID NO: 15851 - DNA, 20 bp, Artificial Sequence
  Synthetic
aagcagtcgaaaatcaggcg

SEQ ID NO: 15852 - DNA, 20 bp, Artificial Sequence
  Synthetic
aaggtcgaaatcgccaaacg

SEQ ID NO: 15853 - DNA, 18 bp, Artificial Sequence
  Synthetic
tcggggaatcagaagcgg

SEQ ID NO: 15854 - DNA, 19 bp, Artificial Sequence
  Synthetic
tgacgaaagaggcggaaca

SEQ ID NO: 15855 - DNA, 18 bp, Artificial Sequence
  Synthetic
gccgtgtcaagatggaaa

SEQ ID NO: 15856 - DNA, 16 bp, Artificial Sequence
  Synthetic
tgcagacggcggaaca

SEQ ID NO: 15857 - DNA, 18 bp, Artificial Sequence
  Synthetic
gtcgagaccgcctgtttc

SEQ ID NO: 15858 - DNA, 20 bp, Artificial Sequence
  Synthetic
aatcggcgagatttccatcg

SEQ ID NO: 15859 - DNA, 17 bp, Artificial Sequence
  Synthetic
cgtaccacgctgctgac

SEQ ID NO: 15860 - DNA, 20 bp, Artificial Sequence
  Synthetic
ccgtcctattatgtccgtcg

SEQ ID NO: 15861 - DNA, 18 bp, Artificial Sequence
  Synthetic
cgtatcggacgggttgga

SEQ ID NO: 15862 - DNA, 16 bp, Artificial Sequence
  Synthetic
gtgctcctggcgcaga

SEQ ID NO: 15863 - DNA, 18 bp, Artificial Sequence
  Synthetic
acgcttggaaaacacccg

SEQ ID NO: 15864 - DNA, 20 bp, Artificial Sequence
  Synthetic
atctcgaaacccgtcattcc

SEQ ID NO: 15865 - DNA, 16 bp, Artificial Sequence
  Synthetic
gcccgcctgagcaaca

SEQ ID NO: 15866 - DNA, 19 bp, Artificial Sequence
  Synthetic
cgaagaaaaccacctgcgt

SEQ ID NO: 15867 - DNA, 16 bp, Artificial Sequence
  Synthetic
ggaagctgcccgaagc

SEQ ID NO: 15868 - DNA, 16 bp, Artificial Sequence
  Synthetic
gccgccgtttcccgtt

SEQ ID NO: 15869 - DNA, 20 bp, Artificial Sequence
  Synthetic
aaggaaccaccgtatccaca

SEQ ID NO: 15870 - DNA, 17 bp, Artificial Sequence
  Synthetic
gcgcgataatcggcagg

SEQ ID NO: 15871 - DNA, 16 bp, Artificial Sequence
  Synthetic
acgtccagcggcgtca

SEQ ID NO: 15872 - DNA, 19 bp, Artificial Sequence
  Synthetic
gccgcatagtcaaaatgcc

SEQ ID NO: 15873 - DNA, 16 bp, Artificial Sequence
  Synthetic
ccgcagcaattcccgc

SEQ ID NO: 15874 - DNA, 19 bp, Artificial Sequence
  Synthetic
ccctcataaaaccgctgcc

SEQ ID NO: 15875 - DNA, 20 bp, Artificial Sequence
  Synthetic
aaccaccaccagataatcgc

SEQ ID NO: 15876 - DNA, 19 bp, Artificial Sequence
  Synthetic
tcgcatcctcctccttcaa

SEQ ID NO: 15877 - DNA, 19 bp, Artificial Sequence
  Synthetic
gccaccagcgtgattttgc

SEQ ID NO: 15878 - DNA, 15 bp, Artificial Sequence
  Synthetic
aatccgccgccgcat

SEQ ID NO: 15879 - DNA, 20 bp, Artificial Sequence
  Synthetic
taagcctgtccaacacatcc

SEQ ID NO: 15880 - DNA, 19 bp, Artificial Sequence
  Synthetic
caaaccccaccgcagaatg

SEQ ID NO: 15881 - DNA, 17 bp, Artificial Sequence
  Synthetic
gcggcagggatttgacc

SEQ ID NO: 15882 - DNA, 16 bp, Artificial Sequence
  Synthetic
caccgtgcgccctgtt

SEQ ID NO: 15883 - DNA, 20 bp, Artificial Sequence
  Synthetic
caacacggttgtttcagggt

SEQ ID NO: 15884 - DNA, 19 bp, Artificial Sequence
  Synthetic
gtatcacgcgcattcccct

SEQ ID NO: 15885 - DNA, 20 bp, Artificial Sequence
  Synthetic
acggcgtagttttcaatccg

SEQ ID NO: 15886 - DNA, 17 bp, Artificial Sequence
  Synthetic
tcaacggcgcggattcg

SEQ ID NO: 15887 - DNA, 16 bp, Artificial Sequence
  Synthetic
cgccggccgatgatga

SEQ ID NO: 15888 - DNA, 20 bp, Artificial Sequence
  Synthetic
tccactccgaatgtctgacg

SEQ ID NO: 15889 - DNA, 16 bp, Artificial Sequence
  Synthetic
cgtgccggggttctca

SEQ ID NO: 15890 - DNA, 21 bp, Artificial Sequence
  Synthetic
atactggaatttctgcgtttg

SEQ ID NO: 15891 - DNA, 18 bp, Artificial Sequence
  Synthetic
tttggtggcggaggaaac

SEQ ID NO: 15892 - DNA, 19 bp, Artificial Sequence
  Synthetic
tggtcaggaacaatgcctg

SEQ ID NO: 15893 - DNA, 19 bp, Artificial Sequence
  Synthetic
ataaggcgtggcagaagga

SEQ ID NO: 15894 - DNA, 20 bp, Artificial Sequence
  Synthetic
agagatggttaacgaaggcg

SEQ ID NO: 15895 - DNA, 19 bp, Artificial Sequence
  Synthetic
gccacatcgacatccaaga

SEQ ID NO: 15896 - DNA, 19 bp, Artificial Sequence
  Synthetic
agctcgttaccgaacagct

SEQ ID NO: 15897 - DNA, 18 bp, Artificial Sequence
  Synthetic
gccgtttaccgcaacaac

SEQ ID NO: 15898 - DNA, 19 bp, Artificial Sequence
  Synthetic
gtatccatcccgattcggc

SEQ ID NO: 15899 - DNA, 19 bp, Artificial Sequence
  Synthetic
ttacctctacacggacggc

SEQ ID NO: 15900 - DNA, 23 bp, Artificial Sequence
  Synthetic
gatgtttcaaatttcgaagatgt

SEQ ID NO: 15901 - DNA, 19 bp, Artificial Sequence
  Synthetic
tagctacccggctatgcaa

SEQ ID NO: 15902 - DNA, 16 bp, Artificial Sequence
  Synthetic
cttttcctgccgcgcc

SEQ ID NO: 15903 - DNA, 16 bp, Artificial Sequence
  Synthetic
aacgctcaaaccgccg

SEQ ID NO: 15904 - DNA, 15 bp, Artificial Sequence
  Synthetic
gccatcgcgccgttt

SEQ ID NO: 15905 - DNA, 18 bp, Artificial Sequence
  Synthetic
ccctgaaatcgaacgccg

SEQ ID NO: 15906 - DNA, 20 bp, Artificial Sequence
  Synthetic
cttcctgattaccatcggcg

SEQ ID NO: 15907 - DNA, 18 bp, Artificial Sequence
  Synthetic
tcaacagtggcgcgaaac

SEQ ID NO: 15908 - DNA, 16 bp, Artificial Sequence
  Synthetic
gcggcggcttcagcta

SEQ ID NO: 15909 - DNA, 16 bp, Artificial Sequence
  Synthetic
ggcagcgttacgggca

SEQ ID NO: 15910 - DNA, 20 bp, Artificial Sequence
  Synthetic
ggtctggtcggacagattgc

SEQ ID NO: 15911 - DNA, 17 bp, Artificial Sequence
  Synthetic
tctacaccgcccaagca

SEQ ID NO: 15912 - DNA, 18 bp, Artificial Sequence
  Synthetic
ggcacgttctaccaaggc

SEQ ID NO: 15913 - DNA, 16 bp, Artificial Sequence
  Synthetic
cagctcgcccaagcca

SEQ ID NO: 15914 - DNA, 17 bp, Artificial Sequence
  Synthetic
cctcacccaagccgtct

SEQ ID NO: 15915 - DNA, 19 bp, Artificial Sequence
  Synthetic
cggcaaacacccattgacc

SEQ ID NO: 15916 - DNA, 20 bp, Artificial Sequence
  Synthetic
cgtaaacgctgtaatactgc

SEQ ID NO: 15917 - DNA, 20 bp, Artificial Sequence
  Synthetic
caatgactaccaccacgacg

SEQ ID NO: 15918 - DNA, 19 bp, Artificial Sequence
  Synthetic
aaactaccgccgcaatacg

SEQ ID NO: 15919 - DNA, 16 bp, Artificial Sequence
  Synthetic
cgaagcccagcgcatc

SEQ ID NO: 15920 - DNA, 17 bp, Artificial Sequence
  Synthetic
acgcggctacaacgtcg

SEQ ID NO: 15921 - DNA, 17 bp, Artificial Sequence
  Synthetic
cccgttgcgtttcggaa

SEQ ID NO: 15922 - DNA, 20 bp, Artificial Sequence
  Synthetic
gctgccgtagattttgacgg

SEQ ID NO: 15923 - DNA, 18 bp, Artificial Sequence
  Synthetic
ttcgggtttttgacggcg

SEQ ID NO: 15924 - DNA, 18 bp, Artificial Sequence
  Synthetic
tcgggagccagagtctct

SEQ ID NO: 15925 - DNA, 18 bp, Artificial Sequence
  Synthetic
gcgttgcgccataatggt

SEQ ID NO: 15926 - DNA, 16 bp, Artificial Sequence
  Synthetic
gcggcggctttgttca

SEQ ID NO: 15927 - DNA, 16 bp, Artificial Sequence
  Synthetic
cagctgacgggcgtgt

SEQ ID NO: 15928 - DNA, 16 bp, Artificial Sequence
  Synthetic
cgcagcaaaccgccga

SEQ ID NO: 15929 - DNA, 20 bp, Artificial Sequence
  Synthetic
tgcctgatacagtcggtaca

SEQ ID NO: 15930 - DNA, 19 bp, Artificial Sequence
  Synthetic
tttggaaggcaagagcgac

SEQ ID NO: 15931 - DNA, 17 bp, Artificial Sequence
  Synthetic
tgccgcctgcaaacctc

SEQ ID NO: 15932 - DNA, 15 bp, Artificial Sequence
  Synthetic
ccaaacgccgcgtgt

SEQ ID NO: 15933 - DNA, 17 bp, Artificial Sequence
  Synthetic
gcaacgacatcctcgcc

SEQ ID NO: 15934 - DNA, 16 bp, Artificial Sequence
  Synthetic
ccgcgctgtacggcat

SEQ ID NO: 15935 - DNA, 18 bp, Artificial Sequence
  Synthetic
atcgacgaccaccacacc

SEQ ID NO: 15936 - DNA, 20 bp, Artificial Sequence
  Synthetic
cttagggcaaatgggtctgc

SEQ ID NO: 15937 - DNA, 18 bp, Artificial Sequence
  Synthetic
atcagtacgggaatgagc

SEQ ID NO: 15938 - DNA, 19 bp, Artificial Sequence
  Synthetic
ttgaaagtgcgcgaactgt

SEQ ID NO: 15939 - DNA, 17 bp, Artificial Sequence
  Synthetic
gccaaagccgaactcgc

SEQ ID NO: 15940 - DNA, 20 bp, Artificial Sequence
  Synthetic
cccataccgattccaacacg

SEQ ID NO: 15941 - DNA, 19 bp, Artificial Sequence
  Synthetic
gcgtgggcgttttacttgt

SEQ ID NO: 15942 - DNA, 20 bp, Artificial Sequence
  Synthetic
cgtagccggcttctatttcg

SEQ ID NO: 15943 - DNA, 20 bp, Artificial Sequence
  Synthetic
gccaaacggcaaaaaaacgc

SEQ ID NO: 15944 - DNA, 22 bp, Artificial Sequence
  Synthetic
taaacttttggtgctttttccg

SEQ ID NO: 15945 - DNA, 22 bp, Artificial Sequence
  Synthetic
aaaagaaggttcaatatgtcgg

SEQ ID NO: 15946 - DNA, 16 bp, Artificial Sequence
  Synthetic
cggctgtgcgtgaggt

SEQ ID NO: 15947 - DNA, 19 bp, Artificial Sequence
  Synthetic
cctgttttttgacgctgaa

SEQ ID NO: 15948 - DNA, 17 bp, Artificial Sequence
  Synthetic
gcacatccgccacatcc

SEQ ID NO: 15949 - DNA, 18 bp, Artificial Sequence
  Synthetic
cagcaggctgatggcaat

SEQ ID NO: 15950 - DNA, 16 bp, Artificial Sequence
  Synthetic
cggcccagcaacacca

SEQ ID NO: 15951 - DNA, 17 bp, Artificial Sequence
  Synthetic
ctcccgcaacaatgggc

SEQ ID NO: 15952 - DNA, 17 bp, Artificial Sequence
  Synthetic
ggcacctgtatcggcgt

SEQ ID NO: 15953 - DNA, 16 bp, Artificial Sequence
  Synthetic
aaacccaagccgcacc

SEQ ID NO: 15954 - DNA, 18 bp, Artificial Sequence
  Synthetic
aaaagccgaaaccgcacc

SEQ ID NO: 15955 - DNA, 16 bp, Artificial Sequence
  Synthetic
tgagttcgggcgggag

SEQ ID NO: 15956 - DNA, 20 bp, Artificial Sequence
  Synthetic
aggaaaaccaacatgtccgc

SEQ ID NO: 15957 - DNA, 18 bp, Artificial Sequence
  Synthetic
acctgttcccgattggcg

SEQ ID NO: 15958 - DNA, 16 bp, Artificial Sequence
  Synthetic
cagcgtgcagagccac

SEQ ID NO: 15959 - DNA, 19 bp, Artificial Sequence
  Synthetic
gcgaagaaagccttgccaa

SEQ ID NO: 15960 - DNA, 18 bp, Artificial Sequence
  Synthetic
atggcggacggtataggc

SEQ ID NO: 15961 - DNA, 19 bp, Artificial Sequence
  Synthetic
cggagcatccaaatggcag

SEQ ID NO: 15962 - DNA, 17 bp, Artificial Sequence
  Synthetic
cgtaaaggcagacgcgg

SEQ ID NO: 15963 - DNA, 19 bp, Artificial Sequence
  Synthetic
caccagaggttcgtccact

SEQ ID NO: 15964 - DNA, 18 bp, Artificial Sequence
  Synthetic
aaagatgaagcggcaatg

SEQ ID NO: 15965 - DNA, 20 bp, Artificial Sequence
  Synthetic
ccaaacccaatgcttcaacc

SEQ ID NO: 15966 - DNA, 19 bp, Artificial Sequence
  Synthetic
gcggatccgggtttgatta

SEQ ID NO: 15967 - DNA, 20 bp, Artificial Sequence
  Synthetic
tttgccgaaaatatccccca

SEQ ID NO: 15968 - DNA, 18 bp, Artificial Sequence
  Synthetic
tgcctgtatttccgcgac

SEQ ID NO: 15969 - DNA, 20 bp, Artificial Sequence
  Synthetic
aactcaatgcggacgtatcc

SEQ ID NO: 15970 - DNA, 20 bp, Artificial Sequence
  Synthetic
cgcacaaaaccatgtttggg

SEQ ID NO: 15971 - DNA, 18 bp, Artificial Sequence
  Synthetic
gcgcgccatttgagtttc

SEQ ID NO: 15972 - DNA, 19 bp, Artificial Sequence
  Synthetic
tgcatcgatttgaccggtt

SEQ ID NO: 15973 - DNA, 18 bp, Artificial Sequence
  Synthetic
gcttgaaagcccacctcg

SEQ ID NO: 15974 - DNA, 17 bp, Artificial Sequence
  Synthetic
gactacggcttccacgc

SEQ ID NO: 15975 - DNA, 15 bp, Artificial Sequence
  Synthetic
tcaacgcgccgcaca

SEQ ID NO: 15976 - DNA, 20 bp, Artificial Sequence
  Synthetic
cctgacaggttgcttcgaag

SEQ ID NO: 15977 - DNA, 16 bp, Artificial Sequence
  Synthetic
cccgactttgagcgcg

SEQ ID NO: 15978 - DNA, 19 bp, Artificial Sequence
  Synthetic
gtcggggtggacttcaaag

SEQ ID NO: 15979 - DNA, 20 bp, Artificial Sequence
  Synthetic
atcaggtcggtcagatagct

SEQ ID NO: 15980 - DNA, 20 bp, Artificial Sequence
  Synthetic
ttgcacgtcgatttcagtgg

SEQ ID NO: 15981 - DNA, 18 bp, Artificial Sequence
  Synthetic
accgtatgttccgcaacc

SEQ ID NO: 15982 - DNA, 18 bp, Artificial Sequence
  Synthetic
gcggggttcagttcgatg

SEQ ID NO: 15983 - DNA, 17 bp, Artificial Sequence
  Synthetic
gcggatgaagccttcgc

SEQ ID NO: 15984 - DNA, 18 bp, Artificial Sequence
  Synthetic
tgaaacatctgccgcgtc

SEQ ID NO: 15985 - DNA, 20 bp, Artificial Sequence
  Synthetic
gcaaaaaccaccgtttaccg

SEQ ID NO: 15986 - DNA, 20 bp, Artificial Sequence
  Synthetic
ccatactgacggttctgcag

SEQ ID NO: 15987 - DNA, 16 bp, Artificial Sequence
  Synthetic
cggcaagcgtcccgtt

SEQ ID NO: 15988 - DNA, 18 bp, Artificial Sequence
  Synthetic
gttgacggtgcggacatt

SEQ ID NO: 15989 - DNA, 16 bp, Artificial Sequence
  Synthetic
ccgtcgtgcgaggcat

SEQ ID NO: 15990 - DNA, 19 bp, Artificial Sequence
  Synthetic
ggaagaaatccgcgctttg

SEQ ID NO: 15991 - DNA, 16 bp, Artificial Sequence
  Synthetic
cattgcagcacgccgg

SEQ ID NO: 15992 - DNA, 16 bp, Artificial Sequence
  Synthetic
cgttcgcgtggggcat

SEQ ID NO: 15993 - DNA, 20 bp, Artificial Sequence
  Synthetic
ttcggcaaaaaagaaaccgc

SEQ ID NO: 15994 - DNA, 17 bp, Artificial Sequence
  Synthetic
gtaccgacgcttccggt

SEQ ID NO: 15995 - DNA, 16 bp, Artificial Sequence
  Synthetic
cacgcgcccgaacaga

SEQ ID NO: 15996 - DNA, 20 bp, Artificial Sequence
  Synthetic
caaaatcagggtttgcgagc

SEQ ID NO: 15997 - DNA, 18 bp, Artificial Sequence
  Synthetic
gttcgggaagtcgctgac

SEQ ID NO: 15998 - DNA, 18 bp, Artificial Sequence
  Synthetic
catcggtgcgctctttgg

SEQ ID NO: 15999 - DNA, 16 bp, Artificial Sequence
  Synthetic
gatacgggcggcggtt

SEQ ID NO: 16000 - DNA, 19 bp, Artificial Sequence
  Synthetic
ctgatgagggcttcgagga

SEQ ID NO: 16001 - DNA, 20 bp, Artificial Sequence
  Synthetic
tactgcaaaaggtgatgccg

SEQ ID NO: 16002 - DNA, 20 bp, Artificial Sequence
  Synthetic
tccggcttcgaacaatctgt

SEQ ID NO: 16003 - DNA, 17 bp, Artificial Sequence
  Synthetic
tgccacatcgggttgcc

SEQ ID NO: 16004 - DNA, 18 bp, Artificial Sequence
  Synthetic
cctgcgtcagatcgggat

SEQ ID NO: 16005 - DNA, 18 bp, Artificial Sequence
  Synthetic
cggttcgacaccccattt

SEQ ID NO: 16006 - DNA, 18 bp, Artificial Sequence
  Synthetic
ctcaggcacgacatcacg

SEQ ID NO: 16007 - DNA, 18 bp, Artificial Sequence
  Synthetic
ggacttttctcccacgaa

SEQ ID NO: 16008 - DNA, 18 bp, Artificial Sequence
  Synthetic
aggctgggtcaaatccgg

SEQ ID NO: 16009 - DNA, 16 bp, Artificial Sequence
  Synthetic
gggcaagtgttcgccg

SEQ ID NO: 16010 - DNA, 16 bp, Artificial Sequence
  Synthetic
tacggctgcggacggt

SEQ ID NO: 16011 - DNA, 16 bp, Artificial Sequence
  Synthetic
gttgtggtagccgccg

SEQ ID NO: 16012 - DNA, 18 bp, Artificial Sequence
  Synthetic
atcacgaagacggctcgg

SEQ ID NO: 16013 - DNA, 18 bp, Artificial Sequence
  Synthetic
atgtcgaaaccgccgttg

SEQ ID NO: 16014 - DNA, 20 bp, Artificial Sequence
  Synthetic
attttccaacacctgcttgc

SEQ ID NO: 16015 - DNA, 20 bp, Artificial Sequence
  Synthetic
aaccaccacgtcgtaatcgt

SEQ ID NO: 16016 - DNA, 16 bp, Artificial Sequence
  Synthetic
ggcgcatacacgtcgg

SEQ ID NO: 16017 - DNA, 20 bp, Artificial Sequence
  Synthetic
aactacaccaaccgttctcc

SEQ ID NO: 16018 - DNA, 16 bp, Artificial Sequence
  Synthetic
cgcgcttgccagccaa

SEQ ID NO: 16019 - DNA, 20 bp, Artificial Sequence
  Synthetic
tatcggcaatttcctgctgg

SEQ ID NO: 16020 - DNA, 20 bp, Artificial Sequence
  Synthetic
gcaaacgcctcgatattggg

SEQ ID NO: 16021 - DNA, 20 bp, Artificial Sequence
  Synthetic
tacgcaaacactacgtctgc

SEQ ID NO: 16022 - DNA, 17 bp, Artificial Sequence
  Synthetic
gcgcggtgcaaatcttg

SEQ ID NO: 16023 - DNA, 16 bp, Artificial Sequence
  Synthetic
cccaacatcgcgcgca

SEQ ID NO: 16024 - DNA, 16 bp, Artificial Sequence
  Synthetic
ggctcgtcggcgaaga

SEQ ID NO: 16025 - DNA, 20 bp, Artificial Sequence
  Synthetic
gatacgcctttcaaacggct

SEQ ID NO: 16026 - DNA, 18 bp, Artificial Sequence
  Synthetic
agcttgcagaaacgcgag

SEQ ID NO: 16027 - DNA, 16 bp, Artificial Sequence
  Synthetic
cttcgagcgcgtccag

SEQ ID NO: 16028 - DNA, 20 bp, Artificial Sequence
  Synthetic
tagcgatgtcgtctgaaagc

SEQ ID NO: 16029 - DNA, 19 bp, Artificial Sequence
  Synthetic
cctgtacgggcagggattt

SEQ ID NO: 16030 - DNA, 16 bp, Artificial Sequence
  Synthetic
tgccacagttgcggcg

SEQ ID NO: 16031 - DNA, 16 bp, Artificial Sequence
  Synthetic
tcggcatgggcaagct

SEQ ID NO: 16032 - DNA, 20 bp, Artificial Sequence
  Synthetic
aatgggggcggtgtttaagc

SEQ ID NO: 16033 - DNA, 18 bp, Artificial Sequence
  Synthetic
tcggtgcgttcttctccg

SEQ ID NO: 16034 - DNA, 16 bp, Artificial Sequence
  Synthetic
tgcctgtccgacgacc

SEQ ID NO: 16035 - DNA, 18 bp, Artificial Sequence
  Synthetic
tatgccaaaagccccgtc

SEQ ID NO: 16036 - DNA, 16 bp, Artificial Sequence
  Synthetic
tgggaacaagccgcca

SEQ ID NO: 16037 - DNA, 18 bp, Artificial Sequence
  Synthetic
cgacaacacgctcgttct

SEQ ID NO: 16038 - DNA, 20 bp, Artificial Sequence
  Synthetic
ttgaaaccctgaccctctgc

SEQ ID NO: 16039 - DNA, 16 bp, Artificial Sequence
  Synthetic
gcgtccagggtcagct

SEQ ID NO: 16040 - DNA, 18 bp, Artificial Sequence
  Synthetic
acttcctgatcgcgcatc

SEQ ID NO: 16041 - DNA, 20 bp, Artificial Sequence
  Synthetic
gggtttgtaccaacagtccg

SEQ ID NO: 16042 - DNA, 20 bp, Artificial Sequence
  Synthetic
gtctacttcgcggttgaagg

SEQ ID NO: 16043 - DNA, 17 bp, Artificial Sequence
  Synthetic
aatggcggggaagtcgg

SEQ ID NO: 16044 - DNA, 17 bp, Artificial Sequence
  Synthetic
gcgcgtaggtcagttcc

SEQ ID NO: 16045 - DNA, 16 bp, Artificial Sequence
  Synthetic
cgcctaagccgatgcg

SEQ ID NO: 16046 - DNA, 18 bp, Artificial Sequence
  Synthetic
cgtacacgctccaaaccg

SEQ ID NO: 16047 - DNA, 23 bp, Artificial Sequence
  Synthetic
ttaacacagagtatgcaacttac

SEQ ID NO: 16048 - DNA, 21 bp, Artificial Sequence
  Synthetic
cagtatgacaatttgctgaac

SEQ ID NO: 16049 - DNA, 18 bp, Artificial Sequence
  Synthetic
tgctgattaccaccaaca

SEQ ID NO: 16050 - DNA, 18 bp, Artificial Sequence
  Synthetic
ttgggtcaaaatgggtgc

SEQ ID NO: 16051 - DNA, 19 bp, Artificial Sequence
  Synthetic
tgaaatgttcaacggcatt

SEQ ID NO: 16052 - DNA, 19 bp, Artificial Sequence
  Synthetic
ctgaaaatgcgcctgctca

SEQ ID NO: 16053 - DNA, 21 bp, Artificial Sequence
  Synthetic
ttcttgttttgatgttggcag

SEQ ID NO: 16054 - DNA, 18 bp, Artificial Sequence
  Synthetic
actttagcgcgaaaccat

SEQ ID NO: 16055 - DNA, 18 bp, Artificial Sequence
  Synthetic
cctgcatttcccaaaagc

SEQ ID NO: 16056 - DNA, 18 bp, Artificial Sequence
  Synthetic
caaccgcttgaaacactt

SEQ ID NO: 16057 - DNA, 21 bp, Artificial Sequence
  Synthetic
catacaggacataatgcctac

SEQ ID NO: 16058 - DNA, 22 bp, Artificial Sequence
  Synthetic
gcatatccggcaaataatcttg

SEQ ID NO: 16059 - DNA, 18 bp, Artificial Sequence
  Synthetic
gtcgtcaaagcaggcaaa

SEQ ID NO: 16060 - DNA, 19 bp, Artificial Sequence
  Synthetic
cggcaataatcgacagcgc

SEQ ID NO: 16061 - DNA, 17 bp, Artificial Sequence
  Synthetic
gcccgtagcgacttggt

SEQ ID NO: 16062 - DNA, 25 bp, Artificial Sequence
  Synthetic
agatagggagagaaataaatatcgt

SEQ ID NO: 16063 - DNA, 17 bp, Artificial Sequence
  Synthetic
gcctgatcgaatggccg

SEQ ID NO: 16064 - DNA, 16 bp, Artificial Sequence
  Synthetic
gccggcacactgttcg

SEQ ID NO: 16065 - DNA, 16 bp, Artificial Sequence
  Synthetic
gcgtgtcgccaaaggg

SEQ ID NO: 16066 - DNA, 19 bp, Artificial Sequence
  Synthetic
gcacccgatatgccgtcta

SEQ ID NO: 16067 - DNA, 20 bp, Artificial Sequence
  Synthetic
gccgagttcttctccaaact

SEQ ID NO: 16068 - DNA, 20 bp, Artificial Sequence
  Synthetic
gatgccttgttcttccagcc

SEQ ID NO: 16069 - DNA, 18 bp, Artificial Sequence
  Synthetic
cgaccaagcccaaatcgc

SEQ ID NO: 16070 - DNA, 19 bp, Artificial Sequence
  Synthetic
caacaccagctcgttcaca

SEQ ID NO: 16071 - DNA, 20 bp, Artificial Sequence
  Synthetic
gaagcagtcgtctatggtcg

SEQ ID NO: 16072 - DNA, 16 bp, Artificial Sequence
  Synthetic
gaccaggccctgcgta

SEQ ID NO: 16073 - DNA, 18 bp, Artificial Sequence
  Synthetic
aagcaagcgaaaacggca

SEQ ID NO: 16074 - DNA, 16 bp, Artificial Sequence
  Synthetic
gtgctcctggcgcaga

SEQ ID NO: 16075 - DNA, 20 bp, Artificial Sequence
  Synthetic
aaacacccgcttcaaaaccc

SEQ ID NO: 16076 - DNA, 18 bp, Artificial Sequence
  Synthetic
gggaatccggacctgtcc

SEQ ID NO: 16077 - DNA, 17 bp, Artificial Sequence
  Synthetic
caaccatacggacggcg

SEQ ID NO: 16078 - DNA, 20 bp, Artificial Sequence
  Synthetic
tgtcgatgacggtagtcgga

SEQ ID NO: 16079 - DNA, 16 bp, Artificial Sequence
  Synthetic
ccgctccggcatggtt

SEQ ID NO: 16080 - DNA, 16 bp, Artificial Sequence
  Synthetic
cctgacattcggcggc

SEQ ID NO: 16081 - DNA, 15 bp, Artificial Sequence
  Synthetic
gcgcgtaccggcaaa

SEQ ID NO: 16082 - DNA, 20 bp, Artificial Sequence
  Synthetic
cattggatggcgagatgtgg

SEQ ID NO: 16083 - DNA, 20 bp, Artificial Sequence
  Synthetic
cgcgggttggaagtattggt

SEQ ID NO: 16084 - DNA, 17 bp, Artificial Sequence
  Synthetic
ccggcgtcatgttggaa

SEQ ID NO: 16085 - DNA, 16 bp, Artificial Sequence
  Synthetic
atatcgggcaggcgca

SEQ ID NO: 16086 - DNA, 16 bp, Artificial Sequence
  Synthetic
ggcatggtcgccccaa

SEQ ID NO: 16087 - DNA, 16 bp, Artificial Sequence
  Synthetic
cggggtggtgtccgta

SEQ ID NO: 16088 - DNA, 17 bp, Artificial Sequence
  Synthetic
cagaaagccgcgtttgc

SEQ ID NO: 16089 - DNA, 16 bp, Artificial Sequence
  Synthetic
acgcagtcggtcaggt

SEQ ID NO: 16090 - DNA, 17 bp, Artificial Sequence
  Synthetic
gcggcggttcacaatgt

SEQ ID NO: 16091 - DNA, 19 bp, Artificial Sequence
  Synthetic
aatggcggtcagaatcagc

SEQ ID NO: 16092 - DNA, 18 bp, Artificial Sequence
  Synthetic
cgttcagacggcctttga

SEQ ID NO: 16093 - DNA, 19 bp, Artificial Sequence
  Synthetic
cgttgatgatgtcgtgcgg

SEQ ID NO: 16094 - DNA, 17 bp, Artificial Sequence
  Synthetic
cgactggtcaaggccgt

SEQ ID NO: 16095 - DNA, 20 bp, Artificial Sequence
  Synthetic
gtttgattgccgaaccaggt

SEQ ID NO: 16096 - DNA, 18 bp, Artificial Sequence
  Synthetic
agcgaaagttccaaacct

SEQ ID NO: 16097 - DNA, 19 bp, Artificial Sequence
  Synthetic
atgtcgcggaatttggcag

SEQ ID NO: 16098 - DNA, 19 bp, Artificial Sequence
  Synthetic
gtgctttcttgcgcactgc

SEQ ID NO: 16099 - DNA, 19 bp, Artificial Sequence
  Synthetic
acagaccttttccggattg

SEQ ID NO: 16100 - DNA, 17 bp, Artificial Sequence
  Synthetic
ggcgttgactttgccct

SEQ ID NO: 16101 - DNA, 16 bp, Artificial Sequence
  Synthetic
catccacgccatcggc

SEQ ID NO: 16102 - DNA, 16 bp, Artificial Sequence
  Synthetic
gatgcttgccgtgcgc

SEQ ID NO: 16103 - DNA, 16 bp, Artificial Sequence
  Synthetic
ggcgaagtcgtgtccg

SEQ ID NO: 16104 - DNA, 16 bp, Artificial Sequence
  Synthetic
gatgccagcatcggcg

SEQ ID NO: 16105 - DNA, 16 bp, Artificial Sequence
  Synthetic
gaccgaacttgccgcc

SEQ ID NO: 16106 - DNA, 18 bp, Artificial Sequence
  Synthetic
tcggtttcgacatcacgc

SEQ ID NO: 16107 - DNA, 18 bp, Artificial Sequence
  Synthetic
gccatgtacggtttgggt

SEQ ID NO: 16108 - DNA, 18 bp, Artificial Sequence
  Synthetic
aacgccaaggcaaccaaa

SEQ ID NO: 16109 - DNA, 16 bp, Artificial Sequence
  Synthetic
ggcttgcccgtcttgg

SEQ ID NO: 16110 - DNA, 19 bp, Artificial Sequence
  Synthetic
catcggaaaacacgtcgcc

SEQ ID NO: 16111 - DNA, 20 bp, Artificial Sequence
  Synthetic
acaaacgcaagacttcgtct

SEQ ID NO: 16112 - DNA, 20 bp, Artificial Sequence
  Synthetic
tcgatgcccgtaaacgttac

SEQ ID NO: 16113 - DNA, 16 bp, Artificial Sequence
  Synthetic
tttccggcggcgaacg

SEQ ID NO: 16114 - DNA, 20 bp, Artificial Sequence
  Synthetic
gacggaacagaacaaatgcc

SEQ ID NO: 16115 - DNA, 17 bp, Artificial Sequence
  Synthetic
gggcaaacggcaacagc

SEQ ID NO: 16116 - DNA, 21 bp, Artificial Sequence
  Synthetic
tcgtacaggttaatcaaatgg

SEQ ID NO: 16117 - DNA, 18 bp, Artificial Sequence
  Synthetic
taccccctaccctgaccg

SEQ ID NO: 16118 - DNA, 16 bp, Artificial Sequence
  Synthetic
cgaagccctgttccgc

SEQ ID NO: 16119 - DNA, 18 bp, Artificial Sequence
  Synthetic
cccgatacagctaccccg

SEQ ID NO: 16120 - DNA, 18 bp, Artificial Sequence
  Synthetic
gacagggcggttgtcatc

SEQ ID NO: 16121 - DNA, 20 bp, Artificial Sequence
  Synthetic
acaggaagcgtttcatctgg

SEQ ID NO: 16122 - DNA, 20 bp, Artificial Sequence
  Synthetic
ttgttcgacggtcattttgc

SEQ ID NO: 16123 - DNA, 16 bp, Artificial Sequence
  Synthetic
gtgtgccgcttccgca

SEQ ID NO: 16124 - DNA, 19 bp, Artificial Sequence
  Synthetic
aggcacggtagaagaagcc

SEQ ID NO: 16125 - DNA, 15 bp, Artificial Sequence
  Synthetic
tacgcgcgcggcatt

SEQ ID NO: 16126 - DNA, 19 bp, Artificial Sequence
  Synthetic
aatatttcaccgcccccga

SEQ ID NO: 16127 - DNA, 16 bp, Artificial Sequence
  Synthetic
tccccgaccgcgacat

SEQ ID NO: 16128 - DNA, 16 bp, Artificial Sequence
  Synthetic
cgcggacaagacctgc

SEQ ID NO: 16129 - DNA, 16 bp, Artificial Sequence
  Synthetic
cgcaggattgtgccgc

SEQ ID NO: 16130 - DNA, 17 bp, Artificial Sequence
  Synthetic
ccgaacgcgcctttctg

SEQ ID NO: 16131 - DNA, 16 bp, Artificial Sequence
  Synthetic
gccgcctttgtccgca

SEQ ID NO: 16132 - DNA, 18 bp, Artificial Sequence
  Synthetic
ttaaggcggctttgtcgg

SEQ ID NO: 16133 - DNA, 20 bp, Artificial Sequence
  Synthetic
gtaccgcttcaggaaatcgc

SEQ ID NO: 16134 - DNA, 18 bp, Artificial Sequence
  Synthetic
gcccagttgaacagggga

SEQ ID NO: 16135 - DNA, 20 bp, Artificial Sequence
  Synthetic
cttaccccgtatcggcaaac

SEQ ID NO: 16136 - DNA, 16 bp, Artificial Sequence
  Synthetic
cggctgtgcgtgaggt

SEQ ID NO: 16137 - DNA, 16 bp, Artificial Sequence
  Synthetic
cggcgcggcaaagtct

SEQ ID NO: 16138 - DNA, 16 bp, Artificial Sequence
  Synthetic
gcgaactcaacgccgc

SEQ ID NO: 16139 - DNA, 21 bp, Artificial Sequence
  Synthetic
gaaaagtaattcttggttgcc

SEQ ID NO: 16140 - DNA, 20 bp, Artificial Sequence
  Synthetic
ttccacataatgaagcggct

SEQ ID NO: 16141 - DNA, 20 bp, Artificial Sequence
  Synthetic
aaatcaaactgattgccgcc

SEQ ID NO: 16142 - DNA, 19 bp, Artificial Sequence
  Synthetic
tccgaaaaaggcctgaccg

SEQ ID NO: 16143 - DNA, 17 bp, Artificial Sequence
  Synthetic
tcgcggacgacgtttcc

SEQ ID NO: 16144 - DNA, 18 bp, Artificial Sequence
  Synthetic
catttgttgcaggcggga

SEQ ID NO: 16145 - DNA, 19 bp, Artificial Sequence
  Synthetic
gacggcacagtaaaggctg

SEQ ID NO: 16146 - DNA, 19 bp, Artificial Sequence
  Synthetic
gccttcgacgatttcggaa

SEQ ID NO: 16147 - DNA, 16 bp, Artificial Sequence
  Synthetic
cgccaaccgcaaccat

SEQ ID NO: 16148 - DNA, 16 bp, Artificial Sequence
  Synthetic
tccctgccgtccgcat

SEQ ID NO: 16149 - DNA, 17 bp, Artificial Sequence
  Synthetic
actggtggctgacccat

SEQ ID NO: 16150 - DNA, 18 bp, Artificial Sequence
  Synthetic
cccaatttcgcacaatgg

SEQ ID NO: 16151 - DNA, 16 bp, Artificial Sequence
  Synthetic
gctgatcggcgatgcg

SEQ ID NO: 16152 - DNA, 16 bp, Artificial Sequence
  Synthetic
ctgaccggcgttccct

SEQ ID NO: 16153 - DNA, 20 bp, Artificial Sequence
  Synthetic
cgaattgaacggcttatggc

SEQ ID NO: 16154 - DNA, 16 bp, Artificial Sequence
  Synthetic
tgaccgccctgacagg

SEQ ID NO: 16155 - DNA, 18 bp, Artificial Sequence
  Synthetic
aaccgaaaatgccgtctt

SEQ ID NO: 16156 - DNA, 18 bp, Artificial Sequence
  Synthetic
tcctcctcaaacccgacc

SEQ ID NO: 16157 - DNA, 16 bp, Artificial Sequence
  Synthetic
gccgcatccgcctaca

SEQ ID NO: 16158 - DNA, 20 bp, Artificial Sequence
  Synthetic
cggacggcaagaaataccgg

SEQ ID NO: 16159 - DNA, 19 bp, Artificial Sequence
  Synthetic
gatgcgctgtttgcacaaa

SEQ ID NO: 16160 - DNA, 15 bp, Artificial Sequence
  Synthetic
agcgcgtcccacctt

SEQ ID NO: 16161 - DNA, 19 bp, Artificial Sequence
  Synthetic
cctccatatacgccagccc

SEQ ID NO: 16162 - DNA, 17 bp, Artificial Sequence
  Synthetic
catgcccgacaacccca

SEQ ID NO: 16163 - DNA, 21 bp, Artificial Sequence
  Synthetic
aggtaatactgttcctctacc

SEQ ID NO: 16164 - DNA, 18 bp, Artificial Sequence
  Synthetic
ccgtaacggcgcattacg

SEQ ID NO: 16165 - DNA, 16 bp, Artificial Sequence
  Synthetic
gcaaggtcgtgcgcca

SEQ ID NO: 16166 - DNA, 20 bp, Artificial Sequence
  Synthetic
caaggcgatgtcctgatacg

SEQ ID NO: 16167 - DNA, 20 bp, Artificial Sequence
  Synthetic
atttgatgatgtgccagccg

SEQ ID NO: 16168 - DNA, 16 bp, Artificial Sequence
  Synthetic
tgcgaaatccgtgccg

SEQ ID NO: 16169 - DNA, 19 bp, Artificial Sequence
  Synthetic
atttcagcttcgctcacgc

SEQ ID NO: 16170 - DNA, 17 bp, Artificial Sequence
  Synthetic
ggataccgccctgctgt

SEQ ID NO: 16171 - DNA, 17 bp, Artificial Sequence
  Synthetic
tcgcccaacatttcggc

SEQ ID NO: 16172 - DNA, 17 bp, Artificial Sequence
  Synthetic
ttcggttctctcggggc

SEQ ID NO: 16173 - DNA, 20 bp, Artificial Sequence
  Synthetic
gcacactgatacccaaagca

SEQ ID NO: 16174 - DNA, 16 bp, Artificial Sequence
  Synthetic
cgcacttgccgcagaa

SEQ ID NO: 16175 - DNA, 18 bp, Artificial Sequence
  Synthetic
ctggcggtatgaacaggc

SEQ ID NO: 16176 - DNA, 16 bp, Artificial Sequence
  Synthetic
agaatccgcccgaccg

SEQ ID NO: 16177 - DNA, 16 bp, Artificial Sequence
  Synthetic
cgcgccccgatgaaac

SEQ ID NO: 16178 - DNA, 19 bp, Artificial Sequence
  Synthetic
ttcacgggcgcaaaacttc

SEQ ID NO: 16179 - DNA, 20 bp, Artificial Sequence
  Synthetic
acggctttgggcattttgtc

SEQ ID NO: 16180 - DNA, 16 bp, Artificial Sequence
  Synthetic
tcggcaaatacgcgcc

SEQ ID NO: 16181 - DNA, 19 bp, Artificial Sequence
  Synthetic
cgaagccgtctatgccaag

SEQ ID NO: 16182 - DNA, 19 bp, Artificial Sequence
  Synthetic
tttacgccaaactctgggc

SEQ ID NO: 16183 - DNA, 16 bp, Artificial Sequence
  Synthetic
gccgccgctacatcgt

SEQ ID NO: 16184 - DNA, 17 bp, Artificial Sequence
  Synthetic
cgcacgggattcgagga

SEQ ID NO: 16185 - DNA, 18 bp, Artificial Sequence
  Synthetic
ccgtccgacaacaccatc

SEQ ID NO: 16186 - DNA, 16 bp, Artificial Sequence
  Synthetic
tcccacacggcaagct

SEQ ID NO: 16187 - DNA, 18 bp, Artificial Sequence
  Synthetic
cagaaatcggagtcgggc

SEQ ID NO: 16188 - DNA, 18 bp, Artificial Sequence
  Synthetic
ggagagcgcccaatacca

SEQ ID NO: 16189 - DNA, 19 bp, Artificial Sequence
  Synthetic
cgacgtaaaccaccaccag

SEQ ID NO: 16190 - DNA, 20 bp, Artificial Sequence
  Synthetic
atgataaataccgacgccgc

SEQ ID NO: 16191 - DNA, 16 bp, Artificial Sequence
  Synthetic
ccgccgcctgtacgaa

SEQ ID NO: 16192 - DNA, 19 bp, Artificial Sequence
  Synthetic
caatgcgccgtctatgtgt

SEQ ID NO: 16193 - DNA, 20 bp, Artificial Sequence
  Synthetic
tcattatgggacaggtcgcc

SEQ ID NO: 16194 - DNA, 17 bp, Artificial Sequence
  Synthetic
gccctgctgattctgcc

SEQ ID NO: 16195 - DNA, 19 bp, Artificial Sequence
  Synthetic
gtgatgctcacccaccaaa

SEQ ID NO: 16196 - DNA, 20 bp, Artificial Sequence
  Synthetic
gagcttcagatgtgtagggc

SEQ ID NO: 16197 - DNA, 17 bp, Artificial Sequence
  Synthetic
cgacccgcgcaaattcc

SEQ ID NO: 16198 - DNA, 16 bp, Artificial Sequence
  Synthetic
catgcggcggtcagga

SEQ ID NO: 16199 - DNA, 16 bp, Artificial Sequence
  Synthetic
cagttcggcggacgca

SEQ ID NO: 16200 - DNA, 16 bp, Artificial Sequence
  Synthetic
cgtccgcggaaggctt

SEQ ID NO: 16201 - DNA, 16 bp, Artificial Sequence
  Synthetic
ccggacacgcccagtt

SEQ ID NO: 16202 - DNA, 19 bp, Artificial Sequence
  Synthetic
cgacgacggagttgagatg

SEQ ID NO: 16203 - DNA, 20 bp, Artificial Sequence
  Synthetic
catcatgaccgtcttgcacg

SEQ ID NO: 16204 - DNA, 18 bp, Artificial Sequence
  Synthetic
gatggtgtacgccatggc

SEQ ID NO: 16205 - DNA, 20 bp, Artificial Sequence
  Synthetic
ctacaaaaccaacgcctcca

SEQ ID NO: 16206 - DNA, 16 bp, Artificial Sequence
  Synthetic
cggcgggttggtgcaa

SEQ ID NO: 16207 - DNA, 18 bp, Artificial Sequence
  Synthetic
ttttcaatccggccggtg

SEQ ID NO: 16208 - DNA, 16 bp, Artificial Sequence
  Synthetic
gacggcgatgtcctgc

SEQ ID NO: 16209 - DNA, 17 bp, Artificial Sequence
  Synthetic
cgacagccgttttgccg

SEQ ID NO: 16210 - DNA, 19 bp, Artificial Sequence
  Synthetic
cgcaatccaagtcccatcc

SEQ ID NO: 16211 - DNA, 16 bp, Artificial Sequence
  Synthetic
cgacatccgcgcccaa

SEQ ID NO: 16212 - DNA, 20 bp, Artificial Sequence
  Synthetic
cggaaggcttattgaccacc

SEQ ID NO: 16213 - DNA, 18 bp, Artificial Sequence
  Synthetic
gggcaaactctcccgttt

SEQ ID NO: 16214 - DNA, 20 bp, Artificial Sequence
  Synthetic
aagcgatgaaggacaacacc

SEQ ID NO: 16215 - DNA, 16 bp, Artificial Sequence
  Synthetic
caccgcccgaaaccga

SEQ ID NO: 16216 - DNA, 16 bp, Artificial Sequence
  Synthetic
ccgcgcacgttttcgg

SEQ ID NO: 16217 - DNA, 18 bp, Artificial Sequence
  Synthetic
gcacaggaaatgccgtct

SEQ ID NO: 16218 - DNA, 19 bp, Artificial Sequence
  Synthetic
cacggcagttatcaggctg

SEQ ID NO: 16219 - DNA, 19 bp, Artificial Sequence
  Synthetic
cgcggagtttaaagcacgc

SEQ ID NO: 16220 - DNA, 19 bp, Artificial Sequence
  Synthetic
gaacaaatccgcgtgttcg

SEQ ID NO: 16221 - DNA, 17 bp, Artificial Sequence
  Synthetic
ttcctgcaccagctcga

SEQ ID NO: 16222 - DNA, 16 bp, Artificial Sequence
  Synthetic
tgccctgcggatccaa

SEQ ID NO: 16223 - DNA, 17 bp, Artificial Sequence
  Synthetic
acaacggcagcgaatgg

SEQ ID NO: 16224 - DNA, 18 bp, Artificial Sequence
  Synthetic
atgacgcgcgaacgtttg

SEQ ID NO: 16225 - DNA, 16 bp, Artificial Sequence
  Synthetic
tgctcctgaccaccgc

SEQ ID NO: 16226 - DNA, 16 bp, Artificial Sequence
  Synthetic
tggaagccctcgccga

SEQ ID NO: 16227 - DNA, 18 bp, Artificial Sequence
  Synthetic
caccatcggcgtgaaacc

SEQ ID NO: 16228 - DNA, 16 bp, Artificial Sequence
  Synthetic
cgctgctcgccgtgat

SEQ ID NO: 16229 - DNA, 18 bp, Artificial Sequence
  Synthetic
cgtgtcgaaggcttgcag

SEQ ID NO: 16230 - DNA, 19 bp, Artificial Sequence
  Synthetic
agcgtaaccataggcagct

SEQ ID NO: 16231 - DNA, 17 bp, Artificial Sequence
  Synthetic
tgatgaccgcgctgtcc

SEQ ID NO: 16232 - DNA, 19 bp, Artificial Sequence
  Synthetic
gattacccagcaaatgcgc

SEQ ID NO: 16233 - DNA, 16 bp, Artificial Sequence
  Synthetic
cgcccccatgtgcgat

SEQ ID NO: 16234 - DNA, 24 bp, Artificial Sequence
  Synthetic
ccaaatcttttgctttagtatcag

SEQ ID NO: 16235 - DNA, 20 bp, Artificial Sequence
  Synthetic
tcaattgtaccaatcaggct

SEQ ID NO: 16236 - DNA, 22 bp, Artificial Sequence
  Synthetic
ttagttttgcctttagtggtaa

SEQ ID NO: 16237 - DNA, 19 bp, Artificial Sequence
  Synthetic
ggcacaaaataagccgatt

SEQ ID NO: 16238 - DNA, 17 bp, Artificial Sequence
  Synthetic
gacggcattgcatcgcg

SEQ ID NO: 16239 - DNA, 20 bp, Artificial Sequence
  Synthetic
atcgtcttcaacaacgacca

SEQ ID NO: 16240 - DNA, 19 bp, Artificial Sequence
  Synthetic
gcccaaacctccatctcac

SEQ ID NO: 16241 - DNA, 16 bp, Artificial Sequence
  Synthetic
cccgcgcctgtaaacg

SEQ ID NO: 16242 - DNA, 18 bp, Artificial Sequence
  Synthetic
ttgctgtgggggttgtct

SEQ ID NO: 16243 - DNA, 18 bp, Artificial Sequence
  Synthetic
cgaaataacgccgctcca

SEQ ID NO: 16244 - DNA, 18 bp, Artificial Sequence
  Synthetic
gcggattgcggatttcgt

SEQ ID NO: 16245 - DNA, 18 bp, Artificial Sequence
  Synthetic
tactacacccgcacccat

SEQ ID NO: 16246 - DNA, 19 bp, Artificial Sequence
  Synthetic
ccccgtattgaccacgtcc

SEQ ID NO: 16247 - DNA, 17 bp, Artificial Sequence
  Synthetic
gcgatgtggcaaacgcg

SEQ ID NO: 16248 - DNA, 18 bp, Artificial Sequence
  Synthetic
cgtatggcgatgtaccgg

SEQ ID NO: 16249 - DNA, 16 bp, Artificial Sequence
  Synthetic
cagcgattggggcgtc

SEQ ID NO: 16250 - DNA, 18 bp, Artificial Sequence
  Synthetic
aattgatgacgggggaag

SEQ ID NO: 16251 - DNA, 16 bp, Artificial Sequence
  Synthetic
gcgtgcggcatcgact

SEQ ID NO: 16252 - DNA, 17 bp, Artificial Sequence
  Synthetic
agcgatttggcgagccg

SEQ ID NO: 16253 - DNA, 18 bp, Artificial Sequence
  Synthetic
aataaatcgacgcgccgg

SEQ ID NO: 16254 - DNA, 16 bp, Artificial Sequence
  Synthetic
tccaactcgcgcaggt

SEQ ID NO: 16255 - DNA, 18 bp, Artificial Sequence
  Synthetic
accgccgcgatacctatg

SEQ ID NO: 16256 - DNA, 18 bp, Artificial Sequence
  Synthetic
catcctcctgccggtttg

SEQ ID NO: 16257 - DNA, 18 bp, Artificial Sequence
  Synthetic
gaggtatttggggcgaaa

SEQ ID NO: 16258 - DNA, 19 bp, Artificial Sequence
  Synthetic
tttccgggtgtattcggca

SEQ ID NO: 16259 - DNA, 19 bp, Artificial Sequence
  Synthetic
ccggacacttggttttcgg

SEQ ID NO: 16260 - DNA, 17 bp, Artificial Sequence
  Synthetic
cgctatgcgccaatccc

SEQ ID NO: 16261 - DNA, 18 bp, Artificial Sequence
  Synthetic
cttcccgttttcgccagt

SEQ ID NO: 16262 - DNA, 18 bp, Artificial Sequence
  Synthetic
ctggctgaccaacccctt

SEQ ID NO: 16263 - DNA, 16 bp, Artificial Sequence
  Synthetic
gctgccgccaatcgct

SEQ ID NO: 16264 - DNA, 20 bp, Artificial Sequence
  Synthetic
accggcagcttcaaaaacac

SEQ ID NO: 16265 - DNA, 18 bp, Artificial Sequence
  Synthetic
gccaacccaactacaccg

SEQ ID NO: 16266 - DNA, 16 bp, Artificial Sequence
  Synthetic
cgacagcctgcaaccc

SEQ ID NO: 16267 - DNA, 17 bp, Artificial Sequence
  Synthetic
acatgggacccgacgac

SEQ ID NO: 16268 - DNA, 19 bp, Artificial Sequence
  Synthetic
ctaccctatagcccgcctt

SEQ ID NO: 16269 - DNA, 18 bp, Artificial Sequence
  Synthetic
cgctgacgctgatttccg

SEQ ID NO: 16270 - DNA, 16 bp, Artificial Sequence
  Synthetic
gcgcccaagcttcgac

SEQ ID NO: 16271 - DNA, 19 bp, Artificial Sequence
  Synthetic
gtcgttgccaaagcctttg

SEQ ID NO: 16272 - DNA, 18 bp, Artificial Sequence
  Synthetic
acataaacagcggcaggg

SEQ ID NO: 16273 - DNA, 18 bp, Artificial Sequence
  Synthetic
ctttggacggcgttacca

SEQ ID NO: 16274 - DNA, 18 bp, Artificial Sequence
  Synthetic
ggaaggttcgggcatcac

SEQ ID NO: 16275 - DNA, 17 bp, Artificial Sequence
  Synthetic
tagcgtgccgggcgtta

SEQ ID NO: 16276 - DNA, 18 bp, Artificial Sequence
  Synthetic
aactcgtccgtactttgg

SEQ ID NO: 16277 - DNA, 20 bp, Artificial Sequence
  Synthetic
aatgcaatgtttatctgcct

SEQ ID NO: 16278 - DNA, 20 bp, Artificial Sequence
  Synthetic
caaatgccttggaaaaacct

SEQ ID NO: 16279 - DNA, 18 bp, Artificial Sequence
  Synthetic
ttgttatggcttggggtg

SEQ ID NO: 16280 - DNA, 18 bp, Artificial Sequence
  Synthetic
aggttgacaagcccggtt

SEQ ID NO: 16281 - DNA, 17 bp, Artificial Sequence
  Synthetic
gttgccggaaaccgtca

SEQ ID NO: 16282 - DNA, 19 bp, Artificial Sequence
  Synthetic
ctgccggtaatgttttgcg

SEQ ID NO: 16283 - DNA, 20 bp, Artificial Sequence
  Synthetic
cgatgcggtcgttttgaaag

SEQ ID NO: 16284 - DNA, 16 bp, Artificial Sequence
  Synthetic
gtcaggccggcggtat

SEQ ID NO: 16285 - DNA, 16 bp, Artificial Sequence
  Synthetic
tcgatgcgcgaagggt

SEQ ID NO: 16286 - DNA, 18 bp, Artificial Sequence
  Synthetic
gtcgagcagtgtgccttt

SEQ ID NO: 16287 - DNA, 20 bp, Artificial Sequence
  Synthetic
ttgtccgcgtatgatgaacg

SEQ ID NO: 16288 - DNA, 18 bp, Artificial Sequence
  Synthetic
cgtttccaagaggcggtc

SEQ ID NO: 16289 - DNA, 16 bp, Artificial Sequence
  Synthetic
ccgtcaaaaccggccg

SEQ ID NO: 16290 - DNA, 18 bp, Artificial Sequence
  Synthetic
ttttacccctgcttcacg

SEQ ID NO: 16291 - DNA, 16 bp, Artificial Sequence
  Synthetic
cggcgtacggctcgaa

SEQ ID NO: 16292 - DNA, 16 bp, Artificial Sequence
  Synthetic
cgatgccgtgtccgca

SEQ ID NO: 16293 - DNA, 17 bp, Artificial Sequence
  Synthetic
tcttctgtgccgtccgg

SEQ ID NO: 16294 - DNA, 17 bp, Artificial Sequence
  Synthetic
caggtggcggttgtagc

SEQ ID NO: 16295 - DNA, 19 bp, Artificial Sequence
  Synthetic
cgatacagtcgcacatggc

SEQ ID NO: 16296 - DNA, 18 bp, Artificial Sequence
  Synthetic
cgacctcgacaccgacga

SEQ ID NO: 16297 - DNA, 19 bp, Artificial Sequence
  Synthetic
aactcaaagtcctcgccga

SEQ ID NO: 16298 - DNA, 19 bp, Artificial Sequence
  Synthetic
tccccggtctgattgaagg

SEQ ID NO: 16299 - DNA, 18 bp, Artificial Sequence
  Synthetic
gggctggacggacatgtg

SEQ ID NO: 16300 - DNA, 16 bp, Artificial Sequence
  Synthetic
gttcggctgcacccca

SEQ ID NO: 16301 - DNA, 18 bp, Artificial Sequence
  Synthetic
ccacttgggcgtgaatcg

SEQ ID NO: 16302 - DNA, 19 bp, Artificial Sequence
  Synthetic
cgcctttgacaaagttcgg

SEQ ID NO: 16303 - DNA, 18 bp, Artificial Sequence
  Synthetic
ttgccgcaacacgtatcg

SEQ ID NO: 16304 - DNA, 19 bp, Artificial Sequence
  Synthetic
cgagtgcctgatgttcagt

SEQ ID NO: 16305 - DNA, 16 bp, Artificial Sequence
  Synthetic
agggcgaacagacggt

SEQ ID NO: 16306 - DNA, 17 bp, Artificial Sequence
  Synthetic
gggaaaacgcccaagcc

SEQ ID NO: 16307 - DNA, 16 bp, Artificial Sequence
  Synthetic
aatcggggtcggcagg

SEQ ID NO: 16308 - DNA, 17 bp, Artificial Sequence
  Synthetic
attcgacggccagtgcg

SEQ ID NO: 16309 - DNA, 19 bp, Artificial Sequence
  Synthetic
ggcggtgggcatttgtttg

SEQ ID NO: 16310 - DNA, 17 bp, Artificial Sequence
  Synthetic
gtgtaaacccgcgccac

SEQ ID NO: 16311 - DNA, 20 bp, Artificial Sequence
  Synthetic
actcgctggataatggcttg

SEQ ID NO: 16312 - DNA, 16 bp, Artificial Sequence
  Synthetic
agcgttgccgtcaggg

SEQ ID NO: 16313 - DNA, 15 bp, Artificial Sequence
  Synthetic
aaagcagggccgcca

SEQ ID NO: 16314 - DNA, 16 bp, Artificial Sequence
  Synthetic
ccgatccgcgcatcgt

SEQ ID NO: 16315 - DNA, 16 bp, Artificial Sequence
  Synthetic
cgcaagccggcaaact

SEQ ID NO: 16316 - DNA, 20 bp, Artificial Sequence
  Synthetic
ggcaaaaaccaaggctttga

SEQ ID NO: 16317 - DNA, 18 bp, Artificial Sequence
  Synthetic
cgaccgggcatattcagc

SEQ ID NO: 16318 - DNA, 16 bp, Artificial Sequence
  Synthetic
gcttttcgccgcttgc

SEQ ID NO: 16319 - DNA, 16 bp, Artificial Sequence
  Synthetic
gcgcggcaggtcgaaa

SEQ ID NO: 16320 - DNA, 20 bp, Artificial Sequence
  Synthetic
aaactttaccgcgaactgcc

SEQ ID NO: 16321 - DNA, 19 bp, Artificial Sequence
  Synthetic
gcaaggcgaagtcatcacc

SEQ ID NO: 16322 - DNA, 16 bp, Artificial Sequence
  Synthetic
tgctcaaacgcctgcg

SEQ ID NO: 16323 - DNA, 19 bp, Artificial Sequence
  Synthetic
cgtgaaaacaaacgcggac

SEQ ID NO: 16324 - DNA, 18 bp, Artificial Sequence
  Synthetic
actggccgaaatcacccg

SEQ ID NO: 16325 - DNA, 16 bp, Artificial Sequence
  Synthetic
cgcagcagcctttcgc

SEQ ID NO: 16326 - DNA, 17 bp, Artificial Sequence
  Synthetic
ccatttgggctgctcgc

SEQ ID NO: 16327 - DNA, 20 bp, Artificial Sequence
  Synthetic
ttgttctttgcccctgaagg

SEQ ID NO: 16328 - DNA, 18 bp, Artificial Sequence
  Synthetic
tgaaaagcctgaatccgt

SEQ ID NO: 16329 - DNA, 18 bp, Artificial Sequence
  Synthetic
gccgcctttaccgaatgc

SEQ ID NO: 16330 - DNA, 17 bp, Artificial Sequence
  Synthetic
ttggacgaagccgcagc

SEQ ID NO: 16331 - DNA, 17 bp, Artificial Sequence
  Synthetic
gccatccgtgaagcagc

SEQ ID NO: 16332 - DNA, 20 bp, Artificial Sequence
  Synthetic
tcatcacctacaaactcgcc

SEQ ID NO: 16333 - DNA, 17 bp, Artificial Sequence
  Synthetic
caggttgacggcaggtg

SEQ ID NO: 16334 - DNA, 20 bp, Artificial Sequence
  Synthetic
taatcgcgtccagattgagg

SEQ ID NO: 16335 - DNA, 17 bp, Artificial Sequence
  Synthetic
cctttttcgcgtgccgc

SEQ ID NO: 16336 - DNA, 18 bp, Artificial Sequence
  Synthetic
tgcccttgattgccgttg

SEQ ID NO: 16337 - DNA, 16 bp, Artificial Sequence
  Synthetic
aaggcttgggcgcaca

SEQ ID NO: 16338 - DNA, 19 bp, Artificial Sequence
  Synthetic
atggccttggtcggtatgg

SEQ ID NO: 16339 - DNA, 17 bp, Artificial Sequence
  Synthetic
cgaacatcggcggtctg

SEQ ID NO: 16340 - DNA, 19 bp, Artificial Sequence
  Synthetic
gaaccggtatcgaaatcgt

SEQ ID NO: 16341 - DNA, 20 bp, Artificial Sequence
  Synthetic
ttcctttctttgcgatgcct

SEQ ID NO: 16342 - DNA, 16 bp, Artificial Sequence
  Synthetic
cgccggcagaagcgtt

SEQ ID NO: 16343 - DNA, 20 bp, Artificial Sequence
  Synthetic
gacaaaaccaaattcccgcc

SEQ ID NO: 16344 - DNA, 16 bp, Artificial Sequence
  Synthetic
cgtgcctgttccggca

SEQ ID NO: 16345 - DNA, 17 bp, Artificial Sequence
  Synthetic
ggtaactgtgcgcctgc

SEQ ID NO: 16346 - DNA, 16 bp, Artificial Sequence
  Synthetic
gcgagcgtttcccagc

SEQ ID NO: 16347 - DNA, 18 bp, Artificial Sequence
  Synthetic
gcactaccgctggacgta

SEQ ID NO: 16348 - DNA, 16 bp, Artificial Sequence
  Synthetic
cggcgttcgtgtcggt

SEQ ID NO: 16349 - DNA, 20 bp, Artificial Sequence
  Synthetic
gatttcctcgaccttgcctt

SEQ ID NO: 16350 - DNA, 19 bp, Artificial Sequence
  Synthetic
agggttcgtacagggatgc

SEQ ID NO: 16351 - DNA, 18 bp, Artificial Sequence
  Synthetic
cgccgcatcatatgggaa

SEQ ID NO: 16352 - DNA, 16 bp, Artificial Sequence
  Synthetic
ccaagcgtgcggatgc

SEQ ID NO: 16353 - DNA, 15 bp, Artificial Sequence
  Synthetic
ccggttgcgcgcaaa

SEQ ID NO: 16354 - DNA, 20 bp, Artificial Sequence
  Synthetic
ttggaaatggaaaacccgcg

SEQ ID NO: 16355 - DNA, 18 bp, Artificial Sequence
  Synthetic
aggttgatgtcttgcggc

SEQ ID NO: 16356 - DNA, 19 bp, Artificial Sequence
  Synthetic
cttcatcggtcagcggaat

SEQ ID NO: 16357 - DNA, 17 bp, Artificial Sequence
  Synthetic
atgctgtcggcgagtgc

SEQ ID NO: 16358 - DNA, 16 bp, Artificial Sequence
  Synthetic
ggtcgctgtctcgcgt

SEQ ID NO: 16359 - DNA, 16 bp, Artificial Sequence
  Synthetic
aatcgggcccggatgg

SEQ ID NO: 16360 - DNA, 16 bp, Artificial Sequence
  Synthetic
gcactgccgccggatt

SEQ ID NO: 16361 - DNA, 16 bp, Artificial Sequence
  Synthetic
gcaccaaaatgccgcg

SEQ ID NO: 16362 - DNA, 23 bp, Artificial Sequence
  Synthetic
ggctttaattgacgattatcttg

SEQ ID NO: 16363 - DNA, 17 bp, Artificial Sequence
  Synthetic
ccgtccggttcaaaccc

SEQ ID NO: 16364 - DNA, 17 bp, Artificial Sequence
  Synthetic
attgtgcggcggaaacc

SEQ ID NO: 16365 - DNA, 17 bp, Artificial Sequence
  Synthetic
cgttcggctttggtgcc

SEQ ID NO: 16366 - DNA, 17 bp, Artificial Sequence
  Synthetic
aggctccggcgaatacg

SEQ ID NO: 16367 - DNA, 19 bp, Artificial Sequence
  Synthetic
cctgccctatctggtagcg

SEQ ID NO: 16368 - DNA, 20 bp, Artificial Sequence
  Synthetic
cgccggctttgtttatgttg

SEQ ID NO: 16369 - DNA, 16 bp, Artificial Sequence
  Synthetic
cgtttgaggcgcgggt

SEQ ID NO: 16370 - DNA, 18 bp, Artificial Sequence
  Synthetic
ttccgccgactattccca

SEQ ID NO: 16371 - DNA, 18 bp, Artificial Sequence
  Synthetic
gcggcggattttgcctct

SEQ ID NO: 16372 - DNA, 17 bp, Artificial Sequence
  Synthetic
aaacaggatgccgacgc

SEQ ID NO: 16373 - DNA, 20 bp, Artificial Sequence
  Synthetic
aacaagtgcagatgcttggt

SEQ ID NO: 16374 - DNA, 19 bp, Artificial Sequence
  Synthetic
ttcgttgaggaatcgggct

SEQ ID NO: 16375 - DNA, 18 bp, Artificial Sequence
  Synthetic
tgcctgaaacaatgccgt

SEQ ID NO: 16376 - DNA, 16 bp, Artificial Sequence
  Synthetic
cgaggtcgttgcgcag

SEQ ID NO: 16377 - DNA, 17 bp, Artificial Sequence
  Synthetic
tttggcggatgcggtcg

SEQ ID NO: 16378 - DNA, 18 bp, Artificial Sequence
  Synthetic
cgccgcaaaccaatttcg

SEQ ID NO: 16379 - DNA, 19 bp, Artificial Sequence
  Synthetic
catccgatacagccgtccc

SEQ ID NO: 16380 - DNA, 16 bp, Artificial Sequence
  Synthetic
cccgcctgccaaaacc

SEQ ID NO: 16381 - DNA, 20 bp, Artificial Sequence
  Synthetic
tacccggaaaaacatacgcg

SEQ ID NO: 16382 - DNA, 15 bp, Artificial Sequence
  Synthetic
ttgcggtcggtgcgt

SEQ ID NO: 16383 - DNA, 18 bp, Artificial Sequence
  Synthetic
aacagggcatattcgcgc

SEQ ID NO: 16384 - DNA, 17 bp, Artificial Sequence
  Synthetic
cggcaggcatgataggc

SEQ ID NO: 16385 - DNA, 19 bp, Artificial Sequence
  Synthetic
ccatttccgttacccgctt

SEQ ID NO: 16386 - DNA, 18 bp, Artificial Sequence
  Synthetic
gtcgtcgcttcgtttgcc

SEQ ID NO: 16387 - DNA, 17 bp, Artificial Sequence
  Synthetic
gcaaaattgccgccgcc

SEQ ID NO: 16388 - DNA, 19 bp, Artificial Sequence
  Synthetic
gccgtcgccgtattcaaac

SEQ ID NO: 16389 - DNA, 17 bp, Artificial Sequence
  Synthetic
atggcgaacgggtttgc

SEQ ID NO: 16390 - DNA, 18 bp, Artificial Sequence
  Synthetic
cgcaaggaagacggttcg

SEQ ID NO: 16391 - DNA, 18 bp, Artificial Sequence
  Synthetic
gaatgtttgttgcgccgg

SEQ ID NO: 16392 - DNA, 16 bp, Artificial Sequence
  Synthetic
gcgtcgccgaatctgc

SEQ ID NO: 16393 - DNA, 18 bp, Artificial Sequence
  Synthetic
ttgtccaatgcgctggtg

SEQ ID NO: 16394 - DNA, 15 bp, Artificial Sequence
  Synthetic
cgcgagcgtgccttt

SEQ ID NO: 16395 - DNA, 18 bp, Artificial Sequence
  Synthetic
ggtggaaaggatgtcggc

SEQ ID NO: 16396 - DNA, 19 bp, Artificial Sequence
  Synthetic
ctgcaatgggaaggaacgg

SEQ ID NO: 16397 - DNA, 18 bp, Artificial Sequence
  Synthetic
cttgcgtgcagagtaccg

SEQ ID NO: 16398 - DNA, 22 bp, Artificial Sequence
  Synthetic
ttgtagctactttgatattccg

SEQ ID NO: 16399 - DNA, 19 bp, Artificial Sequence
  Synthetic
ttatgcaacgaaagcttgt

SEQ ID NO: 16400 - DNA, 18 bp, Artificial Sequence
  Synthetic
aaaaggaccgtctgttgc

SEQ ID NO: 16401 - DNA, 18 bp, Artificial Sequence
  Synthetic
agaagtgttcctgcagct

SEQ ID NO: 16402 - DNA, 21 bp, Artificial Sequence
  Synthetic
atcatataccagcaacaaggg

SEQ ID NO: 16403 - DNA, 21 bp, Artificial Sequence
  Synthetic
tgggaaagttgattatgatgg

SEQ ID NO: 16404 - DNA, 18 bp, Artificial Sequence
  Synthetic
ctagggatccggccatag

SEQ ID NO: 16405 - DNA, 22 bp, Artificial Sequence
  Synthetic
tattccactagaacctataggc

SEQ ID NO: 16406 - DNA, 20 bp, Artificial Sequence
  Synthetic
gccacctgtacaaagtactc

SEQ ID NO: 16407 - DNA, 23 bp, Artificial Sequence
  Synthetic
ttttctgacgaatctttattgga

SEQ ID NO: 16408 - DNA, 21 bp, Artificial Sequence
  Synthetic
gttttgcgtttacagttacct

SEQ ID NO: 16409 - DNA, 18 bp, Artificial Sequence
  Synthetic
tggccagattttgtgcag

SEQ ID NO: 16410 - DNA, 23 bp, Artificial Sequence
  Synthetic
ttggaagtagaaatagtaatgca

SEQ ID NO: 16411 - DNA, 22 bp, Artificial Sequence
  Synthetic
caatgttaagctgtgaaacttg

SEQ ID NO: 16412 - DNA, 18 bp, Artificial Sequence
  Synthetic
cgacaatgcttcaatccg

SEQ ID NO: 16413 - DNA, 20 bp, Artificial Sequence
  Synthetic
gcctggacagtagtaaacag

SEQ ID NO: 16414 - DNA, 23 bp, Artificial Sequence
  Synthetic
attgaaccttttctgaaaacaac

SEQ ID NO: 16415 - DNA, 18 bp, Artificial Sequence
  Synthetic
aagcaagtactggcggaa

SEQ ID NO: 16416 - DNA, 19 bp, Artificial Sequence
  Synthetic
ctggatagagctcgatgag

SEQ ID NO: 16417 - DNA, 23 bp, Artificial Sequence
  Synthetic
atggtttcatcataaaaggaaga

SEQ ID NO: 16418 - DNA, 20 bp, Artificial Sequence
  Synthetic
ctccttcagtcactacaaca

SEQ ID NO: 16419 - DNA, 17 bp, Artificial Sequence
  Synthetic
ggaggaagccacacgga

SEQ ID NO: 16420 - DNA, 19 bp, Artificial Sequence
  Synthetic
cggaccccctttcaaagtg

SEQ ID NO: 16421 - DNA, 20 bp, Artificial Sequence
  Synthetic
tagcttcccagagagaagcg

SEQ ID NO: 16422 - DNA, 20 bp, Artificial Sequence
  Synthetic
ttccccttatgtccagtccc

SEQ ID NO: 16423 - DNA, 19 bp, Artificial Sequence
  Synthetic
gttctcgagggccttcctt

SEQ ID NO: 16424 - DNA, 22 bp, Artificial Sequence
  Synthetic
cgaaaccggtacatataaaagt

SEQ ID NO: 16425 - DNA, 20 bp, Artificial Sequence
  Synthetic
tatggtgcaacattagaagc

SEQ ID NO: 16426 - DNA, 25 bp, Artificial Sequence
  Synthetic
attgaagatgtaatactagatctgg

SEQ ID NO: 16427 - DNA, 18 bp, Artificial Sequence
  Synthetic
cttggtgtgccatcagtg

SEQ ID NO: 16428 - DNA, 19 bp, Artificial Sequence
  Synthetic
taacccaggcattgtttca

SEQ ID NO: 16429 - DNA, 21 bp, Artificial Sequence
  Synthetic
caatgggaatcctgtatatgc

SEQ ID NO: 16430 - DNA, 18 bp, Artificial Sequence
  Synthetic
gtggtgccctctactgtt

SEQ ID NO: 16431 - DNA, 21 bp, Artificial Sequence
  Synthetic
taaaggtactggagatgttga

SEQ ID NO: 16432 - DNA, 18 bp, Artificial Sequence
  Synthetic
ggcaccaaggaaaccgag

SEQ ID NO: 16433 - DNA, 18 bp, Artificial Sequence
  Synthetic
ctgtgggtcctacagaac

SEQ ID NO: 16434 - DNA, 20 bp, Artificial Sequence
  Synthetic
cagtagtactgtagcacctg

SEQ ID NO: 16435 - DNA, 21 bp, Artificial Sequence
  Synthetic
atatgcagaccctgatacagt

SEQ ID NO: 16436 - DNA, 25 bp, Artificial Sequence
  Synthetic
catggggataattattatttatggc

SEQ ID NO: 16437 - DNA, 21 bp, Artificial Sequence
  Synthetic
cgaaattcctaaggtatctgc

SEQ ID NO: 16438 - DNA, 25 bp, Artificial Sequence
  Synthetic
cagttatgtattataggttgtacac

SEQ ID NO: 16439 - DNA, 22 bp, Artificial Sequence
  Synthetic
acagcatgtttttttttcttcg

SEQ ID NO: 16440 - DNA, 22 bp, Artificial Sequence
  Synthetic
aacgcaaaaaacgtaaacttac

SEQ ID NO: 16441 - DNA, 16 bp, Artificial Sequence
  Synthetic
tggagcacccccccta

SEQ ID NO: 16442 - DNA, 20 bp, Artificial Sequence
  Synthetic
gcaagcccacctatatgtgt

SEQ ID NO: 16443 - DNA, 18 bp, Artificial Sequence
  Synthetic
tctagtaggcccgctggt

SEQ ID NO: 16444 - DNA, 20 bp, Artificial Sequence
  Synthetic
ttgttctccttccacttgcc

SEQ ID NO: 16445 - DNA, 20 bp, Artificial Sequence
  Synthetic
tttgttacagtccaaagtgg

SEQ ID NO: 16446 - DNA, 21 bp, Artificial Sequence
  Synthetic
tcaggccatttgtattttgag

SEQ ID NO: 16447 - DNA, 18 bp, Artificial Sequence
  Synthetic
gtcaccgcatagctctgc

SEQ ID NO: 16448 - DNA, 18 bp, Artificial Sequence
  Synthetic
cgctggtgactttctgtg

SEQ ID NO: 16449 - DNA, 19 bp, Artificial Sequence
  Synthetic
cacggttgatggtttgccc

SEQ ID NO: 16450 - DNA, 20 bp, Artificial Sequence
  Synthetic
acacccaataaccgttgacg

SEQ ID NO: 16451 - DNA, 20 bp, Artificial Sequence
  Synthetic
gccactcttgatacaaaacc

SEQ ID NO: 16452 - DNA, 18 bp, Artificial Sequence
  Synthetic
gtcctaaccgaagctcca

SEQ ID NO: 16453 - DNA, 19 bp, Artificial Sequence
  Synthetic
acattgttgaagccttcga

SEQ ID NO: 16454 - DNA, 21 bp, Artificial Sequence
  Synthetic
gagtacaatcaccacaactag

SEQ ID NO: 16455 - DNA, 18 bp, Artificial Sequence
  Synthetic
ttgacatgctaggcggct

SEQ ID NO: 16456 - DNA, 22 bp, Artificial Sequence
  Synthetic
acttgttcaaattactggagag

SEQ ID NO: 16457 - DNA, 19 bp, Artificial Sequence
  Synthetic
tcatgtcctgaaagcctgc

SEQ ID NO: 16458 - DNA, 20 bp, Artificial Sequence
  Synthetic
tgggaaagagtgagttttcg

SEQ ID NO: 16459 - DNA, 20 bp, Artificial Sequence
  Synthetic
gctaagtcccacatcactgg

SEQ ID NO: 16460 - DNA, 19 bp, Artificial Sequence
  Synthetic
tgttgtcgatgtggtcacc

SEQ ID NO: 16461 - DNA, 18 bp, Artificial Sequence
  Synthetic
cgaacaggctggcatgaa

SEQ ID NO: 16462 - DNA, 20 bp, Artificial Sequence
  Synthetic
ttgaggacaaacttcccgag

SEQ ID NO: 16463 - DNA, 18 bp, Artificial Sequence
  Synthetic
cttctctggcatgctaca

SEQ ID NO: 16464 - DNA, 18 bp, Artificial Sequence
  Synthetic
gggagaccccgggcttaa

SEQ ID NO: 16465 - DNA, 21 bp, Artificial Sequence
  Synthetic
tctgtttctctcaccatttcc

SEQ ID NO: 16466 - DNA, 20 bp, Artificial Sequence
  Synthetic
tacagaaattggtcaaagcc

SEQ ID NO: 16467 - DNA, 18 bp, Artificial Sequence
  Synthetic
caagtgtgcatagcatgg

SEQ ID NO: 16468 - DNA, 23 bp, Artificial Sequence
  Synthetic
ggaaaatcattcatactagcaca

SEQ ID NO: 16469 - DNA, 22 bp, Artificial Sequence
  Synthetic
cattgcttggatcctaacaatg

SEQ ID NO: 16470 - DNA, 23 bp, Artificial Sequence
  Synthetic
ttgaattgtcttattgttcgttg

SEQ ID NO: 16471 - DNA, 22 bp, Artificial Sequence
  Synthetic
attatattgggttgacacctgt

SEQ ID NO: 16472 - DNA, 25 bp, Artificial Sequence
  Synthetic
atatatttgaagagagtacagatgg

SEQ ID NO: 16473 - DNA, 22 bp, Artificial Sequence
  Synthetic
aaaagacgattatttcaggaca

SEQ ID NO: 16474 - DNA, 25 bp, Artificial Sequence
  Synthetic
aggtaaagtcatttctttcatgaac

SEQ ID NO: 16475 - DNA, 18 bp, Artificial Sequence
  Synthetic
tcgcagactccagccaag

SEQ ID NO: 16476 - DNA, 18 bp, Artificial Sequence
  Synthetic
gaatctgctgtcccgtct

SEQ ID NO: 16477 - DNA, 18 bp, Artificial Sequence
  Synthetic
tggattgggaattggcac

SEQ ID NO: 16478 - DNA, 20 bp, Artificial Sequence
  Synthetic
cttttccgatgatgtcactt

SEQ ID NO: 16479 - DNA, 18 bp, Artificial Sequence
  Synthetic
accgttaggggttggaac

SEQ ID NO: 16480 - DNA, 23 bp, Artificial Sequence
  Synthetic
aatacaagatggtgatatgtgtg

SEQ ID NO: 16481 - DNA, 18 bp, Artificial Sequence
  Synthetic
cagagctgtcaaccgttt

SEQ ID NO: 16482 - DNA, 18 bp, Artificial Sequence
  Synthetic
caacccttcttgtgacct

SEQ ID NO: 16483 - DNA, 20 bp, Artificial Sequence
  Synthetic
caaaagagcggtttttaccc

SEQ ID NO: 16484 - DNA, 18 bp, Artificial Sequence
  Synthetic
ggccaaacattgcgagta

SEQ ID NO: 16485 - DNA, 19 bp, Artificial Sequence
  Synthetic
agaggactatttggagcca

SEQ ID NO: 16486 - DNA, 23 bp, Artificial Sequence
  Synthetic
agattgatgaccaaatacaagac

SEQ ID NO: 16487 - DNA, 20 bp, Artificial Sequence
  Synthetic
atgagtgtcgaacagcctcc

SEQ ID NO: 16488 - DNA, 17 bp, Artificial Sequence
  Synthetic
gcccacaggacgtcaag

SEQ ID NO: 16489 - DNA, 17 bp, Artificial Sequence
  Synthetic
tgccctgtgtcctggaa

SEQ ID NO: 16490 - DNA, 20 bp, Artificial Sequence
  Synthetic
ctgggccaaggttatactgg

SEQ ID NO: 16491 - DNA, 20 bp, Artificial Sequence
  Synthetic
tcaactcttctgggtgtcca

SEQ ID NO: 16492 - DNA, 18 bp, Artificial Sequence
  Synthetic
taacattaggccccccgc

SEQ ID NO: 16493 - DNA, 20 bp, Artificial Sequence
  Synthetic
aattggacctatggtgagcg

SEQ ID NO: 16494 - DNA, 20 bp, Artificial Sequence
  Synthetic
gaagcaacctgcaagaacgt

SEQ ID NO: 16495 - DNA, 20 bp, Artificial Sequence
  Synthetic
tttcatagcccgagtggagg

SEQ ID NO: 16496 - DNA, 18 bp, Artificial Sequence
  Synthetic
tgaaggattgggcagcgt

SEQ ID NO: 16497 - DNA, 20 bp, Artificial Sequence
  Synthetic
aggtgcagttcttatccacg

SEQ ID NO: 16498 - DNA, 20 bp, Artificial Sequence
  Synthetic
ttacctcaagggttcctcgg

SEQ ID NO: 16499 - DNA, 16 bp, Artificial Sequence
  Synthetic
gttcgggttcggggca

SEQ ID NO: 16500 - DNA, 19 bp, Artificial Sequence
  Synthetic
taaagggcggtaggcatct

SEQ ID NO: 16501 - DNA, 20 bp, Artificial Sequence
  Synthetic
gagactactacagtgcccca

SEQ ID NO: 16502 - DNA, 20 bp, Artificial Sequence
  Synthetic
ccagctgggatacaatgtgg

SEQ ID NO: 16503 - DNA, 18 bp, Artificial Sequence
  Synthetic
accttgccgggtaatccc

SEQ ID NO: 16504 - DNA, 20 bp, Artificial Sequence
  Synthetic
tcaatactctgccctggagc

SEQ ID NO: 16505 - DNA, 19 bp, Artificial Sequence
  Synthetic
cggcactgacagacttcaa

SEQ ID NO: 16506 - DNA, 20 bp, Artificial Sequence
  Synthetic
acaatctgaagtgtccctgc

SEQ ID NO: 16507 - DNA, 18 bp, Artificial Sequence
  Synthetic
tctccaccctctctggca

SEQ ID NO: 16508 - DNA, 17 bp, Artificial Sequence
  Synthetic
gacttggaagcgaccgg

SEQ ID NO: 16509 - DNA, 18 bp, Artificial Sequence
  Synthetic
cagggtcatggtcaaccg

SEQ ID NO: 16510 - DNA, 19 bp, Artificial Sequence
  Synthetic
ccctagaggaagcctgtgg

SEQ ID NO: 16511 - DNA, 20 bp, Artificial Sequence
  Synthetic
gctttagcctcctgtagagc

SEQ ID NO: 16512 - DNA, 20 bp, Artificial Sequence
  Synthetic
cggttaattcctggctaggg

SEQ ID NO: 16513 - DNA, 18 bp, Artificial Sequence
  Synthetic
ttggagacatcgggctcg

SEQ ID NO: 16514 - DNA, 23 bp, Artificial Sequence
  Synthetic
cttgtagatctgttctctaaacg

SEQ ID NO: 16515 - DNA, 20 bp, Artificial Sequence
  Synthetic
ggttagagacgtgctagtgc

SEQ ID NO: 16516 - DNA, 20 bp, Artificial Sequence
  Synthetic
gagtgccaagaaatttgaca

SEQ ID NO: 16517 - DNA, 18 bp, Artificial Sequence
  Synthetic
gcaagggaggtaggacta

SEQ ID NO: 16518 - DNA, 18 bp, Artificial Sequence
  Synthetic
attgttgagtcctgcggt

SEQ ID NO: 16519 - DNA, 21 bp, Artificial Sequence
  Synthetic
gacgccatggtttatacttca

SEQ ID NO: 16520 - DNA, 19 bp, Artificial Sequence
  Synthetic
ttgttaacaaggcactcga

SEQ ID NO: 16521 - DNA, 19 bp, Artificial Sequence
  Synthetic
accagtctgtgtaaatggc

SEQ ID NO: 16522 - DNA, 25 bp, Artificial Sequence
  Synthetic
acttttcatcacgtatgtattgttc

SEQ ID NO: 16523 - DNA, 21 bp, Artificial Sequence
  Synthetic
tgtgttgacatcgttaaggag

SEQ ID NO: 16524 - DNA, 20 bp, Artificial Sequence
  Synthetic
tcacaggacatcttacttgc

SEQ ID NO: 16525 - DNA, 20 bp, Artificial Sequence
  Synthetic
gaacatgcttagaggtgaag

SEQ ID NO: 16526 - DNA, 22 bp, Artificial Sequence
  Synthetic
aactgtatcctggaatttgaga

SEQ ID NO: 16527 - DNA, 20 bp, Artificial Sequence
  Synthetic
ccgtagtgtcagtatcatca

SEQ ID NO: 16528 - DNA, 23 bp, Artificial Sequence
  Synthetic
atgtaaatcatgagggtaagact

SEQ ID NO: 16529 - DNA, 21 bp, Artificial Sequence
  Synthetic
catgctaatttggaatctgca

SEQ ID NO: 16530 - DNA, 21 bp, Artificial Sequence
  Synthetic
taaggagaccctctatcgtat

SEQ ID NO: 16531 - DNA, 18 bp, Artificial Sequence
  Synthetic
caaagccagcttcacgag

SEQ ID NO: 16532 - DNA, 22 bp, Artificial Sequence
  Synthetic
accatacagaaggaagtcatag

SEQ ID NO: 16533 - DNA, 21 bp, Artificial Sequence
  Synthetic
gctccttcttattgtaatggc

SEQ ID NO: 16534 - DNA, 18 bp, Artificial Sequence
  Synthetic
tcttggctcatgtggttt

SEQ ID NO: 16535 - DNA, 21 bp, Artificial Sequence
  Synthetic
tcattagtgatgaagttgctc

SEQ ID NO: 16536 - DNA, 22 bp, Artificial Sequence
  Synthetic
gtttccgttaagatgtttgatg

SEQ ID NO: 16537 - DNA, 20 bp, Artificial Sequence
  Synthetic
catatcaatgcccaagtagc

SEQ ID NO: 16538 - DNA, 21 bp, Artificial Sequence
  Synthetic
aaatcattggttacaaagcca

SEQ ID NO: 16539 - DNA, 18 bp, Artificial Sequence
  Synthetic
gctatgggcaaacctgtg

SEQ ID NO: 16540 - DNA, 19 bp, Artificial Sequence
  Synthetic
ttactcctcttgtgcaacc

SEQ ID NO: 16541 - DNA, 22 bp, Artificial Sequence
  Synthetic
gttacatttagtaccttcgagg

SEQ ID NO: 16542 - DNA, 20 bp, Artificial Sequence
  Synthetic
gctgatgttctctaccaacc

SEQ ID NO: 16543 - DNA, 21 bp, Artificial Sequence
  Synthetic
aaaattgtctgcttaggctta

SEQ ID NO: 16544 - DNA, 22 bp, Artificial Sequence
  Synthetic
agattcaccactactttgaatg

SEQ ID NO: 16545 - DNA, 24 bp, Artificial Sequence
  Synthetic
catcattggatgcttttaactttc

SEQ ID NO: 16546 - DNA, 25 bp, Artificial Sequence
  Synthetic
tctactatggtaatgctttagatca

SEQ ID NO: 16547 - DNA, 18 bp, Artificial Sequence
  Synthetic
atatgaactcccaggggc

SEQ ID NO: 16548 - DNA, 22 bp, Artificial Sequence
  Synthetic
agaagatggtttctcttttgtc

SEQ ID NO: 16549 - DNA, 19 bp, Artificial Sequence
  Synthetic
caggctatgacccaaatgt

SEQ ID NO: 16550 - DNA, 21 bp, Artificial Sequence
  Synthetic
ttggcctcttattgttacagc

SEQ ID NO: 16551 - DNA, 18 bp, Artificial Sequence
  Synthetic
tatggtgctgggcagttt

SEQ ID NO: 16552 - DNA, 23 bp, Artificial Sequence
  Synthetic
taaaggattctgtgacttgaaag

SEQ ID NO: 16553 - DNA, 23 bp, Artificial Sequence
  Synthetic
ataacttggttaaagattgtcca

SEQ ID NO: 16554 - DNA, 24 bp, Artificial Sequence
  Synthetic
tgtacgccaatcattattaaagac

SEQ ID NO: 16555 - DNA, 23 bp, Artificial Sequence
  Synthetic
tctcttcgaccgttattttaaat

SEQ ID NO: 16556 - DNA, 22 bp, Artificial Sequence
  Synthetic
tattgctagataaacgcactac

SEQ ID NO: 16557 - DNA, 25 bp, Artificial Sequence
  Synthetic
aactcaaatgaatcttaagtatgcc

SEQ ID NO: 16558 - DNA, 20 bp, Artificial Sequence
  Synthetic
gttcttgctcgcaaacataa

SEQ ID NO: 16559 - DNA, 21 bp, Artificial Sequence
  Synthetic
atcatgaattcgtggatgagt

SEQ ID NO: 16560 - DNA, 22 bp, Artificial Sequence
  Synthetic
acttatgattgaaaggttcgtg

SEQ ID NO: 16561 - DNA, 20 bp, Artificial Sequence
  Synthetic
gaccattcctatgttgcaag

SEQ ID NO: 16562 - DNA, 20 bp, Artificial Sequence
  Synthetic
ccaacacttgtactgagaga

SEQ ID NO: 16563 - DNA, 21 bp, Artificial Sequence
  Synthetic
cttagtgcacctactctagtg

SEQ ID NO: 16564 - DNA, 19 bp, Artificial Sequence
  Synthetic
atgcattgccagaaacaac

SEQ ID NO: 16565 - DNA, 22 bp, Artificial Sequence
  Synthetic
aaaagcacacaaggataagtca

SEQ ID NO: 16566 - DNA, 22 bp, Artificial Sequence
  Synthetic
cattttgtgcataatgtctgat

SEQ ID NO: 16567 - DNA, 24 bp, Artificial Sequence
  Synthetic
ggttaccctaatatgtttatcacc

SEQ ID NO: 16568 - DNA, 22 bp, Artificial Sequence
  Synthetic
agtgatacactgaaaggattgt

SEQ ID NO: 16569 - DNA, 22 bp, Artificial Sequence
  Synthetic
attataggagatgaactgaggg

SEQ ID NO: 16570 - DNA, 21 bp, Artificial Sequence
  Synthetic
aatgcaattgtgtgtaggttt

SEQ ID NO: 16571 - DNA, 20 bp, Artificial Sequence
  Synthetic
atttctgctggatttagcct

SEQ ID NO: 16572 - DNA, 18 bp, Artificial Sequence
  Synthetic
tctgcacaatgactgaca

SEQ ID NO: 16573 - DNA, 20 bp, Artificial Sequence
  Synthetic
taagcccagatcacaaatgg

SEQ ID NO: 16574 - DNA, 25 bp, Artificial Sequence
  Synthetic
aataaagtcacaagatttgtcagtg

SEQ ID NO: 16575 - DNA, 19 bp, Artificial Sequence
  Synthetic
ctcagacaatggttgccaa

SEQ ID NO: 16576 - DNA, 22 bp, Artificial Sequence
  Synthetic
ggacagcttttgttacaaatgt

SEQ ID NO: 16577 - DNA, 22 bp, Artificial Sequence
  Synthetic
gtaactttgaattgtgtgacaa

SEQ ID NO: 16578 - DNA, 19 bp, Artificial Sequence
  Synthetic
ttttcacctgctcaagaca

SEQ ID NO: 16579 - DNA, 25 bp, Artificial Sequence
  Synthetic
ctacaactcaacatttttttcaacc

SEQ ID NO: 16580 - DNA, 18 bp, Artificial Sequence
  Synthetic
taggccctttgagagaga

SEQ ID NO: 16581 - DNA, 25 bp, Artificial Sequence
  Synthetic
catctgaaatattagacatttcacc

SEQ ID NO: 16582 - DNA, 22 bp, Artificial Sequence
  Synthetic
actagccaaaaatctattgtgg

SEQ ID NO: 16583 - DNA, 22 bp, Artificial Sequence
  Synthetic
aggtcttttattgaggacttgc

SEQ ID NO: 16584 - DNA, 24 bp, Artificial Sequence
  Synthetic
tctatgagaaccaaaaacaaatcg

SEQ ID NO: 16585 - DNA, 19 bp, Artificial Sequence
  Synthetic
tgagtgtgttcttggacaa

SEQ ID NO: 16586 - DNA, 23 bp, Artificial Sequence
  Synthetic
tcgttattggcatcattaacaac

SEQ ID NO: 16587 - DNA, 22 bp, Artificial Sequence
  Synthetic
catcgtcatggttacaatcttg

SEQ ID NO: 16588 - DNA, 19 bp, Artificial Sequence
  Synthetic
gctgtttttcagagcgcta

SEQ ID NO: 16589 - DNA, 21 bp, Artificial Sequence
  Synthetic
aattggtggttattctgagga

SEQ ID NO: 16590 - DNA, 18 bp, Artificial Sequence
  Synthetic
tcggaagaaacaggtacg

SEQ ID NO: 16591 - DNA, 18 bp, Artificial Sequence
  Synthetic
tcctggaacaatggaacc

SEQ ID NO: 16592 - DNA, 20 bp, Artificial Sequence
  Synthetic
acttgtcattggtgctgtga

SEQ ID NO: 16593 - DNA, 24 bp, Artificial Sequence
  Synthetic
catgaaaattattctcttcctgac

SEQ ID NO: 16594 - DNA, 22 bp, Artificial Sequence
  Synthetic
ttgtatttctctatgcagttgc

SEQ ID NO: 16595 - DNA, 19 bp, Artificial Sequence
  Synthetic
ccccccgcattacatttgg

SEQ ID NO: 16596 - DNA, 18 bp, Artificial Sequence
  Synthetic
acttccctacggcgctaa

SEQ ID NO: 16597 - DNA, 20 bp, Artificial Sequence
  Synthetic
cttgagagcaaagtttctgg

SEQ ID NO: 16598 - DNA, 20 bp, Artificial Sequence
  Synthetic
tcatggagccattaaattgg

SEQ ID NO: 16599 - DNA, 24 bp, Artificial Sequence
  Synthetic
ttccgtttacgatacatagtctac

SEQ ID NO: 16600 - DNA, 18 bp, Artificial Sequence
  Synthetic
ccatgcggtgttgtactc

SEQ ID NO: 16601 - DNA, 20 bp, Artificial Sequence
  Synthetic
agtagacctggcagatgagg

SEQ ID NO: 16602 - DNA, 18 bp, Artificial Sequence
  Synthetic
gtgtccgtgtttcctgtt

SEQ ID NO: 16603 - DNA, 24 bp, Artificial Sequence
  Synthetic
ctgttaaagatgtgttagaaaagg

SEQ ID NO: 16604 - DNA, 18 bp, Artificial Sequence
  Synthetic
tggacagtcgttcttgga

SEQ ID NO: 16605 - DNA, 19 bp, Artificial Sequence
  Synthetic
aggtgagcaaggtagagaa

SEQ ID NO: 16606 - DNA, 22 bp, Artificial Sequence
  Synthetic
tcaattagccctatgttttcag

SEQ ID NO: 16607 - DNA, 25 bp, Artificial Sequence
  Synthetic
tgaatatgtacactgttgatttacg

SEQ ID NO: 16608 - DNA, 18 bp, Artificial Sequence
  Synthetic
tcctggtgttggaaaacc

SEQ ID NO: 16609 - DNA, 25 bp, Artificial Sequence
  Synthetic
caaagatttttgcttaagattagcc

SEQ ID NO: 16610 - DNA, 20 bp, Artificial Sequence
  Synthetic
ttatgtatgtacccccagga

SEQ ID NO: 16611 - DNA, 21 bp, Artificial Sequence
  Synthetic
cacgattcaaatattgtgtgc

SEQ ID NO: 16612 - DNA, 25 bp, Artificial Sequence
  Synthetic
tgattctattcttgtatcatactcc

SEQ ID NO: 16613 - DNA, 24 bp, Artificial Sequence
  Synthetic
tggtgttataggtatgattacagc

SEQ ID NO: 16614 - DNA, 20 bp, Artificial Sequence
  Synthetic
cacaaactgtaattgccact

SEQ ID NO: 16615 - DNA, 20 bp, Artificial Sequence
  Synthetic
actggaaaatctcttgccac

SEQ ID NO: 16616 - DNA, 21 bp, Artificial Sequence
  Synthetic
accatttacatccaagtttgt

SEQ ID NO: 16617 - DNA, 25 bp, Artificial Sequence
  Synthetic
ctataggtataatagctaatgtggt

SEQ ID NO: 16618 - DNA, 20 bp, Artificial Sequence
  Synthetic
tggtacttccaacacattct

SEQ ID NO: 16619 - DNA, 20 bp, Artificial Sequence
  Synthetic
tactgcacgaatgatcaagt

SEQ ID NO: 16620 - DNA, 24 bp, Artificial Sequence
  Synthetic
tgtgttattcagaagtgtatttgg

SEQ ID NO: 16621 - DNA, 18 bp, Artificial Sequence
  Synthetic
acccctgctgataagtct

SEQ ID NO: 16622 - DNA, 18 bp, Artificial Sequence
  Synthetic
aagaggtggagttgtcac

SEQ ID NO: 16623 - DNA, 24 bp, Artificial Sequence
  Synthetic
tctaaaaggagattgtttacagac

SEQ ID NO: 16624 - DNA, 22 bp, Artificial Sequence
  Synthetic
gggtaaagtaggctttctagat

SEQ ID NO: 16625 - DNA, 18 bp, Artificial Sequence
  Synthetic
ctgagcgtacgttttgct

SEQ ID NO: 16626 - DNA, 23 bp, Artificial Sequence
  Synthetic
caacctgatgtgttaaagtatgg

SEQ ID NO: 16627 - DNA, 24 bp, Artificial Sequence
  Synthetic
cagaaatatgggcatttatacctg

SEQ ID NO: 16628 - DNA, 18 bp, Artificial Sequence
  Synthetic
gcccattacaaggcctaa

SEQ ID NO: 16629 - DNA, 18 bp, Artificial Sequence
  Synthetic
cacacctgtcactgcatt

SEQ ID NO: 16630 - DNA, 25 bp, Artificial Sequence
  Synthetic
agaaggggaaacattaaatattcct

SEQ ID NO: 16631 - DNA, 23 bp, Artificial Sequence
  Synthetic
gtattcagatgtaagttaccaga

SEQ ID NO: 16632 - DNA, 18 bp, Artificial Sequence
  Synthetic
caattgctttgtggcctg

SEQ ID NO: 16633 - DNA, 23 bp, Artificial Sequence
  Synthetic
atgtaaaataactttggatgctg

SEQ ID NO: 16634 - DNA, 24 bp, Artificial Sequence
  Synthetic
gcttgaataaattgtttactgtgc

SEQ ID NO: 16635 - DNA, 23 bp, Artificial Sequence
  Synthetic
taaagtatgaaggggactattgc

SEQ ID NO: 16636 - DNA, 18 bp, Artificial Sequence
  Synthetic
ccaggacctgctttcaag

SEQ ID NO: 16637 - DNA, 18 bp, Artificial Sequence
  Synthetic
ccgagctttagtggacct

SEQ ID NO: 16638 - DNA, 20 bp, Artificial Sequence
  Synthetic
cagtgtgacgaagaagatga

SEQ ID NO: 16639 - DNA, 23 bp, Artificial Sequence
  Synthetic
tattcaaatactggacaatggac

SEQ ID NO: 16640 - DNA, 19 bp, Artificial Sequence
  Synthetic
cgacaagagaacgacgacg

SEQ ID NO: 16641 - DNA, 20 bp, Artificial Sequence
  Synthetic
tacaaaaccaagcataccac

SEQ ID NO: 16642 - DNA, 25 bp, Artificial Sequence
  Synthetic
cttttaatagggttatcaatcaagg

SEQ ID NO: 16643 - DNA, 18 bp, Artificial Sequence
  Synthetic
gcgcaggtgttaagacaa

SEQ ID NO: 16644 - DNA, 18 bp, Artificial Sequence
  Synthetic
atgtcgctgtttggagac

SEQ ID NO: 16645 - DNA, 18 bp, Artificial Sequence
  Synthetic
cctgtcaggaatgggaac

SEQ ID NO: 16646 - DNA, 18 bp, Artificial Sequence
  Synthetic
gtcttcggtacctggagt

SEQ ID NO: 16647 - DNA, 20 bp, Artificial Sequence
  Synthetic
actcactgagtgacatcaac

SEQ ID NO: 16648 - DNA, 19 bp, Artificial Sequence
  Synthetic
aggtccaatctaccgaaga

SEQ ID NO: 16649 - DNA, 20 bp, Artificial Sequence
  Synthetic
agcagaaatcctgggaatgc

SEQ ID NO: 16650 - DNA, 19 bp, Artificial Sequence
  Synthetic
caattggtgtggatggcat

SEQ ID NO: 16651 - DNA, 19 bp, Artificial Sequence
  Synthetic
tttttgttcatgatgcccg

SEQ ID NO: 16652 - DNA, 18 bp, Artificial Sequence
  Synthetic
ggctgttgctgcttcaat

SEQ ID NO: 16653 - DNA, 22 bp, Artificial Sequence
  Synthetic
aaattgacacgattactgttga

SEQ ID NO: 16654 - DNA, 21 bp, Artificial Sequence
  Synthetic
ccgttgaggtatttttctcac

SEQ ID NO: 16655 - DNA, 23 bp, Artificial Sequence
  Synthetic
gttgaaatgaaaaaacctcatgc

SEQ ID NO: 16656 - DNA, 25 bp, Artificial Sequence
  Synthetic
gttggtaaatcaaccttatttaacg

SEQ ID NO: 16657 - DNA, 18 bp, Artificial Sequence
  Synthetic
taaacgttatgcgcgtgt

SEQ ID NO: 16658 - DNA, 22 bp, Artificial Sequence
  Synthetic
cgtgcagaagaagaaatttcag

SEQ ID NO: 16659 - DNA, 23 bp, Artificial Sequence
  Synthetic
atggtaaaaatgattgttggtct

SEQ ID NO: 16660 - DNA, 20 bp, Artificial Sequence
  Synthetic
aggaggacataatggcatta

SEQ ID NO: 16661 - DNA, 18 bp, Artificial Sequence
  Synthetic
gtgggcttgtctggtcta

SEQ ID NO: 16662 - DNA, 20 bp, Artificial Sequence
  Synthetic
ggaggctcaaaatttgtgat

SEQ ID NO: 16663 - DNA, 18 bp, Artificial Sequence
  Synthetic
cagcaattagaagcgctg

SEQ ID NO: 16664 - DNA, 23 bp, Artificial Sequence
  Synthetic
aagttactaagttttgacgatgt

SEQ ID NO: 16665 - DNA, 23 bp, Artificial Sequence
  Synthetic
gaataccgattgaaatttctcct

SEQ ID NO: 16666 - DNA, 19 bp, Artificial Sequence
  Synthetic
gtggtgatcacatctgctt

SEQ ID NO: 16667 - DNA, 19 bp, Artificial Sequence
  Synthetic
tggtaccgaaaacatgagt

SEQ ID NO: 16668 - DNA, 25 bp, Artificial Sequence
  Synthetic
atcaagatgaataccctaaatttgg

SEQ ID NO: 16669 - DNA, 18 bp, Artificial Sequence
  Synthetic
cttttgctgctcaggctt

SEQ ID NO: 16670 - DNA, 18 bp, Artificial Sequence
  Synthetic
cacgattatggtcggtgg

SEQ ID NO: 16671 - DNA, 22 bp, Artificial Sequence
  Synthetic
tcttgccaaagaatatctgaac

SEQ ID NO: 16672 - DNA, 25 bp, Artificial Sequence
  Synthetic
tttgaaggataagattgatagaagg

SEQ ID NO: 16673 - DNA, 25 bp, Artificial Sequence
  Synthetic
ctttgatcagcatttaaaactactg

SEQ ID NO: 16674 - DNA, 24 bp, Artificial Sequence
  Synthetic
ctaaaaaatggttagttaagccag

SEQ ID NO: 16675 - DNA, 20 bp, Artificial Sequence
  Synthetic
gttgtcaagagcttactgac

SEQ ID NO: 16676 - DNA, 19 bp, Artificial Sequence
  Synthetic
aaagtaaatggttggcagc

SEQ ID NO: 16677 - DNA, 19 bp, Artificial Sequence
  Synthetic
tgtctcttggtatacggct

SEQ ID NO: 16678 - DNA, 19 bp, Artificial Sequence
  Synthetic
tggtgcttacttcttgagc

SEQ ID NO: 16679 - DNA, 25 bp, Artificial Sequence
  Synthetic
tctttcaaaaacactaagaaagacc

SEQ ID NO: 16680 - DNA, 20 bp, Artificial Sequence
  Synthetic
aaagctgagtttgcaaaagc

SEQ ID NO: 16681 - DNA, 24 bp, Artificial Sequence
  Synthetic
catcagtttttagaggagaattgg

SEQ ID NO: 16682 - DNA, 25 bp, Artificial Sequence
  Synthetic
ctaaaaagagcttatttgtgacaag

SEQ ID NO: 16683 - DNA, 19 bp, Artificial Sequence
  Synthetic
gcacctgcttctagtccag

SEQ ID NO: 16684 - DNA, 18 bp, Artificial Sequence
  Synthetic
caccacaagtgttgcaac

SEQ ID NO: 16685 - DNA, 20 bp, Artificial Sequence
  Synthetic
gccatttgcaagtatttacg

SEQ ID NO: 16686 - DNA, 25 bp, Artificial Sequence
  Synthetic
ggtcttgaaatgtattatactagtg

SEQ ID NO: 16687 - DNA, 19 bp, Artificial Sequence
  Synthetic
ttccctcactggaaattcc

SEQ ID NO: 16688 - DNA, 22 bp, Artificial Sequence
  Synthetic
aggtttatccaccatattgatg

SEQ ID NO: 16689 - DNA, 18 bp, Artificial Sequence
  Synthetic
ctaagccaaccaaagcgt

SEQ ID NO: 16690 - DNA, 21 bp, Artificial Sequence
  Synthetic
aaagaaaatgagaccactgtc

SEQ ID NO: 16691 - DNA, 18 bp, Artificial Sequence
  Synthetic
ccaaacagctccgttgag

SEQ ID NO: 16692 - DNA, 22 bp, Artificial Sequence
  Synthetic
tatcatttacgatgcccttacc

SEQ ID NO: 16693 - DNA, 20 bp, Artificial Sequence
  Synthetic
gcagagttgaatttgacctt

SEQ ID NO: 16694 - DNA, 25 bp, Artificial Sequence
  Synthetic
cacatgtctaagttattattggttg

SEQ ID NO: 16695 - DNA, 18 bp, Artificial Sequence
  Synthetic
tgtggctctagcttttcg

SEQ ID NO: 16696 - DNA, 22 bp, Artificial Sequence
  Synthetic
agatactacgacgattagagaa

SEQ ID NO: 16697 - DNA, 22 bp, Artificial Sequence
  Synthetic
gaagcagtcttagctaatcaac

SEQ ID NO: 16698 - DNA, 24 bp, Artificial Sequence
  Synthetic
tattgttggtcctaatttcaatcg

SEQ ID NO: 16699 - DNA, 23 bp, Artificial Sequence
  Synthetic
taaaaatagggatgatgctatcg

SEQ ID NO: 16700 - DNA, 18 bp, Artificial Sequence
  Synthetic
gccattaccgactaccga

SEQ ID NO: 16701 - DNA, 19 bp, Artificial Sequence
  Synthetic
taagccctgattatgctcc

SEQ ID NO: 16702 - DNA, 21 bp, Artificial Sequence
  Synthetic
taaacggtaagaaagtagccg

SEQ ID NO: 16703 - DNA, 19 bp, Artificial Sequence
  Synthetic
ctcttgacgatgctcttcg

SEQ ID NO: 16704 - DNA, 18 bp, Artificial Sequence
  Synthetic
gctgcagcttctttttcc

SEQ ID NO: 16705 - DNA, 21 bp, Artificial Sequence
  Synthetic
tacaaaaaagagtttcggtgg

SEQ ID NO: 16706 - DNA, 21 bp, Artificial Sequence
  Synthetic
caagtccccttcttagaaagt

SEQ ID NO: 16707 - DNA, 19 bp, Artificial Sequence
  Synthetic
aggaaggtcaattggttgc

SEQ ID NO: 16708 - DNA, 19 bp, Artificial Sequence
  Synthetic
gttccggctatgaaaatgc

SEQ ID NO: 16709 - DNA, 20 bp, Artificial Sequence
  Synthetic
aaaatggcaccattgattgc

SEQ ID NO: 16710 - DNA, 19 bp, Artificial Sequence
  Synthetic
ttatccaaacgtgccaaac

SEQ ID NO: 16711 - DNA, 20 bp, Artificial Sequence
  Synthetic
ggctttattcaagacttgcc

SEQ ID NO: 16712 - DNA, 25 bp, Artificial Sequence
  Synthetic
cagtttgttccttttagaatcaaag

SEQ ID NO: 16713 - DNA, 21 bp, Artificial Sequence
  Synthetic
cctactttgctgaaatctacc

SEQ ID NO: 16714 - DNA, 19 bp, Artificial Sequence
  Synthetic
tacacctgatgacacactc

SEQ ID NO: 16715 - DNA, 19 bp, Artificial Sequence
  Synthetic
gaaggaacgcaaagacaaa

SEQ ID NO: 16716 - DNA, 18 bp, Artificial Sequence
  Synthetic
gtctggcgcataccattt

SEQ ID NO: 16717 - DNA, 18 bp, Artificial Sequence
  Synthetic
cggattgcgagaaatcac

SEQ ID NO: 16718 - DNA, 20 bp, Artificial Sequence
  Synthetic
aacaaagaacgcctagaaca

SEQ ID NO: 16719 - DNA, 18 bp, Artificial Sequence
  Synthetic
caggcttgattgcgtcag

SEQ ID NO: 16720 - DNA, 21 bp, Artificial Sequence
  Synthetic
ccgctcagttgatttatgatc

SEQ ID NO: 16721 - DNA, 25 bp, Artificial Sequence
  Synthetic
ttatcagtttttagaggctattggt

SEQ ID NO: 16722 - DNA, 18 bp, Artificial Sequence
  Synthetic
aaacgacctcaactccaa

SEQ ID NO: 16723 - DNA, 19 bp, Artificial Sequence
  Synthetic
tctttttcagatggggggt

SEQ ID NO: 16724 - DNA, 18 bp, Artificial Sequence
  Synthetic
cttagcagccgagtacga

SEQ ID NO: 16725 - DNA, 18 bp, Artificial Sequence
  Synthetic
agcagccttgtctgctta

SEQ ID NO: 16726 - DNA, 18 bp, Artificial Sequence
  Synthetic
cgtcagttagtggaaggg

SEQ ID NO: 16727 - DNA, 23 bp, Artificial Sequence
  Synthetic
tatggcctgtcaattagatacac

SEQ ID NO: 16728 - DNA, 23 bp, Artificial Sequence
  Synthetic
atgaacccctaaaacattacact

SEQ ID NO: 16729 - DNA, 19 bp, Artificial Sequence
  Synthetic
gtttgaatttgcatgtggc

SEQ ID NO: 16730 - DNA, 20 bp, Artificial Sequence
  Synthetic
ttgtggatctgtgtttaagc

SEQ ID NO: 16731 - DNA, 18 bp, Artificial Sequence
  Synthetic
aaagcaagagcccctgaa

SEQ ID NO: 16732 - DNA, 20 bp, Artificial Sequence
  Synthetic
ccagttgctactttatcgac

SEQ ID NO: 16733 - DNA, 20 bp, Artificial Sequence
  Synthetic
gcggtaaaaattcctggacg

SEQ ID NO: 16734 - DNA, 21 bp, Artificial Sequence
  Synthetic
caggctgtaataatttagcgc

SEQ ID NO: 16735 - DNA, 19 bp, Artificial Sequence
  Synthetic
ccaaaggtttcaagccttg

SEQ ID NO: 16736 - DNA, 22 bp, Artificial Sequence
  Synthetic
tgccttaaacccatttaattgc

SEQ ID NO: 16737 - DNA, 18 bp, Artificial Sequence
  Synthetic
caagtcctgcaacagcta

SEQ ID NO: 16738 - DNA, 23 bp, Artificial Sequence
  Synthetic
tatttttgatggtcttgtcaacg

SEQ ID NO: 16739 - DNA, 22 bp, Artificial Sequence
  Synthetic
gtaatcaccaaaggtttgtagt

SEQ ID NO: 16740 - DNA, 23 bp, Artificial Sequence
  Synthetic
caggtggagtatatcaattctcc

SEQ ID NO: 16741 - DNA, 22 bp, Artificial Sequence
  Synthetic
agcttcaacgattttttcaatg

SEQ ID NO: 16742 - DNA, 19 bp, Artificial Sequence
  Synthetic
agccttatttcggtaagct

SEQ ID NO: 16743 - DNA, 23 bp, Artificial Sequence
  Synthetic
taaccattgctcaaaaaagaaga

SEQ ID NO: 16744 - DNA, 20 bp, Artificial Sequence
  Synthetic
ttgatttgggacataacagc

SEQ ID NO: 16745 - DNA, 18 bp, Artificial Sequence
  Synthetic
atgttttaaggcccgtcg

SEQ ID NO: 16746 - DNA, 23 bp, Artificial Sequence
  Synthetic
taagccaagaatgttaaaaaacc

SEQ ID NO: 16747 - DNA, 22 bp, Artificial Sequence
  Synthetic
ttatgctggtgattttttctca

SEQ ID NO: 16748 - DNA, 23 bp, Artificial Sequence
  Synthetic
tttgaaaaacgttggataagacg

SEQ ID NO: 16749 - DNA, 19 bp, Artificial Sequence
  Synthetic
caagaagtgcaatgatggg

SEQ ID NO: 16750 - DNA, 18 bp, Artificial Sequence
  Synthetic
tcccaccaaagtaatgcg

SEQ ID NO: 16751 - DNA, 20 bp, Artificial Sequence
  Synthetic
tttcacttcttcactagcgt

SEQ ID NO: 16752 - DNA, 18 bp, Artificial Sequence
  Synthetic
cgacgacgttctaagcta

SEQ ID NO: 16753 - DNA, 20 bp, Artificial Sequence
  Synthetic
ccatagaaacacggacatca

SEQ ID NO: 16754 - DNA, 21 bp, Artificial Sequence
  Synthetic
caagaagaaccagagtcaaac

SEQ ID NO: 16755 - DNA, 19 bp, Artificial Sequence
  Synthetic
cccatgatggatgaaaggt

SEQ ID NO: 16756 - DNA, 20 bp, Artificial Sequence
  Synthetic
tagtcatcctcaccaaaacc

SEQ ID NO: 16757 - DNA, 25 bp, Artificial Sequence
  Synthetic
cgatatacgtattagtatcaaggat

SEQ ID NO: 16758 - DNA, 21 bp, Artificial Sequence
  Synthetic
tatcaacctgacttaaagcgt

SEQ ID NO: 16759 - DNA, 18 bp, Artificial Sequence
  Synthetic
ttgttcccaagctgcttg

SEQ ID NO: 16760 - DNA, 25 bp, Artificial Sequence
  Synthetic
ctgtgattataagcaaatcatcttg

SEQ ID NO: 16761 - DNA, 23 bp, Artificial Sequence
  Synthetic
aaacgattaatgtctattctcgt

SEQ ID NO: 16762 - DNA, 25 bp, Artificial Sequence
  Synthetic
aaagttactaaatagctatagtccg

SEQ ID NO: 16763 - DNA, 19 bp, Artificial Sequence
  Synthetic
agctgagctaaactcccat

SEQ ID NO: 16764 - DNA, 20 bp, Artificial Sequence
  Synthetic
atgctttcagcgcttatccc

SEQ ID NO: 16765 - DNA, 20 bp, Artificial Sequence
  Synthetic
tgttatccccagggtagctt

SEQ ID NO: 16766 - DNA, 19 bp, Artificial Sequence
  Synthetic
ggcgtcaccccctatacat

SEQ ID NO: 16767 - DNA, 25 bp, Artificial Sequence
  Synthetic
cagctcaatgttataaagataagca

SEQ ID NO: 16768 - DNA, 20 bp, Artificial Sequence
  Synthetic
ctctcctaccatgacacttt

SEQ ID NO: 16769 - DNA, 19 bp, Artificial Sequence
  Synthetic
atcgtaactcgccggttca

SEQ ID NO: 16770 - DNA, 18 bp, Artificial Sequence
  Synthetic
gacctcctgcgtgcaaag

SEQ ID NO: 16771 - DNA, 23 bp, Artificial Sequence
  Synthetic
tctttgattgttttttcagtagc

SEQ ID NO: 16772 - DNA, 20 bp, Artificial Sequence
  Synthetic
cttgttatctgctgccattg

SEQ ID NO: 16773 - DNA, 19 bp, Artificial Sequence
  Synthetic
ctgggatacgagttgatcc

SEQ ID NO: 16774 - DNA, 21 bp, Artificial Sequence
  Synthetic
accaccaagtttgttatcacc

SEQ ID NO: 16775 - DNA, 18 bp, Artificial Sequence
  Synthetic
cactgcttgacgttttgc

SEQ ID NO: 16776 - DNA, 25 bp, Artificial Sequence
  Synthetic
gcttctaacttgctatctagtttac

SEQ ID NO: 16777 - DNA, 18 bp, Artificial Sequence
  Synthetic
ccaaggcacgttctagat

SEQ ID NO: 16778 - DNA, 25 bp, Artificial Sequence
  Synthetic
cgataataatcacctaatttagcag

SEQ ID NO: 16779 - DNA, 18 bp, Artificial Sequence
  Synthetic
agcgctcctctacgatag

SEQ ID NO: 16780 - DNA, 18 bp, Artificial Sequence
  Synthetic
cttggcatccgtccacta

SEQ ID NO: 16781 - DNA, 18 bp, Artificial Sequence
  Synthetic
gctggtggaacttctgtt

SEQ ID NO: 16782 - DNA, 22 bp, Artificial Sequence
  Synthetic
cacaaaaagatctctttgcctt

SEQ ID NO: 16783 - DNA, 23 bp, Artificial Sequence
  Synthetic
ctatgcgcaaaatgatatctttg

SEQ ID NO: 16784 - DNA, 19 bp, Artificial Sequence
  Synthetic
tggaaaataagcgtgctca

SEQ ID NO: 16785 - DNA, 24 bp, Artificial Sequence
  Synthetic
aagcctattatgatctgatgaaga

SEQ ID NO: 16786 - DNA, 18 bp, Artificial Sequence
  Synthetic
tcgtgattgtggttgacc

SEQ ID NO: 16787 - DNA, 18 bp, Artificial Sequence
  Synthetic
ctattgagagcgcacaga

SEQ ID NO: 16788 - DNA, 20 bp, Artificial Sequence
  Synthetic
cgatcaagaacaagaagctc

SEQ ID NO: 16789 - DNA, 25 bp, Artificial Sequence
  Synthetic
taccaagcctataaagaaaaacaag

SEQ ID NO: 16790 - DNA, 24 bp, Artificial Sequence
  Synthetic
tagctctagtgatatcaaatatgc

SEQ ID NO: 16791 - DNA, 19 bp, Artificial Sequence
  Synthetic
ggtcagaatcaccacttcc

SEQ ID NO: 16792 - DNA, 18 bp, Artificial Sequence
  Synthetic
caaaagggcacaggttga

SEQ ID NO: 16793 - DNA, 23 bp, Artificial Sequence
  Synthetic
gaaaggaattcacacttatgact

SEQ ID NO: 16794 - DNA, 20 bp, Artificial Sequence
  Synthetic
ctcagtttgactttgcctta

SEQ ID NO: 16795 - DNA, 24 bp, Artificial Sequence
  Synthetic
ctctttaatcagcttgagattgac

SEQ ID NO: 16796 - DNA, 23 bp, Artificial Sequence
  Synthetic
atcaaagatgtagataatcaccg

SEQ ID NO: 16797 - DNA, 19 bp, Artificial Sequence
  Synthetic
agattgggctttatcacgt

SEQ ID NO: 16798 - DNA, 23 bp, Artificial Sequence
  Synthetic
gtctgattaaatcctacccattg

SEQ ID NO: 16799 - DNA, 23 bp, Artificial Sequence
  Synthetic
gattactccattattggcaaagg

SEQ ID NO: 16800 - DNA, 19 bp, Artificial Sequence
  Synthetic
ccacgagtggtttgattgt

SEQ ID NO: 16801 - DNA, 18 bp, Artificial Sequence
  Synthetic
catcagtatgtcgccgcc

SEQ ID NO: 16802 - DNA, 17 bp, Artificial Sequence
  Synthetic
gatatgcagcgctggcg

SEQ ID NO: 16803 - DNA, 20 bp, Artificial Sequence
  Synthetic
caatgcgtgctcatggtatg

SEQ ID NO: 16804 - DNA, 19 bp, Artificial Sequence
  Synthetic
gcgcgttagggctattggg

SEQ ID NO: 16805 - DNA, 19 bp, Artificial Sequence
  Synthetic
aaagtcaccgttggcacag

SEQ ID NO: 16806 - DNA, 20 bp, Artificial Sequence
  Synthetic
aaagagacatttgtccccgg

SEQ ID NO: 16807 - DNA, 20 bp, Artificial Sequence
  Synthetic
ctgacagccgacttttaccc

SEQ ID NO: 16808 - DNA, 18 bp, Artificial Sequence
  Synthetic
gccaccgtctacaccgga

SEQ ID NO: 16809 - DNA, 16 bp, Artificial Sequence
  Synthetic
gagtccagccggtcca

SEQ ID NO: 16810 - DNA, 19 bp, Artificial Sequence
  Synthetic
tgtggcgcctgactatagg

SEQ ID NO: 16811 - DNA, 16 bp, Artificial Sequence
  Synthetic
ggggaagtccgtcggt

SEQ ID NO: 16812 - DNA, 20 bp, Artificial Sequence
  Synthetic
tgattttgagagcaagggcc

SEQ ID NO: 16813 - DNA, 20 bp, Artificial Sequence
  Synthetic
tgcaggacatagacgcagtg

SEQ ID NO: 16814 - DNA, 19 bp, Artificial Sequence
  Synthetic
caggtacggcaaggagaca

SEQ ID NO: 16815 - DNA, 20 bp, Artificial Sequence
  Synthetic
tattgatgaaggaggccggg

SEQ ID NO: 16816 - DNA, 16 bp, Artificial Sequence
  Synthetic
gccctcatcaccggct

SEQ ID NO: 16817 - DNA, 17 bp, Artificial Sequence
  Synthetic
ctgctctgtcgtgcctg

SEQ ID NO: 16818 - DNA, 16 bp, Artificial Sequence
  Synthetic
cgacgcggcacacgat

SEQ ID NO: 16819 - DNA, 18 bp, Artificial Sequence
  Synthetic
ggtgggtatgcggtgtca

SEQ ID NO: 16820 - DNA, 19 bp, Artificial Sequence
  Synthetic
accaattcagcctacaccg

SEQ ID NO: 16821 - DNA, 16 bp, Artificial Sequence
  Synthetic
gctcgccccatcacca

SEQ ID NO: 16822 - DNA, 19 bp, Artificial Sequence
  Synthetic
gggcaagatcagtttttgg

SEQ ID NO: 16823 - DNA, 23 bp, Artificial Sequence
  Synthetic
actaaacgaaatttttctagtgc

SEQ ID NO: 16824 - DNA, 18 bp, Artificial Sequence
  Synthetic
gttcgcacctatagcgaa

SEQ ID NO: 16825 - DNA, 23 bp, Artificial Sequence
  Synthetic
attacaaatggtatgtcattgct

SEQ ID NO: 16826 - DNA, 25 bp, Artificial Sequence
  Synthetic
tactttctaatcaattacgtctagc

SEQ ID NO: 16827 - DNA, 22 bp, Artificial Sequence
  Synthetic
tgaacttgccactgttaatttg

SEQ ID NO: 16828 - DNA, 19 bp, Artificial Sequence
  Synthetic
ggttgatggctgtagtgtc

SEQ ID NO: 16829 - DNA, 25 bp, Artificial Sequence
  Synthetic
cacttacttctaatggtcttttagg

SEQ ID NO: 16830 - DNA, 24 bp, Artificial Sequence
  Synthetic
gtccattatttatacaggtgattg

SEQ ID NO: 16831 - DNA, 22 bp, Artificial Sequence
  Synthetic
ggtaaaaagtttgatgatcagg

SEQ ID NO: 16832 - DNA, 20 bp, Artificial Sequence
  Synthetic
aagctggtgaagttaaacct

SEQ ID NO: 16833 - DNA, 21 bp, Artificial Sequence
  Synthetic
tttttgttgagagttgtacca

SEQ ID NO: 16834 - DNA, 19 bp, Artificial Sequence
  Synthetic
aacaattgggtgttgtgag

SEQ ID NO: 16835 - DNA, 23 bp, Artificial Sequence
  Synthetic
tgtaaaagtactgtagttgaagt

SEQ ID NO: 16836 - DNA, 21 bp, Artificial Sequence
  Synthetic
tgtttgaagcacctttacact

SEQ ID NO: 16837 - DNA, 21 bp, Artificial Sequence
  Synthetic
tattgtagagttggtgaatgc

SEQ ID NO: 16838 - DNA, 21 bp, Artificial Sequence
  Synthetic
atagtggtagtgctagtgagg

SEQ ID NO: 16839 - DNA, 25 bp, Artificial Sequence
  Synthetic
accactgttcttattgattatgatc

SEQ ID NO: 16840 - DNA, 23 bp, Artificial Sequence
  Synthetic
tacaccaaattgagttaggtagt

SEQ ID NO: 16841 - DNA, 25 bp, Artificial Sequence
  Synthetic
aggttttttaaatgtactatgggtg

SEQ ID NO: 16842 - DNA, 23 bp, Artificial Sequence
  Synthetic
ttgcttatgaaaatgctagacaa

SEQ ID NO: 16843 - DNA, 20 bp, Artificial Sequence
  Synthetic
tctgttcattatgctggagt

SEQ ID NO: 16844 - DNA, 21 bp, Artificial Sequence
  Synthetic
cgttcttggttttataggtgc

SEQ ID NO: 16845 - DNA, 20 bp, Artificial Sequence
  Synthetic
ggtaaatgtgttcaggttcc

SEQ ID NO: 16846 - DNA, 25 bp, Artificial Sequence
  Synthetic
tgttataaagaggtgtactaagtcg

SEQ ID NO: 16847 - DNA, 25 bp, Artificial Sequence
  Synthetic
cccagttgaaaatgaagatatacat

SEQ ID NO: 16848 - DNA, 20 bp, Artificial Sequence
  Synthetic
gtgttccacttgttacaact

SEQ ID NO: 16849 - DNA, 21 bp, Artificial Sequence
  Synthetic
ctttgacaaagcgtaatgtcc

SEQ ID NO: 16850 - DNA, 22 bp, Artificial Sequence
  Synthetic
gcctaacatgatacgtatgatt

SEQ ID NO: 16851 - DNA, 23 bp, Artificial Sequence
  Synthetic
gttgggttgaagaagatttaact

SEQ ID NO: 16852 - DNA, 25 bp, Artificial Sequence
  Synthetic
aatcaagaagataagttttggtgtg

SEQ ID NO: 16853 - DNA, 23 bp, Artificial Sequence
  Synthetic
ttttgtcttaacatctcacaatg

SEQ ID NO: 16854 - DNA, 20 bp, Artificial Sequence
  Synthetic
tttgctattcgtaatgtgcg

SEQ ID NO: 16855 - DNA, 23 bp, Artificial Sequence
  Synthetic
gttgtgattatgtttacaatccg

SEQ ID NO: 16856 - DNA, 19 bp, Artificial Sequence
  Synthetic
gctgttactgatgccaaat

SEQ ID NO: 16857 - DNA, 21 bp, Artificial Sequence
  Synthetic
caaagtttttgttcgctatgg

SEQ ID NO: 16858 - DNA, 24 bp, Artificial Sequence
  Synthetic
actaaagagtttagatcttggtgt

SEQ ID NO: 16859 - DNA, 18 bp, Artificial Sequence
  Synthetic
acaatgtgcgtacctcat

SEQ ID NO: 16860 - DNA, 19 bp, Artificial Sequence
  Synthetic
tggcctcttgctttttcac

SEQ ID NO: 16861 - DNA, 22 bp, Artificial Sequence
  Synthetic
ggcataactatatctggtgaaa

SEQ ID NO: 16862 - DNA, 18 bp, Artificial Sequence
  Synthetic
gccgcattcctaatggtt

SEQ ID NO: 16863 - DNA, 21 bp, Artificial Sequence
  Synthetic
ttcttgacaccacaatacctt

SEQ ID NO: 16864 - DNA, 18 bp, Artificial Sequence
  Synthetic
gtgtgagcacttgcagtt

SEQ ID NO: 16865 - DNA, 23 bp, Artificial Sequence
  Synthetic
cttggttttaaaaatgtttccac

SEQ ID NO: 16866 - DNA, 21 bp, Artificial Sequence
  Synthetic
ttacctcagagaaacattcgt

SEQ ID NO: 16867 - DNA, 21 bp, Artificial Sequence
  Synthetic
tgttaatcaacagggtagtgc

SEQ ID NO: 16868 - DNA, 18 bp, Artificial Sequence
  Synthetic
atgtaaaggcgtggtctg

SEQ ID NO: 16869 - DNA, 24 bp, Artificial Sequence
  Synthetic
gaaaattatatcaaatggccttgg

SEQ ID NO: 16870 - DNA, 22 bp, Artificial Sequence
  Synthetic
tgcttaccaagattatatgcaa

SEQ ID NO: 16871 - DNA, 23 bp, Artificial Sequence
  Synthetic
gcttttaatcctgaaactaatgc

SEQ ID NO: 16872 - DNA, 25 bp, Artificial Sequence
  Synthetic
tctaaactaaacaaaatggctagtg

SEQ ID NO: 16873 - DNA, 19 bp, Artificial Sequence
  Synthetic
caacgttctgatggtgttg

SEQ ID NO: 16874 - DNA, 22 bp, Artificial Sequence
  Synthetic
gattctaaccagtcttcttcag

SEQ ID NO: 16875 - DNA, 18 bp, Artificial Sequence
  Synthetic
aggttttccacagcttgc

SEQ ID NO: 16876 - DNA, 19 bp, Artificial Sequence
  Synthetic
tcaagggtgtgctagaact

SEQ ID NO: 16877 - DNA, 19 bp, Artificial Sequence
  Synthetic
aacgattggtttttggtgg

SEQ ID NO: 16878 - DNA, 18 bp, Artificial Sequence
  Synthetic
taaagatacggctggcgt

SEQ ID NO: 16879 - DNA, 20 bp, Artificial Sequence
  Synthetic
ctgagcctccaaaatcaaga

SEQ ID NO: 16880 - DNA, 25 bp, Artificial Sequence
  Synthetic
aacaggacagtaaattgatagaaga

SEQ ID NO: 16881 - DNA, 18 bp, Artificial Sequence
  Synthetic
gagagctgtttttggcac

SEQ ID NO: 16882 - DNA, 16 bp, Artificial Sequence
  Synthetic
ctggggctcctgcagt

SEQ ID NO: 16883 - DNA, 21 bp, Artificial Sequence
  Synthetic
aggataggtagtgctagaatg

SEQ ID NO: 16884 - DNA, 22 bp, Artificial Sequence
  Synthetic
ctcatgcaaaatatcaaacacc

SEQ ID NO: 16885 - DNA, 22 bp, Artificial Sequence
  Synthetic
gaaattttccccatagatgttg

SEQ ID NO: 16886 - DNA, 20 bp, Artificial Sequence
  Synthetic
ggagaagcatcaacatcaga

SEQ ID NO: 16887 - DNA, 20 bp, Artificial Sequence
  Synthetic
aatccagcatttgagccaga

SEQ ID NO: 16888 - DNA, 20 bp, Artificial Sequence
  Synthetic
tattgctccagaagactcaa

SEQ ID NO: 16889 - DNA, 20 bp, Artificial Sequence
  Synthetic
ccatcactagaatcctgtcc

SEQ ID NO: 16890 - DNA, 19 bp, Artificial Sequence
  Synthetic
gggccaccctcttttaaat

SEQ ID NO: 16891 - DNA, 19 bp, Artificial Sequence
  Synthetic
ttggggctatggattttgc

SEQ ID NO: 16892 - DNA, 21 bp, Artificial Sequence
  Synthetic
caacaaattatgtaggcacac

SEQ ID NO: 16893 - DNA, 24 bp, Artificial Sequence
  Synthetic
ctgattgattgtgtgttattttcc

SEQ ID NO: 16894 - DNA, 23 bp, Artificial Sequence
  Synthetic
tcttcattgtttatggtttaccg

SEQ ID NO: 16895 - DNA, 18 bp, Artificial Sequence
  Synthetic
gcgcagtgtttgaatgtg

SEQ ID NO: 16896 - DNA, 25 bp, Artificial Sequence
  Synthetic
ttggaaactaacagtgatatatcag

SEQ ID NO: 16897 - DNA, 21 bp, Artificial Sequence
  Synthetic
cgaaggcgattatttaatgtg

SEQ ID NO: 16898 - DNA, 18 bp, Artificial Sequence
  Synthetic
cctgctgcaatgttttgg

SEQ ID NO: 16899 - DNA, 19 bp, Artificial Sequence
  Synthetic
tttgtatgagcctgttgca

SEQ ID NO: 16900 - DNA, 22 bp, Artificial Sequence
  Synthetic
ctgttgagtctttatgaacagg

SEQ ID NO: 16901 - DNA, 25 bp, Artificial Sequence
  Synthetic
aagattcttcaatatggaagtttgg

SEQ ID NO: 16902 - DNA, 22 bp, Artificial Sequence
  Synthetic
tctatctaacattcccactaca

SEQ ID NO: 16903 - DNA, 21 bp, Artificial Sequence
  Synthetic
gtcaatctgtaggtgaagaca

SEQ ID NO: 16904 - DNA, 18 bp, Artificial Sequence
  Synthetic
tgttaccgggcatcctag

SEQ ID NO: 16905 - DNA, 22 bp, Artificial Sequence
  Synthetic
tagaagatggtgatatgatgga

SEQ ID NO: 16906 - DNA, 22 bp, Artificial Sequence
  Synthetic
aatacatttgtagccaatggag

SEQ ID NO: 16907 - DNA, 23 bp, Artificial Sequence
  Synthetic
gacaccaaatcctaataaaatgc

SEQ ID NO: 16908 - DNA, 19 bp, Artificial Sequence
  Synthetic
tttagtcactggcaaacgg

SEQ ID NO: 16909 - DNA, 22 bp, Artificial Sequence
  Synthetic
ggggtaaaaatgatgaaagtgc

SEQ ID NO: 16910 - DNA, 23 bp, Artificial Sequence
  Synthetic
aaaaagggatatacgtaatgtgt

SEQ ID NO: 16911 - DNA, 19 bp, Artificial Sequence
  Synthetic
tcttcgagcgttttgatga

SEQ ID NO: 16912 - DNA, 18 bp, Artificial Sequence
  Synthetic
tggaagtccatggtgagg

SEQ ID NO: 16913 - DNA, 18 bp, Artificial Sequence
  Synthetic
gcatggagctgtaggagt

SEQ ID NO: 16914 - DNA, 18 bp, Artificial Sequence
  Synthetic
tggtcttgaccacatcct

SEQ ID NO: 16915 - DNA, 25 bp, Artificial Sequence
  Synthetic
gtggtgaaattattatacaatgagc

SEQ ID NO: 16916 - DNA, 25 bp, Artificial Sequence
  Synthetic
aaggttccatttatttacacaagag

SEQ ID NO: 16917 - DNA, 20 bp, Artificial Sequence
  Synthetic
agcaaagatgtcttttgctt

SEQ ID NO: 16918 - DNA, 24 bp, Artificial Sequence
  Synthetic
gagatcttgtctttgattttcaag

SEQ ID NO: 16919 - DNA, 20 bp, Artificial Sequence
  Synthetic
aagtcagcacatcagaaagg

SEQ ID NO: 16920 - DNA, 21 bp, Artificial Sequence
  Synthetic
aagctaacagagggaaaatgg

SEQ ID NO: 16921 - DNA, 21 bp, Artificial Sequence
  Synthetic
gtcttcaacctctaatcctcc

SEQ ID NO: 16922 - DNA, 18 bp, Artificial Sequence
  Synthetic
cagctggagacttggagt

SEQ ID NO: 16923 - DNA, 23 bp, Artificial Sequence
  Synthetic
tgaaataatgaagttttcctgga

SEQ ID NO: 16924 - DNA, 25 bp, Artificial Sequence
  Synthetic
atggatatagtggacaattagtttg

SEQ ID NO: 16925 - DNA, 22 bp, Artificial Sequence
  Synthetic
gtttttccagtcttttccatct

SEQ ID NO: 16926 - DNA, 21 bp, Artificial Sequence
  Synthetic
agaatctcagtcaactttgga

SEQ ID NO: 16927 - DNA, 19 bp, Artificial Sequence
  Synthetic
cgaaggtcttcctggaatg

SEQ ID NO: 16928 - DNA, 23 bp, Artificial Sequence
  Synthetic
atcatcacattgataaaaccatg

SEQ ID NO: 16929 - DNA, 21 bp, Artificial Sequence
  Synthetic
ctcctggatttccttatgtcc

SEQ ID NO: 16930 - DNA, 20 bp, Artificial Sequence
  Synthetic
tactcaattttgtgccgaat

SEQ ID NO: 16931 - DNA, 21 bp, Artificial Sequence
  Synthetic
agctacattctatgtctggtt

SEQ ID NO: 16932 - DNA, 18 bp, Artificial Sequence
  Synthetic
ggagaccctcagtgtgat

SEQ ID NO: 16933 - DNA, 24 bp, Artificial Sequence
  Synthetic
gacccacttaaaattcaaataccc

SEQ ID NO: 16934 - DNA, 24 bp, Artificial Sequence
  Synthetic
ggagacatacttttgattaacagc

SEQ ID NO: 16935 - DNA, 18 bp, Artificial Sequence
  Synthetic
gcaacagggatgcgaaat

SEQ ID NO: 16936 - DNA, 22 bp, Artificial Sequence
  Synthetic
gaagtagaagggagaattcagg

SEQ ID NO: 16937 - DNA, 25 bp, Artificial Sequence
  Synthetic
atacagagatgaagcattaaacaac

SEQ ID NO: 16938 - DNA, 19 bp, Artificial Sequence
  Synthetic
cctgccactcataaacaag

SEQ ID NO: 16939 - DNA, 21 bp, Artificial Sequence
  Synthetic
tgttgtttcaattgtgctaga

SEQ ID NO: 16940 - DNA, 21 bp, Artificial Sequence
  Synthetic
agaagcaactataccagacat

SEQ ID NO: 16941 - DNA, 18 bp, Artificial Sequence
  Synthetic
accttctttgctgtgtcc

SEQ ID NO: 16942 - DNA, 19 bp, Artificial Sequence
  Synthetic
gagcagcaaatacaggact

SEQ ID NO: 16943 - DNA, 23 bp, Artificial Sequence
  Synthetic
atgctcagcaaatttaaaaacag

SEQ ID NO: 16944 - DNA, 21 bp, Artificial Sequence
  Synthetic
gaaagacaaacttagaggctc

SEQ ID NO: 16945 - DNA, 18 bp, Artificial Sequence
  Synthetic
gcgcacgtagagtaaagc

SEQ ID NO: 16946 - DNA, 24 bp, Artificial Sequence
  Synthetic
gtcctactgatataatacctttgg

SEQ ID NO: 16947 - DNA, 23 bp, Artificial Sequence
  Synthetic
aggttacattagagtcagtagac

SEQ ID NO: 16948 - DNA, 21 bp, Artificial Sequence
  Synthetic
tttacatccaagtttgagacg

SEQ ID NO: 16949 - DNA, 21 bp, Artificial Sequence
  Synthetic
catgaagtgttagttcccaag

SEQ ID NO: 16950 - DNA, 21 bp, Artificial Sequence
  Synthetic
ggtgaatacatcctttgatcc

SEQ ID NO: 16951 - DNA, 21 bp, Artificial Sequence
  Synthetic
taatgatgtgtatggcaatgc

SEQ ID NO: 16952 - DNA, 18 bp, Artificial Sequence
  Synthetic
tctctcaccattgcaaca

SEQ ID NO: 16953 - DNA, 22 bp, Artificial Sequence
  Synthetic
gcaatgtcaaattacaggattt

SEQ ID NO: 16954 - DNA, 18 bp, Artificial Sequence
  Synthetic
gtgtgtgtagcatggtcc

SEQ ID NO: 16955 - DNA, 22 bp, Artificial Sequence
  Synthetic
ggaaaattgtccatattagccc

SEQ ID NO: 16956 - DNA, 18 bp, Artificial Sequence
  Synthetic
gagagggaatccaggagt

SEQ ID NO: 16957 - DNA, 19 bp, Artificial Sequence
  Synthetic
gcctaattacgctgtccgc

SEQ ID NO: 16958 - DNA, 19 bp, Artificial Sequence
  Synthetic
ccctgtggagactgcatct

SEQ ID NO: 16959 - DNA, 17 bp, Artificial Sequence
  Synthetic
gctggacgaactgtgcg

SEQ ID NO: 16960 - DNA, 16 bp, Artificial Sequence
  Synthetic
gggcggtctcccttgt

SEQ ID NO: 16961 - DNA, 20 bp, Artificial Sequence
  Synthetic
gtgtacgtccaccacatgag

SEQ ID NO: 16962 - DNA, 18 bp, Artificial Sequence
  Synthetic
gccggcgagagaaagaga

SEQ ID NO: 16963 - DNA, 16 bp, Artificial Sequence
  Synthetic
cgggtatgagccgcca

SEQ ID NO: 16964 - DNA, 18 bp, Artificial Sequence
  Synthetic
cgtagacgggctcgaagc

SEQ ID NO: 16965 - DNA, 19 bp, Artificial Sequence
  Synthetic
aacatcaagttccctggaa

SEQ ID NO: 16966 - DNA, 19 bp, Artificial Sequence
  Synthetic
gcaaaaagtctggcaaacc

SEQ ID NO: 16967 - DNA, 19 bp, Artificial Sequence
  Synthetic
tgcaaaaaaacagagtggt

SEQ ID NO: 16968 - DNA, 22 bp, Artificial Sequence
  Synthetic
gacacgaaacactgatacttac

SEQ ID NO: 16969 - DNA, 18 bp, Artificial Sequence
  Synthetic
ctcccgaagaactgacag

SEQ ID NO: 16970 - DNA, 21 bp, Artificial Sequence
  Synthetic
cctttgccatagtaaacatga

SEQ ID NO: 16971 - DNA, 21 bp, Artificial Sequence
  Synthetic
gtttgttgttgtacttcaagc

SEQ ID NO: 16972 - DNA, 20 bp, Artificial Sequence
  Synthetic
attgtttgatttcggttgga

SEQ ID NO: 16973 - DNA, 21 bp, Artificial Sequence
  Synthetic
agggacttgatatatccgagt

SEQ ID NO: 16974 - DNA, 22 bp, Artificial Sequence
  Synthetic
ttgtgtttttttaccgaaagac

SEQ ID NO: 16975 - DNA, 22 bp, Artificial Sequence
  Synthetic
tctgcgcagattttaaaatacg

SEQ ID NO: 16976 - DNA, 19 bp, Artificial Sequence
  Synthetic
ttacgtcgtttcctgtagc

SEQ ID NO: 16977 - DNA, 18 bp, Artificial Sequence
  Synthetic
tctgacggctaaggtgaa

SEQ ID NO: 16978 - DNA, 21 bp, Artificial Sequence
  Synthetic
tgtatcggaaaaactcgaatt

SEQ ID NO: 16979 - DNA, 24 bp, Artificial Sequence
  Synthetic
gaaagtttcggaaaatgtaaacac

SEQ ID NO: 16980 - DNA, 23 bp, Artificial Sequence
  Synthetic
tgtgttataacagacatatgcaa

SEQ ID NO: 16981 - DNA, 22 bp, Artificial Sequence
  Synthetic
aggacactttcaaaatttttcg

SEQ ID NO: 16982 - DNA, 18 bp, Artificial Sequence
  Synthetic
cggtgagcaagttctctt

SEQ ID NO: 16983 - DNA, 18 bp, Artificial Sequence
  Synthetic
aacgctgtttaaaagggc

SEQ ID NO: 16984 - DNA, 19 bp, Artificial Sequence
  Synthetic
gctgacaggatcgtcccct

SEQ ID NO: 16985 - DNA, 16 bp, Artificial Sequence
  Synthetic
tggagacgcgggcgaa

SEQ ID NO: 16986 - DNA, 20 bp, Artificial Sequence
  Synthetic
gccgtgacgtatgaagaaga

SEQ ID NO: 16987 - DNA, 19 bp, Artificial Sequence
  Synthetic
gcctccgatacgtacgact

SEQ ID NO: 16988 - DNA, 20 bp, Artificial Sequence
  Synthetic
aatcatgcattgtgtggggt

SEQ ID NO: 16989 - DNA, 18 bp, Artificial Sequence
  Synthetic
ccttagcccaagagcatg

SEQ ID NO: 16990 - DNA, 18 bp, Artificial Sequence
  Synthetic
ctcacagaacttcaggct

SEQ ID NO: 16991 - DNA, 18 bp, Artificial Sequence
  Synthetic
aaatgggaggacctgaga

SEQ ID NO: 16992 - DNA, 23 bp, Artificial Sequence
  Synthetic
aatacaataagcaatgaggaaac

SEQ ID NO: 16993 - DNA, 23 bp, Artificial Sequence
  Synthetic
gactttcgagtttagtagtacag

SEQ ID NO: 16994 - DNA, 23 bp, Artificial Sequence
  Synthetic
cgatacaagggtatgatatgacc

SEQ ID NO: 16995 - DNA, 22 bp, Artificial Sequence
  Synthetic
gttatcatgcgaacaattcaac

SEQ ID NO: 16996 - DNA, 20 bp, Artificial Sequence
  Synthetic
aagctcatggtcctacattg

SEQ ID NO: 16997 - DNA, 19 bp, Artificial Sequence
  Synthetic
aaagaagtcctcgtgctat

SEQ ID NO: 16998 - DNA, 19 bp, Artificial Sequence
  Synthetic
tggaaatctagtggtaccg

SEQ ID NO: 16999 - DNA, 23 bp, Artificial Sequence
  Synthetic
attcaatctagaggcctatttgg

SEQ ID NO: 17000 - DNA, 17 bp, Artificial Sequence
  Synthetic
cttccacgcggcagatc

SEQ ID NO: 17001 - DNA, 20 bp, Artificial Sequence
  Synthetic
ttggagtgggagagaacaga

SEQ ID NO: 17002 - DNA, 18 bp, Artificial Sequence
  Synthetic
ctccgcacgtctgtctga

SEQ ID NO: 17003 - DNA, 16 bp, Artificial Sequence
  Synthetic
agtctatgcgcgcgcc

SEQ ID NO: 17004 - DNA, 20 bp, Artificial Sequence
  Synthetic
ttcacacagatgcaaccgat

SEQ ID NO: 17005 - DNA, 16 bp, Artificial Sequence
  Synthetic
ccgtctggcgtcgaac

SEQ ID NO: 17006 - DNA, 18 bp, Artificial Sequence
  Synthetic
cgccgttctgtctcgaga

SEQ ID NO: 17007 - DNA, 20 bp, Artificial Sequence
  Synthetic
gaagaatctgccgatcacca

SEQ ID NO: 17008 - DNA, 16 bp, Artificial Sequence
  Synthetic
agaaagaggcgccggt

SEQ ID NO: 17009 - DNA, 20 bp, Artificial Sequence
  Synthetic
ctgcgaagatagtgaccccg

SEQ ID NO: 17010 - DNA, 24 bp, Artificial Sequence
  Synthetic
actccttaacacatcattattcct

SEQ ID NO: 17011 - DNA, 19 bp, Artificial Sequence
  Synthetic
tagcgattttgtgctcatg

SEQ ID NO: 17012 - DNA, 22 bp, Artificial Sequence
  Synthetic
gtttccaatgtccattttttcc

SEQ ID NO: 17013 - DNA, 24 bp, Artificial Sequence
  Synthetic
tagctctgttttctttgttttgtc

SEQ ID NO: 17014 - DNA, 23 bp, Artificial Sequence
  Synthetic
tttttgttaaaaagcgaatgtcc

SEQ ID NO: 17015 - DNA, 18 bp, Artificial Sequence
  Synthetic
cacacatcacgagtctcc

SEQ ID NO: 17016 - DNA, 23 bp, Artificial Sequence
  Synthetic
tatgatcatctgaaactgtttgg

SEQ ID NO: 17017 - DNA, 20 bp, Artificial Sequence
  Synthetic
gatgacgcatacgatctact

SEQ ID NO: 17018 - DNA, 18 bp, Artificial Sequence
  Synthetic
ccgtcattacatctcccg

SEQ ID NO: 17019 - DNA, 18 bp, Artificial Sequence
  Synthetic
tttcgacgcaaactttgg

SEQ ID NO: 17020 - DNA, 20 bp, Artificial Sequence
  Synthetic
gttcgttgagagaattaggc

SEQ ID NO: 17021 - DNA, 25 bp, Artificial Sequence
  Synthetic
agaaacatactgatttgtacagaag

SEQ ID NO: 17022 - DNA, 18 bp, Artificial Sequence
  Synthetic
gtgttggtaaacgcgtgt

SEQ ID NO: 17023 - DNA, 18 bp, Artificial Sequence
  Synthetic
tttttcaaacgtctgggc

SEQ ID NO: 17024 - DNA, 18 bp, Artificial Sequence
  Synthetic
gtttgtggagtcggtagc

SEQ ID NO: 17025 - DNA, 20 bp, Artificial Sequence
  Synthetic
gagcctagcgattagtttgt

SEQ ID NO: 17026 - DNA, 18 bp, Artificial Sequence
  Synthetic
tgatgccaatgaagcctt

SEQ ID NO: 17027 - DNA, 19 bp, Artificial Sequence
  Synthetic
tgaatgggagcctttgaac

SEQ ID NO: 17028 - DNA, 21 bp, Artificial Sequence
  Synthetic
atctgtgtttgtatctgctcc

SEQ ID NO: 17029 - DNA, 23 bp, Artificial Sequence
  Synthetic
tgaattttttctggaatcttgag

SEQ ID NO: 17030 - DNA, 16 bp, Artificial Sequence
  Synthetic
gccgacacactgcagc

SEQ ID NO: 17031 - DNA, 18 bp, Artificial Sequence
  Synthetic
gagctctctcaccccgtg

SEQ ID NO: 17032 - DNA, 17 bp, Artificial Sequence
  Synthetic
ggccgccgagattaacg

SEQ ID NO: 17033 - DNA, 17 bp, Artificial Sequence
  Synthetic
ccggtgattcccggaga

SEQ ID NO: 17034 - DNA, 16 bp, Artificial Sequence
  Synthetic
acatgagggcggccag

SEQ ID NO: 17035 - DNA, 18 bp, Artificial Sequence
  Synthetic
ccttaatgggaacgggga

SEQ ID NO: 17036 - DNA, 21 bp, Artificial Sequence
  Synthetic
ctattgccgcaaatatcattg

SEQ ID NO: 17037 - DNA, 20 bp, Artificial Sequence
  Synthetic
gtttcctttggcatatccgc

SEQ ID NO: 17038 - DNA, 18 bp, Artificial Sequence
  Synthetic
tttctgacatgaccctcg

SEQ ID NO: 17039 - DNA, 20 bp, Artificial Sequence
  Synthetic
ctcatcggaggacttgaatg

SEQ ID NO: 17040 - DNA, 18 bp, Artificial Sequence
  Synthetic
gtaaccgaaaacggtccg

SEQ ID NO: 17041 - DNA, 25 bp, Artificial Sequence
  Synthetic
ttatggaaaagtgaatcagtatagg

SEQ ID NO: 17042 - DNA, 20 bp, Artificial Sequence
  Synthetic
tcagaagatgaccatgaaca

SEQ ID NO: 17043 - DNA, 19 bp, Artificial Sequence
  Synthetic
tatagtgtgccccaactgt

SEQ ID NO: 17044 - DNA, 18 bp, Artificial Sequence
  Synthetic
gcgacagttgaaacggaa

SEQ ID NO: 17045 - DNA, 18 bp, Artificial Sequence
  Synthetic
tggacaacgtgtagatgg

SEQ ID NO: 17046 - DNA, 21 bp, Artificial Sequence
  Synthetic
gttggaacatagttttgctga

SEQ ID NO: 17047 - DNA, 19 bp, Artificial Sequence
  Synthetic
cagtttagagctgcagaca

SEQ ID NO: 17048 - DNA, 19 bp, Artificial Sequence
  Synthetic
catgcagcaattgaaatgc

SEQ ID NO: 17049 - DNA, 18 bp, Artificial Sequence
  Synthetic
cggagacttgtccatcag

SEQ ID NO: 17050 - DNA, 20 bp, Artificial Sequence
  Synthetic
catcaggtacagatgtccct

SEQ ID NO: 17051 - DNA, 20 bp, Artificial Sequence
  Synthetic
ttaacatctggtcctgacat

SEQ ID NO: 17052 - DNA, 23 bp, Artificial Sequence
  Synthetic
ccatattttgaattgaaaaagcc

SEQ ID NO: 17053 - DNA, 25 bp, Artificial Sequence
  Synthetic
gttgctatggattataaacaaactc

SEQ ID NO: 17054 - DNA, 18 bp, Artificial Sequence
  Synthetic
gcccctacctcttcttcc

SEQ ID NO: 17055 - DNA, 18 bp, Artificial Sequence
  Synthetic
gttccctgccaaaaatgc

SEQ ID NO: 17056 - DNA, 23 bp, Artificial Sequence
  Synthetic
acatataaaagcactgtgtacaa

SEQ ID NO: 17057 - DNA, 25 bp, Artificial Sequence
  Synthetic
ctgtttgctattttatagtaaggtc

SEQ ID NO: 17058 - DNA, 21 bp, Artificial Sequence
  Synthetic
atcagcagtataatcatgcac

SEQ ID NO: 17059 - DNA, 18 bp, Artificial Sequence
  Synthetic
gacagctcagcagttgtt

SEQ ID NO: 17060 - DNA, 19 bp, Artificial Sequence
  Synthetic
aggctcacaacatagtgtg

SEQ ID NO: 17061 - DNA, 22 bp, Artificial Sequence
  Synthetic
acaccagaatggatagaaagac

SEQ ID NO: 17062 - DNA, 23 bp, Artificial Sequence
  Synthetic
tatgaaacaatggataaagcatg

SEQ ID NO: 17063 - DNA, 23 bp, Artificial Sequence
  Synthetic
aatggaaatcctgtataccaatt

SEQ ID NO: 17064 - DNA, 19 bp, Artificial Sequence
  Synthetic
ggatgggtggtgtaaagtg

SEQ ID NO: 17065 - DNA, 18 bp, Artificial Sequence
  Synthetic
ggcacctacgaagcctca

SEQ ID NO: 17066 - DNA, 23 bp, Artificial Sequence
  Synthetic
aggtatcggtttcaaaaacataa

SEQ ID NO: 17067 - DNA, 19 bp, Artificial Sequence
  Synthetic
cgccatatatgctgctagg

SEQ ID NO: 17068 - DNA, 25 bp, Artificial Sequence
  Synthetic
agttctactacatatactaatccca

SEQ ID NO: 17069 - DNA, 25 bp, Artificial Sequence
  Synthetic
gataatcccatatttcaaaatgctg

SEQ ID NO: 17070 - DNA, 22 bp, Artificial Sequence
  Synthetic
tcaatctccttttgataccacc

SEQ ID NO: 17071 - DNA, 25 bp, Artificial Sequence
  Synthetic
catactatgaattctaccttactgg

SEQ ID NO: 17072 - DNA, 25 bp, Artificial Sequence
  Synthetic
tttgttttatacactatgccttacc

SEQ ID NO: 17073 - DNA, 18 bp, Artificial Sequence
  Synthetic
cccaatgggtgttgtact

SEQ ID NO: 17074 - DNA, 20 bp, Artificial Sequence
  Synthetic
tgcatacccagcagtagacc

SEQ ID NO: 17075 - DNA, 20 bp, Artificial Sequence
  Synthetic
tgacccagttaaagatgtct

SEQ ID NO: 17076 - DNA, 24 bp, Artificial Sequence
  Synthetic
acatcttctaatatagtgccaatc

SEQ ID NO: 17077 - DNA, 21 bp, Artificial Sequence
  Synthetic
tgtacactgtacaactaggga

SEQ ID NO: 17078 - DNA, 21 bp, Artificial Sequence
  Synthetic
ctggtattgatgaaccaacaa

SEQ ID NO: 17079 - DNA, 24 bp, Artificial Sequence
  Synthetic
tagaaagtttccttggtagatctg

SEQ ID NO: 17080 - DNA, 18 bp, Artificial Sequence
  Synthetic
caggagctccaattcctt

SEQ ID NO: 17081 - DNA, 18 bp, Artificial Sequence
  Synthetic
acatggtgtcattggcat

SEQ ID NO: 17082 - DNA, 18 bp, Artificial Sequence
  Synthetic
aaactcctctgaccctca

SEQ ID NO: 17083 - DNA, 21 bp, Artificial Sequence
  Synthetic
ttgctcaacatacaccttagc

SEQ ID NO: 17084 - DNA, 20 bp, Artificial Sequence
  Synthetic
ccaaaggctgttttagtacc

SEQ ID NO: 17085 - DNA, 23 bp, Artificial Sequence
  Synthetic
tgaaaattattgtgtgtgtgttg

SEQ ID NO: 17086 - DNA, 20 bp, Artificial Sequence
  Synthetic
aaagttggtttgttgtggat

SEQ ID NO: 17087 - DNA, 24 bp, Artificial Sequence
  Synthetic
agaagctacaaaagtaataagtcc

SEQ ID NO: 17088 - DNA, 21 bp, Artificial Sequence
  Synthetic
tatacgcagatgaagatagca

SEQ ID NO: 17089 - DNA, 22 bp, Artificial Sequence
  Synthetic
tatgaggaatgcattagatggt

SEQ ID NO: 17090 - DNA, 22 bp, Artificial Sequence
  Synthetic
ttcaagtttcagaagctaaagc

SEQ ID NO: 17091 - DNA, 18 bp, Artificial Sequence
  Synthetic
ggcctcctccaactccat

SEQ ID NO: 17092 - DNA, 21 bp, Artificial Sequence
  Synthetic
aactgtaaacctcccaaaagg

SEQ ID NO: 17093 - DNA, 23 bp, Artificial Sequence
  Synthetic
aggggaaatcgatattgtatcag

SEQ ID NO: 17094 - DNA, 25 bp, Artificial Sequence
  Synthetic
gatgtttcatttacatttgaaaggg

SEQ ID NO: 17095 - DNA, 22 bp, Artificial Sequence
  Synthetic
tggattggtagtgtttaatccc

SEQ ID NO: 17096 - DNA, 21 bp, Artificial Sequence
  Synthetic
gaagaggaaatccattaggtg

SEQ ID NO: 17097 - DNA, 18 bp, Artificial Sequence
  Synthetic
ggctggaaaggttggaga

SEQ ID NO: 17098 - DNA, 24 bp, Artificial Sequence
  Synthetic
tacaagtatattacttcatgggcc

SEQ ID NO: 17099 - DNA, 18 bp, Artificial Sequence
  Synthetic
gctcagccactaacccgt

SEQ ID NO: 17100 - DNA, 18 bp, Artificial Sequence
  Synthetic
ctgtgggatggaaccaac

SEQ ID NO: 17101 - DNA, 20 bp, Artificial Sequence
  Synthetic
aaattcacacaacctctagc

SEQ ID NO: 17102 - DNA, 19 bp, Artificial Sequence
  Synthetic
taaaggttggtggtggaag

SEQ ID NO: 17103 - DNA, 25 bp, Artificial Sequence
  Synthetic
ttcaaatgttaggagagataacaag

SEQ ID NO: 17104 - DNA, 21 bp, Artificial Sequence
  Synthetic
gataagtcagagttctcaggg

SEQ ID NO: 17105 - DNA, 20 bp, Artificial Sequence
  Synthetic
caagaaaacagcagacaagc

SEQ ID NO: 17106 - DNA, 20 bp, Artificial Sequence
  Synthetic
acaccaatgatgaaacagga

SEQ ID NO: 17107 - DNA, 18 bp, Artificial Sequence
  Synthetic
ctctttgggccaagatcc

SEQ ID NO: 17108 - DNA, 24 bp, Artificial Sequence
  Synthetic
ggttttcctaggtttactattcca

SEQ ID NO: 17109 - DNA, 20 bp, Artificial Sequence
  Synthetic
attcagcacaaactaccatg

SEQ ID NO: 17110 - DNA, 20 bp, Artificial Sequence
  Synthetic
ttggagggctgctactatag

SEQ ID NO: 17111 - DNA, 20 bp, Artificial Sequence
  Synthetic
gtttagacactcaccaaggt

SEQ ID NO: 17112 - DNA, 19 bp, Artificial Sequence
  Synthetic
ctgtcacaagtcaccatgg

SEQ ID NO: 17113 - DNA, 20 bp, Artificial Sequence
  Synthetic
gtttaaccaaaccaggtgac

SEQ ID NO: 17114 - DNA, 18 bp, Artificial Sequence
  Synthetic
acccacagtaacagtccc

SEQ ID NO: 17115 - DNA, 20 bp, Artificial Sequence
  Synthetic
atagaggagagcaaatccag

SEQ ID NO: 17116 - DNA, 20 bp, Artificial Sequence
  Synthetic
ttgatgtgtattgcccaagg

SEQ ID NO: 17117 - DNA, 21 bp, Artificial Sequence
  Synthetic
atatgactatccaacccaacc

SEQ ID NO: 17118 - DNA, 19 bp, Artificial Sequence
  Synthetic
tcctggtgttaaggaacca

SEQ ID NO: 17119 - DNA, 20 bp, Artificial Sequence
  Synthetic
ttcccttatgtgtctttggg

SEQ ID NO: 17120 - DNA, 20 bp, Artificial Sequence
  Synthetic
caggtatcttaacaggctca

SEQ ID NO: 17121 - DNA, 20 bp, Artificial Sequence
  Synthetic
aatgtgaccttccttaaacg

SEQ ID NO: 17122 - DNA, 21 bp, Artificial Sequence
  Synthetic
cgcgagatactaacaaaaacc

SEQ ID NO: 17123 - DNA, 18 bp, Artificial Sequence
  Synthetic
gtcggacagagtgatggt

SEQ ID NO: 17124 - DNA, 20 bp, Artificial Sequence
  Synthetic
gtcgttttcccaaatgaagt

SEQ ID NO: 17125 - DNA, 19 bp, Artificial Sequence
  Synthetic
catccgtcaagaaggaaga

SEQ ID NO: 17126 - DNA, 18 bp, Artificial Sequence
  Synthetic
ggcgatctgaatttcgtg

SEQ ID NO: 17127 - DNA, 19 bp, Artificial Sequence
  Synthetic
attgaccgtttcttgaggg

SEQ ID NO: 17128 - DNA, 20 bp, Artificial Sequence
  Synthetic
acaagcggtaatgcagttga

SEQ ID NO: 17129 - DNA, 18 bp, Artificial Sequence
  Synthetic
accgattacgtggggttt

SEQ ID NO: 17130 - DNA, 18 bp, Artificial Sequence
  Synthetic
cccacacttcaggaccta

SEQ ID NO: 17131 - DNA, 18 bp, Artificial Sequence
  Synthetic
ttggacaatcctgaggtg

SEQ ID NO: 17132 - DNA, 18 bp, Artificial Sequence
  Synthetic
ggttagaccgagtggcga

SEQ ID NO: 17133 - DNA, 20 bp, Artificial Sequence
  Synthetic
gggaatttaacaagacacgc

SEQ ID NO: 17134 - DNA, 19 bp, Artificial Sequence
  Synthetic
gcaggggctacattctgga

SEQ ID NO: 17135 - DNA, 18 bp, Artificial Sequence
  Synthetic
acgaggattgggaggagg

SEQ ID NO: 17136 - DNA, 18 bp, Artificial Sequence
  Synthetic
tggaagacccaagagcga

SEQ ID NO: 17137 - DNA, 20 bp, Artificial Sequence
  Synthetic
gtgcaactttagccagacca

SEQ ID NO: 17138 - DNA, 16 bp, Artificial Sequence
  Synthetic
gggatgggccggagtt

SEQ ID NO: 17139 - DNA, 18 bp, Artificial Sequence
  Synthetic
tggtccacctctcccgat

SEQ ID NO: 17140 - DNA, 20 bp, Artificial Sequence
  Synthetic
ggcctggatcttaaggttgg

SEQ ID NO: 17141 - DNA, 17 bp, Artificial Sequence
  Synthetic
ggggtgatgagctgcga

SEQ ID NO: 17142 - DNA, 16 bp, Artificial Sequence
  Synthetic
tccaggcggtcccaga

SEQ ID NO: 17143 - DNA, 17 bp, Artificial Sequence
  Synthetic
cggagcttgcccttgga

SEQ ID NO: 17144 - DNA, 16 bp, Artificial Sequence
  Synthetic
tgtcctgcaggggcgt

SEQ ID NO: 17145 - DNA, 18 bp, Artificial Sequence
  Synthetic
ccagctgttggggtaggt

SEQ ID NO: 17146 - DNA, 18 bp, Artificial Sequence
  Synthetic
cgcaacgcacttccattc

SEQ ID NO: 17147 - DNA, 20 bp, Artificial Sequence
  Synthetic
tacacatagatgggctccga

SEQ ID NO: 17148 - DNA, 20 bp, Artificial Sequence
  Synthetic
atggttaacggccttgtagg

SEQ ID NO: 17149 - DNA, 18 bp, Artificial Sequence
  Synthetic
ctgggcggctaggacaat

SEQ ID NO: 17150 - DNA, 16 bp, Artificial Sequence
  Synthetic
tcccagcgatcccagc

SEQ ID NO: 17151 - DNA, 16 bp, Artificial Sequence
  Synthetic
cgctgcacgggctgta

SEQ ID NO: 17152 - DNA, 16 bp, Artificial Sequence
  Synthetic
gacgcggcggttgaca

SEQ ID NO: 17153 - DNA, 16 bp, Artificial Sequence
  Synthetic
tccccgtcaacgtcgc

SEQ ID NO: 17154 - DNA, 18 bp, Artificial Sequence
  Synthetic
tcgcgctcaaaatccccg

SEQ ID NO: 17155 - DNA, 18 bp, Artificial Sequence
  Synthetic
ggcgctaacgatgcatct

SEQ ID NO: 17156 - DNA, 19 bp, Artificial Sequence
  Synthetic
atgtcatcatttgcggcgg

SEQ ID NO: 17157 - DNA, 17 bp, Artificial Sequence
  Synthetic
actaggaagtgcggcgg

SEQ ID NO: 17158 - DNA, 18 bp, Artificial Sequence
  Synthetic
cttcctccgtagcctggc

SEQ ID NO: 17159 - DNA, 18 bp, Artificial Sequence
  Synthetic
agcattgccagggttacg

SEQ ID NO: 17160 - DNA, 18 bp, Artificial Sequence
  Synthetic
ggcctacgagcagacggt

SEQ ID NO: 17161 - DNA, 20 bp, Artificial Sequence
  Synthetic
gcgatcaactactcagtgct

SEQ ID NO: 17162 - DNA, 16 bp, Artificial Sequence
  Synthetic
aggatgcacccgctgc

SEQ ID NO: 17163 - DNA, 16 bp, Artificial Sequence
  Synthetic
aggccatccgtcccga

SEQ ID NO: 17164 - DNA, 20 bp, Artificial Sequence
  Synthetic
tttttccagacaagccggca

SEQ ID NO: 17165 - DNA, 19 bp, Artificial Sequence
  Synthetic
acgacaccgacagtttgag

SEQ ID NO: 17166 - DNA, 16 bp, Artificial Sequence
  Synthetic
gcgcggcgtccatgaa

SEQ ID NO: 17167 - DNA, 20 bp, Artificial Sequence
  Synthetic
gaacgccatggccaataacg

SEQ ID NO: 17168 - DNA, 20 bp, Artificial Sequence
  Synthetic
ccttgttagagatgaggcgc

SEQ ID NO: 17169 - DNA, 19 bp, Artificial Sequence
  Synthetic
aagtggggcgtcaaaatgg

SEQ ID NO: 17170 - DNA, 20 bp, Artificial Sequence
  Synthetic
caagtacttggaaagcaaga

SEQ ID NO: 17171 - DNA, 20 bp, Artificial Sequence
  Synthetic
gcaagtttactggtcgctgc

SEQ ID NO: 17172 - DNA, 20 bp, Artificial Sequence
  Synthetic
cgagtgaccgttactgacgc

SEQ ID NO: 17173 - DNA, 16 bp, Artificial Sequence
  Synthetic
gcttacaagcgcgggc

SEQ ID NO: 17174 - DNA, 16 bp, Artificial Sequence
  Synthetic
cagacgagcggccgtt

SEQ ID NO: 17175 - DNA, 17 bp, Artificial Sequence
  Synthetic
tgtgcgcgagtttgctc

SEQ ID NO: 17176 - DNA, 19 bp, Artificial Sequence
  Synthetic
tacccgaccatgcagatca

SEQ ID NO: 17177 - DNA, 16 bp, Artificial Sequence
  Synthetic
gtgcagaccgacccct

SEQ ID NO: 17178 - DNA, 19 bp, Artificial Sequence
  Synthetic
actgttgcagagagatggc

SEQ ID NO: 17179 - DNA, 20 bp, Artificial Sequence
  Synthetic
catcaattttgcgtccctgg

SEQ ID NO: 17180 - DNA, 16 bp, Artificial Sequence
  Synthetic
ccgtgcagcgcgagat

SEQ ID NO: 17181 - DNA, 16 bp, Artificial Sequence
  Synthetic
cagctccggtcgtgca

SEQ ID NO: 17182 - DNA, 16 bp, Artificial Sequence
  Synthetic
ccgggtctggtgcagt

SEQ ID NO: 17183 - DNA, 22 bp, Artificial Sequence
  Synthetic
caaaacaaactaatgctggaaa

SEQ ID NO: 17184 - DNA, 20 bp, Artificial Sequence
  Synthetic
tgtggttgacttacaagaca

SEQ ID NO: 17185 - DNA, 18 bp, Artificial Sequence
  Synthetic
ttgtacctgcccgactcc

SEQ ID NO: 17186 - DNA, 20 bp, Artificial Sequence
  Synthetic
cacctacgagtggaacttcc

SEQ ID NO: 17187 - DNA, 19 bp, Artificial Sequence
  Synthetic
gttcgactcctcggttagc

SEQ ID NO: 17188 - DNA, 16 bp, Artificial Sequence
  Synthetic
ccctgcccttccagca

SEQ ID NO: 17189 - DNA, 20 bp, Artificial Sequence
  Synthetic
tgaagttttcgacgtggtca

SEQ ID NO: 17190 - DNA, 16 bp, Artificial Sequence
  Synthetic
gctcgcgcacctgcta

SEQ ID NO: 17191 - DNA, 18 bp, Artificial Sequence
  Synthetic
gggaaccccaccatgaac

SEQ ID NO: 17192 - DNA, 19 bp, Artificial Sequence
  Synthetic
tgcggtactggtacttggg

SEQ ID NO: 17193 - DNA, 19 bp, Artificial Sequence
  Synthetic
ctgtggggcttgtggttac

SEQ ID NO: 17194 - DNA, 16 bp, Artificial Sequence
  Synthetic
gcgctgaccgttctcg

SEQ ID NO: 17195 - DNA, 20 bp, Artificial Sequence
  Synthetic
tttggaagatctcggtctgc

SEQ ID NO: 17196 - DNA, 20 bp, Artificial Sequence
  Synthetic
tgtttggtctttctgggctg

SEQ ID NO: 17197 - DNA, 20 bp, Artificial Sequence
  Synthetic
gcaacccaaaatcaagcagg

SEQ ID NO: 17198 - DNA, 19 bp, Artificial Sequence
  Synthetic
gttacactagcgccctggt

SEQ ID NO: 17199 - DNA, 18 bp, Artificial Sequence
  Synthetic
ttggaatgtatgcgccgc

SEQ ID NO: 17200 - DNA, 19 bp, Artificial Sequence
  Synthetic
gacgagaacctgaaggagc

SEQ ID NO: 17201 - DNA, 19 bp, Artificial Sequence
  Synthetic
agctggccaactacattgc

SEQ ID NO: 17202 - DNA, 20 bp, Artificial Sequence
  Synthetic
tctttgaggaccaattgcgc

SEQ ID NO: 17203 - DNA, 17 bp, Artificial Sequence
  Synthetic
gcaggcaacagagcagc

SEQ ID NO: 17204 - DNA, 18 bp, Artificial Sequence
  Synthetic
cttgaccaccagggagct

SEQ ID NO: 17205 - DNA, 20 bp, Artificial Sequence
  Synthetic
actaccgtactacttccgcg

SEQ ID NO: 17206 - DNA, 20 bp, Artificial Sequence
  Synthetic
cagttcgtggaggagtttgt

SEQ ID NO: 17207 - DNA, 18 bp, Artificial Sequence
  Synthetic
cccgaagttgcatgagaa

SEQ ID NO: 17208 - DNA, 22 bp, Artificial Sequence
  Synthetic
tatctgctgggttagatattgc

SEQ ID NO: 17209 - DNA, 19 bp, Artificial Sequence
  Synthetic
ctaccaaggagaacatggt

SEQ ID NO: 17210 - DNA, 21 bp, Artificial Sequence
  Synthetic
ccagttacatggtatgatgga

SEQ ID NO: 17211 - DNA, 20 bp, Artificial Sequence
  Synthetic
gtgtcagtcaaaaccttgtt

SEQ ID NO: 17212 - DNA, 22 bp, Artificial Sequence
  Synthetic
gataaggcaaatcgttacagaa

SEQ ID NO: 17213 - DNA, 24 bp, Artificial Sequence
  Synthetic
ctcaggtttgcatattcaaattac

SEQ ID NO: 17214 - DNA, 18 bp, Artificial Sequence
  Synthetic
gccattccccacctacct

SEQ ID NO: 17215 - DNA, 23 bp, Artificial Sequence
  Synthetic
ttcctattacttggtaattgtgg

SEQ ID NO: 17216 - DNA, 19 bp, Artificial Sequence
  Synthetic
ccccagcagaagcaaaagt

SEQ ID NO: 17217 - DNA, 18 bp, Artificial Sequence
  Synthetic
cttccttactcccccctt

SEQ ID NO: 17218 - DNA, 24 bp, Artificial Sequence
  Synthetic
ggtggaaatatatgtgttagagtt

SEQ ID NO: 17219 - DNA, 21 bp, Artificial Sequence
  Synthetic
tttggtagcctatccaaaacc

SEQ ID NO: 17220 - DNA, 19 bp, Artificial Sequence
  Synthetic
cacattctcccaccaccag

SEQ ID NO: 17221 - DNA, 19 bp, Artificial Sequence
  Synthetic
gcaccgcattctaatttcg

SEQ ID NO: 17222 - DNA, 20 bp, Artificial Sequence
  Synthetic
aggcacactgacatacatct

SEQ ID NO: 17223 - DNA, 19 bp, Artificial Sequence
  Synthetic
tgcgaattcccctcaacac

SEQ ID NO: 17224 - DNA, 20 bp, Artificial Sequence
  Synthetic
catcatgttacattcctgca

SEQ ID NO: 17225 - DNA, 19 bp, Artificial Sequence
  Synthetic
ctgcatgctggaataagct

SEQ ID NO: 17226 - DNA, 19 bp, Artificial Sequence
  Synthetic
gtccgtgtgattaaagagc

SEQ ID NO: 17227 - DNA, 18 bp, Artificial Sequence
  Synthetic
cagtacaagcgccaacag

SEQ ID NO: 17228 - DNA, 18 bp, Artificial Sequence
  Synthetic
ttataatggccgggctac

SEQ ID NO: 17229 - DNA, 18 bp, Artificial Sequence
  Synthetic
ccattgttccaagggcaa

SEQ ID NO: 17230 - DNA, 20 bp, Artificial Sequence
  Synthetic
atactcagagacccagttca

SEQ ID NO: 17231 - DNA, 25 bp, Artificial Sequence
  Synthetic
ttgatcatacagacataacatttgg

SEQ ID NO: 17232 - DNA, 18 bp, Artificial Sequence
  Synthetic
ggccgacagaaaacagag

SEQ ID NO: 17233 - DNA, 19 bp, Artificial Sequence
  Synthetic
tctcagatgtcatcggact

SEQ ID NO: 17234 - DNA, 20 bp, Artificial Sequence
  Synthetic
ggagtggaatctctaggaga

SEQ ID NO: 17235 - DNA, 24 bp, Artificial Sequence
  Synthetic
gagggtagaacaaataataatgga

SEQ ID NO: 17236 - DNA, 18 bp, Artificial Sequence
  Synthetic
tcgaagaccacaacacca

SEQ ID NO: 17237 - DNA, 18 bp, Artificial Sequence
  Synthetic
cgggaaaacgggaaatcc

SEQ ID NO: 17238 - DNA, 20 bp, Artificial Sequence
  Synthetic
aaatggctgaaacatacagg

SEQ ID NO: 17239 - DNA, 22 bp, Artificial Sequence
  Synthetic
gcattgacctcaaaataactgt

SEQ ID NO: 17240 - DNA, 24 bp, Artificial Sequence
  Synthetic
tggaacatcactaggtacaattac

SEQ ID NO: 17241 - DNA, 21 bp, Artificial Sequence
  Synthetic
caggcacattatccaaaactc

SEQ ID NO: 17242 - DNA, 25 bp, Artificial Sequence
  Synthetic
tcagttcaaataagaaaaacgtagg

SEQ ID NO: 17243 - DNA, 25 bp, Artificial Sequence
  Synthetic
atccctgataacaataactaatgac

SEQ ID NO: 17244 - DNA, 25 bp, Artificial Sequence
  Synthetic
ctctactctgctaatataacagaaa

SEQ ID NO: 17245 - DNA, 18 bp, Artificial Sequence
  Synthetic
catccacatgtacatgcg

SEQ ID NO: 17246 - DNA, 24 bp, Artificial Sequence
  Synthetic
catacaacaatcaaatctatccac

SEQ ID NO: 17247 - DNA, 21 bp, Artificial Sequence
  Synthetic
gaaaacaccattgctattcac

SEQ ID NO: 17248 - DNA, 23 bp, Artificial Sequence
  Synthetic
ggtaatttctcatacctatgaca

SEQ ID NO: 17249 - DNA, 22 bp, Artificial Sequence
  Synthetic
acttttgaccatcctttttctg

SEQ ID NO: 17250 - DNA, 23 bp, Artificial Sequence
  Synthetic
gaaggtaggctacttaaactagg

SEQ ID NO: 17251 - DNA, 19 bp, Artificial Sequence
  Synthetic
ccactatctcctgatgcag

SEQ ID NO: 17252 - DNA, 19 bp, Artificial Sequence
  Synthetic
cccggcagatcaaaatcag

SEQ ID NO: 17253 - DNA, 25 bp, Artificial Sequence
  Synthetic
gtattaatgtattgtgatgttgtcg

SEQ ID NO: 17254 - DNA, 19 bp, Artificial Sequence
  Synthetic
aagatgagagcagtccagg

SEQ ID NO: 17255 - DNA, 20 bp, Artificial Sequence
  Synthetic
tcttgcagctgttaaagttg

SEQ ID NO: 17256 - DNA, 23 bp, Artificial Sequence
  Synthetic
aagggaaaaattggttaagatgt

SEQ ID NO: 17257 - DNA, 25 bp, Artificial Sequence
  Synthetic
gagtatatgtgttcagtagaattgg

SEQ ID NO: 17258 - DNA, 19 bp, Artificial Sequence
  Synthetic
gggcttatggaactgatga

SEQ ID NO: 17259 - DNA, 21 bp, Artificial Sequence
  Synthetic
ttcgggggtattctaatcaat

SEQ ID NO: 17260 - DNA, 21 bp, Artificial Sequence
  Synthetic
tgagagtaagaggtataggga

SEQ ID NO: 17261 - DNA, 22 bp, Artificial Sequence
  Synthetic
ttatcacaccaattgagacttt

SEQ ID NO: 17262 - DNA, 18 bp, Artificial Sequence
  Synthetic
ggatgtcaatccgacctt

SEQ ID NO: 17263 - DNA, 20 bp, Artificial Sequence
  Synthetic
atcacacccaggaatctttg

SEQ ID NO: 17264 - DNA, 22 bp, Artificial Sequence
  Synthetic
ggatgtgatagaatcaatggat

SEQ ID NO: 17265 - DNA, 22 bp, Artificial Sequence
  Synthetic
acactagcgagaaatatttgtg

SEQ ID NO: 17266 - DNA, 18 bp, Artificial Sequence
  Synthetic
ctgagcattgcacccata

SEQ ID NO: 17267 - DNA, 21 bp, Artificial Sequence
  Synthetic
tcttaggagtctcaatcctga

SEQ ID NO: 17268 - DNA, 22 bp, Artificial Sequence
  Synthetic
gatttgtagccaattttagcat

SEQ ID NO: 17269 - DNA, 19 bp, Artificial Sequence
  Synthetic
tctccacattccagaagtc

SEQ ID NO: 17270 - DNA, 21 bp, Artificial Sequence
  Synthetic
gggaattcttgaagatgaaca

SEQ ID NO: 17271 - DNA, 18 bp, Artificial Sequence
  Synthetic
gtagggtcagcaaagcac

SEQ ID NO: 17272 - DNA, 18 bp, Artificial Sequence
  Synthetic
aaaagtgagggagctgcg

SEQ ID NO: 17273 - DNA, 20 bp, Artificial Sequence
  Synthetic
ggtggttgacctacattgca

SEQ ID NO: 17274 - DNA, 24 bp, Artificial Sequence
  Synthetic
agacatattagaggtgtttaaggt

SEQ ID NO: 17275 - DNA, 19 bp, Artificial Sequence
  Synthetic
tgtgcgatacaaatgtggg

SEQ ID NO: 17276 - DNA, 19 bp, Artificial Sequence
  Synthetic
tgggcatatgacaatgaca

SEQ ID NO: 17277 - DNA, 20 bp, Artificial Sequence
  Synthetic
ggtaccaaaaaaaagctgca

SEQ ID NO: 17278 - DNA, 18 bp, Artificial Sequence
  Synthetic
aggaggaggaggatgagg

SEQ ID NO: 17279 - DNA, 19 bp, Artificial Sequence
  Synthetic
aagggttacaaacaagtgc

SEQ ID NO: 17280 - DNA, 21 bp, Artificial Sequence
  Synthetic
gctttcctatctttcctcact

SEQ ID NO: 17281 - DNA, 19 bp, Artificial Sequence
  Synthetic
gggggattgggtataggca

SEQ ID NO: 17282 - DNA, 18 bp, Artificial Sequence
  Synthetic
gggtctgtgcaggttagc

SEQ ID NO: 17283 - DNA, 19 bp, Artificial Sequence
  Synthetic
gcgctcgggtacactttta

SEQ ID NO: 17284 - DNA, 20 bp, Artificial Sequence
  Synthetic
gtaccagctgtaccatatgt

SEQ ID NO: 17285 - DNA, 18 bp, Artificial Sequence
  Synthetic
cagttcccgtctgcttac

SEQ ID NO: 17286 - DNA, 22 bp, Artificial Sequence
  Synthetic
aataaatctgaagtgccattgg

SEQ ID NO: 17287 - DNA, 25 bp, Artificial Sequence
  Synthetic
ctgattcccaattatttaataagcc

SEQ ID NO: 17288 - DNA, 19 bp, Artificial Sequence
  Synthetic
ttgttggatgactggaact

SEQ ID NO: 17289 - DNA, 20 bp, Artificial Sequence
  Synthetic
tgctacaaaacgcaaaaagc

SEQ ID NO: 17290 - DNA, 20 bp, Artificial Sequence
  Synthetic
tgcaccctgtgagtaagtgt

SEQ ID NO: 17291 - DNA, 18 bp, Artificial Sequence
  Synthetic
gggtgtgtttgacaggtt

SEQ ID NO: 17292 - DNA, 21 bp, Artificial Sequence
  Synthetic
ttggagaaacagtggaattac

SEQ ID NO: 17293 - DNA, 18 bp, Artificial Sequence
  Synthetic
gacgtttgcatccaacac

SEQ ID NO: 17294 - DNA, 19 bp, Artificial Sequence
  Synthetic
gggacggtccagtacttcc

SEQ ID NO: 17295 - DNA, 18 bp, Artificial Sequence
  Synthetic
ccggcccgtcaatcaaag

SEQ ID NO: 17296 - DNA, 21 bp, Artificial Sequence
  Synthetic
tttaccgagtaaaaggttcca

SEQ ID NO: 17297 - DNA, 19 bp, Artificial Sequence
  Synthetic
tgattctggtctcacctgt

SEQ ID NO: 17298 - DNA, 18 bp, Artificial Sequence
  Synthetic
cgcggttcgatgtagggt

SEQ ID NO: 17299 - DNA, 20 bp, Artificial Sequence
  Synthetic
catgtggctgagcaaaaagg

SEQ ID NO: 17300 - DNA, 17 bp, Artificial Sequence
  Synthetic
aggttcctgcggaggtg

SEQ ID NO: 17301 - DNA, 17 bp, Artificial Sequence
  Synthetic
tacttgaggagccggcg

SEQ ID NO: 17302 - DNA, 16 bp, Artificial Sequence
  Synthetic
ccccttccgcctccaa

SEQ ID NO: 17303 - DNA, 18 bp, Artificial Sequence
  Synthetic
gtcgtcacgctccacaac

SEQ ID NO: 17304 - DNA, 18 bp, Artificial Sequence
  Synthetic
gtcctcgaattcgtggcc

SEQ ID NO: 17305 - DNA, 20 bp, Artificial Sequence
  Synthetic
cggtgcgaaatgaagagtgt

SEQ ID NO: 17306 - DNA, 20 bp, Artificial Sequence
  Synthetic
tgagaagcagtttcaggacg

SEQ ID NO: 17307 - DNA, 19 bp, Artificial Sequence
  Synthetic
ttatcaggtacgtgctgtt

SEQ ID NO: 17308 - DNA, 16 bp, Artificial Sequence
  Synthetic
cgatggagcgcatgcc

SEQ ID NO: 17309 - DNA, 18 bp, Artificial Sequence
  Synthetic
cccgttgcagtgattcgg

SEQ ID NO: 17310 - DNA, 17 bp, Artificial Sequence
  Synthetic
gtcccgttgtgcgttgt

SEQ ID NO: 17311 - DNA, 19 bp, Artificial Sequence
  Synthetic
cagacggtgtcagtcaagg

SEQ ID NO: 17312 - DNA, 20 bp, Artificial Sequence
  Synthetic
ccaacagtagtccctctgcc

SEQ ID NO: 17313 - DNA, 19 bp, Artificial Sequence
  Synthetic
cgtcctccccctgaaaagc

SEQ ID NO: 17314 - DNA, 17 bp, Artificial Sequence
  Synthetic
cgtagctggcggttctg

SEQ ID NO: 17315 - DNA, 16 bp, Artificial Sequence
  Synthetic
agccacgcgctagcac

SEQ ID NO: 17316 - DNA, 20 bp, Artificial Sequence
  Synthetic
aaaggggatcaaattggccc

SEQ ID NO: 17317 - DNA, 18 bp, Artificial Sequence
  Synthetic
cgaggcctgcgtaacttg

SEQ ID NO: 17318 - DNA, 19 bp, Artificial Sequence
  Synthetic
ctgtccttagttggcgccg

SEQ ID NO: 17319 - DNA, 18 bp, Artificial Sequence
  Synthetic
cggcggtaacaaaggacg

SEQ ID NO: 17320 - DNA, 18 bp, Artificial Sequence
  Synthetic
gacgcaaagacgctcctg

SEQ ID NO: 17321 - DNA, 20 bp, Artificial Sequence
  Synthetic
cagagagcctagaatcacgc

SEQ ID NO: 17322 - DNA, 19 bp, Artificial Sequence
  Synthetic
ccccacacgccatagacat

SEQ ID NO: 17323 - DNA, 20 bp, Artificial Sequence
  Synthetic
ctttccacacgcaatgaagc

SEQ ID NO: 17324 - DNA, 20 bp, Artificial Sequence
  Synthetic
ttgtatgccagaagcctcct

SEQ ID NO: 17325 - DNA, 16 bp, Artificial Sequence
  Synthetic
cgctgtgcgccctcaa

SEQ ID NO: 17326 - DNA, 17 bp, Artificial Sequence
  Synthetic
tgctgctcctgctcctc

SEQ ID NO: 17327 - DNA, 18 bp, Artificial Sequence
  Synthetic
cggagacacaggatggga

SEQ ID NO: 17328 - DNA, 16 bp, Artificial Sequence
  Synthetic
acggtgcccagtgggt

SEQ ID NO: 17329 - DNA, 20 bp, Artificial Sequence
  Synthetic
gagacagctctgattcacgg

SEQ ID NO: 17330 - DNA, 17 bp, Artificial Sequence
  Synthetic
aagcgtcggagagctgg

SEQ ID NO: 17331 - DNA, 17 bp, Artificial Sequence
  Synthetic
ggacggagtgatggcct

SEQ ID NO: 17332 - DNA, 19 bp, Artificial Sequence
  Synthetic
agtccggagaagatagggc

SEQ ID NO: 17333 - DNA, 18 bp, Artificial Sequence
  Synthetic
gcagggatgtctgaggag

SEQ ID NO: 17334 - DNA, 19 bp, Artificial Sequence
  Synthetic
cggggtggtaactacctgc

SEQ ID NO: 17335 - DNA, 20 bp, Artificial Sequence
  Synthetic
cagacagtgggtatggcaat

SEQ ID NO: 17336 - DNA, 21 bp, Artificial Sequence
  Synthetic
catagaaccaccaaaactgag

SEQ ID NO: 17337 - DNA, 22 bp, Artificial Sequence
  Synthetic
tcaggtttctaagacatcaagg

SEQ ID NO: 17338 - DNA, 20 bp, Artificial Sequence
  Synthetic
agtgagcatagacagaaagc

SEQ ID NO: 17339 - DNA, 19 bp, Artificial Sequence
  Synthetic
tgctgtttaaggcccgaga

SEQ ID NO: 17340 - DNA, 20 bp, Artificial Sequence
  Synthetic
tggctgggactgttattcac

SEQ ID NO: 17341 - DNA, 18 bp, Artificial Sequence
  Synthetic
gcctttgtaacactgtgg

SEQ ID NO: 17342 - DNA, 19 bp, Artificial Sequence
  Synthetic
tggggtcatgatgatgttc

SEQ ID NO: 17343 - DNA, 18 bp, Artificial Sequence
  Synthetic
caggagcgtcacatccca

SEQ ID NO: 17344 - DNA, 19 bp, Artificial Sequence
  Synthetic
gttgcccccagcttctact

SEQ ID NO: 17345 - DNA, 18 bp, Artificial Sequence
  Synthetic
gtggcggcctaatgaaag

SEQ ID NO: 17346 - DNA, 18 bp, Artificial Sequence
  Synthetic
gaggacggggatatggtt

SEQ ID NO: 17347 - DNA, 22 bp, Artificial Sequence
  Synthetic
ggaatatctcaggcatatggag

SEQ ID NO: 17348 - DNA, 22 bp, Artificial Sequence
  Synthetic
acatgtatggtatgtatcccct

SEQ ID NO: 17349 - DNA, 23 bp, Artificial Sequence
  Synthetic
aaacttactagatgatagcgatg

SEQ ID NO: 17350 - DNA, 22 bp, Artificial Sequence
  Synthetic
acagtggaatagaaaatgaagc

SEQ ID NO: 17351 - DNA, 25 bp, Artificial Sequence
  Synthetic
ggtttctcatatgaattcaaaaagc

SEQ ID NO: 17352 - DNA, 24 bp, Artificial Sequence
  Synthetic
tcatgagaaaagaaggaatactgt

SEQ ID NO: 17353 - DNA, 20 bp, Artificial Sequence
  Synthetic
atcagctcttcctaccccac

SEQ ID NO: 17354 - DNA, 23 bp, Artificial Sequence
  Synthetic
aataaagtagaggaaacaacact

SEQ ID NO: 17355 - DNA, 19 bp, Artificial Sequence
  Synthetic
ggtcactcctgaagtagtg

SEQ ID NO: 17356 - DNA, 19 bp, Artificial Sequence
  Synthetic
gaaaatcccgcctttacca

SEQ ID NO: 17357 - DNA, 19 bp, Artificial Sequence
  Synthetic
tggtgtggctcttagagtg

SEQ ID NO: 17358 - DNA, 19 bp, Artificial Sequence
  Synthetic
atcttccaccttccagacc

SEQ ID NO: 17359 - DNA, 21 bp, Artificial Sequence
  Synthetic
gaaactgaaaggtattgaggt

SEQ ID NO: 17360 - DNA, 19 bp, Artificial Sequence
  Synthetic
ctgcccacctcttgaatta

SEQ ID NO: 17361 - DNA, 23 bp, Artificial Sequence
  Synthetic
gggttgtaggtgaaaatattcct

SEQ ID NO: 17362 - DNA, 18 bp, Artificial Sequence
  Synthetic
ccacacgttgtcctgatc

SEQ ID NO: 17363 - DNA, 23 bp, Artificial Sequence
  Synthetic
actgtgaatttaatgtgaaatgc

SEQ ID NO: 17364 - DNA, 23 bp, Artificial Sequence
  Synthetic
ttgcaagaaattgatattcgttg

SEQ ID NO: 17365 - DNA, 23 bp, Artificial Sequence
  Synthetic
gtgagaatgagcatgatactttg

SEQ ID NO: 17366 - DNA, 23 bp, Artificial Sequence
  Synthetic
attgaaaagacgattgttgtttc

SEQ ID NO: 17367 - DNA, 25 bp, Artificial Sequence
  Synthetic
taacaaatgcctcttatatgtatgg

SEQ ID NO: 17368 - DNA, 18 bp, Artificial Sequence
  Synthetic
gacgacgacgacgaagag

SEQ ID NO: 17369 - DNA, 25 bp, Artificial Sequence
  Synthetic
gaacataaagaatctagtagcaagc

SEQ ID NO: 17370 - DNA, 25 bp, Artificial Sequence
  Synthetic
aataaagtagaaggtaatacatggg

SEQ ID NO: 17371 - DNA, 20 bp, Artificial Sequence
  Synthetic
tgttatagacacaggcacat

SEQ ID NO: 17372 - DNA, 18 bp, Artificial Sequence
  Synthetic
actgctgtgcaaactcat

SEQ ID NO: 17373 - DNA, 23 bp, Artificial Sequence
  Synthetic
ttgcactttatacatctaggttt

SEQ ID NO: 17374 - DNA, 22 bp, Artificial Sequence
  Synthetic
attaatacattaccctgtgcag

SEQ ID NO: 17375 - DNA, 25 bp, Artificial Sequence
  Synthetic
attgttggaactgatttatacttcc

SEQ ID NO: 17376 - DNA, 23 bp, Artificial Sequence
  Synthetic
ggtattgaaattgatagaggtgg

SEQ ID NO: 17377 - DNA, 22 bp, Artificial Sequence
  Synthetic
tattttaatcctaatggccagg

SEQ ID NO: 17378 - DNA, 23 bp, Artificial Sequence
  Synthetic
tattttgcatgtgaaatggaaca

SEQ ID NO: 17379 - DNA, 20 bp, Artificial Sequence
  Synthetic
tgaacaggccaaaaatgaac

SEQ ID NO: 17380 - DNA, 18 bp, Artificial Sequence
  Synthetic
agggctcaacctttcaga

SEQ ID NO: 17381 - DNA, 20 bp, Artificial Sequence
  Synthetic
caactgtggaaaactccatt

SEQ ID NO: 17382 - DNA, 25 bp, Artificial Sequence
  Synthetic
tgcagatttcttaaaattagagagg

SEQ ID NO: 17383 - DNA, 18 bp, Artificial Sequence
  Synthetic
ccagaccggatgatggaa

SEQ ID NO: 17384 - DNA, 23 bp, Artificial Sequence
  Synthetic
taaaggacaagaaatgtgatgtc

SEQ ID NO: 17385 - DNA, 18 bp, Artificial Sequence
  Synthetic
cattttggcgccaactct

SEQ ID NO: 17386 - DNA, 18 bp, Artificial Sequence
  Synthetic
ggggtgtgtagacattgc

SEQ ID NO: 17387 - DNA, 20 bp, Artificial Sequence
  Synthetic
ctgacgctgctattagaagt

SEQ ID NO: 17388 - DNA, 25 bp, Artificial Sequence
  Synthetic
tcaaatttgttaaatgatgaggagg

SEQ ID NO: 17389 - DNA, 22 bp, Artificial Sequence
  Synthetic
tgattggattgtaaatcagacc

SEQ ID NO: 17390 - DNA, 21 bp, Artificial Sequence
  Synthetic
atggtacccctgtatttcaac

SEQ ID NO: 17391 - DNA, 23 bp, Artificial Sequence
  Synthetic
caagctttattattttttgcacg

SEQ ID NO: 17392 - DNA, 24 bp, Artificial Sequence
  Synthetic
tttgtagactcagatgatatgtgg

SEQ ID NO: 17393 - DNA, 17 bp, Artificial Sequence
  Synthetic
ccacggggctacgagaa

SEQ ID NO: 17394 - DNA, 17 bp, Artificial Sequence
  Synthetic
gggaagcgagcacctca

SEQ ID NO: 17395 - DNA, 21 bp, Artificial Sequence
  Synthetic
agagtacaaacagttagtgga

SEQ ID NO: 17396 - DNA, 23 bp, Artificial Sequence
  Synthetic
gaatctgcattaactgatcatgt

SEQ ID NO: 17397 - DNA, 18 bp, Artificial Sequence
  Synthetic
gccctcacgtttagttcg

SEQ ID NO: 17398 - DNA, 25 bp, Artificial Sequence
  Synthetic
agtgcatttttatacagatcttagc

SEQ ID NO: 17399 - DNA, 21 bp, Artificial Sequence
  Synthetic
gcgttctaccacatttactgt

SEQ ID NO: 17400 - DNA, 19 bp, Artificial Sequence
  Synthetic
cctgcaactggtaaggtat

SEQ ID NO: 17401 - DNA, 24 bp, Artificial Sequence
  Synthetic
ccagaaaaggaaagattagtatgg

SEQ ID NO: 17402 - DNA, 18 bp, Artificial Sequence
  Synthetic
aatgttatgccaggcact

SEQ ID NO: 17403 - DNA, 19 bp, Artificial Sequence
  Synthetic
tcttacatcacaggcaaca

SEQ ID NO: 17404 - DNA, 20 bp, Artificial Sequence
  Synthetic
acagaaaataacagggtccc

SEQ ID NO: 17405 - DNA, 18 bp, Artificial Sequence
  Synthetic
gaaggggtcttgcaagga

SEQ ID NO: 17406 - DNA, 23 bp, Artificial Sequence
  Synthetic
agacattaaacgaaaaacagatg

SEQ ID NO: 17407 - DNA, 23 bp, Artificial Sequence
  Synthetic
tacaagaaaatgtagaagacctt

SEQ ID NO: 17408 - DNA, 19 bp, Artificial Sequence
  Synthetic
gcaggtaaacgaggaatgt

SEQ ID NO: 17409 - DNA, 18 bp, Artificial Sequence
  Synthetic
aaaaccacgctaaaaccg

SEQ ID NO: 17410 - DNA, 19 bp, Artificial Sequence
  Synthetic
ttttaccgaactggatggg

SEQ ID NO: 17411 - DNA, 23 bp, Artificial Sequence
  Synthetic
agtgttattgatattcaaacgcc

SEQ ID NO: 17412 - DNA, 19 bp, Artificial Sequence
  Synthetic
gggcgcgagatttgtacaa

SEQ ID NO: 17413 - DNA, 18 bp, Artificial Sequence
  Synthetic
cagtgacggaagacctag

SEQ ID NO: 17414 - DNA, 18 bp, Artificial Sequence
  Synthetic
ccttagggcaacattggg

SEQ ID NO: 17415 - DNA, 21 bp, Artificial Sequence
  Synthetic
aaaacgtgaacaagtctatgc

SEQ ID NO: 17416 - DNA, 18 bp, Artificial Sequence
  Synthetic
tagcctttgtaccagcac

SEQ ID NO: 17417 - DNA, 18 bp, Artificial Sequence
  Synthetic
gatgagctggaggaggag

SEQ ID NO: 17418 - DNA, 25 bp, Artificial Sequence
  Synthetic
gggtcagttatttcaaatctaatag

SEQ ID NO: 17419 - DNA, 23 bp, Artificial Sequence
  Synthetic
tccaaaaaaacgtttatttgagg

SEQ ID NO: 17420 - DNA, 20 bp, Artificial Sequence
  Synthetic
atttgtgtttggtcaaatgc

SEQ ID NO: 17421 - DNA, 19 bp, Artificial Sequence
  Synthetic
cagcaagaaaacgaagagt

SEQ ID NO: 17422 - DNA, 19 bp, Artificial Sequence
  Synthetic
tattttgggggtttgggaa

SEQ ID NO: 17423 - DNA, 19 bp, Artificial Sequence
  Synthetic
cagaaggtgttccagagac

SEQ ID NO: 17424 - DNA, 23 bp, Artificial Sequence
  Synthetic
ttgttattcaatcaagaacttgc

SEQ ID NO: 17425 - DNA, 21 bp, Artificial Sequence
  Synthetic
agaattaggtagaggaggtcc

SEQ ID NO: 17426 - DNA, 21 bp, Artificial Sequence
  Synthetic
gcacacaagaattcaagatgg

SEQ ID NO: 17427 - DNA, 21 bp, Artificial Sequence
  Synthetic
aagcgattttaaccagtacac

SEQ ID NO: 17428 - DNA, 20 bp, Artificial Sequence
  Synthetic
ttttgccaaatgtactgtga

SEQ ID NO: 17429 - DNA, 20 bp, Artificial Sequence
  Synthetic
cagaggcgattgttataccg

SEQ ID NO: 17430 - DNA, 24 bp, Artificial Sequence
  Synthetic
ctttacctgaggtgattattaggt

SEQ ID NO: 17431 - DNA, 19 bp, Artificial Sequence
  Synthetic
acttcttgtgcaaactgtg

SEQ ID NO: 17432 - DNA, 18 bp, Artificial Sequence
  Synthetic
ggcaaaacggagactgtt

SEQ ID NO: 17433 - DNA, 24 bp, Artificial Sequence
  Synthetic
taatttcatgatgggagaatttcc

SEQ ID NO: 17434 - DNA, 20 bp, Artificial Sequence
  Synthetic
ctagctctacaaggccaacc

SEQ ID NO: 17435 - DNA, 18 bp, Artificial Sequence
  Synthetic
tagaacggttgcgagaac

SEQ ID NO: 17436 - DNA, 18 bp, Artificial Sequence
  Synthetic
gggcataggtactggcaa

SEQ ID NO: 17437 - DNA, 21 bp, Artificial Sequence
  Synthetic
ccatcagttgttagtacctct

SEQ ID NO: 17438 - DNA, 21 bp, Artificial Sequence
  Synthetic
tatagggggacaatatgagga

SEQ ID NO: 17439 - DNA, 23 bp, Artificial Sequence
  Synthetic
taacaaatacatgagcaaacagt

SEQ ID NO: 17440 - DNA, 23 bp, Artificial Sequence
  Synthetic
tgtcaattttgtaaagtttcagg

SEQ ID NO: 17441 - DNA, 25 bp, Artificial Sequence
  Synthetic
tccttatgccagatataatttttgg

SEQ ID NO: 17442 - DNA, 25 bp, Artificial Sequence
  Synthetic
caactatatctactgactcatttgg

SEQ ID NO: 17443 - DNA, 20 bp, Artificial Sequence
  Synthetic
cgccaaaaggaagtaaagac

SEQ ID NO: 17444 - DNA, 21 bp, Artificial Sequence
  Synthetic
cgagtgacatcaaaatcatgg

SEQ ID NO: 17445 - DNA, 18 bp, Artificial Sequence
  Synthetic
gagagaaagtcggaaccc

SEQ ID NO: 17446 - DNA, 18 bp, Artificial Sequence
  Synthetic
gagtcagctggtgtggat

SEQ ID NO: 17447 - DNA, 22 bp, Artificial Sequence
  Synthetic
cgttttctgtacaaagaaacct

SEQ ID NO: 17448 - DNA, 19 bp, Artificial Sequence
  Synthetic
tttcaaccgaaaacggtac

SEQ ID NO: 17449 - DNA, 23 bp, Artificial Sequence
  Synthetic
acggtaaagtaacaactattcca

SEQ ID NO: 17450 - DNA, 18 bp, Artificial Sequence
  Synthetic
gacagggagacagctcag

SEQ ID NO: 17451 - DNA, 18 bp, Artificial Sequence
  Synthetic
gatggaggctcacagact

SEQ ID NO: 17452 - DNA, 20 bp, Artificial Sequence
  Synthetic
aatacagcacagttttcagg

SEQ ID NO: 17453 - DNA, 25 bp, Artificial Sequence
  Synthetic
cacacatatgtagtaaagtagatga

SEQ ID NO: 17454 - DNA, 24 bp, Artificial Sequence
  Synthetic
attatacagactttaatgacgagg

SEQ ID NO: 17455 - DNA, 18 bp, Artificial Sequence
  Synthetic
tattttgctgctacgcct

SEQ ID NO: 17456 - DNA, 22 bp, Artificial Sequence
  Synthetic
atgctgtgtggttaataaacac

SEQ ID NO: 17457 - DNA, 18 bp, Artificial Sequence
  Synthetic
ggctctgtccatgttagt

SEQ ID NO: 17458 - DNA, 22 bp, Artificial Sequence
  Synthetic
tggataatccagtctttgagga

SEQ ID NO: 17459 - DNA, 22 bp, Artificial Sequence
  Synthetic
cacatgatgtggttatacatgg

SEQ ID NO: 17460 - DNA, 18 bp, Artificial Sequence
  Synthetic
ctcacgtttgcttgctgt

SEQ ID NO: 17461 - DNA, 19 bp, Artificial Sequence
  Synthetic
acagggacacaataatggc

SEQ ID NO: 17462 - DNA, 25 bp, Artificial Sequence
  Synthetic
catactatgaactccactttacttg

SEQ ID NO: 17463 - DNA, 21 bp, Artificial Sequence
  Synthetic
actactactaaaaaacgctcg

SEQ ID NO: 17464 - DNA, 18 bp, Artificial Sequence
  Synthetic
ggttgtgtccctaggcat

SEQ ID NO: 17465 - DNA, 18 bp, Artificial Sequence
  Synthetic
gtaagacgcctcgcctta

SEQ ID NO: 17466 - DNA, 22 bp, Artificial Sequence
  Synthetic
atatcggtgcatatataagtgc

SEQ ID NO: 17467 - DNA, 18 bp, Artificial Sequence
  Synthetic
aagtgtgcaggacattgt

SEQ ID NO: 17468 - DNA, 18 bp, Artificial Sequence
  Synthetic
aaaattgtgtgccccaac

SEQ ID NO: 17469 - DNA, 22 bp, Artificial Sequence
  Synthetic
gtacccgaatggattaaaagac

SEQ ID NO: 17470 - DNA, 20 bp, Artificial Sequence
  Synthetic
agtcatttttggttatcgcc

SEQ ID NO: 17471 - DNA, 23 bp, Artificial Sequence
  Synthetic
aaagtgtttacgttttcaaatcc

SEQ ID NO: 17472 - DNA, 20 bp, Artificial Sequence
  Synthetic
acataaggcacgtgaaatgg

SEQ ID NO: 17473 - DNA, 22 bp, Artificial Sequence
  Synthetic
tacaaaacatgtaagcaaagtg

SEQ ID NO: 17474 - DNA, 25 bp, Artificial Sequence
  Synthetic
gattcttctatagtttcattagtgg

SEQ ID NO: 17475 - DNA, 20 bp, Artificial Sequence
  Synthetic
agaatttcagcacagtgact

SEQ ID NO: 17476 - DNA, 22 bp, Artificial Sequence
  Synthetic
tatgggtccgattttatattgc

SEQ ID NO: 17477 - DNA, 25 bp, Artificial Sequence
  Synthetic
gtcagtagattataaacaaacacag

SEQ ID NO: 17478 - DNA, 18 bp, Artificial Sequence
  Synthetic
gcagatccctatggcgat

SEQ ID NO: 17479 - DNA, 19 bp, Artificial Sequence
  Synthetic
taatagccactgtgtctcc

SEQ ID NO: 17480 - DNA, 22 bp, Artificial Sequence
  Synthetic
aaaagtgatcagatttgcattg

SEQ ID NO: 17481 - DNA, 19 bp, Artificial Sequence
  Synthetic
acgaattcatcaatgtgcc

SEQ ID NO: 17482 - DNA, 20 bp, Artificial Sequence
  Synthetic
acccaacaataaagaggagc

SEQ ID NO: 17483 - DNA, 21 bp, Artificial Sequence
  Synthetic
gaatgatgccatcaatttcga

SEQ ID NO: 17484 - DNA, 25 bp, Artificial Sequence
  Synthetic
gagagagagaagaagaaaaaagaga

SEQ ID NO: 17485 - DNA, 25 bp, Artificial Sequence
  Synthetic
aaggaggatagagaatttaaacaag

SEQ ID NO: 17486 - DNA, 18 bp, Artificial Sequence
  Synthetic
aacgtatgactacccgca

SEQ ID NO: 17487 - DNA, 22 bp, Artificial Sequence
  Synthetic
ctgagtgacatcaaaatcatgg

SEQ ID NO: 17488 - DNA, 23 bp, Artificial Sequence
  Synthetic
aataaatacctggaagaacatcc

SEQ ID NO: 17489 - DNA, 18 bp, Artificial Sequence
  Synthetic
ctccctaggaggtctgga

SEQ ID NO: 17490 - DNA, 18 bp, Artificial Sequence
  Synthetic
gagtcaactggtgtggat

SEQ ID NO: 17491 - DNA, 25 bp, Artificial Sequence
  Synthetic
ctattggagatgtaaagttagaact

SEQ ID NO: 17492 - DNA, 21 bp, Artificial Sequence
  Synthetic
aaagtactttagtcctagccc

SEQ ID NO: 17493 - DNA, 20 bp, Artificial Sequence
  Synthetic
aacattactgcaaccacatt

SEQ ID NO: 17494 - DNA, 25 bp, Artificial Sequence
  Synthetic
aataaaatatacccaaggtaaggtg

SEQ ID NO: 17495 - DNA, 24 bp, Artificial Sequence
  Synthetic
ctttttttagtaaactgtggaagc

SEQ ID NO: 17496 - DNA, 23 bp, Artificial Sequence
  Synthetic
tcgcatacatttaaaaaacaagg

SEQ ID NO: 17497 - DNA, 18 bp, Artificial Sequence
  Synthetic
ggggatccgagtctccta

SEQ ID NO: 17498 - DNA, 22 bp, Artificial Sequence
  Synthetic
acctcctacatctactcctaag

SEQ ID NO: 17499 - DNA, 18 bp, Artificial Sequence
  Synthetic
tggctcagttgaattgca

SEQ ID NO: 17500 - DNA, 19 bp, Artificial Sequence
  Synthetic
acatcctgttattcctggc

SEQ ID NO: 17501 - DNA, 18 bp, Artificial Sequence
  Synthetic
ggtgctaaggacgctaga

SEQ ID NO: 17502 - DNA, 23 bp, Artificial Sequence
  Synthetic
gtttgagggtaatggtaaaaagt

SEQ ID NO: 17503 - DNA, 25 bp, Artificial Sequence
  Synthetic
cttacagatatattgattctcttgc

SEQ ID NO: 17504 - DNA, 19 bp, Artificial Sequence
  Synthetic
tattgcttttggaggcacc

SEQ ID NO: 17505 - DNA, 24 bp, Artificial Sequence
  Synthetic
acctgttccacaagtactacaaca

SEQ ID NO: 17506 - DNA, 22 bp, Artificial Sequence
  Synthetic
tgctgcagctgtttcatgattt

SEQ ID NO: 17507 - DNA, 25 bp, Artificial Sequence
  Synthetic
gcagagtagcatcatctagaaaacc

SEQ ID NO: 17508 - DNA, 25 bp, Artificial Sequence
  Synthetic
tggcgagcataataatatagcacat

SEQ ID NO: 17509 - DNA, 19 bp, Artificial Sequence
  Synthetic
ggtggggaaacggagtcgc

SEQ ID NO: 17510 - DNA, 20 bp, Artificial Sequence
  Synthetic
ataccccagcaccgaccacc

SEQ ID NO: 17511 - DNA, 25 bp, Artificial Sequence
  Synthetic
tgagcctgattttgaaatgctacaa

SEQ ID NO: 17512 - DNA, 25 bp, Artificial Sequence
  Synthetic
ggacctcccaaagtctctaattcta

SEQ ID NO: 17513 - DNA, 20 bp, Artificial Sequence
  Synthetic
aatgcctcatctggagcagc

SEQ ID NO: 17514 - DNA, 23 bp, Artificial Sequence
  Synthetic
gggttaacaatagtgtgtggcac

SEQ ID NO: 17515 - DNA, 25 bp, Artificial Sequence
  Synthetic
ggatttcctgttaatccaatgccta

SEQ ID NO: 17516 - DNA, 25 bp, Artificial Sequence
  Synthetic
ggccatttaccttatttactggtga

SEQ ID NO: 17517 - DNA, 22 bp, Artificial Sequence
  Synthetic
ccagaatgcatattgtccccag

SEQ ID NO: 17518 - DNA, 25 bp, Artificial Sequence
  Synthetic
gtctgtaactaagtcctaaggatgc

SEQ ID NO: 17519 - DNA, 20 bp, Artificial Sequence
  Synthetic
aatgcctgcaataagcacgc

SEQ ID NO: 17520 - DNA, 24 bp, Artificial Sequence
  Synthetic
ggacaacaaagagaaagtccttcg

SEQ ID NO: 17521 - DNA, 24 bp, Artificial Sequence
  Synthetic
actttcgttttagggcagctattg

SEQ ID NO: 17522 - DNA, 25 bp, Artificial Sequence
  Synthetic
gcgccaagctttctaaagaaagatt

SEQ ID NO: 17523 - DNA, 20 bp, Artificial Sequence
  Synthetic
gcgtgtcttggaggtcgagg

SEQ ID NO: 17524 - DNA, 25 bp, Artificial Sequence
  Synthetic
ccaagtctagacagacctgttgttt

SEQ ID NO: 17525 - DNA, 25 bp, Artificial Sequence
  Synthetic
ctccaggatttactctactaggagt

SEQ ID NO: 17526 - DNA, 20 bp, Artificial Sequence
  Synthetic
acggttggatgtccactagc

SEQ ID NO: 17527 - DNA, 24 bp, Artificial Sequence
  Synthetic
ctctggtgtgtaatgtctccaaag

SEQ ID NO: 17528 - DNA, 20 bp, Artificial Sequence
  Synthetic
agcaaaatccagatcgggcg

SEQ ID NO: 17529 - DNA, 24 bp, Artificial Sequence
  Synthetic
tcgcctatgacttggatgaagtat

SEQ ID NO: 17530 - DNA, 24 bp, Artificial Sequence
  Synthetic
ccgaataggaaagtatgggtgacc

SEQ ID NO: 17531 - DNA, 22 bp, Artificial Sequence
  Synthetic
ggtctaaagatacgtcctggcg

SEQ ID NO: 17532 - DNA, 23 bp, Artificial Sequence
  Synthetic
ggtgttccaaagtacacatgtga

SEQ ID NO: 17533 - DNA, 22 bp, Artificial Sequence
  Synthetic
ggtcctggaggctgtacgacac

SEQ ID NO: 17534 - DNA, 20 bp, Artificial Sequence
  Synthetic
gactccgccaacgatctgcc

SEQ ID NO: 17535 - DNA, 22 bp, Artificial Sequence
  Synthetic
gcgcctaggacagggatgtacc

SEQ ID NO: 17536 - DNA, 22 bp, Artificial Sequence
  Synthetic
cactggttcccaacacctgcta

SEQ ID NO: 17537 - DNA, 19 bp, Artificial Sequence
  Synthetic
ccattgacaaggccggcgc

SEQ ID NO: 17538 - DNA, 22 bp, Artificial Sequence
  Synthetic
cctctcgggacagccactagaa

SEQ ID NO: 17539 - DNA, 22 bp, Artificial Sequence
  Synthetic
gacgtatcttgcacggaggacc

SEQ ID NO: 17540 - DNA, 21 bp, Artificial Sequence
  Synthetic
ggggacatgtccaccctgtct

SEQ ID NO: 17541 - DNA, 20 bp, Artificial Sequence
  Synthetic
gccgcgttgaggtggatcaa

SEQ ID NO: 17542 - DNA, 22 bp, Artificial Sequence
  Synthetic
cacgtttggagtgctgcttcac

SEQ ID NO: 17543 - DNA, 19 bp, Artificial Sequence
  Synthetic
aaatcccgtaggccgccgg

SEQ ID NO: 17544 - DNA, 19 bp, Artificial Sequence
  Synthetic
aacacctgcacctcgccgg

SEQ ID NO: 17545 - DNA, 20 bp, Artificial Sequence
  Synthetic
acaagacaggccctcccgag

SEQ ID NO: 17546 - DNA, 22 bp, Artificial Sequence
  Synthetic
cggtgcgcacacttggatcaat

SEQ ID NO: 17547 - DNA, 21 bp, Artificial Sequence
  Synthetic
cccccttgatgtgttgcaggg

SEQ ID NO: 17548 - DNA, 22 bp, Artificial Sequence
  Synthetic
gcgagacagaatcttgcgggac

SEQ ID NO: 17549 - DNA, 20 bp, Artificial Sequence
  Synthetic
aaacctctctgtcgggggcc

SEQ ID NO: 17550 - DNA, 21 bp, Artificial Sequence
  Synthetic
gggggctagtaactgaggcgg

SEQ ID NO: 17551 - DNA, 22 bp, Artificial Sequence
  Synthetic
cggcacaaacaactcccacaac

SEQ ID NO: 17552 - DNA, 22 bp, Artificial Sequence
  Synthetic
tccctggaaggctgggaagtac

SEQ ID NO: 17553 - DNA, 20 bp, Artificial Sequence
  Synthetic
acacgggcacttgaggtcct

SEQ ID NO: 17554 - DNA, 19 bp, Artificial Sequence
  Synthetic
acaggaggggtctgcgcag

SEQ ID NO: 17555 - DNA, 22 bp, Artificial Sequence
  Synthetic
tgggcgcaagagatctgacttc

SEQ ID NO: 17556 - DNA, 22 bp, Artificial Sequence
  Synthetic
gctctcagtgcggatgtcttgt

SEQ ID NO: 17557 - DNA, 19 bp, Artificial Sequence
  Synthetic
gtcatcgccgcagaccagg

SEQ ID NO: 17558 - DNA, 22 bp, Artificial Sequence
  Synthetic
cgcctgcaagtggagtgagttt

SEQ ID NO: 17559 - DNA, 25 bp, Artificial Sequence
  Synthetic
gctgattttcctcctgttattgctg

SEQ ID NO: 17560 - DNA, 22 bp, Artificial Sequence
  Synthetic
agtctccagctgctttcatttg

SEQ ID NO: 17561 - DNA, 24 bp, Artificial Sequence
  Synthetic
gtgtctattgtgtagcctgttccc

SEQ ID NO: 17562 - DNA, 20 bp, Artificial Sequence
  Synthetic
catggcattctgtgaccctg

SEQ ID NO: 17563 - DNA, 21 bp, Artificial Sequence
  Synthetic
cgtttccacctacgggtaaac

SEQ ID NO: 17564 - DNA, 25 bp, Artificial Sequence
  Synthetic
cccatcccattgttgatcatattgt

SEQ ID NO: 17565 - DNA, 25 bp, Artificial Sequence
  Synthetic
ttctggaatatgcaggtttctcaaa

SEQ ID NO: 17566 - DNA, 22 bp, Artificial Sequence
  Synthetic
aaggttgcaacacttagcgtag

SEQ ID NO: 17567 - DNA, 20 bp, Artificial Sequence
  Synthetic
gcatatctggtcccccctca

SEQ ID NO: 17568 - DNA, 25 bp, Artificial Sequence
  Synthetic
actgtatctcgggttttctttctcc

SEQ ID NO: 17569 - DNA, 23 bp, Artificial Sequence
  Synthetic
cgcttgtattgttgtacgatcct

SEQ ID NO: 17570 - DNA, 24 bp, Artificial Sequence
  Synthetic
atccctgaactacctcttttcgat

SEQ ID NO: 17571 - DNA, 24 bp, Artificial Sequence
  Synthetic
tgccatcctccttctataaaacca

SEQ ID NO: 17572 - DNA, 22 bp, Artificial Sequence
  Synthetic
tttgtggtgtggtgtcattgtg

SEQ ID NO: 17573 - DNA, 23 bp, Artificial Sequence
  Synthetic
aacttgactttgctaagagccat

SEQ ID NO: 17574 - DNA, 25 bp, Artificial Sequence
  Synthetic
tgggtagtaagcctttataacgttt

SEQ ID NO: 17575 - DNA, 20 bp, Artificial Sequence
  Synthetic
cccattatgcctaggccagc

SEQ ID NO: 17576 - DNA, 24 bp, Artificial Sequence
  Synthetic
aaccatggcatctcttataccatc

SEQ ID NO: 17577 - DNA, 25 bp, Artificial Sequence
  Synthetic
gtttgtttgttggtcttctgttggt

SEQ ID NO: 17578 - DNA, 25 bp, Artificial Sequence
  Synthetic
tgggtgtggatatttgtttcactag

SEQ ID NO: 17579 - DNA, 25 bp, Artificial Sequence
  Synthetic
cctgagtaagggatgatttttgcat

SEQ ID NO: 17580 - DNA, 25 bp, Artificial Sequence
  Synthetic
ctgatgaacaatgacttgggatgat

SEQ ID NO: 17581 - DNA, 21 bp, Artificial Sequence
  Synthetic
tgattgagagtgtcccaggtc

SEQ ID NO: 17582 - DNA, 25 bp, Artificial Sequence
  Synthetic
gcaaggtacaaagttgaacacttca

SEQ ID NO: 17583 - DNA, 23 bp, Artificial Sequence
  Synthetic
ttcccttttgacttgtgtgttct

SEQ ID NO: 17584 - DNA, 24 bp, Artificial Sequence
  Synthetic
gcatttgttttgaggattggcaac

SEQ ID NO: 17585 - DNA, 25 bp, Artificial Sequence
  Synthetic
actccatttgataagctgactacag

SEQ ID NO: 17586 - DNA, 23 bp, Artificial Sequence
  Synthetic
actgatcctgcattgtcacagta

SEQ ID NO: 17587 - DNA, 23 bp, Artificial Sequence
  Synthetic
accactcagttgatccttgctta

SEQ ID NO: 17588 - DNA, 20 bp, Artificial Sequence
  Synthetic
cactccaactacaccgaggg

SEQ ID NO: 17589 - DNA, 23 bp, Artificial Sequence
  Synthetic
ctgagttctctttctttgcctgt

SEQ ID NO: 17590 - DNA, 24 bp, Artificial Sequence
  Synthetic
tctgtagtggtatagtgttgtgca

SEQ ID NO: 17591 - DNA, 25 bp, Artificial Sequence
  Synthetic
ggcgatgcaaatagttaacacttaa

SEQ ID NO: 17592 - DNA, 22 bp, Artificial Sequence
  Synthetic
ggaggctgcacgacactcatac

SEQ ID NO: 17593 - DNA, 19 bp, Artificial Sequence
  Synthetic
acgatctgaccgccacccg

SEQ ID NO: 17594 - DNA, 19 bp, Artificial Sequence
  Synthetic
tggcagcgcctccaagagg

SEQ ID NO: 17595 - DNA, 19 bp, Artificial Sequence
  Synthetic
tcgaggcgttaccctcgcg

SEQ ID NO: 17596 - DNA, 20 bp, Artificial Sequence
  Synthetic
ttgtgggatccggagcagct

SEQ ID NO: 17597 - DNA, 21 bp, Artificial Sequence
  Synthetic
tgggcaaaatcggtaaggcgt

SEQ ID NO: 17598 - DNA, 22 bp, Artificial Sequence
  Synthetic
tccgcacactttggtgaatcca

SEQ ID NO: 17599 - DNA, 22 bp, Artificial Sequence
  Synthetic
cggacctgtccctgtcttccag

SEQ ID NO: 17600 - DNA, 19 bp, Artificial Sequence
  Synthetic
acaagaccgtgcgtcccgg

SEQ ID NO: 17601 - DNA, 21 bp, Artificial Sequence
  Synthetic
ggtccgaagatggccaggagt

SEQ ID NO: 17602 - DNA, 22 bp, Artificial Sequence
  Synthetic
cgggagaagacgactggttcca

SEQ ID NO: 17603 - DNA, 22 bp, Artificial Sequence
  Synthetic
cccgtggtagacagtccagcat

SEQ ID NO: 17604 - DNA, 22 bp, Artificial Sequence
  Synthetic
aaagtccaccgctttagccact

SEQ ID NO: 17605 - DNA, 22 bp, Artificial Sequence
  Synthetic
aggaacttgccgtaggtggagt

SEQ ID NO: 17606 - DNA, 21 bp, Artificial Sequence
  Synthetic
cgagctcgtcgcacttcttct

SEQ ID NO: 17607 - DNA, 22 bp, Artificial Sequence
  Synthetic
ggacgagtcgaacatgccggag

SEQ ID NO: 17608 - DNA, 19 bp, Artificial Sequence
  Synthetic
gggtgttggcccatggagg

SEQ ID NO: 17609 - DNA, 21 bp, Artificial Sequence
  Synthetic
tgcttgaactgctcagcgagc

SEQ ID NO: 17610 - DNA, 19 bp, Artificial Sequence
  Synthetic
aaggcagtagcggcaccgg

SEQ ID NO: 17611 - DNA, 18 bp, Artificial Sequence
  Synthetic
tgcatcgctctccggcac

SEQ ID NO: 17612 - DNA, 22 bp, Artificial Sequence
  Synthetic
gtcctaggaccgacgatcctca

SEQ ID NO: 17613 - DNA, 22 bp, Artificial Sequence
  Synthetic
cgggtactcgtggagtcctact

SEQ ID NO: 17614 - DNA, 22 bp, Artificial Sequence
  Synthetic
agcggatcgaaggagtccagaa

SEQ ID NO: 17615 - DNA, 20 bp, Artificial Sequence
  Synthetic
gccggaagttgaggagctgc

SEQ ID NO: 17616 - DNA, 22 bp, Artificial Sequence
  Synthetic
ctttggcaagcactgcgtgaag

SEQ ID NO: 17617 - DNA, 21 bp, Artificial Sequence
  Synthetic
acacgatgagacgagctggct

SEQ ID NO: 17618 - DNA, 22 bp, Artificial Sequence
  Synthetic
gcccccaacataaagcctctca

SEQ ID NO: 17619 - DNA, 22 bp, Artificial Sequence
  Synthetic
ggggttgtagggtcacgggtaa

SEQ ID NO: 17620 - DNA, 22 bp, Artificial Sequence
  Synthetic
tgcggccaccctattgatttca

SEQ ID NO: 17621 - DNA, 25 bp, Artificial Sequence
  Synthetic
cccatattctttcattgccttttcc

SEQ ID NO: 17622 - DNA, 25 bp, Artificial Sequence
  Synthetic
ggagaaatttaggcttctcaactcc

SEQ ID NO: 17623 - DNA, 25 bp, Artificial Sequence
  Synthetic
tgtctttggaattttctcctcgttt

SEQ ID NO: 17624 - DNA, 22 bp, Artificial Sequence
  Synthetic
cttgcaatgtgctcaattggag

SEQ ID NO: 17625 - DNA, 25 bp, Artificial Sequence
  Synthetic
tcggatcagtaagagagaattccat

SEQ ID NO: 17626 - DNA, 25 bp, Artificial Sequence
  Synthetic
gtctttttctttgacagaagactcg

SEQ ID NO: 17627 - DNA, 20 bp, Artificial Sequence
  Synthetic
gagggccttccactttctgc

SEQ ID NO: 17628 - DNA, 25 bp, Artificial Sequence
  Synthetic
ccaagcgaatctctgtagagtttta

SEQ ID NO: 17629 - DNA, 21 bp, Artificial Sequence
  Synthetic
ggggttcagtagcagacattg

SEQ ID NO: 17630 - DNA, 23 bp, Artificial Sequence
  Synthetic
caggtcaaacggttctggtttta

SEQ ID NO: 17631 - DNA, 25 bp, Artificial Sequence
  Synthetic
gcttccacaaaaaaccatccattac

SEQ ID NO: 17632 - DNA, 22 bp, Artificial Sequence
  Synthetic
ccgggggcttaggtccttttct

SEQ ID NO: 17633 - DNA, 23 bp, Artificial Sequence
  Synthetic
aggattgccatctaatgcattgc

SEQ ID NO: 17634 - DNA, 22 bp, Artificial Sequence
  Synthetic
gtgttgctagggtctccattct

SEQ ID NO: 17635 - DNA, 23 bp, Artificial Sequence
  Synthetic
gttcggtgctgtatactgtcttt

SEQ ID NO: 17636 - DNA, 25 bp, Artificial Sequence
  Synthetic
ccacataatacactttgtgttctgc

SEQ ID NO: 17637 - DNA, 25 bp, Artificial Sequence
  Synthetic
gggttaccctcatatacaggattgt

SEQ ID NO: 17638 - DNA, 20 bp, Artificial Sequence
  Synthetic
aggacgtgcgggaacaaatg

SEQ ID NO: 17639 - DNA, 22 bp, Artificial Sequence
  Synthetic
gaggtagctacatcaaggggta

SEQ ID NO: 17640 - DNA, 24 bp, Artificial Sequence
  Synthetic
cccgttgtaaccagtatggcttat

SEQ ID NO: 17641 - DNA, 25 bp, Artificial Sequence
  Synthetic
gggttataccaaagttccagtcctc

SEQ ID NO: 17642 - DNA, 19 bp, Artificial Sequence
  Synthetic
tcaggaggcaccacaggcg

SEQ ID NO: 17643 - DNA, 22 bp, Artificial Sequence
  Synthetic
acgagcccccaactgtgtacta

SEQ ID NO: 17644 - DNA, 22 bp, Artificial Sequence
  Synthetic
ctgggcttgggtttggatgagt

SEQ ID NO: 17645 - DNA, 20 bp, Artificial Sequence
  Synthetic
tggcagtggggtcaaactgc

SEQ ID NO: 17646 - DNA, 20 bp, Artificial Sequence
  Synthetic
gtctttggcactccctggca

SEQ ID NO: 17647 - DNA, 20 bp, Artificial Sequence
  Synthetic
ggctgatttggggggggttt

SEQ ID NO: 17648 - DNA, 22 bp, Artificial Sequence
  Synthetic
ggcaagattacaggcggccttt

SEQ ID NO: 17649 - DNA, 21 bp, Artificial Sequence
  Synthetic
tcgccaggttccattggcttt

SEQ ID NO: 17650 - DNA, 22 bp, Artificial Sequence
  Synthetic
gcatttcgaacagggtgggact

SEQ ID NO: 17651 - DNA, 22 bp, Artificial Sequence
  Synthetic
gctggcgtaaggtaggagttcc

SEQ ID NO: 17652 - DNA, 20 bp, Artificial Sequence
  Synthetic
tggggtaggggggcatgtag

SEQ ID NO: 17653 - DNA, 22 bp, Artificial Sequence
  Synthetic
gcgaacgtggtgcaaatagacg

SEQ ID NO: 17654 - DNA, 25 bp, Artificial Sequence
  Synthetic
acacatattgaggaagtcttgggaa

SEQ ID NO: 17655 - DNA, 21 bp, Artificial Sequence
  Synthetic
gcgcttaccgggatgagagca

SEQ ID NO: 17656 - DNA, 22 bp, Artificial Sequence
  Synthetic
gggcaggattgcagggtttaga

SEQ ID NO: 17657 - DNA, 20 bp, Artificial Sequence
  Synthetic
taggggcaggtccatgattg

SEQ ID NO: 17658 - DNA, 19 bp, Artificial Sequence
  Synthetic
gcgggatcctagcgtggga

SEQ ID NO: 17659 - DNA, 20 bp, Artificial Sequence
  Synthetic
ggctggaggcgatgtggttg

SEQ ID NO: 17660 - DNA, 22 bp, Artificial Sequence
  Synthetic
agagcgggagaaagaggaggaa

SEQ ID NO: 17661 - DNA, 20 bp, Artificial Sequence
  Synthetic
tttgcctgttccatgcccgg

SEQ ID NO: 17662 - DNA, 22 bp, Artificial Sequence
  Synthetic
ggaggggagtcgagggataagg

SEQ ID NO: 17663 - DNA, 23 bp, Artificial Sequence
  Synthetic
tgtagtactaaagatggctggcc

SEQ ID NO: 17664 - DNA, 20 bp, Artificial Sequence
  Synthetic
acgtcagggcctagcctgag

SEQ ID NO: 17665 - DNA, 21 bp, Artificial Sequence
  Synthetic
ggatggcggcctcaggtaagg

SEQ ID NO: 17666 - DNA, 21 bp, Artificial Sequence
  Synthetic
gccatatggtccactgtggtt

SEQ ID NO: 17667 - DNA, 25 bp, Artificial Sequence
  Synthetic
ttgtcattggtccatttctattcca

SEQ ID NO: 17668 - DNA, 25 bp, Artificial Sequence
  Synthetic
aggagaaattttgcaatcttggagt

SEQ ID NO: 17669 - DNA, 23 bp, Artificial Sequence
  Synthetic
ctagtggatctgctgatactgct

SEQ ID NO: 17670 - DNA, 25 bp, Artificial Sequence
  Synthetic
gcacccttattttcaatgtttggag

SEQ ID NO: 17671 - DNA, 25 bp, Artificial Sequence
  Synthetic
gcacttttgcatctttctgaaaatg

SEQ ID NO: 17672 - DNA, 22 bp, Artificial Sequence
  Synthetic
gtttcactgacctcctcaggag

SEQ ID NO: 17673 - DNA, 25 bp, Artificial Sequence
  Synthetic
ccctcatttgttggaatagagtcct

SEQ ID NO: 17674 - DNA, 20 bp, Artificial Sequence
  Synthetic
tccggatgtgccttcatctg

SEQ ID NO: 17675 - DNA, 20 bp, Artificial Sequence
  Synthetic
caaagagggcctgccacttt

SEQ ID NO: 17676 - DNA, 22 bp, Artificial Sequence
  Synthetic
tccattcaagtcctccgatgag

SEQ ID NO: 17677 - DNA, 22 bp, Artificial Sequence
  Synthetic
tccatggctgtatggaggatct

SEQ ID NO: 17678 - DNA, 25 bp, Artificial Sequence
  Synthetic
acttccattgtttcaaggcatgaat

SEQ ID NO: 17679 - DNA, 25 bp, Artificial Sequence
  Synthetic
agcctctcttattcagtctttgttt

SEQ ID NO: 17680 - DNA, 23 bp, Artificial Sequence
  Synthetic
tctcacaacatttgccagtttgg

SEQ ID NO: 17681 - DNA, 25 bp, Artificial Sequence
  Synthetic
gctggtatttgtgttcgaatcttca

SEQ ID NO: 17682 - DNA, 22 bp, Artificial Sequence
  Synthetic
agcaaaatcgtcggatgattgg

SEQ ID NO: 17683 - DNA, 25 bp, Artificial Sequence
  Synthetic
ccaaggtcattgtttatcatgttgt

SEQ ID NO: 17684 - DNA, 22 bp, Artificial Sequence
  Synthetic
cgccaacagtaaggtgacgaca

SEQ ID NO: 17685 - DNA, 21 bp, Artificial Sequence
  Synthetic
gcctcgagcttgggcttctcc

SEQ ID NO: 17686 - DNA, 22 bp, Artificial Sequence
  Synthetic
agtttcggggattgtgaaccgt

SEQ ID NO: 17687 - DNA, 18 bp, Artificial Sequence
  Synthetic
agcagcgtggcggcgaaa

SEQ ID NO: 17688 - DNA, 21 bp, Artificial Sequence
  Synthetic
gcagtaccactaccgccaccc

SEQ ID NO: 17689 - DNA, 23 bp, Artificial Sequence
  Synthetic
aatgttgcgttgttggagagtat

SEQ ID NO: 17690 - DNA, 20 bp, Artificial Sequence
  Synthetic
caagaagcgaccgcagtggg

SEQ ID NO: 17691 - DNA, 20 bp, Artificial Sequence
  Synthetic
gcgtgctgcatagcttggcg

SEQ ID NO: 17692 - DNA, 22 bp, Artificial Sequence
  Synthetic
cggtgctttctgcagtgtgtgg

SEQ ID NO: 17693 - DNA, 21 bp, Artificial Sequence
  Synthetic
cgaaacgagaggctcagccgc

SEQ ID NO: 17694 - DNA, 20 bp, Artificial Sequence
  Synthetic
tccacaggtaccgcgtctgt

SEQ ID NO: 17695 - DNA, 18 bp, Artificial Sequence
  Synthetic
ccggcggctgcagttgtt

SEQ ID NO: 17696 - DNA, 22 bp, Artificial Sequence
  Synthetic
cgcctcgttttcctcttcggtg

SEQ ID NO: 17697 - DNA, 22 bp, Artificial Sequence
  Synthetic
gcgcctctctcatggatccact

SEQ ID NO: 17698 - DNA, 19 bp, Artificial Sequence
  Synthetic
tgacgtacccgccgggaac

SEQ ID NO: 17699 - DNA, 18 bp, Artificial Sequence
  Synthetic
tggagtttgcgcgcgtcg

SEQ ID NO: 17700 - DNA, 19 bp, Artificial Sequence
  Synthetic
accccgtgcaacgtcgaga

SEQ ID NO: 17701 - DNA, 21 bp, Artificial Sequence
  Synthetic
gcagctatgctcgatgaccga

SEQ ID NO: 17702 - DNA, 20 bp, Artificial Sequence
  Synthetic
gccgtcaacagcgtgccttt

SEQ ID NO: 17703 - DNA, 21 bp, Artificial Sequence
  Synthetic
gccgacttggaggactttgcc

SEQ ID NO: 17704 - DNA, 19 bp, Artificial Sequence
  Synthetic
gccgtagttgtcgcggtcc

SEQ ID NO: 17705 - DNA, 21 bp, Artificial Sequence
  Synthetic
cgactgccgcatggtttcctc

SEQ ID NO: 17706 - DNA, 21 bp, Artificial Sequence
  Synthetic
cgctcgtcagcaggtagaagg

SEQ ID NO: 17707 - DNA, 20 bp, Artificial Sequence
  Synthetic
cccttgaacatcccgcagca

SEQ ID NO: 17708 - DNA, 19 bp, Artificial Sequence
  Synthetic
gcgcggtcattctggccaa

SEQ ID NO: 17709 - DNA, 18 bp, Artificial Sequence
  Synthetic
gctcgcagtagtggcgca

SEQ ID NO: 17710 - DNA, 20 bp, Artificial Sequence
  Synthetic
agtgcgtatacggggctggg

SEQ ID NO: 17711 - DNA, 20 bp, Artificial Sequence
  Synthetic
aagcagccgcgtcttaagcg

SEQ ID NO: 17712 - DNA, 20 bp, Artificial Sequence
  Synthetic
ctacgcacctgtggccgcag

SEQ ID NO: 17713 - DNA, 19 bp, Artificial Sequence
  Synthetic
taccagcggcccatggtgc

SEQ ID NO: 17714 - DNA, 20 bp, Artificial Sequence
  Synthetic
ccgcgcacttttgccaagtc

SEQ ID NO: 17715 - DNA, 19 bp, Artificial Sequence
  Synthetic
tggcgcagttctggcacgg

SEQ ID NO: 17716 - DNA, 20 bp, Artificial Sequence
  Synthetic
agacgcgcgtactcggaaac

SEQ ID NO: 17717 - DNA, 22 bp, Artificial Sequence
  Synthetic
ccagacctccagcaacaccgtc

SEQ ID NO: 17718 - DNA, 19 bp, Artificial Sequence
  Synthetic
acggtttccacgccaccgc

SEQ ID NO: 17719 - DNA, 19 bp, Artificial Sequence
  Synthetic
ctgcgcgaagaactgggct

SEQ ID NO: 17720 - DNA, 20 bp, Artificial Sequence
  Synthetic
cgtggttggagcagcaccag

SEQ ID NO: 17721 - DNA, 19 bp, Artificial Sequence
  Synthetic
ttctggcggtgggtcccga

SEQ ID NO: 17722 - DNA, 20 bp, Artificial Sequence
  Synthetic
ggcgtccgaatggtgggtag

SEQ ID NO: 17723 - DNA, 21 bp, Artificial Sequence
  Synthetic
acgcggccattttgtgtttgg

SEQ ID NO: 17724 - DNA, 20 bp, Artificial Sequence
  Synthetic
tgtcaaccgtcgcatcacgc

SEQ ID NO: 17725 - DNA, 22 bp, Artificial Sequence
  Synthetic
cgttgtggtagaacggcaaccg

SEQ ID NO: 17726 - DNA, 21 bp, Artificial Sequence
  Synthetic
cgcagattctcggccaacagc

SEQ ID NO: 17727 - DNA, 20 bp, Artificial Sequence
  Synthetic
gcacccaggacctccggtac

SEQ ID NO: 17728 - DNA, 22 bp, Artificial Sequence
  Synthetic
ccgcagaaagtcgaagatgccc

SEQ ID NO: 17729 - DNA, 22 bp, Artificial Sequence
  Synthetic
gtgagcaccatcagcacctgat

SEQ ID NO: 17730 - DNA, 21 bp, Artificial Sequence
  Synthetic
ggctgcagcgctttcagaatt

SEQ ID NO: 17731 - DNA, 19 bp, Artificial Sequence
  Synthetic
ttcgggtagctgcaggccg

SEQ ID NO: 17732 - DNA, 21 bp, Artificial Sequence
  Synthetic
cggttgggcgcgttgatctag

SEQ ID NO: 17733 - DNA, 21 bp, Artificial Sequence
  Synthetic
cagtccgccgctcattttgtg

SEQ ID NO: 17734 - DNA, 19 bp, Artificial Sequence
  Synthetic
tgatgcgggtgcgtagggt

SEQ ID NO: 17735 - DNA, 19 bp, Artificial Sequence
  Synthetic
gaaagcgaagacggcgccc

SEQ ID NO: 17736 - DNA, 22 bp, Artificial Sequence
  Synthetic
gtcatggccaatcgtcgtctcc

SEQ ID NO: 17737 - DNA, 19 bp, Artificial Sequence
  Synthetic
ggacccgaaaacgagggcg

SEQ ID NO: 17738 - DNA, 22 bp, Artificial Sequence
  Synthetic
cgtgcaggatgacgtggattct

SEQ ID NO: 17739 - DNA, 21 bp, Artificial Sequence
  Synthetic
ggtgagagtagtggtggggct

SEQ ID NO: 17740 - DNA, 19 bp, Artificial Sequence
  Synthetic
gagaggaggagagccggca

SEQ ID NO: 17741 - DNA, 19 bp, Artificial Sequence
  Synthetic
cggcgtcggcgtttccaac

SEQ ID NO: 17742 - DNA, 20 bp, Artificial Sequence
  Synthetic
catctctaccgccgccgtgc

SEQ ID NO: 17743 - DNA, 21 bp, Artificial Sequence
  Synthetic
tgcgacgaacacgaagctctc

SEQ ID NO: 17744 - DNA, 20 bp, Artificial Sequence
  Synthetic
caccgacacagcagcaccag

SEQ ID NO: 17745 - DNA, 22 bp, Artificial Sequence
  Synthetic
gcgtccgacgatgtgctcttct

SEQ ID NO: 17746 - DNA, 22 bp, Artificial Sequence
  Synthetic
cgtcttttcggcgctcaacaag

SEQ ID NO: 17747 - DNA, 19 bp, Artificial Sequence
  Synthetic
acgcccgccagaagtacgc

SEQ ID NO: 17748 - DNA, 19 bp, Artificial Sequence
  Synthetic
tctgttggcggggctcacg

SEQ ID NO: 17749 - DNA, 20 bp, Artificial Sequence
  Synthetic
agaggctacccgaccgtagc

SEQ ID NO: 17750 - DNA, 20 bp, Artificial Sequence
  Synthetic
gacggtcgtggtctcctcgg

SEQ ID NO: 17751 - DNA, 21 bp, Artificial Sequence
  Synthetic
acagtacgacggcaacccaac

SEQ ID NO: 17752 - DNA, 21 bp, Artificial Sequence
  Synthetic
catcctgctgtcacacgacga

SEQ ID NO: 17753 - DNA, 18 bp, Artificial Sequence
  Synthetic
aagcgcgtgcccacccaa

SEQ ID NO: 17754 - DNA, 22 bp, Artificial Sequence
  Synthetic
acctggcatcgcagcctctttc

SEQ ID NO: 17755 - DNA, 19 bp, Artificial Sequence
  Synthetic
tggcttacgacgctgacgc

SEQ ID NO: 17756 - DNA, 22 bp, Artificial Sequence
  Synthetic
ggtcgaacctcataacggtggg

SEQ ID NO: 17757 - DNA, 22 bp, Artificial Sequence
  Synthetic
cttgcgcttaccgatccgctta

SEQ ID NO: 17758 - DNA, 19 bp, Artificial Sequence
  Synthetic
gctcactcaacaccgccgt

SEQ ID NO: 17759 - DNA, 22 bp, Artificial Sequence
  Synthetic
acgtgacgatcaaaagtgcccg

SEQ ID NO: 17760 - DNA, 19 bp, Artificial Sequence
  Synthetic
acgatgatggcccgcgacg

SEQ ID NO: 17761 - DNA, 22 bp, Artificial Sequence
  Synthetic
gcaaccagtgctccactacgtc

SEQ ID NO: 17762 - DNA, 19 bp, Artificial Sequence
  Synthetic
acatggacgccgcctctgc

SEQ ID NO: 17763 - DNA, 18 bp, Artificial Sequence
  Synthetic
atgcaaagacggcgcggg

SEQ ID NO: 17764 - DNA, 18 bp, Artificial Sequence
  Synthetic
tgttgtgtccgccgctgc

SEQ ID NO: 17765 - DNA, 20 bp, Artificial Sequence
  Synthetic
cccgggcactgatcctgacc

SEQ ID NO: 17766 - DNA, 20 bp, Artificial Sequence
  Synthetic
cacgctgaccggcgatcagg

SEQ ID NO: 17767 - DNA, 19 bp, Artificial Sequence
  Synthetic
ttggcccacgacgcctgac

SEQ ID NO: 17768 - DNA, 20 bp, Artificial Sequence
  Synthetic
gcgactcctggacctgcgta

SEQ ID NO: 17769 - DNA, 19 bp, Artificial Sequence
  Synthetic
agatgtggcaggcgcgtct

SEQ ID NO: 17770 - DNA, 19 bp, Artificial Sequence
  Synthetic
acaaccccacgggccgaag

SEQ ID NO: 17771 - DNA, 18 bp, Artificial Sequence
  Synthetic
tctcggtgctgggcgctt

SEQ ID NO: 17772 - DNA, 19 bp, Artificial Sequence
  Synthetic
agggactggaggtgcgcgt

SEQ ID NO: 17773 - DNA, 19 bp, Artificial Sequence
  Synthetic
cgctgtgctggcatcgagt

SEQ ID NO: 17774 - DNA, 22 bp, Artificial Sequence
  Synthetic
ccatgacctacgtgcgcaagtt

SEQ ID NO: 17775 - DNA, 20 bp, Artificial Sequence
  Synthetic
tcgctcgaccgttcgtacga

SEQ ID NO: 17776 - DNA, 22 bp, Artificial Sequence
  Synthetic
gcggtctccacgtcaggtacga

SEQ ID NO: 17777 - DNA, 18 bp, Artificial Sequence
  Synthetic
aacgcgctgcacgaccac

SEQ ID NO: 17778 - DNA, 20 bp, Artificial Sequence
  Synthetic
cggaacccgccatgcaacga

SEQ ID NO: 17779 - DNA, 22 bp, Artificial Sequence
  Synthetic
cgctcgagctcctgcctaaagt

SEQ ID NO: 17780 - DNA, 22 bp, Artificial Sequence
  Synthetic
tcccagtaacagacgacccagt

SEQ ID NO: 17781 - DNA, 22 bp, Artificial Sequence
  Synthetic
gccacgtggttttcgagaacgt

SEQ ID NO: 17782 - DNA, 19 bp, Artificial Sequence
  Synthetic
gggagcgcggtggaagaca

SEQ ID NO: 17783 - DNA, 19 bp, Artificial Sequence
  Synthetic
tctcccccgattccagcgt

SEQ ID NO: 17784 - DNA, 18 bp, Artificial Sequence
  Synthetic
cgctcatccgcgtgctct

SEQ ID NO: 17785 - DNA, 20 bp, Artificial Sequence
  Synthetic
cacggcgtgtccttgctacc

SEQ ID NO: 17786 - DNA, 19 bp, Artificial Sequence
  Synthetic
ttcacgtccgggtggctgc

SEQ ID NO: 17787 - DNA, 22 bp, Artificial Sequence
  Synthetic
ggcgctgatgatgttgacgtcg

SEQ ID NO: 17788 - DNA, 21 bp, Artificial Sequence
  Synthetic
agatgatgcaccccgaactcg

SEQ ID NO: 17789 - DNA, 19 bp, Artificial Sequence
  Synthetic
gcctaacctccgctcgcac

SEQ ID NO: 17790 - DNA, 22 bp, Artificial Sequence
  Synthetic
gcggaggaagattcgtctgagc

SEQ ID NO: 17791 - DNA, 19 bp, Artificial Sequence
  Synthetic
ggccgacgctggttctcct

SEQ ID NO: 17792 - DNA, 21 bp, Artificial Sequence
  Synthetic
ggtcgcagatgagcagcttct

SEQ ID NO: 17793 - DNA, 19 bp, Artificial Sequence
  Synthetic
ttctccaacgcgcggcagg

SEQ ID NO: 17794 - DNA, 22 bp, Artificial Sequence
  Synthetic
cgtccaggttactcggggaaca

SEQ ID NO: 17795 - DNA, 19 bp, Artificial Sequence
  Synthetic
tcgtcctccccttcgtccg

SEQ ID NO: 17796 - DNA, 22 bp, Artificial Sequence
  Synthetic
accactagcttggctacgtgga

SEQ ID NO: 17797 - DNA, 20 bp, Artificial Sequence
  Synthetic
tcgtcgcgctccagcacata

SEQ ID NO: 17798 - DNA, 21 bp, Artificial Sequence
  Synthetic
cgcgctctcttgaacacgaca

SEQ ID NO: 17799 - DNA, 21 bp, Artificial Sequence
  Synthetic
cggatctgcggctcaaacacc

SEQ ID NO: 17800 - DNA, 20 bp, Artificial Sequence
  Synthetic
gactttacggtgcgcggcga

SEQ ID NO: 17801 - DNA, 22 bp, Artificial Sequence
  Synthetic
tctgccgccaccaaaagatctg

SEQ ID NO: 17802 - DNA, 18 bp, Artificial Sequence
  Synthetic
tttccctaccgcgcgctg

SEQ ID NO: 17803 - DNA, 20 bp, Artificial Sequence
  Synthetic
tccacgatgtcggcgatgac

SEQ ID NO: 17804 - DNA, 21 bp, Artificial Sequence
  Synthetic
cccccagggcgttgtaaaagt

SEQ ID NO: 17805 - DNA, 20 bp, Artificial Sequence
  Synthetic
ggggatgtcgtgggtctcct

SEQ ID NO: 17806 - DNA, 22 bp, Artificial Sequence
  Synthetic
gcgcttgagaaaaatgtcgcgg

SEQ ID NO: 17807 - DNA, 20 bp, Artificial Sequence
  Synthetic
agccctcgagcgtgtacgtc

SEQ ID NO: 17808 - DNA, 19 bp, Artificial Sequence
  Synthetic
tgcagactcttgccctgcg

SEQ ID NO: 17809 - DNA, 21 bp, Artificial Sequence
  Synthetic
acagcctggatctcaccgtca

SEQ ID NO: 17810 - DNA, 20 bp, Artificial Sequence
  Synthetic
cgctggatgacggtgatgcg

SEQ ID NO: 17811 - DNA, 22 bp, Artificial Sequence
  Synthetic
actgctgtggtgttgccttctg

SEQ ID NO: 17812 - DNA, 22 bp, Artificial Sequence
  Synthetic
gccacgacaaacactaccgtcg

SEQ ID NO: 17813 - DNA, 19 bp, Artificial Sequence
  Synthetic
tgcatccgtccggtggtgc

SEQ ID NO: 17814 - DNA, 19 bp, Artificial Sequence
  Synthetic
ttccgtgctggcgatcgcg

SEQ ID NO: 17815 - DNA, 22 bp, Artificial Sequence
  Synthetic
tctacccaccctgcgagacatc

SEQ ID NO: 17816 - DNA, 19 bp, Artificial Sequence
  Synthetic
agtgtgccgcacaaggccg

SEQ ID NO: 17817 - DNA, 22 bp, Artificial Sequence
  Synthetic
cccctggtcttcaagcacactt

SEQ ID NO: 17818 - DNA, 20 bp, Artificial Sequence
  Synthetic
gagatgccaacagtgttgct

SEQ ID NO: 17819 - DNA, 21 bp, Artificial Sequence
  Synthetic
cgtacttttccactccaggcg

SEQ ID NO: 17820 - DNA, 22 bp, Artificial Sequence
  Synthetic
gttaggtcgctactcgctggga

SEQ ID NO: 17821 - DNA, 22 bp, Artificial Sequence
  Synthetic
gagcaagttaccatcccctgca

SEQ ID NO: 17822 - DNA, 19 bp, Artificial Sequence
  Synthetic
agggttgagggggccgttc

SEQ ID NO: 17823 - DNA, 18 bp, Artificial Sequence
  Synthetic
aacgacgacgcggttgcc

SEQ ID NO: 17824 - DNA, 19 bp, Artificial Sequence
  Synthetic
gccacaaaagccaccgcgg

SEQ ID NO: 17825 - DNA, 20 bp, Artificial Sequence
  Synthetic
tgcgcgctgctggtgtttta

SEQ ID NO: 17826 - DNA, 19 bp, Artificial Sequence
  Synthetic
acgaaggtccaagcggcgg

SEQ ID NO: 17827 - DNA, 22 bp, Artificial Sequence
  Synthetic
cgcgtgactctctgttcgatgg

SEQ ID NO: 17828 - DNA, 19 bp, Artificial Sequence
  Synthetic
cccaacggtcacacgtccg

SEQ ID NO: 17829 - DNA, 20 bp, Artificial Sequence
  Synthetic
caacgcggcacttccaacag

SEQ ID NO: 17830 - DNA, 19 bp, Artificial Sequence
  Synthetic
ttcgcacacccagcccctg

SEQ ID NO: 17831 - DNA, 19 bp, Artificial Sequence
  Synthetic
ccgacgtcccgcatccaac

SEQ ID NO: 17832 - DNA, 19 bp, Artificial Sequence
  Synthetic
gaacacgcgcaacagggcc

SEQ ID NO: 17833 - DNA, 20 bp, Artificial Sequence
  Synthetic
tatcgtcgggtcggctgtcc

SEQ ID NO: 17834 - DNA, 21 bp, Artificial Sequence
  Synthetic
cctcgtcatcctccgtgtcgg

SEQ ID NO: 17835 - DNA, 20 bp, Artificial Sequence
  Synthetic
ggcccactttcgggtggagg

SEQ ID NO: 17836 - DNA, 22 bp, Artificial Sequence
  Synthetic
ggtgccgaaatcaccgtgtgaa

SEQ ID NO: 17837 - DNA, 19 bp, Artificial Sequence
  Synthetic
atgtcgcgacacccgggtc

SEQ ID NO: 17838 - DNA, 25 bp, Artificial Sequence
  Synthetic
agaacatatataatcgccgtttcgt

SEQ ID NO: 17839 - DNA, 19 bp, Artificial Sequence
  Synthetic
agcacggggtactcgtggc

SEQ ID NO: 17840 - DNA, 22 bp, Artificial Sequence
  Synthetic
gaaggaaaccgaccccgaaact

SEQ ID NO: 17841 - DNA, 20 bp, Artificial Sequence
  Synthetic
ctcaacctgtgcgccacagc

SEQ ID NO: 17842 - DNA, 21 bp, Artificial Sequence
  Synthetic
ccctcactgggctacgagtgc

SEQ ID NO: 17843 - DNA, 20 bp, Artificial Sequence
  Synthetic
tcatctacgtgccccccggg

SEQ ID NO: 17844 - DNA, 19 bp, Artificial Sequence
  Synthetic
tcagcgaaaccggcacccg

SEQ ID NO: 17845 - DNA, 19 bp, Artificial Sequence
  Synthetic
ggctgtcatgggtctgcgc

SEQ ID NO: 17846 - DNA, 19 bp, Artificial Sequence
  Synthetic
atcgttcacgtcgccgccg

SEQ ID NO: 17847 - DNA, 18 bp, Artificial Sequence
  Synthetic
acagcagccgcgcttgtc

SEQ ID NO: 17848 - DNA, 21 bp, Artificial Sequence
  Synthetic
gcgtctacgtggtgatgctgc

SEQ ID NO: 17849 - DNA, 19 bp, Artificial Sequence
  Synthetic
aggcctggttacagcgcgg

SEQ ID NO: 17850 - DNA, 20 bp, Artificial Sequence
  Synthetic
gcaaccccgccaactggttc

SEQ ID NO: 17851 - DNA, 20 bp, Artificial Sequence
  Synthetic
tgttcgacagcggcgtagac

SEQ ID NO: 17852 - DNA, 21 bp, Artificial Sequence
  Synthetic
ggtcatgacaccgacgcgttg

SEQ ID NO: 17853 - DNA, 19 bp, Artificial Sequence
  Synthetic
gtcgctcggcattccgcac

SEQ ID NO: 17854 - DNA, 18 bp, Artificial Sequence
  Synthetic
agttgtgccgccggagct

SEQ ID NO: 17855 - DNA, 20 bp, Artificial Sequence
  Synthetic
aaccagatggcgacggacgt

SEQ ID NO: 17856 - DNA, 20 bp, Artificial Sequence
  Synthetic
tgctaaccacgcaaccggat

SEQ ID NO: 17857 - DNA, 18 bp, Artificial Sequence
  Synthetic
atcccggcaagttgcgcg

SEQ ID NO: 17858 - DNA, 20 bp, Artificial Sequence
  Synthetic
cgcctgctctctccaggtcc

SEQ ID NO: 17859 - DNA, 20 bp, Artificial Sequence
  Synthetic
gccttccagactgcacggcc

SEQ ID NO: 17860 - DNA, 20 bp, Artificial Sequence
  Synthetic
cagaaaacacccccccgccc

SEQ ID NO: 17861 - DNA, 25 bp, Artificial Sequence
  Synthetic
tcttccccatattccttcattgtct

SEQ ID NO: 17862 - DNA, 25 bp, Artificial Sequence
  Synthetic
tgtagtcgtatagatccggaagaaa

SEQ ID NO: 17863 - DNA, 20 bp, Artificial Sequence
  Synthetic
ttcgcctctctcggactgac

SEQ ID NO: 17864 - DNA, 23 bp, Artificial Sequence
  Synthetic
tcctcaaagtccaatttttccgg

SEQ ID NO: 17865 - DNA, 20 bp, Artificial Sequence
  Synthetic
caatgtgctcaattggggca

SEQ ID NO: 17866 - DNA, 24 bp, Artificial Sequence
  Synthetic
ccatactcacaaagttcaccacgt

SEQ ID NO: 17867 - DNA, 24 bp, Artificial Sequence
  Synthetic
tctctttgatagaagactcagcct

SEQ ID NO: 17868 - DNA, 22 bp, Artificial Sequence
  Synthetic
cagatgccctgatctcagtagc

SEQ ID NO: 17869 - DNA, 24 bp, Artificial Sequence
  Synthetic
cctctttgtcatacaggatcagct

SEQ ID NO: 17870 - DNA, 24 bp, Artificial Sequence
  Synthetic
ccattttcgcctctccagaaattc

SEQ ID NO: 17871 - DNA, 22 bp, Artificial Sequence
  Synthetic
ttgaagcaatttgaacccctct

SEQ ID NO: 17872 - DNA, 23 bp, Artificial Sequence
  Synthetic
gcatttcagttttcgcgcctaaa

SEQ ID NO: 17873 - DNA, 23 bp, Artificial Sequence
  Synthetic
tccaatatgtcgtcagcttcctg

SEQ ID NO: 17874 - DNA, 22 bp, Artificial Sequence
  Synthetic
ccgaatcgctacagggaaagcc

SEQ ID NO: 17875 - DNA, 20 bp, Artificial Sequence
  Synthetic
acatctacgcctcccagtca

SEQ ID NO: 17876 - DNA, 20 bp, Artificial Sequence
  Synthetic
tactgcaagagctggcgaac

SEQ ID NO: 17877 - DNA, 22 bp, Artificial Sequence
  Synthetic
gcgccagcgagtaaatgcaaac

SEQ ID NO: 17878 - DNA, 25 bp, Artificial Sequence
  Synthetic
gcgcatgaagtaatggttactgttt

SEQ ID NO: 17879 - DNA, 23 bp, Artificial Sequence
  Synthetic
aggcattttctgaagctgcatta

SEQ ID NO: 17880 - DNA, 25 bp, Artificial Sequence
  Synthetic
accccatttaaacacactctagaaa

SEQ ID NO: 17881 - DNA, 22 bp, Artificial Sequence
  Synthetic
ggcgagggtccaatagttgcat

SEQ ID NO: 17882 - DNA, 25 bp, Artificial Sequence
  Synthetic
aggctcatctttacaaaatactgga

SEQ ID NO: 17883 - DNA, 25 bp, Artificial Sequence
  Synthetic
tggttctccacaatatgaatccaag

SEQ ID NO: 17884 - DNA, 22 bp, Artificial Sequence
  Synthetic
tgggaagtctcagttgttgcgt

SEQ ID NO: 17885 - DNA, 22 bp, Artificial Sequence
  Synthetic
cgcaacgaggaagtttgctgga

SEQ ID NO: 17886 - DNA, 23 bp, Artificial Sequence
  Synthetic
ttaaatgccttcagtgtcctcac

SEQ ID NO: 17887 - DNA, 23 bp, Artificial Sequence
  Synthetic
tggtcagaattcctgtacgagga

SEQ ID NO: 17888 - DNA, 21 bp, Artificial Sequence
  Synthetic
gtgtactcacccaaccagttg

SEQ ID NO: 17889 - DNA, 22 bp, Artificial Sequence
  Synthetic
ccaccattttccccacctggaa

SEQ ID NO: 17890 - DNA, 20 bp, Artificial Sequence
  Synthetic
atgcatcggccctcacacac

SEQ ID NO: 17891 - DNA, 21 bp, Artificial Sequence
  Synthetic
ggttcttaccgtgcagatgca

SEQ ID NO: 17892 - DNA, 20 bp, Artificial Sequence
  Synthetic
ggacgtccctggacccttta

SEQ ID NO: 17893 - DNA, 25 bp, Artificial Sequence
  Synthetic
actttctactgcttaaccccagaaa

SEQ ID NO: 17894 - DNA, 22 bp, Artificial Sequence
  Synthetic
acactgcgcacgcttttacaaa

SEQ ID NO: 17895 - DNA, 20 bp, Artificial Sequence
  Synthetic
ctggacatgcaggtcgaggg

SEQ ID NO: 17896 - DNA, 20 bp, Artificial Sequence
  Synthetic
ttcctccgggagctcgtccg

SEQ ID NO: 17897 - DNA, 22 bp, Artificial Sequence
  Synthetic
cactattgaacgtgcgggacat

SEQ ID NO: 17898 - DNA, 22 bp, Artificial Sequence
  Synthetic
cgtcgcggcgaaatgattgaaa

SEQ ID NO: 17899 - DNA, 20 bp, Artificial Sequence
  Synthetic
ttgctcagcttcctggtact

SEQ ID NO: 17900 - DNA, 22 bp, Artificial Sequence
  Synthetic
accgctttgtagatgtggatga

SEQ ID NO: 17901 - DNA, 20 bp, Artificial Sequence
  Synthetic
gctgccggcatcacatggat

SEQ ID NO: 17902 - DNA, 21 bp, Artificial Sequence
  Synthetic
ggatcctgccggtttcgaacc

SEQ ID NO: 17903 - DNA, 22 bp, Artificial Sequence
  Synthetic
gcgaaacatgttctgacgaggc

SEQ ID NO: 17904 - DNA, 24 bp, Artificial Sequence
  Synthetic
agcttctacaaagtcccaaagatg

SEQ ID NO: 17905 - DNA, 19 bp, Artificial Sequence
  Synthetic
cgcttggctgccaccgtag

SEQ ID NO: 17906 - DNA, 24 bp, Artificial Sequence
  Synthetic
gctttgctatccaacaaagcattt

SEQ ID NO: 17907 - DNA, 25 bp, Artificial Sequence
  Synthetic
aaaagtaatcgggtccagactgata

SEQ ID NO: 17908 - DNA, 25 bp, Artificial Sequence
  Synthetic
gcatttgtaaagtattccccgttca

SEQ ID NO: 17909 - DNA, 20 bp, Artificial Sequence
  Synthetic
ttttgcgtcgctgccaacgt

SEQ ID NO: 17910 - DNA, 25 bp, Artificial Sequence
  Synthetic
ggcatgttggtatgtaagatggttt

SEQ ID NO: 17911 - DNA, 21 bp, Artificial Sequence
  Synthetic
ctaattgggtttcggggtccc

SEQ ID NO: 17912 - DNA, 22 bp, Artificial Sequence
  Synthetic
agttgtaactgcgtcctttggg

SEQ ID NO: 17913 - DNA, 22 bp, Artificial Sequence
  Synthetic
cgcactggatgttggctagacc

SEQ ID NO: 17914 - DNA, 20 bp, Artificial Sequence
  Synthetic
gctgcccgcatcatagctcg

SEQ ID NO: 17915 - DNA, 20 bp, Artificial Sequence
  Synthetic
aactcgacgccgtctgctga

SEQ ID NO: 17916 - DNA, 22 bp, Artificial Sequence
  Synthetic
cctctaacttttgccgcttagg

SEQ ID NO: 17917 - DNA, 22 bp, Artificial Sequence
  Synthetic
tgatggacctcgtctacggcta

SEQ ID NO: 17918 - DNA, 20 bp, Artificial Sequence
  Synthetic
aacggatccgggcacagttt

SEQ ID NO: 17919 - DNA, 21 bp, Artificial Sequence
  Synthetic
gccatcttgaaagcgctggtg

SEQ ID NO: 17920 - DNA, 22 bp, Artificial Sequence
  Synthetic
ccacgatccagtacccctcgaa

SEQ ID NO: 17921 - DNA, 22 bp, Artificial Sequence
  Synthetic
tgtttgctgcattgttagctga

SEQ ID NO: 17922 - DNA, 20 bp, Artificial Sequence
  Synthetic
actgcggaattccacaagga

SEQ ID NO: 17923 - DNA, 25 bp, Artificial Sequence
  Synthetic
ggtagttttatgtttcctggagtgt

SEQ ID NO: 17924 - DNA, 24 bp, Artificial Sequence
  Synthetic
agtgtgctctgaagaatcatgttt

SEQ ID NO: 17925 - DNA, 23 bp, Artificial Sequence
  Synthetic
aggtgccgtctaaatagggaatg

SEQ ID NO: 17926 - DNA, 25 bp, Artificial Sequence
  Synthetic
agttgttatgttgaaactctacggt

SEQ ID NO: 17927 - DNA, 22 bp, Artificial Sequence
  Synthetic
gggtccacagcctagatctcga

SEQ ID NO: 17928 - DNA, 22 bp, Artificial Sequence
  Synthetic
gaacatacaacaaaacaggccg

SEQ ID NO: 17929 - DNA, 22 bp, Artificial Sequence
  Synthetic
gctccccccctaggcttgttat

SEQ ID NO: 17930 - DNA, 21 bp, Artificial Sequence
  Synthetic
cttttatgctggccgactacc

SEQ ID NO: 17931 - DNA, 22 bp, Artificial Sequence
  Synthetic
ctgcgtgtgggagcataagtgt

SEQ ID NO: 17932 - DNA, 20 bp, Artificial Sequence
  Synthetic
gttgttgttcgcaatccggc

SEQ ID NO: 17933 - DNA, 20 bp, Artificial Sequence
  Synthetic
tcctcggggggagtctcgta

SEQ ID NO: 17934 - DNA, 25 bp, Artificial Sequence
  Synthetic
gacaggataggggtattttgtgatt

SEQ ID NO: 17935 - DNA, 21 bp, Artificial Sequence
  Synthetic
gcctccgggtcttgcaagttt

SEQ ID NO: 17936 - DNA, 20 bp, Artificial Sequence
  Synthetic
aagcattgctgccaaacacc

SEQ ID NO: 17937 - DNA, 20 bp, Artificial Sequence
  Synthetic
attgctgtcagactgcggtc

SEQ ID NO: 17938 - DNA, 20 bp, Artificial Sequence
  Synthetic
ttgcggctttcggggacatg

SEQ ID NO: 17939 - DNA, 20 bp, Artificial Sequence
  Synthetic
catgagcagtagccccgacg

SEQ ID NO: 17940 - DNA, 20 bp, Artificial Sequence
  Synthetic
tcgtgttcttgacctcgact

SEQ ID NO: 17941 - DNA, 22 bp, Artificial Sequence
  Synthetic
gagagcggcttgttctagcagt

SEQ ID NO: 17942 - DNA, 22 bp, Artificial Sequence
  Synthetic
cgggaacaggacaaatgcaata

SEQ ID NO: 17943 - DNA, 20 bp, Artificial Sequence
  Synthetic
aaatgcttgcgtacagggtg

SEQ ID NO: 17944 - DNA, 25 bp, Artificial Sequence
  Synthetic
agccagaaggtaaagaaaagagaaa

SEQ ID NO: 17945 - DNA, 24 bp, Artificial Sequence
  Synthetic
ccgtagtaccatcgactgacatta

SEQ ID NO: 17946 - DNA, 24 bp, Artificial Sequence
  Synthetic
gaaccgtcaccatactgtaagaaa

SEQ ID NO: 17947 - DNA, 25 bp, Artificial Sequence
  Synthetic
ttggatattcgggaagatcatcagt

SEQ ID NO: 17948 - DNA, 25 bp, Artificial Sequence
  Synthetic
tgttctttgcctggtaaagattcat

SEQ ID NO: 17949 - DNA, 24 bp, Artificial Sequence
  Synthetic
gtttgcaagtctgtcaggtttgac

SEQ ID NO: 17950 - DNA, 23 bp, Artificial Sequence
  Synthetic
aaggggctccaaaacattgatat

SEQ ID NO: 17951 - DNA, 22 bp, Artificial Sequence
  Synthetic
gggtaagagcgttgttgcgaac

SEQ ID NO: 17952 - DNA, 25 bp, Artificial Sequence
  Synthetic
gctcgcatcaaagggataattaaca

SEQ ID NO: 17953 - DNA, 25 bp, Artificial Sequence
  Synthetic
ggttgatgtgattaatcttccctgt

SEQ ID NO: 17954 - DNA, 24 bp, Artificial Sequence
  Synthetic
gcaatttgtgttttgtgtgtgttt

SEQ ID NO: 17955 - DNA, 25 bp, Artificial Sequence
  Synthetic
gatggacactgactgttgttacttt

SEQ ID NO: 17956 - DNA, 20 bp, Artificial Sequence
  Synthetic
gatgcttttgggacgctggt

SEQ ID NO: 17957 - DNA, 22 bp, Artificial Sequence
  Synthetic
aaagctacgttgagtacttcgg

SEQ ID NO: 17958 - DNA, 20 bp, Artificial Sequence
  Synthetic
tgccacctgcgagatttacg

SEQ ID NO: 17959 - DNA, 25 bp, Artificial Sequence
  Synthetic
tgctggcttctgatttgtatgattt

SEQ ID NO: 17960 - DNA, 20 bp, Artificial Sequence
  Synthetic
aagcatgtttcagaggtcgc

SEQ ID NO: 17961 - DNA, 21 bp, Artificial Sequence
  Synthetic
gcctaaacaagagggcgactc

SEQ ID NO: 17962 - DNA, 22 bp, Artificial Sequence
  Synthetic
cttctcgtaggcactttgcgga

SEQ ID NO: 17963 - DNA, 22 bp, Artificial Sequence
  Synthetic
agggagacatcaaggctgggtt

SEQ ID NO: 17964 - DNA, 22 bp, Artificial Sequence
  Synthetic
ccactgccaccaacaaacatcc

SEQ ID NO: 17965 - DNA, 20 bp, Artificial Sequence
  Synthetic
gtgcggtagctttaatggcc

SEQ ID NO: 17966 - DNA, 25 bp, Artificial Sequence
  Synthetic
tctttgttcttctgaagaaatggga

SEQ ID NO: 17967 - DNA, 21 bp, Artificial Sequence
  Synthetic
gtgtgaaattcgcccataggg

SEQ ID NO: 17968 - DNA, 20 bp, Artificial Sequence
  Synthetic
gcaggtattgggtggctctg

SEQ ID NO: 17969 - DNA, 24 bp, Artificial Sequence
  Synthetic
cctatggttccatgtacacacaac

SEQ ID NO: 17970 - DNA, 23 bp, Artificial Sequence
  Synthetic
acttgtcaccaatccattccaag

SEQ ID NO: 17971 - DNA, 24 bp, Artificial Sequence
  Synthetic
ggtctcttccatctggattttgac

SEQ ID NO: 17972 - DNA, 21 bp, Artificial Sequence
  Synthetic
ccccggagttgaatcatctcc

SEQ ID NO: 17973 - DNA, 25 bp, Artificial Sequence
  Synthetic
tccacatcattttcatctgtgacaa

SEQ ID NO: 17974 - DNA, 22 bp, Artificial Sequence
  Synthetic
ggttctttttcaccggggaata

SEQ ID NO: 17975 - DNA, 23 bp, Artificial Sequence
  Synthetic
aaacacccttctgaagttagctg

SEQ ID NO: 17976 - DNA, 20 bp, Artificial Sequence
  Synthetic
gaggccagaaacggctatct

SEQ ID NO: 17977 - DNA, 20 bp, Artificial Sequence
  Synthetic
gtcgtccaaggttgcaggtc

SEQ ID NO: 17978 - DNA, 25 bp, Artificial Sequence
  Synthetic
ctcctcctctgtaatctcatactca

SEQ ID NO: 17979 - DNA, 25 bp, Artificial Sequence
  Synthetic
ttctgcttcatggacaatataccaa

SEQ ID NO: 17980 - DNA, 24 bp, Artificial Sequence
  Synthetic
ggagttattttcacagcctgcaac

SEQ ID NO: 17981 - DNA, 25 bp, Artificial Sequence
  Synthetic
aactctctgttaacatagcatgctt

SEQ ID NO: 17982 - DNA, 24 bp, Artificial Sequence
  Synthetic
tcagaattgcttcttgaagtgcat

SEQ ID NO: 17983 - DNA, 25 bp, Artificial Sequence
  Synthetic
acagtccagttctgctaaatctttg

SEQ ID NO: 17984 - DNA, 22 bp, Artificial Sequence
  Synthetic
gggccctgattttccttctcgt

SEQ ID NO: 17985 - DNA, 25 bp, Artificial Sequence
  Synthetic
actcatgaataagaagttgcagcaa

SEQ ID NO: 17986 - DNA, 22 bp, Artificial Sequence
  Synthetic
tcagcaaacgatcagcaagagt

SEQ ID NO: 17987 - DNA, 25 bp, Artificial Sequence
  Synthetic
gatgttgttgggtctattgcatcta

SEQ ID NO: 17988 - DNA, 22 bp, Artificial Sequence
  Synthetic
gccaatgctatccgttttgtgg

SEQ ID NO: 17989 - DNA, 25 bp, Artificial Sequence
  Synthetic
agtaggtatttgctgaacccttcta

SEQ ID NO: 17990 - DNA, 25 bp, Artificial Sequence
  Synthetic
acttctagtttttattgtgcctcgg

SEQ ID NO: 17991 - DNA, 25 bp, Artificial Sequence
  Synthetic
gtctggcaaattgaatctaaacact

SEQ ID NO: 17992 - DNA, 25 bp, Artificial Sequence
  Synthetic
tccaaagaaaaacaagctatctcca

SEQ ID NO: 17993 - DNA, 21 bp, Artificial Sequence
  Synthetic
cctcaattccagagggaggtg

SEQ ID NO: 17994 - DNA, 23 bp, Artificial Sequence
  Synthetic
ccaaatgactcagagagactgga

SEQ ID NO: 17995 - DNA, 19 bp, Artificial Sequence
  Synthetic
gttggcagctgacgccggt

SEQ ID NO: 17996 - DNA, 20 bp, Artificial Sequence
  Synthetic
ttgcacagccagttgacgtt

SEQ ID NO: 17997 - DNA, 23 bp, Artificial Sequence
  Synthetic
tccatccgttataaaaaagcccg

SEQ ID NO: 17998 - DNA, 22 bp, Artificial Sequence
  Synthetic
gcacatacattgctccgtccct

SEQ ID NO: 17999 - DNA, 20 bp, Artificial Sequence
  Synthetic
tggaggtggccctgtatagg

SEQ ID NO: 18000 - DNA, 25 bp, Artificial Sequence
  Synthetic
gcttaaaaaatccttcccccattct

SEQ ID NO: 18001 - DNA, 25 bp, Artificial Sequence
  Synthetic
gcattgagagaagtaacagtagtct

SEQ ID NO: 18002 - DNA, 25 bp, Artificial Sequence
  Synthetic
gcagctgtaaaatcaactccttcat

SEQ ID NO: 18003 - DNA, 25 bp, Artificial Sequence
  Synthetic
ttaaacatgtcgcaaaccatttgat

SEQ ID NO: 18004 - DNA, 20 bp, Artificial Sequence
  Synthetic
tatggtcgttgcagacgtgg

SEQ ID NO: 18005 - DNA, 25 bp, Artificial Sequence
  Synthetic
gttgttgcatatccagcataatcaa

SEQ ID NO: 18006 - DNA, 24 bp, Artificial Sequence
  Synthetic
agctgtctactaattgctcatagc

SEQ ID NO: 18007 - DNA, 25 bp, Artificial Sequence
  Synthetic
gcactatagcttctaccataaacca

SEQ ID NO: 18008 - DNA, 20 bp, Artificial Sequence
  Synthetic
ctttccactgcctcggctat

SEQ ID NO: 18009 - DNA, 21 bp, Artificial Sequence
  Synthetic
tgctcccgtacactgtttgtg

SEQ ID NO: 18010 - DNA, 25 bp, Artificial Sequence
  Synthetic
actctcctcgcatatgtcattatca

SEQ ID NO: 18011 - DNA, 22 bp, Artificial Sequence
  Synthetic
cttcctcgtcctcagaatcctg

SEQ ID NO: 18012 - DNA, 25 bp, Artificial Sequence
  Synthetic
cggttccatactatactcagtcctt

SEQ ID NO: 18013 - DNA, 20 bp, Artificial Sequence
  Synthetic
gtttccactgtccacgggtc

SEQ ID NO: 18014 - DNA, 25 bp, Artificial Sequence
  Synthetic
tggtagggggtatttttacaacatc

SEQ ID NO: 18015 - DNA, 25 bp, Artificial Sequence
  Synthetic
ggttgttaatagcagccacaatagt

SEQ ID NO: 18016 - DNA, 21 bp, Artificial Sequence
  Synthetic
ctatataggcccacacgaggc

SEQ ID NO: 18017 - DNA, 25 bp, Artificial Sequence
  Synthetic
ggaaaagttatatcagggccagatt

SEQ ID NO: 18018 - DNA, 25 bp, Artificial Sequence
  Synthetic
gcatgataaaatatgttggtgcgag

SEQ ID NO: 18019 - DNA, 25 bp, Artificial Sequence
  Synthetic
ggaacatctgatttattggtctgca

SEQ ID NO: 18020 - DNA, 20 bp, Artificial Sequence
  Synthetic
gtccctgggctttttgtagc

SEQ ID NO: 18021 - DNA, 20 bp, Artificial Sequence
  Synthetic
taaggcaataccgcaccctg

SEQ ID NO: 18022 - DNA, 22 bp, Artificial Sequence
  Synthetic
tcaccggttccgaagaccacta

SEQ ID NO: 18023 - DNA, 22 bp, Artificial Sequence
  Synthetic
ctgcgcggcaacaagtaaactc

SEQ ID NO: 18024 - DNA, 20 bp, Artificial Sequence
  Synthetic
ctgacaccatgtgccagggc

SEQ ID NO: 18025 - DNA, 21 bp, Artificial Sequence
  Synthetic
cggtaggagtaagggccaccc

SEQ ID NO: 18026 - DNA, 22 bp, Artificial Sequence
  Synthetic
cccagtggcctccagagagtaa

SEQ ID NO: 18027 - DNA, 21 bp, Artificial Sequence
  Synthetic
gccttggccgtagctgtcaag

SEQ ID NO: 18028 - DNA, 22 bp, Artificial Sequence
  Synthetic
cggtactgttcatccacacgca

SEQ ID NO: 18029 - DNA, 22 bp, Artificial Sequence
  Synthetic
caggggtgatagctctacccga

SEQ ID NO: 18030 - DNA, 22 bp, Artificial Sequence
  Synthetic
caggagaaaacagggccacagc

SEQ ID NO: 18031 - DNA, 20 bp, Artificial Sequence
  Synthetic
aatcactgagtcgcgaggcc

SEQ ID NO: 18032 - DNA, 22 bp, Artificial Sequence
  Synthetic
cccttatgatgtctccgcacgc

SEQ ID NO: 18033 - DNA, 20 bp, Artificial Sequence
  Synthetic
accgcagtacccaggaagga

SEQ ID NO: 18034 - DNA, 20 bp, Artificial Sequence
  Synthetic
acgaagtctaccgccttggc

SEQ ID NO: 18035 - DNA, 21 bp, Artificial Sequence
  Synthetic
cgtggtgatggtcctgactcc

SEQ ID NO: 18036 - DNA, 22 bp, Artificial Sequence
  Synthetic
ccccccttgatcagctccagag

SEQ ID NO: 18037 - DNA, 20 bp, Artificial Sequence
  Synthetic
cctaccagtgcggcctctcc

SEQ ID NO: 18038 - DNA, 20 bp, Artificial Sequence
  Synthetic
tggagcgagccagaccttgg

SEQ ID NO: 18039 - DNA, 22 bp, Artificial Sequence
  Synthetic
ggtagagcacttcgcgatcagg

SEQ ID NO: 18040 - DNA, 22 bp, Artificial Sequence
  Synthetic
agggtttgttgggtggtcagag

SEQ ID NO: 18041 - DNA, 17 bp, Artificial Sequence
  Synthetic
tggcggcgcaaaatcgc

SEQ ID NO: 18042 - DNA, 21 bp, Artificial Sequence
  Synthetic
ggggatgcctggcattaaggg

SEQ ID NO: 18043 - DNA, 21 bp, Artificial Sequence
  Synthetic
gatgccgtccacttccgtgaa

SEQ ID NO: 18044 - DNA, 20 bp, Artificial Sequence
  Synthetic
acgtggcctgaagaagacgg

SEQ ID NO: 18045 - DNA, 19 bp, Artificial Sequence
  Synthetic
acagggggctgctttgccg

SEQ ID NO: 18046 - DNA, 22 bp, Artificial Sequence
  Synthetic
gccccagtccacgagtatgaca

SEQ ID NO: 18047 - DNA, 20 bp, Artificial Sequence
  Synthetic
ttgcgggaatggctccgaac

SEQ ID NO: 18048 - DNA, 22 bp, Artificial Sequence
  Synthetic
ggagtcaaagcagcgggtatca

SEQ ID NO: 18049 - DNA, 19 bp, Artificial Sequence
  Synthetic
ctacgccgtcgctctcagc

SEQ ID NO: 18050 - DNA, 20 bp, Artificial Sequence
  Synthetic
atcgagtttggcagcggcag

SEQ ID NO: 18051 - DNA, 25 bp, Artificial Sequence
  Synthetic
tgctgtgaccataagacaatatgaa

SEQ ID NO: 18052 - DNA, 22 bp, Artificial Sequence
  Synthetic
gcctcaacattgggtgaattca

SEQ ID NO: 18053 - DNA, 24 bp, Artificial Sequence
  Synthetic
cttgagtgcatctggtaatttcca

SEQ ID NO: 18054 - DNA, 24 bp, Artificial Sequence
  Synthetic
accaataaacaggtttgtcccaaa

SEQ ID NO: 18055 - DNA, 24 bp, Artificial Sequence
  Synthetic
cctgatgtccatggtattgtcatt

SEQ ID NO: 18056 - DNA, 21 bp, Artificial Sequence
  Synthetic
acctaagccttcagtgagtgc

SEQ ID NO: 18057 - DNA, 20 bp, Artificial Sequence
  Synthetic
tgccatgtgtaatcgcccac

SEQ ID NO: 18058 - DNA, 20 bp, Artificial Sequence
  Synthetic
gtagggtagtgctctgggtg

SEQ ID NO: 18059 - DNA, 25 bp, Artificial Sequence
  Synthetic
tggaatagtaaacacctgatgtacg

SEQ ID NO: 18060 - DNA, 25 bp, Artificial Sequence
  Synthetic
tgtcgtatgtcagcaaaacaaacat

SEQ ID NO: 18061 - DNA, 24 bp, Artificial Sequence
  Synthetic
ggagatccatcacatccaagtagt

SEQ ID NO: 18062 - DNA, 23 bp, Artificial Sequence
  Synthetic
cgtcccacaatggatgttgttaa

SEQ ID NO: 18063 - DNA, 25 bp, Artificial Sequence
  Synthetic
tgtgttagaatttgtggaggctaga

SEQ ID NO: 18064 - DNA, 25 bp, Artificial Sequence
  Synthetic
gggggtgctactcaaattaataagt

SEQ ID NO: 18065 - DNA, 25 bp, Artificial Sequence
  Synthetic
ccttgtcacctggaaaaacatcata

SEQ ID NO: 18066 - DNA, 25 bp, Artificial Sequence
  Synthetic
ggttgcctagtttcattctcatgtt

SEQ ID NO: 18067 - DNA, 20 bp, Artificial Sequence
  Synthetic
tctgggggtgtgatggttag

SEQ ID NO: 18068 - DNA, 20 bp, Artificial Sequence
  Synthetic
aacagcccatgggtccagct

SEQ ID NO: 18069 - DNA, 20 bp, Artificial Sequence
  Synthetic
actgagccctcctgcgacaa

SEQ ID NO: 18070 - DNA, 20 bp, Artificial Sequence
  Synthetic
gcaggcagcagtggatgtgt

SEQ ID NO: 18071 - DNA, 21 bp, Artificial Sequence
  Synthetic
cgatgagagcggaatgtcccg

SEQ ID NO: 18072 - DNA, 22 bp, Artificial Sequence
  Synthetic
accaggataccccgtggattgt

SEQ ID NO: 18073 - DNA, 24 bp, Artificial Sequence
  Synthetic
ggcgtaagataattcctgcagaaa

SEQ ID NO: 18074 - DNA, 24 bp, Artificial Sequence
  Synthetic
actctggctgtacaagaattacac

SEQ ID NO: 18075 - DNA, 23 bp, Artificial Sequence
  Synthetic
gctattccactgtcctcaaacag

SEQ ID NO: 18076 - DNA, 25 bp, Artificial Sequence
  Synthetic
tgtttgttttacaacccaatctggt

SEQ ID NO: 18077 - DNA, 25 bp, Artificial Sequence
  Synthetic
acaatctagtaatggctgaatccaa

SEQ ID NO: 18078 - DNA, 20 bp, Artificial Sequence
  Synthetic
ggtggggctgcttgatctcc

SEQ ID NO: 18079 - DNA, 21 bp, Artificial Sequence
  Synthetic
cctgatcgtggaacagatcga

SEQ ID NO: 18080 - DNA, 23 bp, Artificial Sequence
  Synthetic
catggaggtacccttaggaagtg

SEQ ID NO: 18081 - DNA, 22 bp, Artificial Sequence
  Synthetic
tccctccctaggtgtttgagca

SEQ ID NO: 18082 - DNA, 25 bp, Artificial Sequence
  Synthetic
tcatctatttcaaactgcgccatag

SEQ ID NO: 18083 - DNA, 22 bp, Artificial Sequence
  Synthetic
ctgtctagaggagttgtcagct

SEQ ID NO: 18084 - DNA, 25 bp, Artificial Sequence
  Synthetic
gggtcgaaagatacattttgcctat

SEQ ID NO: 18085 - DNA, 24 bp, Artificial Sequence
  Synthetic
tctgtataaaatccggccatttgc

SEQ ID NO: 18086 - DNA, 25 bp, Artificial Sequence
  Synthetic
cctcactagtaactagagaaccact

SEQ ID NO: 18087 - DNA, 25 bp, Artificial Sequence
  Synthetic
acctaaaggtgtctgatccaaatca

SEQ ID NO: 18088 - DNA, 25 bp, Artificial Sequence
  Synthetic
cgaagttaaagtgatagaacaccga

SEQ ID NO: 18089 - DNA, 22 bp, Artificial Sequence
  Synthetic
tgctggtgagagagaaaaggcc

SEQ ID NO: 18090 - DNA, 22 bp, Artificial Sequence
  Synthetic
gcgggtaggggcagtataccaa

SEQ ID NO: 18091 - DNA, 20 bp, Artificial Sequence
  Synthetic
acaggacctcaggcgggagg

SEQ ID NO: 18092 - DNA, 20 bp, Artificial Sequence
  Synthetic
agggcgtaggtgatggctcc

SEQ ID NO: 18093 - DNA, 20 bp, Artificial Sequence
  Synthetic
agcgacctcagaggcgttcc

SEQ ID NO: 18094 - DNA, 21 bp, Artificial Sequence
  Synthetic
aaaaccaacacccgtgggtca

SEQ ID NO: 18095 - DNA, 19 bp, Artificial Sequence
  Synthetic
tgccagggacgacgtagga

SEQ ID NO: 18096 - DNA, 21 bp, Artificial Sequence
  Synthetic
cagaggcggcataggtgagac

SEQ ID NO: 18097 - DNA, 22 bp, Artificial Sequence
  Synthetic
ccttagagccatccgggtaggt

SEQ ID NO: 18098 - DNA, 22 bp, Artificial Sequence
  Synthetic
gcagcctcaagcatctttgggt

SEQ ID NO: 18099 - DNA, 22 bp, Artificial Sequence
  Synthetic
gccagatttgctgtccgtgcaa

SEQ ID NO: 18100 - DNA, 18 bp, Artificial Sequence
  Synthetic
aatgacaacccggcgccc

SEQ ID NO: 18101 - DNA, 22 bp, Artificial Sequence
  Synthetic
ggaggacccgactagtggtctg

SEQ ID NO: 18102 - DNA, 20 bp, Artificial Sequence
  Synthetic
gagatgcccacctcgcgaag

SEQ ID NO: 18103 - DNA, 20 bp, Artificial Sequence
  Synthetic
aggtcgagctcaaggacggc

SEQ ID NO: 18104 - DNA, 22 bp, Artificial Sequence
  Synthetic
ccagggccccaattcttctcag

SEQ ID NO: 18105 - DNA, 19 bp, Artificial Sequence
  Synthetic
tgggcctggtcacgccaag

SEQ ID NO: 18106 - DNA, 21 bp, Artificial Sequence
  Synthetic
gggagacccgcgtgttggtat

SEQ ID NO: 18107 - DNA, 20 bp, Artificial Sequence
  Synthetic
agactgggccggtcgaagag

SEQ ID NO: 18108 - DNA, 22 bp, Artificial Sequence
  Synthetic
gcacccaggctagtggtgtaag

SEQ ID NO: 18109 - DNA, 20 bp, Artificial Sequence
  Synthetic
attggctgcatatcgacgac

SEQ ID NO: 18110 - DNA, 21 bp, Artificial Sequence
  Synthetic
ccaccaacgattcaggaacat

SEQ ID NO: 18111 - DNA, 23 bp, Artificial Sequence
  Synthetic
gcatgccagatttaccggttatg

SEQ ID NO: 18112 - DNA, 25 bp, Artificial Sequence
  Synthetic
aaactctttcatatgccgttcctat

SEQ ID NO: 18113 - DNA, 21 bp, Artificial Sequence
  Synthetic
acaacatccaacgccgtttta

SEQ ID NO: 18114 - DNA, 24 bp, Artificial Sequence
  Synthetic
aatcgagtcttttcgttcccataa

SEQ ID NO: 18115 - DNA, 22 bp, Artificial Sequence
  Synthetic
tgattaaacaatgggccgttga

SEQ ID NO: 18116 - DNA, 25 bp, Artificial Sequence
  Synthetic
ggaaagaccgtttgttttatagtgg

SEQ ID NO: 18117 - DNA, 22 bp, Artificial Sequence
  Synthetic
tgagtggattattcgacgggac

SEQ ID NO: 18118 - DNA, 24 bp, Artificial Sequence
  Synthetic
cctctatggttgacagcacatttc

SEQ ID NO: 18119 - DNA, 22 bp, Artificial Sequence
  Synthetic
acctcatcgaaatgcgtatagc

SEQ ID NO: 18120 - DNA, 20 bp, Artificial Sequence
  Synthetic
ttttcggtttaggcagccgg

SEQ ID NO: 18121 - DNA, 19 bp, Artificial Sequence
  Synthetic
tgtggccgcccggttttgg

SEQ ID NO: 18122 - DNA, 20 bp, Artificial Sequence
  Synthetic
cagtacgtgctgccgggttt

SEQ ID NO: 18123 - DNA, 20 bp, Artificial Sequence
  Synthetic
ccatccaacagggtgcggtt

SEQ ID NO: 18124 - DNA, 22 bp, Artificial Sequence
  Synthetic
aggaaacatgatgcccggggta

SEQ ID NO: 18125 - DNA, 25 bp, Artificial Sequence
  Synthetic
ccctgcttgcccatactatatgttt

SEQ ID NO: 18126 - DNA, 20 bp, Artificial Sequence
  Synthetic
gtgtcctgtgtcagctgctg

SEQ ID NO: 18127 - DNA, 20 bp, Artificial Sequence
  Synthetic
atctggcctggtgcaatagg

SEQ ID NO: 18128 - DNA, 22 bp, Artificial Sequence
  Synthetic
gttcgcattttggaccaacaag

SEQ ID NO: 18129 - DNA, 25 bp, Artificial Sequence
  Synthetic
tggaatattgctggtgatcctttcc

SEQ ID NO: 18130 - DNA, 24 bp, Artificial Sequence
  Synthetic
tctgtatgtcattgacagtccagc

SEQ ID NO: 18131 - DNA, 24 bp, Artificial Sequence
  Synthetic
tggttattttttgcactgcctctg

SEQ ID NO: 18132 - DNA, 25 bp, Artificial Sequence
  Synthetic
ccattgctctccaattactgtgata

SEQ ID NO: 18133 - DNA, 23 bp, Artificial Sequence
  Synthetic
actggccatcttcctgctaattt

SEQ ID NO: 18134 - DNA, 25 bp, Artificial Sequence
  Synthetic
gtgggatgtgtacttctgaacttat

SEQ ID NO: 18135 - DNA, 25 bp, Artificial Sequence
  Synthetic
gccaagtattgtagagatcctacct

SEQ ID NO: 18136 - DNA, 25 bp, Artificial Sequence
  Synthetic
gcagaattcttattatggcttccac

SEQ ID NO: 18137 - DNA, 21 bp, Artificial Sequence
  Synthetic
tgcttccttccacacaggtac

SEQ ID NO: 18138 - DNA, 25 bp, Artificial Sequence
  Synthetic
agttgatactactggcctaattcca

SEQ ID NO: 18139 - DNA, 25 bp, Artificial Sequence
  Synthetic
tctcttgttaatagcagccctgtaa

SEQ ID NO: 18140 - DNA, 22 bp, Artificial Sequence
  Synthetic
cgcctcaatagccctcagcaaa

SEQ ID NO: 18141 - DNA, 21 bp, Artificial Sequence
  Synthetic
gctcccaccctatctgctgct

SEQ ID NO: 18142 - DNA, 22 bp, Artificial Sequence
  Synthetic
agcaagctcgatgtcagcagtt

SEQ ID NO: 18143 - DNA, 22 bp, Artificial Sequence
  Synthetic
cgtcagagattcccacctcggt

SEQ ID NO: 18144 - DNA, 20 bp, Artificial Sequence
  Synthetic
ccaggggctcagtctggaca

SEQ ID NO: 18145 - DNA, 20 bp, Artificial Sequence
  Synthetic
cccccttcagcacctacgtg

SEQ ID NO: 18146 - DNA, 19 bp, Artificial Sequence
  Synthetic
tcttcgccgggctggacga

SEQ ID NO: 18147 - DNA, 19 bp, Artificial Sequence
  Synthetic
ttcgaggctgtgctgcgcg

SEQ ID NO: 18148 - DNA, 21 bp, Artificial Sequence
  Synthetic
cgcgtacatggccaagctcca

SEQ ID NO: 18149 - DNA, 19 bp, Artificial Sequence
  Synthetic
aggtcctggactgcgtggt

SEQ ID NO: 18150 - DNA, 19 bp, Artificial Sequence
  Synthetic
agctcgtgctcccagaggc

SEQ ID NO: 18151 - DNA, 20 bp, Artificial Sequence
  Synthetic
gctccggggacagttctcca

SEQ ID NO: 18152 - DNA, 21 bp, Artificial Sequence
  Synthetic
gggcaggactagctcgtcgtc

SEQ ID NO: 18153 - DNA, 20 bp, Artificial Sequence
  Synthetic
cgatacacggcaacccccgg

SEQ ID NO: 18154 - DNA, 21 bp, Artificial Sequence
  Synthetic
ctggtgttcgaactgggccac

SEQ ID NO: 18155 - DNA, 21 bp, Artificial Sequence
  Synthetic
tggagcttgtggccctacacc

SEQ ID NO: 18156 - DNA, 22 bp, Artificial Sequence
  Synthetic
gcaagggggagctgctgatcta

SEQ ID NO: 18157 - DNA, 20 bp, Artificial Sequence
  Synthetic
tgaccacatggggccggtac

SEQ ID NO: 18158 - DNA, 20 bp, Artificial Sequence
  Synthetic
gctgctgccgacacaacgtc

SEQ ID NO: 18159 - DNA, 19 bp, Artificial Sequence
  Synthetic
tcgggctggcggtcgatct

SEQ ID NO: 18160 - DNA, 20 bp, Artificial Sequence
  Synthetic
ccacgacatccgcggcttta

SEQ ID NO: 18161 - DNA, 20 bp, Artificial Sequence
  Synthetic
caaggcggcccacttggaat

SEQ ID NO: 18162 - DNA, 22 bp, Artificial Sequence
  Synthetic
acgaagtgaaccaactgccgaa

SEQ ID NO: 18163 - DNA, 18 bp, Artificial Sequence
  Synthetic
acgatcgtgctgcgcgag

SEQ ID NO: 18164 - DNA, 21 bp, Artificial Sequence
  Synthetic
gctgacgcgtgcttttgttcc

SEQ ID NO: 18165 - DNA, 21 bp, Artificial Sequence
  Synthetic
agagctacgcgtacctctgcc

SEQ ID NO: 18166 - DNA, 19 bp, Artificial Sequence
  Synthetic
ccaccaacgtgccctaccc

SEQ ID NO: 18167 - DNA, 19 bp, Artificial Sequence
  Synthetic
ttgtgcgggaggggcttgg

SEQ ID NO: 18168 - DNA, 21 bp, Artificial Sequence
  Synthetic
ccccgcgggatcggatacaag

SEQ ID NO: 18169 - DNA, 19 bp, Artificial Sequence
  Synthetic
tggcacaacagacccgcgg

SEQ ID NO: 18170 - DNA, 19 bp, Artificial Sequence
  Synthetic
ggtccatgttcgagggcgg

SEQ ID NO: 18171 - DNA, 21 bp, Artificial Sequence
  Synthetic
tcgaaggcggaatagtggcgc

SEQ ID NO: 18172 - DNA, 19 bp, Artificial Sequence
  Synthetic
tgcaggcggttgtcgaggc

SEQ ID NO: 18173 - DNA, 22 bp, Artificial Sequence
  Synthetic
cgtcagcaccttcatcgacctg

SEQ ID NO: 18174 - DNA, 21 bp, Artificial Sequence
  Synthetic
gccgcacctcaaggaggaact

SEQ ID NO: 18175 - DNA, 19 bp, Artificial Sequence
  Synthetic
tccagcgcaaccagctccc

SEQ ID NO: 18176 - DNA, 18 bp, Artificial Sequence
  Synthetic
agaagttctgccggcggc

SEQ ID NO: 18177 - DNA, 19 bp, Artificial Sequence
  Synthetic
aggttccgaacgccgtcgg

SEQ ID NO: 18178 - DNA, 19 bp, Artificial Sequence
  Synthetic
tctgcgccaagtgcctggg

SEQ ID NO: 18179 - DNA, 18 bp, Artificial Sequence
  Synthetic
acgccggtgttctgcacg

SEQ ID NO: 18180 - DNA, 21 bp, Artificial Sequence
  Synthetic
gctgatccacatgctggccat

SEQ ID NO: 18181 - DNA, 18 bp, Artificial Sequence
  Synthetic
acgtgagggctcgcagga

SEQ ID NO: 18182 - DNA, 22 bp, Artificial Sequence
  Synthetic
tccctcagatgatagggcgtgt

SEQ ID NO: 18183 - DNA, 21 bp, Artificial Sequence
  Synthetic
ggagtcgaggaccttcagggc

SEQ ID NO: 18184 - DNA, 22 bp, Artificial Sequence
  Synthetic
cctgcatgccaatgcccatgga

SEQ ID NO: 18185 - DNA, 21 bp, Artificial Sequence
  Synthetic
cggcgggatccatggcgatat

SEQ ID NO: 18186 - DNA, 21 bp, Artificial Sequence
  Synthetic
ccacgaacacgagctcggtct

SEQ ID NO: 18187 - DNA, 19 bp, Artificial Sequence
  Synthetic
tcatccacgacgccccgga

SEQ ID NO: 18188 - DNA, 19 bp, Artificial Sequence
  Synthetic
accgaggaggcgtgggtga

SEQ ID NO: 18189 - DNA, 20 bp, Artificial Sequence
  Synthetic
acggatcggcgggcaaaaac

SEQ ID NO: 18190 - DNA, 21 bp, Artificial Sequence
  Synthetic
gcgaatagctacggccgcttg

SEQ ID NO: 18191 - DNA, 19 bp, Artificial Sequence
  Synthetic
cccgtcggtcgcatacagc

SEQ ID NO: 18192 - DNA, 19 bp, Artificial Sequence
  Synthetic
tgcacaacgtacggggcgg

SEQ ID NO: 18193 - DNA, 21 bp, Artificial Sequence
  Synthetic
tgacatagtccccgcccaggc

SEQ ID NO: 18194 - DNA, 19 bp, Artificial Sequence
  Synthetic
gttggtcccgacgctcagc

SEQ ID NO: 18195 - DNA, 19 bp, Artificial Sequence
  Synthetic
tggtgaagggcgacgaacg

SEQ ID NO: 18196 - DNA, 19 bp, Artificial Sequence
  Synthetic
agctgcaccagggtctggc

SEQ ID NO: 18197 - DNA, 22 bp, Artificial Sequence
  Synthetic
cgtggcattcagacagtacggg

SEQ ID NO: 18198 - DNA, 21 bp, Artificial Sequence
  Synthetic
accacacgacatgcaggcttc

SEQ ID NO: 18199 - DNA, 18 bp, Artificial Sequence
  Synthetic
aagtcgacacaccgcgcg

SEQ ID NO: 18200 - DNA, 21 bp, Artificial Sequence
  Synthetic
cccgtgcatgaagacctggat

SEQ ID NO: 18201 - DNA, 20 bp, Artificial Sequence
  Synthetic
gcatcatcccgcccgcatcc

SEQ ID NO: 18202 - DNA, 19 bp, Artificial Sequence
  Synthetic
acgcgtggtaggtcgctgg

SEQ ID NO: 18203 - DNA, 22 bp, Artificial Sequence
  Synthetic
tgggatcggccatcttaagcga

SEQ ID NO: 18204 - DNA, 20 bp, Artificial Sequence
  Synthetic
ggcatgtaggagcacgctgc

SEQ ID NO: 18205 - DNA, 21 bp, Artificial Sequence
  Synthetic
ccaaaacaaaccggctggcgt

SEQ ID NO: 18206 - DNA, 22 bp, Artificial Sequence
  Synthetic
cgtgctggccccttgatacgat

SEQ ID NO: 18207 - DNA, 22 bp, Artificial Sequence
  Synthetic
ccagccttgcaagcactctagt

SEQ ID NO: 18208 - DNA, 25 bp, Artificial Sequence
  Synthetic
acagcaatacaatacagcaaacagt

SEQ ID NO: 18209 - DNA, 22 bp, Artificial Sequence
  Synthetic
ccgtatcccagtgttgcttgct

SEQ ID NO: 18210 - DNA, 25 bp, Artificial Sequence
  Synthetic
acctccatagcacttatctcactat

SEQ ID NO: 18211 - DNA, 25 bp, Artificial Sequence
  Synthetic
gcactggtttacaattatttctggc

SEQ ID NO: 18212 - DNA, 23 bp, Artificial Sequence
  Synthetic
gacaccgcttattcacatactgt

SEQ ID NO: 18213 - DNA, 25 bp, Artificial Sequence
  Synthetic
ggtgataaccaaaaatgtgacccat

SEQ ID NO: 18214 - DNA, 25 bp, Artificial Sequence
  Synthetic
cccatttccacaatacaacttctgt

SEQ ID NO: 18215 - DNA, 20 bp, Artificial Sequence
  Synthetic
ggggttctctccctcgtgga

SEQ ID NO: 18216 - DNA, 25 bp, Artificial Sequence
  Synthetic
tgcctagcaagcattgtttaatgat

SEQ ID NO: 18217 - DNA, 21 bp, Artificial Sequence
  Synthetic
cactggatatggacgggcgtc

SEQ ID NO: 18218 - DNA, 20 bp, Artificial Sequence
  Synthetic
gtcaattgtgtccccccggg

SEQ ID NO: 18219 - DNA, 21 bp, Artificial Sequence
  Synthetic
gccagtagtgcgcctctggta

SEQ ID NO: 18220 - DNA, 20 bp, Artificial Sequence
  Synthetic
gcgtagggtctcctctcaca

SEQ ID NO: 18221 - DNA, 21 bp, Artificial Sequence
  Synthetic
gcagcatggaggaaagtactg

SEQ ID NO: 18222 - DNA, 25 bp, Artificial Sequence
  Synthetic
agggattttcagcatcatcaaactt

SEQ ID NO: 18223 - DNA, 24 bp, Artificial Sequence
  Synthetic
actcatgtctgcatcctcaatgta

SEQ ID NO: 18224 - DNA, 25 bp, Artificial Sequence
  Synthetic
ggtgtgccttaaaaactcaaaaaac

SEQ ID NO: 18225 - DNA, 25 bp, Artificial Sequence
  Synthetic
acctcccaaaacttaagatctttgt

SEQ ID NO: 18226 - DNA, 22 bp, Artificial Sequence
  Synthetic
ggggctattggcaagacagacc

SEQ ID NO: 18227 - DNA, 22 bp, Artificial Sequence
  Synthetic
tctccttcacaatcggatgaca

SEQ ID NO: 18228 - DNA, 23 bp, Artificial Sequence
  Synthetic
ggtgatatgtgaacagcatgcag

SEQ ID NO: 18229 - DNA, 25 bp, Artificial Sequence
  Synthetic
aggagctctctcatacagattcatt

SEQ ID NO: 18230 - DNA, 24 bp, Artificial Sequence
  Synthetic
gatcagcaagtgtttcaccttcta

SEQ ID NO: 18231 - DNA, 20 bp, Artificial Sequence
  Synthetic
ttgaactgcgcgggaaactt

SEQ ID NO: 18232 - DNA, 25 bp, Artificial Sequence
  Synthetic
gctcaggaattgctgataaatccat

SEQ ID NO: 18233 - DNA, 25 bp, Artificial Sequence
  Synthetic
ggtttccttcacatattcatccgta

SEQ ID NO: 18234 - DNA, 21 bp, Artificial Sequence
  Synthetic
aggaccacccctatccatttg

SEQ ID NO: 18235 - DNA, 25 bp, Artificial Sequence
  Synthetic
tttctgtaaaaatcagcaagctgtt

SEQ ID NO: 18236 - DNA, 23 bp, Artificial Sequence
  Synthetic
ccgttgcgcactaaatagaagtg

SEQ ID NO: 18237 - DNA, 22 bp, Artificial Sequence
  Synthetic
gaagagtacgaacagcagtagc

SEQ ID NO: 18238 - DNA, 24 bp, Artificial Sequence
  Synthetic
gagagatacatgaaccgtctgtac

SEQ ID NO: 18239 - DNA, 24 bp, Artificial Sequence
  Synthetic
atagcgactacctgagaagtactt

SEQ ID NO: 18240 - DNA, 23 bp, Artificial Sequence
  Synthetic
tgctgaagctgttcgatgatcta

SEQ ID NO: 18241 - DNA, 25 bp, Artificial Sequence
  Synthetic
tgcccaagtatcattggttatttca

SEQ ID NO: 18242 - DNA, 20 bp, Artificial Sequence
  Synthetic
atgtggacggggtgttgctg

SEQ ID NO: 18243 - DNA, 21 bp, Artificial Sequence
  Synthetic
cccgttcgctgagttgatcga

SEQ ID NO: 18244 - DNA, 23 bp, Artificial Sequence
  Synthetic
agcgcgctttgatctatacattt

SEQ ID NO: 18245 - DNA, 25 bp, Artificial Sequence
  Synthetic
tggtacagtctccggtaaaggtata

SEQ ID NO: 18246 - DNA, 25 bp, Artificial Sequence
  Synthetic
tccgctgcatctgtatatatttcat

SEQ ID NO: 18247 - DNA, 25 bp, Artificial Sequence
  Synthetic
tgatcctattcaagggttgtaactc

SEQ ID NO: 18248 - DNA, 24 bp, Artificial Sequence
  Synthetic
ctctctaagatcccgctcaaactc

SEQ ID NO: 18249 - DNA, 25 bp, Artificial Sequence
  Synthetic
cctccccctaatccatctactatag

SEQ ID NO: 18250 - DNA, 21 bp, Artificial Sequence
  Synthetic
gatgacccgatgttcccaatc

SEQ ID NO: 18251 - DNA, 24 bp, Artificial Sequence
  Synthetic
agccaatatcacacatatccccat

SEQ ID NO: 18252 - DNA, 25 bp, Artificial Sequence
  Synthetic
tcacagttgaacattcacagtacat

SEQ ID NO: 18253 - DNA, 25 bp, Artificial Sequence
  Synthetic
tctgaacttgcacttacctttacaa

SEQ ID NO: 18254 - DNA, 25 bp, Artificial Sequence
  Synthetic
cgtagtgtagtttgatacagttcct

SEQ ID NO: 18255 - DNA, 24 bp, Artificial Sequence
  Synthetic
gtactgctctgacaccttggatat

SEQ ID NO: 18256 - DNA, 25 bp, Artificial Sequence
  Synthetic
acctttttgtcactaggaaggtcta

SEQ ID NO: 18257 - DNA, 23 bp, Artificial Sequence
  Synthetic
gctaacgaagtgtccatgtgttc

SEQ ID NO: 18258 - DNA, 25 bp, Artificial Sequence
  Synthetic
aggaaatcctcaaaatgaattccct

SEQ ID NO: 18259 - DNA, 25 bp, Artificial Sequence
  Synthetic
gacaaaacctcgttgcttaaaaggt

SEQ ID NO: 18260 - DNA, 22 bp, Artificial Sequence
  Synthetic
gactcaactcagcaacagtctg

SEQ ID NO: 18261 - DNA, 25 bp, Artificial Sequence
  Synthetic
gcagaaatatgatttcccagtgtca

SEQ ID NO: 18262 - DNA, 25 bp, Artificial Sequence
  Synthetic
ggatcttaaatcagtttctcccctt

SEQ ID NO: 18263 - DNA, 21 bp, Artificial Sequence
  Synthetic
tgctccggaggttcgttctcc

SEQ ID NO: 18264 - DNA, 25 bp, Artificial Sequence
  Synthetic
cgatctgctaatgtattgccttcta

SEQ ID NO: 18265 - DNA, 20 bp, Artificial Sequence
  Synthetic
tgcttctgcatgcacacttg

SEQ ID NO: 18266 - DNA, 25 bp, Artificial Sequence
  Synthetic
ggcgggattttcaaattcaaattga

SEQ ID NO: 18267 - DNA, 25 bp, Artificial Sequence
  Synthetic
aggctctataggttcaattgcacta

SEQ ID NO: 18268 - DNA, 20 bp, Artificial Sequence
  Synthetic
tttgccacaggtttagccgg

SEQ ID NO: 18269 - DNA, 25 bp, Artificial Sequence
  Synthetic
cgttcaggattgaaaattgactgat

SEQ ID NO: 18270 - DNA, 20 bp, Artificial Sequence
  Synthetic
taggtggacagtctcctgca

SEQ ID NO: 18271 - DNA, 20 bp, Artificial Sequence
  Synthetic
aatggcgagcatacgactgc

SEQ ID NO: 18272 - DNA, 25 bp, Artificial Sequence
  Synthetic
gacatcttgttgccaaagatgttat

SEQ ID NO: 18273 - DNA, 25 bp, Artificial Sequence
  Synthetic
ggctatgttccaaacaacttacctt

SEQ ID NO: 18274 - DNA, 23 bp, Artificial Sequence
  Synthetic
cccttatcaacaaaactgcttgc

SEQ ID NO: 18275 - DNA, 25 bp, Artificial Sequence
  Synthetic
gcaacaaaaaaaagccttacacctc

SEQ ID NO: 18276 - DNA, 24 bp, Artificial Sequence
  Synthetic
tccacaggttcatcgtctagtaaa

SEQ ID NO: 18277 - DNA, 22 bp, Artificial Sequence
  Synthetic
attcattatggcggttcccatg

SEQ ID NO: 18278 - DNA, 22 bp, Artificial Sequence
  Synthetic
gatggtgtttcggaactgatcg

SEQ ID NO: 18279 - DNA, 23 bp, Artificial Sequence
  Synthetic
ttgctgttccaccaattggttta

SEQ ID NO: 18280 - DNA, 20 bp, Artificial Sequence
  Synthetic
gtgcttgtactaggacccgc

SEQ ID NO: 18281 - DNA, 25 bp, Artificial Sequence
  Synthetic
cctgtgacttttggtacttctactt

SEQ ID NO: 18282 - DNA, 25 bp, Artificial Sequence
  Synthetic
ggccatatctaatctgttgtcttct

SEQ ID NO: 18283 - DNA, 25 bp, Artificial Sequence
  Synthetic
accgtcttcctaaataagactgact

SEQ ID NO: 18284 - DNA, 21 bp, Artificial Sequence
  Synthetic
aattgttgggtgcggtaagga

SEQ ID NO: 18285 - DNA, 25 bp, Artificial Sequence
  Synthetic
tgcatgtgtctaaatcttcttgtct

SEQ ID NO: 18286 - DNA, 21 bp, Artificial Sequence
  Synthetic
tggtgctatgtttcttggagc

SEQ ID NO: 18287 - DNA, 25 bp, Artificial Sequence
  Synthetic
ccgcttttaatgcatctgaaacatt

SEQ ID NO: 18288 - DNA, 20 bp, Artificial Sequence
  Synthetic
gcaggctaggacacggtcac

SEQ ID NO: 18289 - DNA, 20 bp, Artificial Sequence
  Synthetic
gtgaattcagtgctggtgcc

SEQ ID NO: 18290 - DNA, 25 bp, Artificial Sequence
  Synthetic
gccaaatactcccatgtccttaaga

SEQ ID NO: 18291 - DNA, 20 bp, Artificial Sequence
  Synthetic
tgttgtagatggcgtcgctg

SEQ ID NO: 18292 - DNA, 25 bp, Artificial Sequence
  Synthetic
ccagtaaattctgtgcacattggtg

SEQ ID NO: 18293 - DNA, 25 bp, Artificial Sequence
  Synthetic
accaatgtagagttttgtgccaaat

SEQ ID NO: 18294 - DNA, 25 bp, Artificial Sequence
  Synthetic
ggattgtaagccaatatcccataca

SEQ ID NO: 18295 - DNA, 25 bp, Artificial Sequence
  Synthetic
tgcgttcttgtttttgatttctgtc

SEQ ID NO: 18296 - DNA, 23 bp, Artificial Sequence
  Synthetic
ctttgccatgtgtaatcatccca

SEQ ID NO: 18297 - DNA, 20 bp, Artificial Sequence
  Synthetic
tgcttccacatgtttggctc

SEQ ID NO: 18298 - DNA, 23 bp, Artificial Sequence
  Synthetic
ggagtagtaaacaccggatgtgc

SEQ ID NO: 18299 - DNA, 22 bp, Artificial Sequence
  Synthetic
gcaaaacagacataaccgcctc

SEQ ID NO: 18300 - DNA, 25 bp, Artificial Sequence
  Synthetic
cgagtcatgtatggatgctatttgt

SEQ ID NO: 18301 - DNA, 25 bp, Artificial Sequence
  Synthetic
tggatgtagttagtgatttgccaga

SEQ ID NO: 18302 - DNA, 20 bp, Artificial Sequence
  Synthetic
agtggggggacttagagtgt

SEQ ID NO: 18303 - DNA, 24 bp, Artificial Sequence
  Synthetic
gtgttggtaagacacagatacgat

SEQ ID NO: 18304 - DNA, 25 bp, Artificial Sequence
  Synthetic
gccatggttattggtcctacatcta

SEQ ID NO: 18305 - DNA, 23 bp, Artificial Sequence
  Synthetic
cttggttttggtgggtgtgttta

SEQ ID NO: 18306 - DNA, 24 bp, Artificial Sequence
  Synthetic
cctccccatactctttcattgttt

SEQ ID NO: 18307 - DNA, 22 bp, Artificial Sequence
  Synthetic
attcggaagtctaagtggtcgt

SEQ ID NO: 18308 - DNA, 23 bp, Artificial Sequence
  Synthetic
ctcatgcttgcaatgtgttcaat

SEQ ID NO: 18309 - DNA, 23 bp, Artificial Sequence
  Synthetic
gtcagtgagagaaaactccatgc

SEQ ID NO: 18310 - DNA, 22 bp, Artificial Sequence
  Synthetic
tttgacagaggactcagcttca

SEQ ID NO: 18311 - DNA, 25 bp, Artificial Sequence
  Synthetic
ggattcttctcctgtcttcctgatg

SEQ ID NO: 18312 - DNA, 25 bp, Artificial Sequence
  Synthetic
catgttttagcctttcgaccttttc

SEQ ID NO: 18313 - DNA, 23 bp, Artificial Sequence
  Synthetic
ccaccattaaaggggcaattttg

SEQ ID NO: 18314 - DNA, 21 bp, Artificial Sequence
  Synthetic
ggcacatctccaaaagcgaag

SEQ ID NO: 18315 - DNA, 23 bp, Artificial Sequence
  Synthetic
cccgaccattgtgaattcctcat

SEQ ID NO: 18316 - DNA, 21 bp, Artificial Sequence
  Synthetic
aggacctttgcatccttttgg

SEQ ID NO: 18317 - DNA, 22 bp, Artificial Sequence
  Synthetic
cagcttttctgttccctgtgtt

SEQ ID NO: 18318 - DNA, 20 bp, Artificial Sequence
  Synthetic
catcctactctgcttcggcg

SEQ ID NO: 18319 - DNA, 25 bp, Artificial Sequence
  Synthetic
gctaccaaatcaaatttctcttgca

SEQ ID NO: 18320 - DNA, 25 bp, Artificial Sequence
  Synthetic
cgagactgtagaatcacaatcactt

SEQ ID NO: 18321 - DNA, 22 bp, Artificial Sequence
  Synthetic
gttcagcttcatcttcgcctaa

SEQ ID NO: 18322 - DNA, 22 bp, Artificial Sequence
  Synthetic
gctcagcgacagagttggtggt

SEQ ID NO: 18323 - DNA, 25 bp, Artificial Sequence
  Synthetic
gaagtcgttcaagtctcgatagacc

SEQ ID NO: 18324 - DNA, 20 bp, Artificial Sequence
  Synthetic
tgacctccaccacccttacc

SEQ ID NO: 18325 - DNA, 25 bp, Artificial Sequence
  Synthetic
acaccagttacttcagaaacaagat

SEQ ID NO: 18326 - DNA, 24 bp, Artificial Sequence
  Synthetic
gcgccttatattagcaggatgtat

SEQ ID NO: 18327 - DNA, 25 bp, Artificial Sequence
  Synthetic
cgtcattcaaaacgtcaaagtaagg

SEQ ID NO: 18328 - DNA, 25 bp, Artificial Sequence
  Synthetic
gggcataaacattaggattttccgt

SEQ ID NO: 18329 - DNA, 22 bp, Artificial Sequence
  Synthetic
ggaggctgcacgacactcatac

SEQ ID NO: 18330 - DNA, 19 bp, Artificial Sequence
  Synthetic
accaacgatctggccgccg

SEQ ID NO: 18331 - DNA, 20 bp, Artificial Sequence
  Synthetic
gctctcacgcaaggcacaca

SEQ ID NO: 18332 - DNA, 22 bp, Artificial Sequence
  Synthetic
ttcgggcactctcagaatgctc

SEQ ID NO: 18333 - DNA, 20 bp, Artificial Sequence
  Synthetic
gttccaagggcttgcatgcg

SEQ ID NO: 18334 - DNA, 21 bp, Artificial Sequence
  Synthetic
agagttcatccacgtgcaccc

SEQ ID NO: 18335 - DNA, 21 bp, Artificial Sequence
  Synthetic
gggcatggtggtaaagctgca

SEQ ID NO: 18336 - DNA, 19 bp, Artificial Sequence
  Synthetic
acaccaaccggcggtaccc

SEQ ID NO: 18337 - DNA, 19 bp, Artificial Sequence
  Synthetic
acgcagcggtgtctgcacc

SEQ ID NO: 18338 - DNA, 22 bp, Artificial Sequence
  Synthetic
agccagcaccgtgataaacagt

SEQ ID NO: 18339 - DNA, 18 bp, Artificial Sequence
  Synthetic
ttggccacgcccctcgta

SEQ ID NO: 18340 - DNA, 22 bp, Artificial Sequence
  Synthetic
ggagtggcactcgtcacagatg

SEQ ID NO: 18341 - DNA, 20 bp, Artificial Sequence
  Synthetic
cgcctgaggtggggatcaca

SEQ ID NO: 18342 - DNA, 20 bp, Artificial Sequence
  Synthetic
agcttcacagagcacgacgc

SEQ ID NO: 18343 - DNA, 22 bp, Artificial Sequence
  Synthetic
taggaggggggtaggacctgtg

SEQ ID NO: 18344 - DNA, 22 bp, Artificial Sequence
  Synthetic
cagcccaaggaccttttgcttg

SEQ ID NO: 18345 - DNA, 19 bp, Artificial Sequence
  Synthetic
aagctgtggacgcggaggg

SEQ ID NO: 18346 - DNA, 21 bp, Artificial Sequence
  Synthetic
gtttgatgcgtccgtctcggg

SEQ ID NO: 18347 - DNA, 22 bp, Artificial Sequence
  Synthetic
tccggggtcctgtgatcttcat

SEQ ID NO: 18348 - DNA, 22 bp, Artificial Sequence
  Synthetic
gcccacagagaagctcacctca

SEQ ID NO: 18349 - DNA, 22 bp, Artificial Sequence
  Synthetic
ggtggtctatggcactctgctg

SEQ ID NO: 18350 - DNA, 20 bp, Artificial Sequence
  Synthetic
gccggctattgaccctccga

SEQ ID NO: 18351 - DNA, 22 bp, Artificial Sequence
  Synthetic
acccgcacggataagtctggat

SEQ ID NO: 18352 - DNA, 20 bp, Artificial Sequence
  Synthetic
tggcacggcatctgcgatag

SEQ ID NO: 18353 - DNA, 22 bp, Artificial Sequence
  Synthetic
tggtacagtcacgggtgaggta

SEQ ID NO: 18354 - DNA, 20 bp, Artificial Sequence
  Synthetic
cgctcccaccctgttgagtt

SEQ ID NO: 18355 - DNA, 25 bp, Artificial Sequence
  Synthetic
gcaatgtaggcttcaatgttctcat

SEQ ID NO: 18356 - DNA, 25 bp, Artificial Sequence
  Synthetic
gtcaattcaacaactgcatggtagg

SEQ ID NO: 18357 - DNA, 25 bp, Artificial Sequence
  Synthetic
cgatgtgcttttccattatccattt

SEQ ID NO: 18358 - DNA, 20 bp, Artificial Sequence
  Synthetic
ggagtgatgcttctgcgatg

SEQ ID NO: 18359 - DNA, 24 bp, Artificial Sequence
  Synthetic
ctaaccatagcagagaccaaactg

SEQ ID NO: 18360 - DNA, 25 bp, Artificial Sequence
  Synthetic
tggttttttgggtcttttcactctt

SEQ ID NO: 18361 - DNA, 24 bp, Artificial Sequence
  Synthetic
gccaaatcttgtaagcatacagga

SEQ ID NO: 18362 - DNA, 21 bp, Artificial Sequence
  Synthetic
acacctgttccacaagtgtga

SEQ ID NO: 18363 - DNA, 25 bp, Artificial Sequence
  Synthetic
tcttctaggattccactgtcatcaa

SEQ ID NO: 18364 - DNA, 25 bp, Artificial Sequence
  Synthetic
ccaaacacatatgaagcatttccaa

SEQ ID NO: 18365 - DNA, 25 bp, Artificial Sequence
  Synthetic
gaaggttctgttggcacatctatat

SEQ ID NO: 18366 - DNA, 25 bp, Artificial Sequence
  Synthetic
cattgtattcagaaactaccagtgc

SEQ ID NO: 18367 - DNA, 25 bp, Artificial Sequence
  Synthetic
gcacagtccattctccagttttact

SEQ ID NO: 18368 - DNA, 24 bp, Artificial Sequence
  Synthetic
gcatttgcccctcctctaattata

SEQ ID NO: 18369 - DNA, 23 bp, Artificial Sequence
  Synthetic
tgccatctggaattactctgcta

SEQ ID NO: 18370 - DNA, 25 bp, Artificial Sequence
  Synthetic
cgtatcctattcaaaccttgactga

SEQ ID NO: 18371 - DNA, 25 bp, Artificial Sequence
  Synthetic
agcctcagtaaatgctgtattctgt

SEQ ID NO: 18372 - DNA, 25 bp, Artificial Sequence
  Synthetic
gaccaacaccttagattgatctaca

SEQ ID NO: 18373 - DNA, 25 bp, Artificial Sequence
  Synthetic
ccttgttctcgctttccataaaaga

SEQ ID NO: 18374 - DNA, 25 bp, Artificial Sequence
  Synthetic
cctgtagtggaattttacaaagctg

SEQ ID NO: 18375 - DNA, 23 bp, Artificial Sequence
  Synthetic
actcaagctgaagtgtgcaaatt

SEQ ID NO: 18376 - DNA, 25 bp, Artificial Sequence
  Synthetic
acgttatctccctcttaagtttcct

SEQ ID NO: 18377 - DNA, 25 bp, Artificial Sequence
  Synthetic
cgcatttgaaaaaaagacgatcaag

SEQ ID NO: 18378 - DNA, 25 bp, Artificial Sequence
  Synthetic
tcatctgatatagcatcccctgttt

SEQ ID NO: 18379 - DNA, 23 bp, Artificial Sequence
  Synthetic
ctgctgagtttccacttcagtat

SEQ ID NO: 18380 - DNA, 25 bp, Artificial Sequence
  Synthetic
tgtgttagtattttgtcctgacaca

SEQ ID NO: 18381 - DNA, 25 bp, Artificial Sequence
  Synthetic
gcacttccactgtatatccatgttt

SEQ ID NO: 18382 - DNA, 25 bp, Artificial Sequence
  Synthetic
aggtgtggtatcagttgaagtagta

SEQ ID NO: 18383 - DNA, 25 bp, Artificial Sequence
  Synthetic
gcttacaaccttagatactgggaca

SEQ ID NO: 18384 - DNA, 20 bp, Artificial Sequence
  Synthetic
ctacacaggcccaaaccagc

SEQ ID NO: 18385 - DNA, 24 bp, Artificial Sequence
  Synthetic
tcaccatcctgaataactgtgttt

SEQ ID NO: 18386 - DNA, 25 bp, Artificial Sequence
  Synthetic
cagtagacccagagcctttaatgta

SEQ ID NO: 18387 - DNA, 25 bp, Artificial Sequence
  Synthetic
ctgatctaggtctgcagaaaacttt

SEQ ID NO: 18388 - DNA, 25 bp, Artificial Sequence
  Synthetic
gcaggaaacgtacaagtttaaacca

SEQ ID NO: 18389 - DNA, 25 bp, Artificial Sequence
  Synthetic
tgtgcataactgtggtaactttctg

SEQ ID NO: 18390 - DNA, 25 bp, Artificial Sequence
  Synthetic
tctttgctttttgtccagatgtctt

SEQ ID NO: 18391 - DNA, 20 bp, Artificial Sequence
  Synthetic
gttctgcttgtccagctgga

SEQ ID NO: 18392 - DNA, 24 bp, Artificial Sequence
  Synthetic
tcgattttcggatcttccccatat

SEQ ID NO: 18393 - DNA, 24 bp, Artificial Sequence
  Synthetic
agtcatacagatccgggagaaatt

SEQ ID NO: 18394 - DNA, 24 bp, Artificial Sequence
  Synthetic
tcttcatgttctttgtccttggaa

SEQ ID NO: 18395 - DNA, 20 bp, Artificial Sequence
  Synthetic
ccgtctcatgcttgcaatgt

SEQ ID NO: 18396 - DNA, 23 bp, Artificial Sequence
  Synthetic
cttgggtcggtaagggaaaattc

SEQ ID NO: 18397 - DNA, 25 bp, Artificial Sequence
  Synthetic
tcaaagaattctttggtcaggtctt

SEQ ID NO: 18398 - DNA, 24 bp, Artificial Sequence
  Synthetic
ttctctgtgtgaccattttcttgg

SEQ ID NO: 18399 - DNA, 23 bp, Artificial Sequence
  Synthetic
gctttcttctcattccctccgac

SEQ ID NO: 18400 - DNA, 25 bp, Artificial Sequence
  Synthetic
tgtgtccgtaacttcatactcttac

SEQ ID NO: 18401 - DNA, 20 bp, Artificial Sequence
  Synthetic
tctgaggattggagtccgtc

SEQ ID NO: 18402 - DNA, 25 bp, Artificial Sequence
  Synthetic
ctggtccaagatcgttgtttatcat

SEQ ID NO: 18403 - DNA, 25 bp, Artificial Sequence
  Synthetic
atcaattcccatttcaagcagacct

SEQ ID NO: 18404 - DNA, 24 bp, Artificial Sequence
  Synthetic
caagagaaattcccaccagagttt

SEQ ID NO: 18405 - DNA, 25 bp, Artificial Sequence
  Synthetic
tcagatacctcgaaagactcctgat

SEQ ID NO: 18406 - DNA, 25 bp, Artificial Sequence
  Synthetic
cctcagcaggtatatcctcataaca

SEQ ID NO: 18407 - DNA, 25 bp, Artificial Sequence
  Synthetic
tgcctcatccacaatataccaatca

SEQ ID NO: 18408 - DNA, 20 bp, Artificial Sequence
  Synthetic
ggcagtctctgtggcacttg

SEQ ID NO: 18409 - DNA, 25 bp, Artificial Sequence
  Synthetic
ggcaagtagagcagatcttgtatta

SEQ ID NO: 18410 - DNA, 24 bp, Artificial Sequence
  Synthetic
aagtctaactggctccaaaacctt

SEQ ID NO: 18411 - DNA, 25 bp, Artificial Sequence
  Synthetic
tgaggccactaagataaagagtcat

SEQ ID NO: 18412 - DNA, 22 bp, Artificial Sequence
  Synthetic
cgatttcgggtggtgtctcgac

SEQ ID NO: 18413 - DNA, 25 bp, Artificial Sequence
  Synthetic
cgtcgtttacgtactcttaacatga

SEQ ID NO: 18414 - DNA, 22 bp, Artificial Sequence
  Synthetic
tgggaacgtgtgattgtacgtg

SEQ ID NO: 18415 - DNA, 21 bp, Artificial Sequence
  Synthetic
agaaacgtgtaggcctttcct

SEQ ID NO: 18416 - DNA, 25 bp, Artificial Sequence
  Synthetic
gccatcatttgaggagatagagcta

SEQ ID NO: 18417 - DNA, 24 bp, Artificial Sequence
  Synthetic
atgaactaatttgcgacgtttacg

SEQ ID NO: 18418 - DNA, 25 bp, Artificial Sequence
  Synthetic
ctggaaatctaacacgaaagactct

SEQ ID NO: 18419 - DNA, 20 bp, Artificial Sequence
  Synthetic
ttgaccagtgttccccagtg

SEQ ID NO: 18420 - DNA, 22 bp, Artificial Sequence
  Synthetic
cagtttttggaacagaacgctg

SEQ ID NO: 18421 - DNA, 25 bp, Artificial Sequence
  Synthetic
gtcatgaggctatatgactaggcaa

SEQ ID NO: 18422 - DNA, 22 bp, Artificial Sequence
  Synthetic
cagatgctctgatttctgtggc

SEQ ID NO: 18423 - DNA, 24 bp, Artificial Sequence
  Synthetic
cctccagaaatttcggtcattgat

SEQ ID NO: 18424 - DNA, 22 bp, Artificial Sequence
  Synthetic
gtcatgcccacttgctactgca

SEQ ID NO: 18425 - DNA, 20 bp, Artificial Sequence
  Synthetic
tggacccctcttgtggaaag

SEQ ID NO: 18426 - DNA, 25 bp, Artificial Sequence
  Synthetic
gagaacatgaaataaagggctctct

SEQ ID NO: 18427 - DNA, 25 bp, Artificial Sequence
  Synthetic
cgttgtattttaatacagccactgc

SEQ ID NO: 18428 - DNA, 22 bp, Artificial Sequence
  Synthetic
tctgcacacacacatcactttg

SEQ ID NO: 18429 - DNA, 24 bp, Artificial Sequence
  Synthetic
gatcccaaatcatctcaaacccat

SEQ ID NO: 18430 - DNA, 23 bp, Artificial Sequence
  Synthetic
gagttttcaaagatccctgggtg

SEQ ID NO: 18431 - DNA, 22 bp, Artificial Sequence
  Synthetic
gccttcttttcattccctccga

SEQ ID NO: 18432 - DNA, 24 bp, Artificial Sequence
  Synthetic
ctttccctaatcttgccatcttgt

SEQ ID NO: 18433 - DNA, 20 bp, Artificial Sequence
  Synthetic
gtccgtcccaccagtatgtg

SEQ ID NO: 18434 - DNA, 22 bp, Artificial Sequence
  Synthetic
accaatgctcatgtcagccgat

SEQ ID NO: 18435 - DNA, 20 bp, Artificial Sequence
  Synthetic
atcctcaaagcgcgccatag

SEQ ID NO: 18436 - DNA, 25 bp, Artificial Sequence
  Synthetic
tgtctccatacacagagtctgaata

SEQ ID NO: 18437 - DNA, 23 bp, Artificial Sequence
  Synthetic
ttggggctctaaatgcaatacaa

SEQ ID NO: 18438 - DNA, 20 bp, Artificial Sequence
  Synthetic
gcatcattgtggacctcctg

SEQ ID NO: 18439 - DNA, 20 bp, Artificial Sequence
  Synthetic
atacattgccgccatgttcg

SEQ ID NO: 18440 - DNA, 25 bp, Artificial Sequence
  Synthetic
acatctaaatcgtatccactgtgac

SEQ ID NO: 18441 - DNA, 22 bp, Artificial Sequence
  Synthetic
atgttcccttgctgcaaagaat

SEQ ID NO: 18442 - DNA, 23 bp, Artificial Sequence
  Synthetic
ccatgttcctgcatcagtcatat

SEQ ID NO: 18443 - DNA, 21 bp, Artificial Sequence
  Synthetic
ggtgctggaatacggtgaggg

SEQ ID NO: 18444 - DNA, 25 bp, Artificial Sequence
  Synthetic
tgccaggtggatgatatatctctat

SEQ ID NO: 18445 - DNA, 22 bp, Artificial Sequence
  Synthetic
ataccaatacccatgcatacgc

SEQ ID NO: 18446 - DNA, 25 bp, Artificial Sequence
  Synthetic
aacatcactacgaggatcaaatgtt

SEQ ID NO: 18447 - DNA, 22 bp, Artificial Sequence
  Synthetic
agggtccatgtcatctgcatat

SEQ ID NO: 18448 - DNA, 24 bp, Artificial Sequence
  Synthetic
cacagcccaaaatacataactgtg

SEQ ID NO: 18449 - DNA, 24 bp, Artificial Sequence
  Synthetic
tgctctattccaaaaatgcctagc

SEQ ID NO: 18450 - DNA, 25 bp, Artificial Sequence
  Synthetic
gagactgtgtagaagcacatattgt

SEQ ID NO: 18451 - DNA, 22 bp, Artificial Sequence
  Synthetic
tgctgtaaggtgtgcagtttta

SEQ ID NO: 18452 - DNA, 25 bp, Artificial Sequence
  Synthetic
cggtataagggaaagttgtgcttat

SEQ ID NO: 18453 - DNA, 25 bp, Artificial Sequence
  Synthetic
cgagttttcaaaaataccaggatgg

SEQ ID NO: 18454 - DNA, 20 bp, Artificial Sequence
  Synthetic
tctcattgcctccaactggc

SEQ ID NO: 18455 - DNA, 24 bp, Artificial Sequence
  Synthetic
ccatcccaccagtaagtagtcttg

SEQ ID NO: 18456 - DNA, 20 bp, Artificial Sequence
  Synthetic
ctgactcgttgctcccagac

SEQ ID NO: 18457 - DNA, 25 bp, Artificial Sequence
  Synthetic
actgctggggaagaatttttcaaat

SEQ ID NO: 18458 - DNA, 20 bp, Artificial Sequence
  Synthetic
acaggatccaccgcctttcg

SEQ ID NO: 18459 - DNA, 22 bp, Artificial Sequence
  Synthetic
ggagcccacaacaatagtgggc

SEQ ID NO: 18460 - DNA, 20 bp, Artificial Sequence
  Synthetic
ggctccgccaaacttcccaa

SEQ ID NO: 18461 - DNA, 20 bp, Artificial Sequence
  Synthetic
gtgcctcgcccaccactaaa

SEQ ID NO: 18462 - DNA, 22 bp, Artificial Sequence
  Synthetic
gccgacactgtgccaagaacct

SEQ ID NO: 18463 - DNA, 22 bp, Artificial Sequence
  Synthetic
gctcacagtcatgttgacccca

SEQ ID NO: 18464 - DNA, 22 bp, Artificial Sequence
  Synthetic
ggcggccctttttgacatggat

SEQ ID NO: 18465 - DNA, 22 bp, Artificial Sequence
  Synthetic
ggcggcgttactgactgaatca

SEQ ID NO: 18466 - DNA, 22 bp, Artificial Sequence
  Synthetic
agcatctggcagtgccgagaac

SEQ ID NO: 18467 - DNA, 20 bp, Artificial Sequence
  Synthetic
gcggttgcctatgggagtgt

SEQ ID NO: 18468 - DNA, 19 bp, Artificial Sequence
  Synthetic
ctggcttcacagcgacggg

SEQ ID NO: 18469 - DNA, 20 bp, Artificial Sequence
  Synthetic
ctggttgaccaccacctggc

SEQ ID NO: 18470 - DNA, 21 bp, Artificial Sequence
  Synthetic
gacccgattgccacgatgcaa

SEQ ID NO: 18471 - DNA, 22 bp, Artificial Sequence
  Synthetic
catgcccagaacactaacgccg

SEQ ID NO: 18472 - DNA, 22 bp, Artificial Sequence
  Synthetic
cgtcctctcgcactcaaccttt

SEQ ID NO: 18473 - DNA, 22 bp, Artificial Sequence
  Synthetic
ccagcgcggagtagtagtgtcc

SEQ ID NO: 18474 - DNA, 22 bp, Artificial Sequence
  Synthetic
ggcccccccacctgagtaataa

SEQ ID NO: 18475 - DNA, 19 bp, Artificial Sequence
  Synthetic
tcacaggggtagcgctccc

SEQ ID NO: 18476 - DNA, 22 bp, Artificial Sequence
  Synthetic
ccaccccgagaggtggattcct

SEQ ID NO: 18477 - DNA, 20 bp, Artificial Sequence
  Synthetic
gccaggcaggagatgatgca

SEQ ID NO: 18478 - DNA, 20 bp, Artificial Sequence
  Synthetic
agagggattttgaggcgcgg

SEQ ID NO: 18479 - DNA, 20 bp, Artificial Sequence
  Synthetic
cgtcaccgtaaccgtgccag

SEQ ID NO: 18480 - DNA, 21 bp, Artificial Sequence
  Synthetic
catcctccagagcctgcaagg

SEQ ID NO: 18481 - DNA, 22 bp, Artificial Sequence
  Synthetic
caatgtcccccactgtgtctgt

SEQ ID NO: 18482 - DNA, 22 bp, Artificial Sequence
  Synthetic
acagttatcgcagccggatgtt

SEQ ID NO: 18483 - DNA, 22 bp, Artificial Sequence
  Synthetic
gccgagcaacactcagctgtat

SEQ ID NO: 18484 - DNA, 22 bp, Artificial Sequence
  Synthetic
atccggtgatgaaccacttcgg

SEQ ID NO: 18485 - DNA, 24 bp, Artificial Sequence
  Synthetic
tgccacagaaattgcaaggtatta

SEQ ID NO: 18486 - DNA, 20 bp, Artificial Sequence
  Synthetic
attcccttccaggcgttcct

SEQ ID NO: 18487 - DNA, 25 bp, Artificial Sequence
  Synthetic
tgctccagttcagtatcatctaaca

SEQ ID NO: 18488 - DNA, 25 bp, Artificial Sequence
  Synthetic
gcagtgtaatgtatatctacgtccc

SEQ ID NO: 18489 - DNA, 23 bp, Artificial Sequence
  Synthetic
ggacccagatatagtcacaatgc

SEQ ID NO: 18490 - DNA, 25 bp, Artificial Sequence
  Synthetic
tggtatgctatatctgcttcgtcta

SEQ ID NO: 18491 - DNA, 24 bp, Artificial Sequence
  Synthetic
acactctacccttcaacactctta

SEQ ID NO: 18492 - DNA, 25 bp, Artificial Sequence
  Synthetic
gccttgtaaaaaaagatttccagct

SEQ ID NO: 18493 - DNA, 19 bp, Artificial Sequence
  Synthetic
gtcgcgggggtggtgtttg

SEQ ID NO: 18494 - DNA, 21 bp, Artificial Sequence
  Synthetic
ctccccttctgcaggtggttg

SEQ ID NO: 18495 - DNA, 24 bp, Artificial Sequence
  Synthetic
agcttcttccagtaatcttccaag

SEQ ID NO: 18496 - DNA, 22 bp, Artificial Sequence
  Synthetic
caggttgccataggccttatca

SEQ ID NO: 18497 - DNA, 22 bp, Artificial Sequence
  Synthetic
gcccctcaggtacaggatggat

SEQ ID NO: 18498 - DNA, 25 bp, Artificial Sequence
  Synthetic
ggttcttcaaagacatccagatcat

SEQ ID NO: 18499 - DNA, 25 bp, Artificial Sequence
  Synthetic
tttctgcattattacgtgactctgg

SEQ ID NO: 18500 - DNA, 25 bp, Artificial Sequence
  Synthetic
ggatcaaaagatgtatcctgtctgt

SEQ ID NO: 18501 - DNA, 25 bp, Artificial Sequence
  Synthetic
ccactaacagttgggaaatacatgg

SEQ ID NO: 18502 - DNA, 25 bp, Artificial Sequence
  Synthetic
cgttttgttcctctattagaccctt

SEQ ID NO: 18503 - DNA, 25 bp, Artificial Sequence
  Synthetic
tgggttggtacattcattgaaatgt

SEQ ID NO: 18504 - DNA, 25 bp, Artificial Sequence
  Synthetic
acataaggttctcttgtcacccaaa

SEQ ID NO: 18505 - DNA, 23 bp, Artificial Sequence
  Synthetic
ccccagtgacacaaacatgtaac

SEQ ID NO: 18506 - DNA, 20 bp, Artificial Sequence
  Synthetic
ataccgggggtaacaggagc

SEQ ID NO: 18507 - DNA, 22 bp, Artificial Sequence
  Synthetic
agcgcgaatctttcttgattgt

SEQ ID NO: 18508 - DNA, 25 bp, Artificial Sequence
  Synthetic
ggtgttttatcgattgttccggtat

SEQ ID NO: 18509 - DNA, 22 bp, Artificial Sequence
  Synthetic
gtccagctttgaccatcatctg

SEQ ID NO: 18510 - DNA, 25 bp, Artificial Sequence
  Synthetic
tgggattgactttgtttttgtctga

SEQ ID NO: 18511 - DNA, 23 bp, Artificial Sequence
  Synthetic
ccgaaagtggtgcatagtttctt

SEQ ID NO: 18512 - DNA, 25 bp, Artificial Sequence
  Synthetic
ctacagcaatttctccaatgacaac

SEQ ID NO: 18513 - DNA, 25 bp, Artificial Sequence
  Synthetic
gctctccaatcaataattgctcaaa

SEQ ID NO: 18514 - DNA, 25 bp, Artificial Sequence
  Synthetic
gttcattaaacaatgccagggaatt

SEQ ID NO: 18515 - DNA, 25 bp, Artificial Sequence
  Synthetic
tggctcatcatggagattgttatca

SEQ ID NO: 18516 - DNA, 25 bp, Artificial Sequence
  Synthetic
cacccaggataggttacatcatcta

SEQ ID NO: 18517 - DNA, 25 bp, Artificial Sequence
  Synthetic
tggatcttctttaggctctagatca

SEQ ID NO: 18518 - DNA, 21 bp, Artificial Sequence
  Synthetic
tcgtcttggggtttgcggtac

SEQ ID NO: 18519 - DNA, 25 bp, Artificial Sequence
  Synthetic
tgatgtggtgtctgttacaatgttt

SEQ ID NO: 18520 - DNA, 25 bp, Artificial Sequence
  Synthetic
tgctagtagttggtaagtcctcaat

SEQ ID NO: 18521 - DNA, 25 bp, Artificial Sequence
  Synthetic
tgcgtttcagtacactaggatgtat

SEQ ID NO: 18522 - DNA, 25 bp, Artificial Sequence
  Synthetic
tgtttggatctggaaattgtagtct

SEQ ID NO: 18523 - DNA, 20 bp, Artificial Sequence
  Synthetic
ccccatcctctgcttgcttt

SEQ ID NO: 18524 - DNA, 25 bp, Artificial Sequence
  Synthetic
aggccaaatactgatttcattcgta

SEQ ID NO: 18525 - DNA, 23 bp, Artificial Sequence
  Synthetic
tggctcctaatgccctatgtaaa

SEQ ID NO: 18526 - DNA, 25 bp, Artificial Sequence
  Synthetic
gctgtcctctttgatacaaaaatcg

SEQ ID NO: 18527 - DNA, 21 bp, Artificial Sequence
  Synthetic
gggaatgtggtgcttatggca

SEQ ID NO: 18528 - DNA, 22 bp, Artificial Sequence
  Synthetic
tcaaagatacctgggtgggatt

SEQ ID NO: 18529 - DNA, 25 bp, Artificial Sequence
  Synthetic
ggtcatgttgtctcttactctcctt

SEQ ID NO: 18530 - DNA, 20 bp, Artificial Sequence
  Synthetic
attacccccaaccggaagtc

SEQ ID NO: 18531 - DNA, 25 bp, Artificial Sequence
  Synthetic
tctcttactctcgaacatgtatcct

SEQ ID NO: 18532 - DNA, 21 bp, Artificial Sequence
  Synthetic
gcccatcccaccagtatgttg

SEQ ID NO: 18533 - DNA, 25 bp, Artificial Sequence
  Synthetic
ccaaggtcattgtttatcatgttgt

SEQ ID NO: 18534 - DNA, 25 bp, Artificial Sequence
  Synthetic
ggatgtgaaggttccggatattgta

SEQ ID NO: 18535 - DNA, 20 bp, Artificial Sequence
  Synthetic
ctcgaacaagttgcagcact

SEQ ID NO: 18536 - DNA, 23 bp, Artificial Sequence
  Synthetic
tcagtctccttcaaatctgtgct

SEQ ID NO: 18537 - DNA, 25 bp, Artificial Sequence
  Synthetic
tcagattctgctatgtcatcagttt

SEQ ID NO: 18538 - DNA, 20 bp, Artificial Sequence
  Synthetic
atgcaccgctgaaagtctcg

SEQ ID NO: 18539 - DNA, 25 bp, Artificial Sequence
  Synthetic
gctagtgacagaggaatgaatagtt

SEQ ID NO: 18540 - DNA, 24 bp, Artificial Sequence
  Synthetic
gcaatttagcatcacccctgtatc

SEQ ID NO: 18541 - DNA, 25 bp, Artificial Sequence
  Synthetic
tccaattcccaaattgccaaagtat

SEQ ID NO: 18542 - DNA, 20 bp, Artificial Sequence
  Synthetic
atcagttccacctgctgcag

SEQ ID NO: 18543 - DNA, 25 bp, Artificial Sequence
  Synthetic
aaacgttccaaaggtatctcttcat

SEQ ID NO: 18544 - DNA, 21 bp, Artificial Sequence
  Synthetic
cccgctcaaagtataggctca

SEQ ID NO: 18545 - DNA, 25 bp, Artificial Sequence
  Synthetic
gcgtgcatgaaagtaaacatcagtt

SEQ ID NO: 18546 - DNA, 24 bp, Artificial Sequence
  Synthetic
gatgaccagtagatccaacaccta

SEQ ID NO: 18547 - DNA, 25 bp, Artificial Sequence
  Synthetic
aggaaagtttgcattaccaaatcct

SEQ ID NO: 18548 - DNA, 25 bp, Artificial Sequence
  Synthetic
cgttacaaagcagattaacaggcaa

SEQ ID NO: 18549 - DNA, 25 bp, Artificial Sequence
  Synthetic
actgtccacaaatagacgtctttta

SEQ ID NO: 18550 - DNA, 20 bp, Artificial Sequence
  Synthetic
ctggtgtccccgtcgctttg

SEQ ID NO: 18551 - DNA, 25 bp, Artificial Sequence
  Synthetic
agcgatatctccagcattttaatgt

SEQ ID NO: 18552 - DNA, 24 bp, Artificial Sequence
  Synthetic
acaggttcaaccactatgtttggt

SEQ ID NO: 18553 - DNA, 20 bp, Artificial Sequence
  Synthetic
tataggggctgctggttgca

SEQ ID NO: 18554 - DNA, 23 bp, Artificial Sequence
  Synthetic
gctctactaaaagctcttggtgt

SEQ ID NO: 18555 - DNA, 25 bp, Artificial Sequence
  Synthetic
catgtgagttactgaaatcctctgt

SEQ ID NO: 18556 - DNA, 24 bp, Artificial Sequence
  Synthetic
ggcagccaatatgacatctgtaaa

SEQ ID NO: 18557 - DNA, 22 bp, Artificial Sequence
  Synthetic
accctattgcaacacgtttacg

SEQ ID NO: 18558 - DNA, 24 bp, Artificial Sequence
  Synthetic
caggatatacctatgaagggtggg

SEQ ID NO: 18559 - DNA, 25 bp, Artificial Sequence
  Synthetic
gcgacaaaaggtacaaggtagtcta

SEQ ID NO: 18560 - DNA, 25 bp, Artificial Sequence
  Synthetic
caaactctgcacactgaatctattc

SEQ ID NO: 18561 - DNA, 25 bp, Artificial Sequence
  Synthetic
ccactgttctcaaacaatcgtcttt

SEQ ID NO: 18562 - DNA, 25 bp, Artificial Sequence
  Synthetic
tgtagcatttccagttgtacactta

SEQ ID NO: 18563 - DNA, 25 bp, Artificial Sequence
  Synthetic
gttgaatccaaaaatgactgtgact

SEQ ID NO: 18564 - DNA, 20 bp, Artificial Sequence
  Synthetic
gcttcttgcacagcatcgaa

SEQ ID NO: 18565 - DNA, 25 bp, Artificial Sequence
  Synthetic
agaggtaacagagggagaaatagtt

SEQ ID NO: 18566 - DNA, 25 bp, Artificial Sequence
  Synthetic
caattgtctttgtgcagtgtcttta

SEQ ID NO: 18567 - DNA, 23 bp, Artificial Sequence
  Synthetic
ccttcatttagaggcaccaaagc

SEQ ID NO: 18568 - DNA, 23 bp, Artificial Sequence
  Synthetic
tgtacttgttgtacccgcctatt

SEQ ID NO: 18569 - DNA, 25 bp, Artificial Sequence
  Synthetic
agtggttgtgctatatctgttacaa

SEQ ID NO: 18570 - DNA, 24 bp, Artificial Sequence
  Synthetic
ggatctggcagcataacccttaat

SEQ ID NO: 18571 - DNA, 25 bp, Artificial Sequence
  Synthetic
tccccataggattcctttgtcattt

SEQ ID NO: 18572 - DNA, 25 bp, Artificial Sequence
  Synthetic
ggaacaaatgctaaattccagtctt

SEQ ID NO: 18573 - DNA, 25 bp, Artificial Sequence
  Synthetic
caatgaaacattaaggtgcaagcat

SEQ ID NO: 18574 - DNA, 20 bp, Artificial Sequence
  Synthetic
gcagttaccactcccggtac

SEQ ID NO: 18575 - DNA, 22 bp, Artificial Sequence
  Synthetic
aggcagtcccccgtgatagtct

SEQ ID NO: 18576 - DNA, 19 bp, Artificial Sequence
  Synthetic
gacgcaatggacccgaggg

SEQ ID NO: 18577 - DNA, 21 bp, Artificial Sequence
  Synthetic
gcgggagtcgtatctggcgat

SEQ ID NO: 18578 - DNA, 21 bp, Artificial Sequence
  Synthetic
ctggacaaggtcgccatctgc

SEQ ID NO: 18579 - DNA, 21 bp, Artificial Sequence
  Synthetic
ccccctgccttacgtggtctt

SEQ ID NO: 18580 - DNA, 19 bp, Artificial Sequence
  Synthetic
agagccaggaccaggacgc

SEQ ID NO: 18581 - DNA, 22 bp, Artificial Sequence
  Synthetic
cacgcctacctgaaggtgaccc

SEQ ID NO: 18582 - DNA, 19 bp, Artificial Sequence
  Synthetic
agacggcgtccctggagtc

SEQ ID NO: 18583 - DNA, 22 bp, Artificial Sequence
  Synthetic
ccaggtacatcagcagacaggc

SEQ ID NO: 18584 - DNA, 22 bp, Artificial Sequence
  Synthetic
tcgtcgtcgaacggttttacgt

SEQ ID NO: 18585 - DNA, 20 bp, Artificial Sequence
  Synthetic
gcggtggcgctgttcaagat

SEQ ID NO: 18586 - DNA, 21 bp, Artificial Sequence
  Synthetic
cccgatgacgtgctggaccta

SEQ ID NO: 18587 - DNA, 21 bp, Artificial Sequence
  Synthetic
cgtcagtttacggaccgcgtg

SEQ ID NO: 18588 - DNA, 22 bp, Artificial Sequence
  Synthetic
cgggaaaaactaccgcgctgat

SEQ ID NO: 18589 - DNA, 21 bp, Artificial Sequence
  Synthetic
ggacgtaaaccaggtgggcca

SEQ ID NO: 18590 - DNA, 19 bp, Artificial Sequence
  Synthetic
ctcgccgagctatgggcct

SEQ ID NO: 18591 - DNA, 19 bp, Artificial Sequence
  Synthetic
ggagggcgtaacgttccgc

SEQ ID NO: 18592 - DNA, 19 bp, Artificial Sequence
  Synthetic
gcccgttaaccccccacgt

SEQ ID NO: 18593 - DNA, 19 bp, Artificial Sequence
  Synthetic
actgtcgtcggtggcgctg

SEQ ID NO: 18594 - DNA, 22 bp, Artificial Sequence
  Synthetic
tcaaccccgccctacactacac

SEQ ID NO: 18595 - DNA, 19 bp, Artificial Sequence
  Synthetic
ttggtgagcgcctggacgc

SEQ ID NO: 18596 - DNA, 22 bp, Artificial Sequence
  Synthetic
cggtttgttggcgcctttatgg

SEQ ID NO: 18597 - DNA, 21 bp, Artificial Sequence
  Synthetic
ctcctgtgcaccctcacgttc

SEQ ID NO: 18598 - DNA, 21 bp, Artificial Sequence
  Synthetic
cttcctaacccagaccccggg

SEQ ID NO: 18599 - DNA, 20 bp, Artificial Sequence
  Synthetic
cccacccccgaaccatgaac

SEQ ID NO: 18600 - DNA, 19 bp, Artificial Sequence
  Synthetic
tcagaacgggccggtcgtc

SEQ ID NO: 18601 - DNA, 19 bp, Artificial Sequence
  Synthetic
aaggtcatccgaggcgccg

SEQ ID NO: 18602 - DNA, 20 bp, Artificial Sequence
  Synthetic
aaggctgccgctttacgagg

SEQ ID NO: 18603 - DNA, 19 bp, Artificial Sequence
  Synthetic
aatcgtggcgcggctcgtg

SEQ ID NO: 18604 - DNA, 20 bp, Artificial Sequence
  Synthetic
gcgcctgatcgtggagacgg

SEQ ID NO: 18605 - DNA, 22 bp, Artificial Sequence
  Synthetic
cgctttgtgactgagaacgtgc

SEQ ID NO: 18606 - DNA, 21 bp, Artificial Sequence
  Synthetic
ggctcgtggtccagtgcatca

SEQ ID NO: 18607 - DNA, 21 bp, Artificial Sequence
  Synthetic
gaccagatgctgcacgtgctg

SEQ ID NO: 18608 - DNA, 20 bp, Artificial Sequence
  Synthetic
ctcgtgcgctttctggagct

SEQ ID NO: 18609 - DNA, 19 bp, Artificial Sequence
  Synthetic
accttcagtccggacgggc

SEQ ID NO: 18610 - DNA, 19 bp, Artificial Sequence
  Synthetic
taagctccatcgcgggcgg

SEQ ID NO: 18611 - DNA, 19 bp, Artificial Sequence
  Synthetic
tcctggcccagcagaccca

SEQ ID NO: 18612 - DNA, 18 bp, Artificial Sequence
  Synthetic
tgctcgcgacgtcgggtt

SEQ ID NO: 18613 - DNA, 19 bp, Artificial Sequence
  Synthetic
tcgaccgcctggccaaacg

SEQ ID NO: 18614 - DNA, 19 bp, Artificial Sequence
  Synthetic
gtggcgtgaaactcccgca

SEQ ID NO: 18615 - DNA, 22 bp, Artificial Sequence
  Synthetic
ggagggggaaggaacgaaacac

SEQ ID NO: 18616 - DNA, 22 bp, Artificial Sequence
  Synthetic
gggaactcgggggtgatgaagt

SEQ ID NO: 18617 - DNA, 21 bp, Artificial Sequence
  Synthetic
tcttggacatacggccgtccc

SEQ ID NO: 18618 - DNA, 20 bp, Artificial Sequence
  Synthetic
gaggccaagctagccgaggc

SEQ ID NO: 18619 - DNA, 22 bp, Artificial Sequence
  Synthetic
acatcaccaccgtcagcacctt

SEQ ID NO: 18620 - DNA, 19 bp, Artificial Sequence
  Synthetic
accccaacgccatcgcctc

SEQ ID NO: 18621 - DNA, 20 bp, Artificial Sequence
  Synthetic
gcgacgcacatcaaggtggg

SEQ ID NO: 18622 - DNA, 18 bp, Artificial Sequence
  Synthetic
cgagatgctgcgctccga

SEQ ID NO: 18623 - DNA, 18 bp, Artificial Sequence
  Synthetic
ttccccaacggcaagccc

SEQ ID NO: 18624 - DNA, 22 bp, Artificial Sequence
  Synthetic
atcaattccaaccggtgctgcg

SEQ ID NO: 18625 - DNA, 19 bp, Artificial Sequence
  Synthetic
agtacgtggaccaggcggt

SEQ ID NO: 18626 - DNA, 22 bp, Artificial Sequence
  Synthetic
acaaggtaaccataggcggggc

SEQ ID NO: 18627 - DNA, 20 bp, Artificial Sequence
  Synthetic
caccatcaaggtcccccccg

SEQ ID NO: 18628 - DNA, 20 bp, Artificial Sequence
  Synthetic
cggtaaaacagagcggggcg

SEQ ID NO: 18629 - DNA, 20 bp, Artificial Sequence
  Synthetic
cgcgagcggatctgctttcg

SEQ ID NO: 18630 - DNA, 19 bp, Artificial Sequence
  Synthetic
atcttgtcgcccacggccg

SEQ ID NO: 18631 - DNA, 20 bp, Artificial Sequence
  Synthetic
ccacttacgggggccacatg

SEQ ID NO: 18632 - DNA, 22 bp, Artificial Sequence
  Synthetic
gctcttaacgaggctctctgcg

SEQ ID NO: 18633 - DNA, 20 bp, Artificial Sequence
  Synthetic
acatgctggccatcatcggc

SEQ ID NO: 18634 - DNA, 22 bp, Artificial Sequence
  Synthetic
ccgccaaccaagggctgataga

SEQ ID NO: 18635 - DNA, 19 bp, Artificial Sequence
  Synthetic
acacgttcttcgccggccc

SEQ ID NO: 18636 - DNA, 19 bp, Artificial Sequence
  Synthetic
tcgtggtcaccggtgctcg

SEQ ID NO: 18637 - DNA, 19 bp, Artificial Sequence
  Synthetic
ttccccgcccggtcgagtt

SEQ ID NO: 18638 - DNA, 21 bp, Artificial Sequence
  Synthetic
cggttcttggccctggtgagt

SEQ ID NO: 18639 - DNA, 19 bp, Artificial Sequence
  Synthetic
accccacagccaaacgcgg

SEQ ID NO: 18640 - DNA, 18 bp, Artificial Sequence
  Synthetic
tccacatcgcgcaggggt

SEQ ID NO: 18641 - DNA, 19 bp, Artificial Sequence
  Synthetic
tagcccgatgcccccgttg

SEQ ID NO: 18642 - DNA, 19 bp, Artificial Sequence
  Synthetic
aggttggagccggcgatgg

SEQ ID NO: 18643 - DNA, 21 bp, Artificial Sequence
  Synthetic
atcgccgacaggtttctggag

SEQ ID NO: 18644 - DNA, 19 bp, Artificial Sequence
  Synthetic
gccagtgacgtggacgcct

SEQ ID NO: 18645 - DNA, 21 bp, Artificial Sequence
  Synthetic
agtgttccaggggcaggaaca

SEQ ID NO: 18646 - DNA, 19 bp, Artificial Sequence
  Synthetic
tgggcgtggcactatcggc

SEQ ID NO: 18647 - DNA, 22 bp, Artificial Sequence
  Synthetic
ttccggaatttatacccgggcc

SEQ ID NO: 18648 - DNA, 20 bp, Artificial Sequence
  Synthetic
cacggggttacgcgggtagt

SEQ ID NO: 18649 - DNA, 19 bp, Artificial Sequence
  Synthetic
tgggcacgtacacccccct

SEQ ID NO: 18650 - DNA, 19 bp, Artificial Sequence
  Synthetic
acgcgcagactgtcgacgg

SEQ ID NO: 18651 - DNA, 21 bp, Artificial Sequence
  Synthetic
gggctgtcattcctcgggaac

SEQ ID NO: 18652 - DNA, 21 bp, Artificial Sequence
  Synthetic
tggtgaatccagacgtggtgc

SEQ ID NO: 18653 - DNA, 21 bp, Artificial Sequence
  Synthetic
gctcgacctctccacacctgc

SEQ ID NO: 18654 - DNA, 19 bp, Artificial Sequence
  Synthetic
agaacgactggcgcgccac

SEQ ID NO: 18655 - DNA, 21 bp, Artificial Sequence
  Synthetic
gagaaccgtggacgacgtacg

SEQ ID NO: 18656 - DNA, 19 bp, Artificial Sequence
  Synthetic
tgttggccccgacgctcag

SEQ ID NO: 18657 - DNA, 19 bp, Artificial Sequence
  Synthetic
accacacgagcacgaggcc

SEQ ID NO: 18658 - DNA, 19 bp, Artificial Sequence
  Synthetic
atcggcgttggtggagggc

SEQ ID NO: 18659 - DNA, 19 bp, Artificial Sequence
  Synthetic
attccaggtcgtcgcggcg

SEQ ID NO: 18660 - DNA, 18 bp, Artificial Sequence
  Synthetic
tttcggcctgccaggtgg

SEQ ID NO: 18661 - DNA, 19 bp, Artificial Sequence
  Synthetic
tcgaccgaacagccgtccg

SEQ ID NO: 18662 - DNA, 20 bp, Artificial Sequence
  Synthetic
tctggacacccccacggacc

SEQ ID NO: 18663 - DNA, 22 bp, Artificial Sequence
  Synthetic
tggggagtagggccttttccat

SEQ ID NO: 18664 - DNA, 19 bp, Artificial Sequence
  Synthetic
cgccctcgacgagtgggat

SEQ ID NO: 18665 - DNA, 18 bp, Artificial Sequence
  Synthetic
aaaccgccccccaagcct

SEQ ID NO: 18666 - DNA, 21 bp, Artificial Sequence
  Synthetic
actgaccctctgatcgccgtt

SEQ ID NO: 18667 - DNA, 19 bp, Artificial Sequence
  Synthetic
cagccccttggagagcacc

SEQ ID NO: 18668 - DNA, 19 bp, Artificial Sequence
  Synthetic
ggcagtgccgcattttggc

SEQ ID NO: 18669 - DNA, 20 bp, Artificial Sequence
  Synthetic
gggccccggggttttaagga

SEQ ID NO: 18670 - DNA, 19 bp, Artificial Sequence
  Synthetic
agtccaggcacgcgtcctc

SEQ ID NO: 18671 - DNA, 22 bp, Artificial Sequence
  Synthetic
ctcttccgcggtaaatcccgtg

SEQ ID NO: 18672 - DNA, 22 bp, Artificial Sequence
  Synthetic
cgccttcacgattacccgttgg

SEQ ID NO: 18673 - DNA, 20 bp, Artificial Sequence
  Synthetic
tgggttcaggcgcctactca

SEQ ID NO: 18674 - DNA, 19 bp, Artificial Sequence
  Synthetic
tcgcacgggccccttttgg

SEQ ID NO: 18675 - DNA, 19 bp, Artificial Sequence
  Synthetic
tggcggtgggagagtcggt

SEQ ID NO: 18676 - DNA, 20 bp, Artificial Sequence
  Synthetic
cgcgcatgcttcatgggtcc

SEQ ID NO: 18677 - DNA, 19 bp, Artificial Sequence
  Synthetic
gggtggcggcaagaacagc

SEQ ID NO: 18678 - DNA, 20 bp, Artificial Sequence
  Synthetic
gtgttgttgggtgccctccg

SEQ ID NO: 18679 - DNA, 21 bp, Artificial Sequence
  Synthetic
cccggcgtccacaaatgagtt

SEQ ID NO: 18680 - DNA, 18 bp, Artificial Sequence
  Synthetic
tttggcgcgtcaccgacc

SEQ ID NO: 18681 - DNA, 18 bp, Artificial Sequence
  Synthetic
aggccgctgtccgtctct

SEQ ID NO: 18682 - DNA, 21 bp, Artificial Sequence
  Synthetic
gcttcgaccgaaactggcgag

SEQ ID NO: 18683 - DNA, 19 bp, Artificial Sequence
  Synthetic
agccacatcaggagcgccc

SEQ ID NO: 18684 - DNA, 25 bp, Artificial Sequence
  Synthetic
tgttcccaatttgtaacatcaagct

SEQ ID NO: 18685 - DNA, 21 bp, Artificial Sequence
  Synthetic
attgtcaaccaactggtgcca

SEQ ID NO: 18686 - DNA, 22 bp, Artificial Sequence
  Synthetic
atcaggataacaggagcactcc

SEQ ID NO: 18687 - DNA, 25 bp, Artificial Sequence
  Synthetic
cctggaattagtgcttttggttctc

SEQ ID NO: 18688 - DNA, 22 bp, Artificial Sequence
  Synthetic
ttccgaaagcccaggatgatgg

SEQ ID NO: 18689 - DNA, 25 bp, Artificial Sequence
  Synthetic
cccataacatccaatgacataaccc

SEQ ID NO: 18690 - DNA, 20 bp, Artificial Sequence
  Synthetic
gtggtctccatgcgacgtgc

SEQ ID NO: 18691 - DNA, 21 bp, Artificial Sequence
  Synthetic
gttccccccagcaaagaattg

SEQ ID NO: 18692 - DNA, 22 bp, Artificial Sequence
  Synthetic
tggaaagattctgccccatgct

SEQ ID NO: 18693 - DNA, 23 bp, Artificial Sequence
  Synthetic
tgtggtttttgtcagtatctcgc

SEQ ID NO: 18694 - DNA, 22 bp, Artificial Sequence
  Synthetic
ccacgggtccatttctattcca

SEQ ID NO: 18695 - DNA, 22 bp, Artificial Sequence
  Synthetic
agatgctagtggatctgctgat

SEQ ID NO: 18696 - DNA, 25 bp, Artificial Sequence
  Synthetic
acccctcatgtactcttatcttcaa

SEQ ID NO: 18697 - DNA, 23 bp, Artificial Sequence
  Synthetic
aatgccttaaaagctgatgcatg

SEQ ID NO: 18698 - DNA, 22 bp, Artificial Sequence
  Synthetic
gtttcactgacctcctcaggag

SEQ ID NO: 18699 - DNA, 25 bp, Artificial Sequence
  Synthetic
caagtacgtctctcatttgttggaa

SEQ ID NO: 18700 - DNA, 20 bp, Artificial Sequence
  Synthetic
gaaaccctctcaagacggcg

SEQ ID NO: 18701 - DNA, 23 bp, Artificial Sequence
  Synthetic
cacacaaatcacgacgacagaaa

SEQ ID NO: 18702 - DNA, 25 bp, Artificial Sequence
  Synthetic
cgcgataatatcaatcttctcctca

SEQ ID NO: 18703 - DNA, 24 bp, Artificial Sequence
  Synthetic
gcaacaacaacgacacgaattact

SEQ ID NO: 18704 - DNA, 25 bp, Artificial Sequence
  Synthetic
tgtcgtctaacagatttgagatgtt

SEQ ID NO: 18705 - DNA, 25 bp, Artificial Sequence
  Synthetic
gatctctacctgcgacgtaaaagta

SEQ ID NO: 18706 - DNA, 24 bp, Artificial Sequence
  Synthetic
tgaggccttcttttctcccataat

SEQ ID NO: 18707 - DNA, 21 bp, Artificial Sequence
  Synthetic
tttcggtgggactggaaacgg

SEQ ID NO: 18708 - DNA, 25 bp, Artificial Sequence
  Synthetic
gttcctatacccagtcctccaaaat

SEQ ID NO: 18709 - DNA, 24 bp, Artificial Sequence
  Synthetic
agttgtaagtacaggtggttctgc

SEQ ID NO: 18710 - DNA, 24 bp, Artificial Sequence
  Synthetic
gatctggagtagcagctacattct

SEQ ID NO: 18711 - DNA, 20 bp, Artificial Sequence
  Synthetic
tcgcctgaatgttggcctat

SEQ ID NO: 18712 - DNA, 25 bp, Artificial Sequence
  Synthetic
ctgtaccagcatagaaaaacagact

SEQ ID NO: 18713 - DNA, 25 bp, Artificial Sequence
  Synthetic
ttaaataatggattgcctgttgtgg

SEQ ID NO: 18714 - DNA, 24 bp, Artificial Sequence
  Synthetic
caccaaagccaatgtcacacatat

SEQ ID NO: 18715 - DNA, 25 bp, Artificial Sequence
  Synthetic
tcgttcagtcatatctatttgccaa

SEQ ID NO: 18716 - DNA, 25 bp, Artificial Sequence
  Synthetic
agtacattcagagaccattcacagt

SEQ ID NO: 18717 - DNA, 22 bp, Artificial Sequence
  Synthetic
cctttggcgccaaaaacttacc

SEQ ID NO: 18718 - DNA, 25 bp, Artificial Sequence
  Synthetic
cgtcagaaattaagttagcaggcaa

SEQ ID NO: 18719 - DNA, 21 bp, Artificial Sequence
  Synthetic
gcttagatgctctctcaggcg

SEQ ID NO: 18720 - DNA, 22 bp, Artificial Sequence
  Synthetic
gcagagtcggaccccaatttcc

SEQ ID NO: 18721 - DNA, 20 bp, Artificial Sequence
  Synthetic
atcccccagacccttttcca

SEQ ID NO: 18722 - DNA, 25 bp, Artificial Sequence
  Synthetic
gctggatctctaaaggtgaatagtt

SEQ ID NO: 18723 - DNA, 25 bp, Artificial Sequence
  Synthetic
tctcttcaaatatgttgtccccaat

SEQ ID NO: 18724 - DNA, 24 bp, Artificial Sequence
  Synthetic
gctatttacatcacgctggaactg

SEQ ID NO: 18725 - DNA, 25 bp, Artificial Sequence
  Synthetic
cgctctgtcatatctaaagtccaga

SEQ ID NO: 18726 - DNA, 24 bp, Artificial Sequence
  Synthetic
caggagtttataggtcagaaccca

SEQ ID NO: 18727 - DNA, 23 bp, Artificial Sequence
  Synthetic
gccaatctggtattatcccttcc

SEQ ID NO: 18728 - DNA, 20 bp, Artificial Sequence
  Synthetic
ccagctcctcccatgtccct

SEQ ID NO: 18729 - DNA, 20 bp, Artificial Sequence
  Synthetic
gcgccaacctgctagggatt

SEQ ID NO: 18730 - DNA, 23 bp, Artificial Sequence
  Synthetic
cgggccgtaacctaactttttct

SEQ ID NO: 18731 - DNA, 20 bp, Artificial Sequence
  Synthetic
ccgcttgttgcacggggtag

SEQ ID NO: 18732 - DNA, 25 bp, Artificial Sequence
  Synthetic
gcctatacatccactggatctgttc

SEQ ID NO: 18733 - DNA, 22 bp, Artificial Sequence
  Synthetic
cgagtgtccctcctttccacag

SEQ ID NO: 18734 - DNA, 23 bp, Artificial Sequence
  Synthetic
gacatgcctaaggctgtcagaat

SEQ ID NO: 18735 - DNA, 24 bp, Artificial Sequence
  Synthetic
ccttttctttttggctagtcctgc

SEQ ID NO: 18736 - DNA, 24 bp, Artificial Sequence
  Synthetic
ccctaggccatttagaagttcttt

SEQ ID NO: 18737 - DNA, 25 bp, Artificial Sequence
  Synthetic
gttcctggctcaagataattttgtt

SEQ ID NO: 18738 - DNA, 25 bp, Artificial Sequence
  Synthetic
gcctggtataggatctcctactagg

SEQ ID NO: 18739 - DNA, 25 bp, Artificial Sequence
  Synthetic
gccttgacttactaaatggtctact

SEQ ID NO: 18740 - DNA, 22 bp, Artificial Sequence
  Synthetic
tgcgttattggccacctactgg

SEQ ID NO: 18741 - DNA, 25 bp, Artificial Sequence
  Synthetic
tcttgttctgtggtaatcatgttga

SEQ ID NO: 18742 - DNA, 25 bp, Artificial Sequence
  Synthetic
ggtaacatctgtccagaacttttct

SEQ ID NO: 18743 - DNA, 22 bp, Artificial Sequence
  Synthetic
acacctggaaaatgagctctcg

SEQ ID NO: 18744 - DNA, 25 bp, Artificial Sequence
  Synthetic
gggtgtctccatgtctattatggat

SEQ ID NO: 18745 - DNA, 21 bp, Artificial Sequence
  Synthetic
actcacttgtctggtgcagaa

SEQ ID NO: 18746 - DNA, 25 bp, Artificial Sequence
  Synthetic
gcttgacacatggttttattgatgt

SEQ ID NO: 18747 - DNA, 24 bp, Artificial Sequence
  Synthetic
gcaatgtctcatgtaacatgtgcc

SEQ ID NO: 18748 - DNA, 25 bp, Artificial Sequence
  Synthetic
gagagtgaaacactaatcctgacat

SEQ ID NO: 18749 - DNA, 25 bp, Artificial Sequence
  Synthetic
ttttccctactttatgccaggtatt

SEQ ID NO: 18750 - DNA, 22 bp, Artificial Sequence
  Synthetic
cgcacatccccatgaatttagc

SEQ ID NO: 18751 - DNA, 22 bp, Artificial Sequence
  Synthetic
cagccagtccctgattgctgtt

SEQ ID NO: 18752 - DNA, 25 bp, Artificial Sequence
  Synthetic
tgctgcctatacaaatctttctgtc

SEQ ID NO: 18753 - DNA, 20 bp, Artificial Sequence
  Synthetic
cagcatggagtcaaactgcc

SEQ ID NO: 18754 - DNA, 21 bp, Artificial Sequence
  Synthetic
agggaacacccaggctctacc

SEQ ID NO: 18755 - DNA, 20 bp, Artificial Sequence
  Synthetic
tcccagtgcagattcgatct

SEQ ID NO: 18756 - DNA, 25 bp, Artificial Sequence
  Synthetic
gcaggtttgacttcatggagtattg

SEQ ID NO: 18757 - DNA, 25 bp, Artificial Sequence
  Synthetic
actggatttattgctgtcttgttgt

SEQ ID NO: 18758 - DNA, 25 bp, Artificial Sequence
  Synthetic
tccaggtttttgtaccatgtaatca

SEQ ID NO: 18759 - DNA, 24 bp, Artificial Sequence
  Synthetic
tcctttaatagttttgcaggcggt

SEQ ID NO: 18760 - DNA, 25 bp, Artificial Sequence
  Synthetic
gctcttagatcatccactttttcgt

SEQ ID NO: 18761 - DNA, 20 bp, Artificial Sequence
  Synthetic
gcattaaaggtgccagcagc

SEQ ID NO: 18762 - DNA, 25 bp, Artificial Sequence
  Synthetic
gccccatggaatgttatttctcttt

SEQ ID NO: 18763 - DNA, 21 bp, Artificial Sequence
  Synthetic
tcgatccagccatctgctcca

SEQ ID NO: 18764 - DNA, 25 bp, Artificial Sequence
  Synthetic
cacaatatcaagtgcagtatcccaa

SEQ ID NO: 18765 - DNA, 24 bp, Artificial Sequence
  Synthetic
tccgcgcaataattcttcaaaaag

SEQ ID NO: 18766 - DNA, 25 bp, Artificial Sequence
  Synthetic
gcttgttatacaatgccagggaatt

SEQ ID NO: 18767 - DNA, 24 bp, Artificial Sequence
  Synthetic
tcttgtaactctaattgcactgca

SEQ ID NO: 18768 - DNA, 24 bp, Artificial Sequence
  Synthetic
tccattgtaatctgcatcaccttt

SEQ ID NO: 18769 - DNA, 25 bp, Artificial Sequence
  Synthetic
ggacaatcaccagtaaagcattgtt

SEQ ID NO: 18770 - DNA, 22 bp, Artificial Sequence
  Synthetic
accaataggctccacaggtact

SEQ ID NO: 18771 - DNA, 25 bp, Artificial Sequence
  Synthetic
gcctgaacgtggttcattatttaca

SEQ ID NO: 18772 - DNA, 23 bp, Artificial Sequence
  Synthetic
cgttcaactatttgggtgggagt

SEQ ID NO: 18773 - DNA, 21 bp, Artificial Sequence
  Synthetic
caccttcacggctcactctta

SEQ ID NO: 18774 - DNA, 20 bp, Artificial Sequence
  Synthetic
acatctgagcgtttgcgttt

SEQ ID NO: 18775 - DNA, 25 bp, Artificial Sequence
  Synthetic
tgggatctggacacagtaatctaaa

SEQ ID NO: 18776 - DNA, 25 bp, Artificial Sequence
  Synthetic
gtgcaacctactataaacacctgat

SEQ ID NO: 18777 - DNA, 24 bp, Artificial Sequence
  Synthetic
ctccggagatatcctttgacattt

SEQ ID NO: 18778 - DNA, 25 bp, Artificial Sequence
  Synthetic
cccaatcatctaacactgttggatt

SEQ ID NO: 18779 - DNA, 25 bp, Artificial Sequence
  Synthetic
cagtttttctggatactttcggaga

SEQ ID NO: 18780 - DNA, 21 bp, Artificial Sequence
  Synthetic
gacaaacagctttcgcaacag

SEQ ID NO: 18781 - DNA, 20 bp, Artificial Sequence
  Synthetic
atgactcctcctctggggtg

SEQ ID NO: 18782 - DNA, 23 bp, Artificial Sequence
  Synthetic
cctagtccactgtcctgaaacag

SEQ ID NO: 18783 - DNA, 24 bp, Artificial Sequence
  Synthetic
gcttgagaagccatttgatgattt

SEQ ID NO: 18784 - DNA, 25 bp, Artificial Sequence
  Synthetic
agtcattaattgctcttgtagtgca

SEQ ID NO: 18785 - DNA, 20 bp, Artificial Sequence
  Synthetic
ttttcctcttcggcctcggc

SEQ ID NO: 18786 - DNA, 21 bp, Artificial Sequence
  Synthetic
tgacatcttctggacagtccc

SEQ ID NO: 18787 - DNA, 25 bp, Artificial Sequence
  Synthetic
gcatctggagtgattggtagtactt

SEQ ID NO: 18788 - DNA, 25 bp, Artificial Sequence
  Synthetic
aggaacctgttgaacaaatctatga

SEQ ID NO: 18789 - DNA, 25 bp, Artificial Sequence
  Synthetic
gtgtcaggaatgttaacaaatgtgt

SEQ ID NO: 18790 - DNA, 24 bp, Artificial Sequence
  Synthetic
gcaaactggttaggatctggtaat

SEQ ID NO: 18791 - DNA, 25 bp, Artificial Sequence
  Synthetic
cccgccgtccataaaaaaataattt

SEQ ID NO: 18792 - DNA, 25 bp, Artificial Sequence
  Synthetic
ccagctgccagttttctaatattga

SEQ ID NO: 18793 - DNA, 22 bp, Artificial Sequence
  Synthetic
ggtcgggtatcaaatacagcag

SEQ ID NO: 18794 - DNA, 25 bp, Artificial Sequence
  Synthetic
cctgtcttcctgatgtgtacttctt

SEQ ID NO: 18795 - DNA, 21 bp, Artificial Sequence
  Synthetic
ggtccatttctgttccaccac

SEQ ID NO: 18796 - DNA, 25 bp, Artificial Sequence
  Synthetic
cctttgttattgtcagctgtgattc

SEQ ID NO: 18797 - DNA, 21 bp, Artificial Sequence
  Synthetic
cctgacaatgttcctagcagc

SEQ ID NO: 18798 - DNA, 25 bp, Artificial Sequence
  Synthetic
gtccaaccattgtgaattcctcata

SEQ ID NO: 18799 - DNA, 21 bp, Artificial Sequence
  Synthetic
ggagttggtgcatgggattca

SEQ ID NO: 18800 - DNA, 25 bp, Artificial Sequence
  Synthetic
tgtttcactaacttcttcaggggat

SEQ ID NO: 18801 - DNA, 21 bp, Artificial Sequence
  Synthetic
cccaaaacatcacgcatctgc

SEQ ID NO: 18802 - DNA, 21 bp, Artificial Sequence
  Synthetic
tcctgctgttccttcatctgg

SEQ ID NO: 18803 - DNA, 21 bp, Artificial Sequence
  Synthetic
actttggttccgtttgacacg

SEQ ID NO: 18804 - DNA, 25 bp, Artificial Sequence
  Synthetic
tcttcattcacgaatttcccaggat

SEQ ID NO: 18805 - DNA, 23 bp, Artificial Sequence
  Synthetic
ccagtttgtttccactcccatat

SEQ ID NO: 18806 - DNA, 22 bp, Artificial Sequence
  Synthetic
ttgtccctccactatgatagca

SEQ ID NO: 18807 - DNA, 25 bp, Artificial Sequence
  Synthetic
tctgaaaccataccaaccatcaatt

SEQ ID NO: 18808 - DNA, 22 bp, Artificial Sequence
  Synthetic
tgtccatttctgaatcagccag

SEQ ID NO: 18809 - DNA, 23 bp, Artificial Sequence
  Synthetic
acttgccattctgccttaacaag

SEQ ID NO: 18810 - DNA, 25 bp, Artificial Sequence
  Synthetic
gcttttgacatatagcacagcgaat

SEQ ID NO: 18811 - DNA, 25 bp, Artificial Sequence
  Synthetic
ttctgtaacgttgtatgtcctgttt

SEQ ID NO: 18812 - DNA, 21 bp, Artificial Sequence
  Synthetic
tttcctgattttcctgcaccc

SEQ ID NO: 18813 - DNA, 24 bp, Artificial Sequence
  Synthetic
gcgattcttgccacatttaaatct

SEQ ID NO: 18814 - DNA, 20 bp, Artificial Sequence
  Synthetic
cagcacgttgggcatattca

SEQ ID NO: 18815 - DNA, 20 bp, Artificial Sequence
  Synthetic
acgcatctaaacgtttggcc

SEQ ID NO: 18816 - DNA, 25 bp, Artificial Sequence
  Synthetic
gcgtccctgtttttttaaacacttt

SEQ ID NO: 18817 - DNA, 22 bp, Artificial Sequence
  Synthetic
ggtcggggtggggtctttgtat

SEQ ID NO: 18818 - DNA, 25 bp, Artificial Sequence
  Synthetic
cacgcagcaacaactataaacaata

SEQ ID NO: 18819 - DNA, 21 bp, Artificial Sequence
  Synthetic
ctaaaaaccacagcagcagcc

SEQ ID NO: 18820 - DNA, 25 bp, Artificial Sequence
  Synthetic
tgcagaggacgtaatattaaaccca

SEQ ID NO: 18821 - DNA, 21 bp, Artificial Sequence
  Synthetic
tgatggcctagtgattgggct

SEQ ID NO: 18822 - DNA, 23 bp, Artificial Sequence
  Synthetic
gaggaggcagataaaccttgttg

SEQ ID NO: 18823 - DNA, 25 bp, Artificial Sequence
  Synthetic
accatcctgaataacactgttttgt

SEQ ID NO: 18824 - DNA, 25 bp, Artificial Sequence
  Synthetic
cgtctagtatgtcaggattcatggt

SEQ ID NO: 18825 - DNA, 25 bp, Artificial Sequence
  Synthetic
gcatgtgcttgctaaatttaatgga

SEQ ID NO: 18826 - DNA, 25 bp, Artificial Sequence
  Synthetic
cttaattgaaatgtgtctgcctgtg

SEQ ID NO: 18827 - DNA, 25 bp, Artificial Sequence
  Synthetic
cactgtgccattgtcatatttttca

SEQ ID NO: 18828 - DNA, 22 bp, Artificial Sequence
  Synthetic
cctccgaccgtctcttcagtct

SEQ ID NO: 18829 - DNA, 20 bp, Artificial Sequence
  Synthetic
agacctgctgctggtactga

SEQ ID NO: 18830 - DNA, 25 bp, Artificial Sequence
  Synthetic
ccaactacttctgaaactggatcaa

SEQ ID NO: 18831 - DNA, 24 bp, Artificial Sequence
  Synthetic
caggccatttacaagtggagttaa

SEQ ID NO: 18832 - DNA, 20 bp, Artificial Sequence
  Synthetic
accactgggcgtcggataat

SEQ ID NO: 18833 - DNA, 20 bp, Artificial Sequence
  Synthetic
gggctagcacatcagcttcc

SEQ ID NO: 18834 - DNA, 25 bp, Artificial Sequence
  Synthetic
acgggaattaagtaatcccatctga

SEQ ID NO: 18835 - DNA, 22 bp, Artificial Sequence
  Synthetic
atgagtcagcaatgccttgttt

SEQ ID NO: 18836 - DNA, 23 bp, Artificial Sequence
  Synthetic
acgatcgttaacggttggatttg

SEQ ID NO: 18837 - DNA, 22 bp, Artificial Sequence
  Synthetic
gccgtagtgctggctagtacca

SEQ ID NO: 18838 - DNA, 25 bp, Artificial Sequence
  Synthetic
ccacaatatcaagtgcaatatccca

SEQ ID NO: 18839 - DNA, 21 bp, Artificial Sequence
  Synthetic
gagctctggattggcataagc

SEQ ID NO: 18840 - DNA, 25 bp, Artificial Sequence
  Synthetic
tgaccagaactatccagatctgtat

SEQ ID NO: 18841 - DNA, 25 bp, Artificial Sequence
  Synthetic
tgttgcatggctctattttgtacaa

SEQ ID NO: 18842 - DNA, 25 bp, Artificial Sequence
  Synthetic
tcttcccaagaatccatgatttgat

SEQ ID NO: 18843 - DNA, 22 bp, Artificial Sequence
  Synthetic
gaccacagtctcagctctacta

SEQ ID NO: 18844 - DNA, 25 bp, Artificial Sequence
  Synthetic
gtgttcctgatgattctgtctgtat

SEQ ID NO: 18845 - DNA, 25 bp, Artificial Sequence
  Synthetic
cctgcatgtcgatatagatcaggta

SEQ ID NO: 18846 - DNA, 24 bp, Artificial Sequence
  Synthetic
ttgactttgagtggtaatggttct

SEQ ID NO: 18847 - DNA, 20 bp, Artificial Sequence
  Synthetic
tggcatcgaacagcattcct

SEQ ID NO: 18848 - DNA, 23 bp, Artificial Sequence
  Synthetic
ttcccaactccttttgcgataat

SEQ ID NO: 18849 - DNA, 25 bp, Artificial Sequence
  Synthetic
gggatgatcagtctatccaataacc

SEQ ID NO: 18850 - DNA, 21 bp, Artificial Sequence
  Synthetic
tctgagtgttcagcagcctag

SEQ ID NO: 18851 - DNA, 25 bp, Artificial Sequence
  Synthetic
ctccttgattaggtggttgattgat

SEQ ID NO: 18852 - DNA, 25 bp, Artificial Sequence
  Synthetic
ccagtattccatctcgaatttggat

SEQ ID NO: 18853 - DNA, 20 bp, Artificial Sequence
  Synthetic
gaagaccagacgtgcacctc

SEQ ID NO: 18854 - DNA, 22 bp, Artificial Sequence
  Synthetic
aagacctccatacccgagaaat

SEQ ID NO: 18855 - DNA, 21 bp, Artificial Sequence
  Synthetic
tgactgggttcactctcgatt

SEQ ID NO: 18856 - DNA, 24 bp, Artificial Sequence
  Synthetic
gcagagtttgaaccgtaagcattt

SEQ ID NO: 18857 - DNA, 25 bp, Artificial Sequence
  Synthetic
ctctgaccaaaagacacatctagat

SEQ ID NO: 18858 - DNA, 25 bp, Artificial Sequence
  Synthetic
gcaggtattaaagaggcatattgca

SEQ ID NO: 18859 - DNA, 25 bp, Artificial Sequence
  Synthetic
ccttcctcctgataaatgaatccac

SEQ ID NO: 18860 - DNA, 25 bp, Artificial Sequence
  Synthetic
agtgtaaaatttgcacgtgtttgtg

SEQ ID NO: 18861 - DNA, 23 bp, Artificial Sequence
  Synthetic
ctacgactccagcatcaaagatg

SEQ ID NO: 18862 - DNA, 20 bp, Artificial Sequence
  Synthetic
aaaccattgctagcggcctc

SEQ ID NO: 18863 - DNA, 25 bp, Artificial Sequence
  Synthetic
cttagtaagccaagcacaaacgtaa

SEQ ID NO: 18864 - DNA, 25 bp, Artificial Sequence
  Synthetic
ccacaagtacattgaactaatgcac

SEQ ID NO: 18865 - DNA, 25 bp, Artificial Sequence
  Synthetic
atgttcctcttctacaaaagtggaa

SEQ ID NO: 18866 - DNA, 24 bp, Artificial Sequence
  Synthetic
acagcacagtcaaagacagtttga

SEQ ID NO: 18867 - DNA, 20 bp, Artificial Sequence
  Synthetic
agcagtgctacgttcaacac

SEQ ID NO: 18868 - DNA, 23 bp, Artificial Sequence
  Synthetic
tcctcaaaccaagactcgttact

SEQ ID NO: 18869 - DNA, 25 bp, Artificial Sequence
  Synthetic
agtgtctaaaaacgcattataggcc

SEQ ID NO: 18870 - DNA, 25 bp, Artificial Sequence
  Synthetic
gtcaaaatgtgtagggtctgcaatt

SEQ ID NO: 18871 - DNA, 25 bp, Artificial Sequence
  Synthetic
tcccagtcaccttcatgtttaattt

SEQ ID NO: 18872 - DNA, 25 bp, Artificial Sequence
  Synthetic
gcatagtcaccatcaagtataccag

SEQ ID NO: 18873 - DNA, 22 bp, Artificial Sequence
  Synthetic
agtgggcgtacaaaacaaaaca

SEQ ID NO: 18874 - DNA, 25 bp, Artificial Sequence
  Synthetic
gcgttcaacttctctttaacaacaa

SEQ ID NO: 18875 - DNA, 25 bp, Artificial Sequence
  Synthetic
tggttctattttaggttgctcaact

SEQ ID NO: 18876 - DNA, 22 bp, Artificial Sequence
  Synthetic
acgtgtgcatcgttgaacatta

SEQ ID NO: 18877 - DNA, 25 bp, Artificial Sequence
  Synthetic
cgacccaatcaacatctattgcttt

SEQ ID NO: 18878 - DNA, 25 bp, Artificial Sequence
  Synthetic
cctctaacacttctaacacgtgaat

SEQ ID NO: 18879 - DNA, 23 bp, Artificial Sequence
  Synthetic
agctgctgacgcttttaagttat

SEQ ID NO: 18880 - DNA, 25 bp, Artificial Sequence
  Synthetic
tggctaaattgacttaactcttggt

SEQ ID NO: 18881 - DNA, 25 bp, Artificial Sequence
  Synthetic
gggaatctcttaagtctagcactct

SEQ ID NO: 18882 - DNA, 25 bp, Artificial Sequence
  Synthetic
aacgatgtgcattagaaatagcact

SEQ ID NO: 18883 - DNA, 23 bp, Artificial Sequence
  Synthetic
gcgtgacagcttggttttcatta

SEQ ID NO: 18884 - DNA, 25 bp, Artificial Sequence
  Synthetic
gccagcgacagtattaacaatttca

SEQ ID NO: 18885 - DNA, 20 bp, Artificial Sequence
  Synthetic
attcacctacgcggcagtat

SEQ ID NO: 18886 - DNA, 25 bp, Artificial Sequence
  Synthetic
gcaattaaatatgcagcacaccaaa

SEQ ID NO: 18887 - DNA, 25 bp, Artificial Sequence
  Synthetic
ccagcctgtaatgtagaaccataac

SEQ ID NO: 18888 - DNA, 25 bp, Artificial Sequence
  Synthetic
ctaaaagaatgtctaggtgtgtgca

SEQ ID NO: 18889 - DNA, 25 bp, Artificial Sequence
  Synthetic
gcaaccacattaactgttaacatct

SEQ ID NO: 18890 - DNA, 25 bp, Artificial Sequence
  Synthetic
acccaaatagtggtggtataaacaa

SEQ ID NO: 18891 - DNA, 23 bp, Artificial Sequence
  Synthetic
accaatgtgtacaacgctcttta

SEQ ID NO: 18892 - DNA, 25 bp, Artificial Sequence
  Synthetic
ggctggactaacacagaaatcataa

SEQ ID NO: 18893 - DNA, 24 bp, Artificial Sequence
  Synthetic
gcccactcctttgaattagaagct

SEQ ID NO: 18894 - DNA, 25 bp, Artificial Sequence
  Synthetic
gcttgttcagccattctgttaattt

SEQ ID NO: 18895 - DNA, 25 bp, Artificial Sequence
  Synthetic
tgcacattcttaccatcattatcct

SEQ ID NO: 18896 - DNA, 25 bp, Artificial Sequence
  Synthetic
ccagagtcatgttcccatttaacat

SEQ ID NO: 18897 - DNA, 25 bp, Artificial Sequence
  Synthetic
acatctttacacaattgccaacagg

SEQ ID NO: 18898 - DNA, 24 bp, Artificial Sequence
  Synthetic
cccggactcgtttaaataactgtt

SEQ ID NO: 18899 - DNA, 25 bp, Artificial Sequence
  Synthetic
cagtctttttcatcaaagttacgca

SEQ ID NO: 18900 - DNA, 21 bp, Artificial Sequence
  Synthetic
tgacgtgcagtagggtattcc

SEQ ID NO: 18901 - DNA, 25 bp, Artificial Sequence
  Synthetic
cgggtacaccatcaataaacacttt

SEQ ID NO: 18902 - DNA, 25 bp, Artificial Sequence
  Synthetic
cccctgagaacgtaagaagtcataa

SEQ ID NO: 18903 - DNA, 20 bp, Artificial Sequence
  Synthetic
aagagacgccacccactgta

SEQ ID NO: 18904 - DNA, 25 bp, Artificial Sequence
  Synthetic
caatgtaaccaagtccagcataagt

SEQ ID NO: 18905 - DNA, 24 bp, Artificial Sequence
  Synthetic
ggtaggcatctatagccagagaaa

SEQ ID NO: 18906 - DNA, 25 bp, Artificial Sequence
  Synthetic
gcagaacttttgtacaaaccaaaga

SEQ ID NO: 18907 - DNA, 25 bp, Artificial Sequence
  Synthetic
accgtaatctactttctcaaacaca

SEQ ID NO: 18908 - DNA, 21 bp, Artificial Sequence
  Synthetic
tcgctccagggtaatacacac

SEQ ID NO: 18909 - DNA, 25 bp, Artificial Sequence
  Synthetic
tgttgaggatcaccaacatatacaa

SEQ ID NO: 18910 - DNA, 25 bp, Artificial Sequence
  Synthetic
cctggcagctacataattttgacta

SEQ ID NO: 18911 - DNA, 25 bp, Artificial Sequence
  Synthetic
agacaatgacaaataagtagtggca

SEQ ID NO: 18912 - DNA, 21 bp, Artificial Sequence
  Synthetic
tgccaacattgtcacctgtga

SEQ ID NO: 18913 - DNA, 25 bp, Artificial Sequence
  Synthetic
gctccaatcttaacaaaataacgca

SEQ ID NO: 18914 - DNA, 25 bp, Artificial Sequence
  Synthetic
gcccttgtttatggcattttcatta

SEQ ID NO: 18915 - DNA, 22 bp, Artificial Sequence
  Synthetic
cccaccatttacaccttcaagg

SEQ ID NO: 18916 - DNA, 23 bp, Artificial Sequence
  Synthetic
tctgtgaatgtctgccacaaatt

SEQ ID NO: 18917 - DNA, 20 bp, Artificial Sequence
  Synthetic
aagcttgtcaagggacgctc

SEQ ID NO: 18918 - DNA, 25 bp, Artificial Sequence
  Synthetic
cgaccttgggtataaaaaccatcat

SEQ ID NO: 18919 - DNA, 25 bp, Artificial Sequence
  Synthetic
caacagtcaaatccaaagacttcaa

SEQ ID NO: 18920 - DNA, 25 bp, Artificial Sequence
  Synthetic
gcacccaagtgtaacactctcatat

SEQ ID NO: 18921 - DNA, 25 bp, Artificial Sequence
  Synthetic
cgccaaaatacataatttgcgtgta

SEQ ID NO: 18922 - DNA, 25 bp, Artificial Sequence
  Synthetic
cgttgcaaacagagtaactagtgtt

SEQ ID NO: 18923 - DNA, 25 bp, Artificial Sequence
  Synthetic
acgtagtttcattgccaatagtagt

SEQ ID NO: 18924 - DNA, 22 bp, Artificial Sequence
  Synthetic
agcgacacaatagacacaggta

SEQ ID NO: 18925 - DNA, 25 bp, Artificial Sequence
  Synthetic
tgaagttgatgtgtacgtaattcca

SEQ ID NO: 18926 - DNA, 25 bp, Artificial Sequence
  Synthetic
gaaacattacgtggttgaacagcaa

SEQ ID NO: 18927 - DNA, 25 bp, Artificial Sequence
  Synthetic
gctaaggttgtagtcaccaaaacta

SEQ ID NO: 18928 - DNA, 25 bp, Artificial Sequence
  Synthetic
tgcctgaattgctaatgaaaatggt

SEQ ID NO: 18929 - DNA, 25 bp, Artificial Sequence
  Synthetic
ccaatctaccagtaatcagcctatc

SEQ ID NO: 18930 - DNA, 25 bp, Artificial Sequence
  Synthetic
tgccttctttgtaaagagcaagatt

SEQ ID NO: 18931 - DNA, 25 bp, Artificial Sequence
  Synthetic
gtgctaatttcactggtcaaattca

SEQ ID NO: 18932 - DNA, 24 bp, Artificial Sequence
  Synthetic
tgtggatcttttcaacgtcgtaat

SEQ ID NO: 18933 - DNA, 25 bp, Artificial Sequence
  Synthetic
aaaattacagcaatcaaagttgcgt

SEQ ID NO: 18934 - DNA, 23 bp, Artificial Sequence
  Synthetic
atcactataagcaccacacacca

SEQ ID NO: 18935 - DNA, 21 bp, Artificial Sequence
  Synthetic
agcccaggtgtcaaagattga

SEQ ID NO: 18936 - DNA, 21 bp, Artificial Sequence
  Synthetic
acgtagaaaacccagcctgtg

SEQ ID NO: 18937 - DNA, 25 bp, Artificial Sequence
  Synthetic
ttctgaaacgtttttgaacattcca

SEQ ID NO: 18938 - DNA, 23 bp, Artificial Sequence
  Synthetic
acctaaagatttaagagccgcag

SEQ ID NO: 18939 - DNA, 25 bp, Artificial Sequence
  Synthetic
ggccaaaacattgtgtgacattaga

SEQ ID NO: 18940 - DNA, 23 bp, Artificial Sequence
  Synthetic
gagatgggttgaattctagtgca

SEQ ID NO: 18941 - DNA, 23 bp, Artificial Sequence
  Synthetic
accactggcttaccattgtgtat

SEQ ID NO: 18942 - DNA, 20 bp, Artificial Sequence
  Synthetic
ccaggtgtggcaaatggaca

SEQ ID NO: 18943 - DNA, 21 bp, Artificial Sequence
  Synthetic
agaaacatctgtcccatcgct

SEQ ID NO: 18944 - DNA, 22 bp, Artificial Sequence
  Synthetic
gcgatgctaccttttccaccct

SEQ ID NO: 18945 - DNA, 25 bp, Artificial Sequence
  Synthetic
ggcattacaccctctgtaaagctaa

SEQ ID NO: 18946 - DNA, 25 bp, Artificial Sequence
  Synthetic
ggcgcatttcgtatcttttatacat

SEQ ID NO: 18947 - DNA, 20 bp, Artificial Sequence
  Synthetic
tccacttgtgcaccaccttt

SEQ ID NO: 18948 - DNA, 24 bp, Artificial Sequence
  Synthetic
gcagaagtgtcagaagcagattct

SEQ ID NO: 18949 - DNA, 25 bp, Artificial Sequence
  Synthetic
tcagctaatgtggtttgttctactt

SEQ ID NO: 18950 - DNA, 22 bp, Artificial Sequence
  Synthetic
cgtgtcgggggttaccacatct

SEQ ID NO: 18951 - DNA, 25 bp, Artificial Sequence
  Synthetic
acagaaatatatgatggggtggcat

SEQ ID NO: 18952 - DNA, 22 bp, Artificial Sequence
  Synthetic
tgacgtgggcggtttaagaagt

SEQ ID NO: 18953 - DNA, 20 bp, Artificial Sequence
  Synthetic
agaaacaccctgaaggcctg

SEQ ID NO: 18954 - DNA, 23 bp, Artificial Sequence
  Synthetic
ggtaaccacagtgacatctgaaa

SEQ ID NO: 18955 - DNA, 21 bp, Artificial Sequence
  Synthetic
ccaacgcaagcttgttaggat

SEQ ID NO: 18956 - DNA, 23 bp, Artificial Sequence
  Synthetic
gccatcccgtgtaaaaaagtgac

SEQ ID NO: 18957 - DNA, 20 bp, Artificial Sequence
  Synthetic
ggggtacaaagcctaactgc

SEQ ID NO: 18958 - DNA, 19 bp, Artificial Sequence
  Synthetic
tgcccatctccacgcgaag

SEQ ID NO: 18959 - DNA, 22 bp, Artificial Sequence
  Synthetic
tgcttgtgaggcatgactccag

SEQ ID NO: 18960 - DNA, 19 bp, Artificial Sequence
  Synthetic
gcgttcagcagcgcctcag

SEQ ID NO: 18961 - DNA, 22 bp, Artificial Sequence
  Synthetic
ccaccggcatagtgatggtcac

SEQ ID NO: 18962 - DNA, 22 bp, Artificial Sequence
  Synthetic
gccgtgctgcacctcaaacatt

SEQ ID NO: 18963 - DNA, 19 bp, Artificial Sequence
  Synthetic
acaaggcaggacgcagccc

SEQ ID NO: 18964 - DNA, 23 bp, Artificial Sequence
  Synthetic
ctacctgaactaagactgggtgt

SEQ ID NO: 18965 - DNA, 22 bp, Artificial Sequence
  Synthetic
cgaggcaggcttacatgggagt

SEQ ID NO: 18966 - DNA, 19 bp, Artificial Sequence
  Synthetic
cgggttggtccagggcctt

SEQ ID NO: 18967 - DNA, 20 bp, Artificial Sequence
  Synthetic
ctcgtctgggttcttggccc

SEQ ID NO: 18968 - DNA, 20 bp, Artificial Sequence
  Synthetic
aagaggcccctctccgcgag

SEQ ID NO: 18969 - DNA, 22 bp, Artificial Sequence
  Synthetic
cctctggtaggactgggcgacc

SEQ ID NO: 18970 - DNA, 21 bp, Artificial Sequence
  Synthetic
cgtaaacgcgctggactgaga

SEQ ID NO: 18971 - DNA, 22 bp, Artificial Sequence
  Synthetic
gccttcttaggagctgtccgag

SEQ ID NO: 18972 - DNA, 22 bp, Artificial Sequence
  Synthetic
gagttgagctgcctaccatgct

SEQ ID NO: 18973 - DNA, 22 bp, Artificial Sequence
  Synthetic
cctcgtcttcggtctcagcttc

SEQ ID NO: 18974 - DNA, 20 bp, Artificial Sequence
  Synthetic
aggggctggtctgtgacctg

SEQ ID NO: 18975 - DNA, 18 bp, Artificial Sequence
  Synthetic
agtccaggcccgggacat

SEQ ID NO: 18976 - DNA, 19 bp, Artificial Sequence
  Synthetic
agagcccagaccggtctcc

SEQ ID NO: 18977 - DNA, 22 bp, Artificial Sequence
  Synthetic
gcaacgtccaggagctgttctc

SEQ ID NO: 18978 - DNA, 19 bp, Artificial Sequence
  Synthetic
tcgtggtggaggctgccag

SEQ ID NO: 18979 - DNA, 19 bp, Artificial Sequence
  Synthetic
cacgttggaccccaagcgg

SEQ ID NO: 18980 - DNA, 19 bp, Artificial Sequence
  Synthetic
ggcggagagaatggaggcc

SEQ ID NO: 18981 - DNA, 18 bp, Artificial Sequence
  Synthetic
aatgcggccctgcacgtg

SEQ ID NO: 18982 - DNA, 22 bp, Artificial Sequence
  Synthetic
aaagctggaagcgcctcctatc

SEQ ID NO: 18983 - DNA, 22 bp, Artificial Sequence
  Synthetic
gccctcctttggggatgatgca

SEQ ID NO: 18984 - DNA, 19 bp, Artificial Sequence
  Synthetic
acccgtgggacaaacgccc

SEQ ID NO: 18985 - DNA, 19 bp, Artificial Sequence
  Synthetic
tccccccgccactactcca

SEQ ID NO: 18986 - DNA, 20 bp, Artificial Sequence
  Synthetic
ccgctttctggtctcgggtg

SEQ ID NO: 18987 - DNA, 20 bp, Artificial Sequence
  Synthetic
cggccgccttcatcgagttc

SEQ ID NO: 18988 - DNA, 22 bp, Artificial Sequence
  Synthetic
gcttgaagaagagctcggggac

SEQ ID NO: 18989 - DNA, 22 bp, Artificial Sequence
  Synthetic
acggcgcagttgacgatagaga

SEQ ID NO: 18990 - DNA, 19 bp, Artificial Sequence
  Synthetic
cgggaggcagatgttggcc

SEQ ID NO: 18991 - DNA, 20 bp, Artificial Sequence
  Synthetic
agacaacgtgggcctcaacg

SEQ ID NO: 18992 - DNA, 21 bp, Artificial Sequence
  Synthetic
cgagggtgtctctggccttgc

SEQ ID NO: 18993 - DNA, 21 bp, Artificial Sequence
  Synthetic
ctcatgagcaccctggcaaca

SEQ ID NO: 18994 - DNA, 19 bp, Artificial Sequence
  Synthetic
aatccgcatggagcccccg

SEQ ID NO: 18995 - DNA, 18 bp, Artificial Sequence
  Synthetic
tccaccacgtggcgggtt

SEQ ID NO: 18996 - DNA, 22 bp, Artificial Sequence
  Synthetic
ccttcagatatgccacccccca

SEQ ID NO: 18997 - DNA, 20 bp, Artificial Sequence
  Synthetic
cccgagggtcatgggctcat

SEQ ID NO: 18998 - DNA, 19 bp, Artificial Sequence
  Synthetic
tcagtcagggaagccgccg

SEQ ID NO: 18999 - DNA, 20 bp, Artificial Sequence
  Synthetic
cagcagcgtgttcacaaact

SEQ ID NO: 19000 - DNA, 20 bp, Artificial Sequence
  Synthetic
gcctgtgctaccggacacgg

SEQ ID NO: 19001 - DNA, 19 bp, Artificial Sequence
  Synthetic
aacggggtggatttggcgt

SEQ ID NO: 19002 - DNA, 21 bp, Artificial Sequence
  Synthetic
caccctcctcttgaacaggcc

SEQ ID NO: 19003 - DNA, 21 bp, Artificial Sequence
  Synthetic
ggacattgtccccccctgact

SEQ ID NO: 19004 - DNA, 19 bp, Artificial Sequence
  Synthetic
acttggctgaaccaccggc

SEQ ID NO: 19005 - DNA, 19 bp, Artificial Sequence
  Synthetic
ctgaagcccggtgcccaaa

SEQ ID NO: 19006 - DNA, 22 bp, Artificial Sequence
  Synthetic
agccagatgttcaggaaccaaa

SEQ ID NO: 19007 - DNA, 20 bp, Artificial Sequence
  Synthetic
gggaacagcaggggaggtcc

SEQ ID NO: 19008 - DNA, 22 bp, Artificial Sequence
  Synthetic
gctctcgctgtagtcagactcg

SEQ ID NO: 19009 - DNA, 19 bp, Artificial Sequence
  Synthetic
ttggtgctgtgcccctgcc

SEQ ID NO: 19010 - DNA, 18 bp, Artificial Sequence
  Synthetic
catgcaccaggggcagct

SEQ ID NO: 19011 - DNA, 19 bp, Artificial Sequence
  Synthetic
gcagcgggtcagcagtcat

SEQ ID NO: 19012 - DNA, 21 bp, Artificial Sequence
  Synthetic
gggaagagcacatgcagcctg

SEQ ID NO: 19013 - DNA, 21 bp, Artificial Sequence
  Synthetic
gctgatggtgcttgccggatg

SEQ ID NO: 19014 - DNA, 19 bp, Artificial Sequence
  Synthetic
atccgggccttgacgtggg

SEQ ID NO: 19015 - DNA, 21 bp, Artificial Sequence
  Synthetic
gctctacgccttcctccgcag

SEQ ID NO: 19016 - DNA, 21 bp, Artificial Sequence
  Synthetic
ggaccaacaacccccacctgt

SEQ ID NO: 19017 - DNA, 25 bp, Artificial Sequence
  Synthetic
gtctcagttgagcattcacctttta

SEQ ID NO: 19018 - DNA, 22 bp, Artificial Sequence
  Synthetic
tgccggactctgtcatccgtaa

SEQ ID NO: 19019 - DNA, 22 bp, Artificial Sequence
  Synthetic
ccgatccgacccgctctacttt

SEQ ID NO: 19020 - DNA, 22 bp, Artificial Sequence
  Synthetic
gcaaaaggggccctattctgct

SEQ ID NO: 19021 - DNA, 19 bp, Artificial Sequence
  Synthetic
gcacagtgcggctcaggct

SEQ ID NO: 19022 - DNA, 20 bp, Artificial Sequence
  Synthetic
caccgacaacgttctgcgcc

SEQ ID NO: 19023 - DNA, 19 bp, Artificial Sequence
  Synthetic
tcccttcgcaggagggcca

SEQ ID NO: 19024 - DNA, 19 bp, Artificial Sequence
  Synthetic
tcccgatggcaggtgcacg

SEQ ID NO: 19025 - DNA, 20 bp, Artificial Sequence
  Synthetic
ggggctccggtgcctttttc

SEQ ID NO: 19026 - DNA, 21 bp, Artificial Sequence
  Synthetic
gcacacgttgttttggcaata

SEQ ID NO: 19027 - DNA, 22 bp, Artificial Sequence
  Synthetic
cggccgtttcaaatgctgtgga

SEQ ID NO: 19028 - DNA, 18 bp, Artificial Sequence
  Synthetic
tgctgtccaccgccctgt

SEQ ID NO: 19029 - DNA, 22 bp, Artificial Sequence
  Synthetic
cggggtttacagtggcctcatt

SEQ ID NO: 19030 - DNA, 20 bp, Artificial Sequence
  Synthetic
gctgaagcggctaagtggga

SEQ ID NO: 19031 - DNA, 19 bp, Artificial Sequence
  Synthetic
tcccgctctgccagctcga

SEQ ID NO: 19032 - DNA, 22 bp, Artificial Sequence
  Synthetic
tgctcttcaaccttggcagtgt

SEQ ID NO: 19033 - DNA, 19 bp, Artificial Sequence
  Synthetic
aggcaggcgtccttgggtg

SEQ ID NO: 19034 - DNA, 20 bp, Artificial Sequence
  Synthetic
tggcgccctaagaccacctg

SEQ ID NO: 19035 - DNA, 18 bp, Artificial Sequence
  Synthetic
gcagcacacgcccccatt

SEQ ID NO: 19036 - DNA, 21 bp, Artificial Sequence
  Synthetic
aaggctggcaaagatccccag

SEQ ID NO: 19037 - DNA, 22 bp, Artificial Sequence
  Synthetic
tcagcctacaagagcacccaga

SEQ ID NO: 19038 - DNA, 22 bp, Artificial Sequence
  Synthetic
gccgagaagaccttctcctgcc

SEQ ID NO: 19039 - DNA, 22 bp, Artificial Sequence
  Synthetic
gccatcaagtgcacgtgcaacg

SEQ ID NO: 19040 - DNA, 20 bp, Artificial Sequence
  Synthetic
gccgggacaagctcagcctc

SEQ ID NO: 19041 - DNA, 20 bp, Artificial Sequence
  Synthetic
aggaggccgggcgctatagg

SEQ ID NO: 19042 - DNA, 21 bp, Artificial Sequence
  Synthetic
gggacgtggtctactgggagc

SEQ ID NO: 19043 - DNA, 20 bp, Artificial Sequence
  Synthetic
cgctgtgtgggcgagctgat

SEQ ID NO: 19044 - DNA, 22 bp, Artificial Sequence
  Synthetic
agctagagaaggagccccatgg

SEQ ID NO: 19045 - DNA, 22 bp, Artificial Sequence
  Synthetic
tgtggctgcgttacaccgatat

SEQ ID NO: 19046 - DNA, 22 bp, Artificial Sequence
  Synthetic
ccctggccacctaccctcttag

SEQ ID NO: 19047 - DNA, 22 bp, Artificial Sequence
  Synthetic
tcaaggcctccctgaggaagga

SEQ ID NO: 19048 - DNA, 21 bp, Artificial Sequence
  Synthetic
cctcccctacggttaccccac

SEQ ID NO: 19049 - DNA, 23 bp, Artificial Sequence
  Synthetic
cgagtcagccatggaagaagaaa

SEQ ID NO: 19050 - DNA, 25 bp, Artificial Sequence
  Synthetic
aggtagtactaaagcatgcaaatct

SEQ ID NO: 19051 - DNA, 25 bp, Artificial Sequence
  Synthetic
cgtttgtactggagaaccaactaac

SEQ ID NO: 19052 - DNA, 25 bp, Artificial Sequence
  Synthetic
tgaaagaagaaaatggcaactggtg

SEQ ID NO: 19053 - DNA, 24 bp, Artificial Sequence
  Synthetic
ggtctatttgtgtggcgagttttc

SEQ ID NO: 19054 - DNA, 23 bp, Artificial Sequence
  Synthetic
accatatctttgggcatctgatg

SEQ ID NO: 19055 - DNA, 22 bp, Artificial Sequence
  Synthetic
cgaaaacggtcgtgtaggtctt

SEQ ID NO: 19056 - DNA, 25 bp, Artificial Sequence
  Synthetic
aggttggggttcttcaatttcaaat

SEQ ID NO: 19057 - DNA, 25 bp, Artificial Sequence
  Synthetic
tgcctccatgaaagtaatatccagt

SEQ ID NO: 19058 - DNA, 25 bp, Artificial Sequence
  Synthetic
gcatttccaaatccaaattcacaca

SEQ ID NO: 19059 - DNA, 25 bp, Artificial Sequence
  Synthetic
tgcaggacattttgtagctaatgat

SEQ ID NO: 19060 - DNA, 25 bp, Artificial Sequence
  Synthetic
ggtatgttggcttggctttatactc

SEQ ID NO: 19061 - DNA, 25 bp, Artificial Sequence
  Synthetic
cgcatggtagcctatacatattgtg

SEQ ID NO: 19062 - DNA, 25 bp, Artificial Sequence
  Synthetic
gtcgatgaaatctcctggataacat

SEQ ID NO: 19063 - DNA, 25 bp, Artificial Sequence
  Synthetic
acttctttccctttcttgttcacat

SEQ ID NO: 19064 - DNA, 25 bp, Artificial Sequence
  Synthetic
agcataccttggtgctattagattt

SEQ ID NO: 19065 - DNA, 20 bp, Artificial Sequence
  Synthetic
aaccggcaatggctccaaat

SEQ ID NO: 19066 - DNA, 25 bp, Artificial Sequence
  Synthetic
cccattgattccaatttcactccat

SEQ ID NO: 19067 - DNA, 21 bp, Artificial Sequence
  Synthetic
acgtgccaagacttaccgtta

SEQ ID NO: 19068 - DNA, 21 bp, Artificial Sequence
  Synthetic
acaccaaatcctcctctgtcc

SEQ ID NO: 19069 - DNA, 25 bp, Artificial Sequence
  Synthetic
cctttccagctgtttctgaccttat

SEQ ID NO: 19070 - DNA, 24 bp, Artificial Sequence
  Synthetic
accagttgtatatcacccagcaaa

SEQ ID NO: 19071 - DNA, 22 bp, Artificial Sequence
  Synthetic
ccctgtacagcatctccatcat

SEQ ID NO: 19072 - DNA, 20 bp, Artificial Sequence
  Synthetic
ctgttgttggtggattggcc

SEQ ID NO: 19073 - DNA, 24 bp, Artificial Sequence
  Synthetic
tggtggcatataatgtagccaaat

SEQ ID NO: 19074 - DNA, 24 bp, Artificial Sequence
  Synthetic
agtcaaattgtgtagcatttgcag

SEQ ID NO: 19075 - DNA, 25 bp, Artificial Sequence
  Synthetic
ggtcagtaagttcaaattgtggttt

SEQ ID NO: 19076 - DNA, 22 bp, Artificial Sequence
  Synthetic
ccccaatcgcataactccattt

SEQ ID NO: 19077 - DNA, 20 bp, Artificial Sequence
  Synthetic
accccgacctggaaagggtg

SEQ ID NO: 19078 - DNA, 21 bp, Artificial Sequence
  Synthetic
ggtgggggtagtggagtctgc

SEQ ID NO: 19079 - DNA, 21 bp, Artificial Sequence
  Synthetic
gcacttaagcacattggcgtc

SEQ ID NO: 19080 - DNA, 25 bp, Artificial Sequence
  Synthetic
cgaaccatgttagttagtatgggtt

SEQ ID NO: 19081 - DNA, 21 bp, Artificial Sequence
  Synthetic
cctggcccttcccctaatgga

SEQ ID NO: 19082 - DNA, 25 bp, Artificial Sequence
  Synthetic
accttctgttacaactggagtatct

SEQ ID NO: 19083 - DNA, 25 bp, Artificial Sequence
  Synthetic
ggcgttgtacatctaaaaattgcct

SEQ ID NO: 19084 - DNA, 22 bp, Artificial Sequence
  Synthetic
actttcaactgggccttgtact

SEQ ID NO: 19085 - DNA, 25 bp, Artificial Sequence
  Synthetic
gcaaacggtcactaattgcatgata

SEQ ID NO: 19086 - DNA, 22 bp, Artificial Sequence
  Synthetic
acctgatgttccaacccctaaa

SEQ ID NO: 19087 - DNA, 25 bp, Artificial Sequence
  Synthetic
tgctggcaaaaagaaattatgatcc

SEQ ID NO: 19088 - DNA, 23 bp, Artificial Sequence
  Synthetic
aggggccgttttttatcgaaatt

SEQ ID NO: 19089 - DNA, 20 bp, Artificial Sequence
  Synthetic
atgcacagctagcgccatat

SEQ ID NO: 19090 - DNA, 22 bp, Artificial Sequence
  Synthetic
tgttgggatcttctggcctatt

SEQ ID NO: 19091 - DNA, 25 bp, Artificial Sequence
  Synthetic
gcttaatgccactgtatcgtttcaa

SEQ ID NO: 19092 - DNA, 24 bp, Artificial Sequence
  Synthetic
acacgttaacagtactcgattcct

SEQ ID NO: 19093 - DNA, 24 bp, Artificial Sequence
  Synthetic
cgttttgatttagcctcagtcttc

SEQ ID NO: 19094 - DNA, 23 bp, Artificial Sequence
  Synthetic
gtgaaatggcgaactgtttgttc

SEQ ID NO: 19095 - DNA, 25 bp, Artificial Sequence
  Synthetic
agaacggttaggattcgtttttctt

SEQ ID NO: 19096 - DNA, 25 bp, Artificial Sequence
  Synthetic
actcggagacaagtgatataatgga

SEQ ID NO: 19097 - DNA, 25 bp, Artificial Sequence
  Synthetic
ccatctttacatgagaaggcattcc

SEQ ID NO: 19098 - DNA, 23 bp, Artificial Sequence
  Synthetic
aaccatgatccaccatgttcaat

SEQ ID NO: 19099 - DNA, 25 bp, Artificial Sequence
  Synthetic
cgcaccttgacaaatcctttagaaa

SEQ ID NO: 19100 - DNA, 24 bp, Artificial Sequence
  Synthetic
agcatcaactgatgagccagaatc

SEQ ID NO: 19101 - DNA, 21 bp, Artificial Sequence
  Synthetic
agacaaagagtatgcagcggt

SEQ ID NO: 19102 - DNA, 24 bp, Artificial Sequence
  Synthetic
tgttccatagtcccttgtcgatat

SEQ ID NO: 19103 - DNA, 24 bp, Artificial Sequence
  Synthetic
atcaccctctacaaaaagctccta

SEQ ID NO: 19104 - DNA, 23 bp, Artificial Sequence
  Synthetic
cacagtatcgcaagttgaaggtt

SEQ ID NO: 19105 - DNA, 20 bp, Artificial Sequence
  Synthetic
tttgcaggcctgtagtccct

SEQ ID NO: 19106 - DNA, 22 bp, Artificial Sequence
  Synthetic
cccccgaaaagctctatccatg

SEQ ID NO: 19107 - DNA, 23 bp, Artificial Sequence
  Synthetic
gccaaccattgcttatccgaaat

SEQ ID NO: 19108 - DNA, 22 bp, Artificial Sequence
  Synthetic
cctttgctacctcttccatgga

SEQ ID NO: 19109 - DNA, 25 bp, Artificial Sequence
  Synthetic
ttttgctatccaatttcctgagtct

SEQ ID NO: 19110 - DNA, 25 bp, Artificial Sequence
  Synthetic
aaagcgttctagttgtgtgtgataa

SEQ ID NO: 19111 - DNA, 22 bp, Artificial Sequence
  Synthetic
gttcgcatattggaagacggag

SEQ ID NO: 19112 - DNA, 23 bp, Artificial Sequence
  Synthetic
aggtttaacaaaagccaaggagg

SEQ ID NO: 19113 - DNA, 24 bp, Artificial Sequence
  Synthetic
cggagtagagaaatcagcagactg

SEQ ID NO: 19114 - DNA, 23 bp, Artificial Sequence
  Synthetic
catgcaccaatagttacggtgtt

SEQ ID NO: 19115 - DNA, 25 bp, Artificial Sequence
  Synthetic
gcttgtgtgtcttttgtctttttca

SEQ ID NO: 19116 - DNA, 23 bp, Artificial Sequence
  Synthetic
gtttcacctcctaagaagaaccg

SEQ ID NO: 19117 - DNA, 23 bp, Artificial Sequence
  Synthetic
catcctgttcagctttacgaagg

SEQ ID NO: 19118 - DNA, 25 bp, Artificial Sequence
  Synthetic
ccttcggttatcggagtagttacaa

SEQ ID NO: 19119 - DNA, 25 bp, Artificial Sequence
  Synthetic
ggaagcagataatttagaggaagct

SEQ ID NO: 19120 - DNA, 24 bp, Artificial Sequence
  Synthetic
cctaagatagcgatcaaaggttga

SEQ ID NO: 19121 - DNA, 23 bp, Artificial Sequence
  Synthetic
gcaggtttagatgttgtgggttt

SEQ ID NO: 19122 - DNA, 25 bp, Artificial Sequence
  Synthetic
aatgttctaaaggggatgtggattt

SEQ ID NO: 19123 - DNA, 21 bp, Artificial Sequence
  Synthetic
ggagtggattcctcggttgtt

SEQ ID NO: 19124 - DNA, 25 bp, Artificial Sequence
  Synthetic
catgggtgatttcttctgggaatta

SEQ ID NO: 19125 - DNA, 23 bp, Artificial Sequence
  Synthetic
agaactgctgcctctaaaagatc

SEQ ID NO: 19126 - DNA, 25 bp, Artificial Sequence
  Synthetic
ctggtaaaagaagggctgtttgata

SEQ ID NO: 19127 - DNA, 20 bp, Artificial Sequence
  Synthetic
ggctgcagaggctattgaag

SEQ ID NO: 19128 - DNA, 20 bp, Artificial Sequence
  Synthetic
agacgtcacaggtgtggtaa

SEQ ID NO: 19129 - DNA, 24 bp, Artificial Sequence
  Synthetic
gattgctcctcagaggtattggta

SEQ ID NO: 19130 - DNA, 22 bp, Artificial Sequence
  Synthetic
tggtttcttgcccaagatctca

SEQ ID NO: 19131 - DNA, 24 bp, Artificial Sequence
  Synthetic
ttcacagatcctccgtaaagaatg

SEQ ID NO: 19132 - DNA, 24 bp, Artificial Sequence
  Synthetic
aggttatggaatcgcggttatcag

SEQ ID NO: 19133 - DNA, 20 bp, Artificial Sequence
  Synthetic
tggaatttctcgaggcgctc

SEQ ID NO: 19134 - DNA, 25 bp, Artificial Sequence
  Synthetic
gaagtggatactgagacagaaagtt

SEQ ID NO: 19135 - DNA, 22 bp, Artificial Sequence
  Synthetic
ggtgcatattacgctgtccttc

SEQ ID NO: 19136 - DNA, 20 bp, Artificial Sequence
  Synthetic
tggtcaaagacgcaagctgt

SEQ ID NO: 19137 - DNA, 22 bp, Artificial Sequence
  Synthetic
atgattttgttcgttggcggag

SEQ ID NO: 19138 - DNA, 24 bp, Artificial Sequence
  Synthetic
agctagcttcatggagtatgtcta

SEQ ID NO: 19139 - DNA, 22 bp, Artificial Sequence
  Synthetic
gggaaaggggttttcaagaaga

SEQ ID NO: 19140 - DNA, 22 bp, Artificial Sequence
  Synthetic
tttcaggaatttctgtcggtgg

SEQ ID NO: 19141 - DNA, 21 bp, Artificial Sequence
  Synthetic
agaaggaagaccgcaaaggaa

SEQ ID NO: 19142 - DNA, 24 bp, Artificial Sequence
  Synthetic
catggtagtcgtaaaagaaaggga

SEQ ID NO: 19143 - DNA, 20 bp, Artificial Sequence
  Synthetic
tagaggcccaggaatggaga

SEQ ID NO: 19144 - DNA, 21 bp, Artificial Sequence
  Synthetic
gctcagtatttagcagggcag

SEQ ID NO: 19145 - DNA, 24 bp, Artificial Sequence
  Synthetic
gttagcatggcaggagaatttctt

SEQ ID NO: 19146 - DNA, 24 bp, Artificial Sequence
  Synthetic
aggctgctaatatgtcttcacgtt

SEQ ID NO: 19147 - DNA, 20 bp, Artificial Sequence
  Synthetic
tcagaaagggctgaaggcag

SEQ ID NO: 19148 - DNA, 23 bp, Artificial Sequence
  Synthetic
agttgcacagaaataacagctcc

SEQ ID NO: 19149 - DNA, 23 bp, Artificial Sequence
  Synthetic
tgctttcgagaggatacaaaggg

SEQ ID NO: 19150 - DNA, 20 bp, Artificial Sequence
  Synthetic
taaggggtccccagacatgg

SEQ ID NO: 19151 - DNA, 20 bp, Artificial Sequence
  Synthetic
tggctcagtcggttcttcag

SEQ ID NO: 19152 - DNA, 21 bp, Artificial Sequence
  Synthetic
tctacggcgagcttgtttact

SEQ ID NO: 19153 - DNA, 25 bp, Artificial Sequence
  Synthetic
cttgaatttcgaaagaggatgttgc

SEQ ID NO: 19154 - DNA, 22 bp, Artificial Sequence
  Synthetic
ggttgtcagtaagatcgtcgga

SEQ ID NO: 19155 - DNA, 22 bp, Artificial Sequence
  Synthetic
acaggattcttgctttggcaga

SEQ ID NO: 19156 - DNA, 25 bp, Artificial Sequence
  Synthetic
cattgatcgttttgctagggatttc

SEQ ID NO: 19157 - DNA, 23 bp, Artificial Sequence
  Synthetic
cacgagtgtttgagtgctaagtc

SEQ ID NO: 19158 - DNA, 20 bp, Artificial Sequence
  Synthetic
gtaggggctcaaggacgaac

SEQ ID NO: 19159 - DNA, 23 bp, Artificial Sequence
  Synthetic
gattgtagagtgggatcagcaag

SEQ ID NO: 19160 - DNA, 25 bp, Artificial Sequence
  Synthetic
cctacctggttgattatggagaaat

SEQ ID NO: 19161 - DNA, 20 bp, Artificial Sequence
  Synthetic
aaagctcctttttcgtgccc

SEQ ID NO: 19162 - DNA, 22 bp, Artificial Sequence
  Synthetic
tcccattctcttcacgaggttt

SEQ ID NO: 19163 - DNA, 23 bp, Artificial Sequence
  Synthetic
tgttcaatgttcctttggagcag

SEQ ID NO: 19164 - DNA, 20 bp, Artificial Sequence
  Synthetic
cgtgcgtgctagaacttctt

SEQ ID NO: 19165 - DNA, 25 bp, Artificial Sequence
  Synthetic
gcatttgtacgttgatatcgagcat

SEQ ID NO: 19166 - DNA, 21 bp, Artificial Sequence
  Synthetic
gcatgcagggttgctatcaac

SEQ ID NO: 19167 - DNA, 22 bp, Artificial Sequence
  Synthetic
tggtataagaacggtcgtgtgc

SEQ ID NO: 19168 - DNA, 21 bp, Artificial Sequence
  Synthetic
gatggcgctattgcaaatgca

SEQ ID NO: 19169 - DNA, 25 bp, Artificial Sequence
  Synthetic
agaagaaaactccaatcaaaacgtg

SEQ ID NO: 19170 - DNA, 20 bp, Artificial Sequence
  Synthetic
ggcagctcctcaattccgag

SEQ ID NO: 19171 - DNA, 20 bp, Artificial Sequence
  Synthetic
gggaagcagaccagagaaga

SEQ ID NO: 19172 - DNA, 21 bp, Artificial Sequence
  Synthetic
tccccagggaatttctttgca

SEQ ID NO: 19173 - DNA, 23 bp, Artificial Sequence
  Synthetic
gggaggtaaatcaagactccgat

SEQ ID NO: 19174 - DNA, 24 bp, Artificial Sequence
  Synthetic
atcgtagagtcttgtatcacctga

SEQ ID NO: 19175 - DNA, 22 bp, Artificial Sequence
  Synthetic
ttacgctaaaaacgggcctatt

SEQ ID NO: 19176 - DNA, 22 bp, Artificial Sequence
  Synthetic
tcatcaagctatcggcgatgta

SEQ ID NO: 19177 - DNA, 21 bp, Artificial Sequence
  Synthetic
gcaagagcagcttctttgtct

SEQ ID NO: 19178 - DNA, 20 bp, Artificial Sequence
  Synthetic
ctccaggagttgcggataca

SEQ ID NO: 19179 - DNA, 25 bp, Artificial Sequence
  Synthetic
caatcaatgcagaattcgtcacaaa

SEQ ID NO: 19180 - DNA, 22 bp, Artificial Sequence
  Synthetic
gctatcgaagtggattgccgaa

SEQ ID NO: 19181 - DNA, 23 bp, Artificial Sequence
  Synthetic
cttcgtcaagggttcttgtgatt

SEQ ID NO: 19182 - DNA, 21 bp, Artificial Sequence
  Synthetic
ttgcgcatggatgactgttag

SEQ ID NO: 19183 - DNA, 25 bp, Artificial Sequence
  Synthetic
cgagcagcaagaaggaattaattgt

SEQ ID NO: 19184 - DNA, 22 bp, Artificial Sequence
  Synthetic
gctgtttcatctgcggaacttt

SEQ ID NO: 19185 - DNA, 25 bp, Artificial Sequence
  Synthetic
gagaagtctttattcaagccaaagg

SEQ ID NO: 19186 - DNA, 20 bp, Artificial Sequence
  Synthetic
aacagaaagcctgagccagc

SEQ ID NO: 19187 - DNA, 24 bp, Artificial Sequence
  Synthetic
gtcctccgctgatgatattagaag

SEQ ID NO: 19188 - DNA, 20 bp, Artificial Sequence
  Synthetic
cagcaaatggtgaatgctgc

SEQ ID NO: 19189 - DNA, 21 bp, Artificial Sequence
  Synthetic
tgcgagtgttatatgagcacg

SEQ ID NO: 19190 - DNA, 25 bp, Artificial Sequence
  Synthetic
tgtccatttatttggtcttggagtc

SEQ ID NO: 19191 - DNA, 22 bp, Artificial Sequence
  Synthetic
cgcttcatcgataggcatagcc

SEQ ID NO: 19192 - DNA, 25 bp, Artificial Sequence
  Synthetic
tccaagaattagacaaaagatcgca

SEQ ID NO: 19193 - DNA, 25 bp, Artificial Sequence
  Synthetic
caaccaccttgatgaaaaacaaagt

SEQ ID NO: 19194 - DNA, 25 bp, Artificial Sequence
  Synthetic
cgatgtagtattttgctcttgcctt

SEQ ID NO: 19195 - DNA, 23 bp, Artificial Sequence
  Synthetic
agctaatcactcacagcaccatc

SEQ ID NO: 19196 - DNA, 20 bp, Artificial Sequence
  Synthetic
taccgtcgtatgtcggctga

SEQ ID NO: 19197 - DNA, 23 bp, Artificial Sequence
  Synthetic
ctttccgactgcagttgatcatt

SEQ ID NO: 19198 - DNA, 25 bp, Artificial Sequence
  Synthetic
gttgttcttttgggtacaacaatct

SEQ ID NO: 19199 - DNA, 20 bp, Artificial Sequence
  Synthetic
caaaggagttgccggacctc

SEQ ID NO: 19200 - DNA, 25 bp, Artificial Sequence
  Synthetic
cgttgaaaccgattttgttgctaac

SEQ ID NO: 19201 - DNA, 20 bp, Artificial Sequence
  Synthetic
acctgcggaagaagctgttg

SEQ ID NO: 19202 - DNA, 25 bp, Artificial Sequence
  Synthetic
ggatcctaaatagcgcttcactaaa

SEQ ID NO: 19203 - DNA, 24 bp, Artificial Sequence
  Synthetic
tcacctaacctaggattatgcgtt

SEQ ID NO: 19204 - DNA, 21 bp, Artificial Sequence
  Synthetic
gccctttcccaactccttgag

SEQ ID NO: 19205 - DNA, 20 bp, Artificial Sequence
  Synthetic
ttaggcccagaggtcgattg

SEQ ID NO: 19206 - DNA, 24 bp, Artificial Sequence
  Synthetic
gtcaccggagcatcattatttact

SEQ ID NO: 19207 - DNA, 20 bp, Artificial Sequence
  Synthetic
gtgggagcgttcgagacatg

SEQ ID NO: 19208 - DNA, 23 bp, Artificial Sequence
  Synthetic
ggacaattccgcataatttcgga

SEQ ID NO: 19209 - DNA, 22 bp, Artificial Sequence
  Synthetic
caatgcaccccttctttctgat

SEQ ID NO: 19210 - DNA, 21 bp, Artificial Sequence
  Synthetic
ccaccttcaatcacagcactt

SEQ ID NO: 19211 - DNA, 22 bp, Artificial Sequence
  Synthetic
cgggatgattgaagtacagtcc

SEQ ID NO: 19212 - DNA, 22 bp, Artificial Sequence
  Synthetic
ccagtcctcttgtctttcgact

SEQ ID NO: 19213 - DNA, 24 bp, Artificial Sequence
  Synthetic
ctgttttattcttgcgtattggct

SEQ ID NO: 19214 - DNA, 21 bp, Artificial Sequence
  Synthetic
cggctttgcgcataaaaaaca

SEQ ID NO: 19215 - DNA, 24 bp, Artificial Sequence
  Synthetic
gcgattttaaccacaagcttcaaa

SEQ ID NO: 19216 - DNA, 24 bp, Artificial Sequence
  Synthetic
caaagttctggcattacagatcct

SEQ ID NO: 19217 - DNA, 23 bp, Artificial Sequence
  Synthetic
gccctgaagtcagattttcttgc

SEQ ID NO: 19218 - DNA, 20 bp, Artificial Sequence
  Synthetic
atgcagggttcgggaaaaca

SEQ ID NO: 19219 - DNA, 22 bp, Artificial Sequence
  Synthetic
cctccgtagacaaaaacaacgg

SEQ ID NO: 19220 - DNA, 24 bp, Artificial Sequence
  Synthetic
gcactctttaaatgattgctgcct

SEQ ID NO: 19221 - DNA, 20 bp, Artificial Sequence
  Synthetic
gagtttgggcaagccgatga

SEQ ID NO: 19222 - DNA, 20 bp, Artificial Sequence
  Synthetic
ctgttcgaaacgcatggcag

SEQ ID NO: 19223 - DNA, 22 bp, Artificial Sequence
  Synthetic
tcccaaccaactgcttaaacat

SEQ ID NO: 19224 - DNA, 24 bp, Artificial Sequence
  Synthetic
agtgattgttacctctttgcaacc

SEQ ID NO: 19225 - DNA, 21 bp, Artificial Sequence
  Synthetic
ccataggatctggaaccggag

SEQ ID NO: 19226 - DNA, 25 bp, Artificial Sequence
  Synthetic
actctttttagactctgtgcgtgtc

SEQ ID NO: 19227 - DNA, 24 bp, Artificial Sequence
  Synthetic
gccccaatcgaaaatctctcctat

SEQ ID NO: 19228 - DNA, 23 bp, Artificial Sequence
  Synthetic
tgggatgcgatcttctgtgtatt

SEQ ID NO: 19229 - DNA, 23 bp, Artificial Sequence
  Synthetic
aggagaacacataccctcttctt

SEQ ID NO: 19230 - DNA, 22 bp, Artificial Sequence
  Synthetic
tgaagaaccaggatccagctaa

SEQ ID NO: 19231 - DNA, 20 bp, Artificial Sequence
  Synthetic
gctcgcaatagcagttctcc

SEQ ID NO: 19232 - DNA, 20 bp, Artificial Sequence
  Synthetic
agagtgcgcaataaccaccc

SEQ ID NO: 19233 - DNA, 25 bp, Artificial Sequence
  Synthetic
gtcacgaatattttcctgagaagga

SEQ ID NO: 19234 - DNA, 21 bp, Artificial Sequence
  Synthetic
aagaccctgctttccctgtaa

SEQ ID NO: 19235 - DNA, 23 bp, Artificial Sequence
  Synthetic
ccaaagctccgtacactttttcc

SEQ ID NO: 19236 - DNA, 20 bp, Artificial Sequence
  Synthetic
atctcccgcagccatatcac

SEQ ID NO: 19237 - DNA, 22 bp, Artificial Sequence
  Synthetic
gtgtctcgaaaagctgcttcta

SEQ ID NO: 19238 - DNA, 23 bp, Artificial Sequence
  Synthetic
cgatttccctaacgcttccttat

SEQ ID NO: 19239 - DNA, 21 bp, Artificial Sequence
  Synthetic
accacaactcttgctcgctta

SEQ ID NO: 19240 - DNA, 25 bp, Artificial Sequence
  Synthetic
catccgcaaaagttactttgttttg

SEQ ID NO: 19241 - DNA, 22 bp, Artificial Sequence
  Synthetic
acaagcttgctgttaaactcct

SEQ ID NO: 19242 - DNA, 25 bp, Artificial Sequence
  Synthetic
gcgcattgaaactatgcagatcaat

SEQ ID NO: 19243 - DNA, 20 bp, Artificial Sequence
  Synthetic
tccagcacacatgagacagg

SEQ ID NO: 19244 - DNA, 25 bp, Artificial Sequence
  Synthetic
ccagaaagtttaatctgcgctcttt

SEQ ID NO: 19245 - DNA, 23 bp, Artificial Sequence
  Synthetic
cctactcatgcggaatgttttgg

SEQ ID NO: 19246 - DNA, 22 bp, Artificial Sequence
  Synthetic
cctaatccacaacgaggtcctg

SEQ ID NO: 19247 - DNA, 24 bp, Artificial Sequence
  Synthetic
ttcctcattatctttggtcttgcc

SEQ ID NO: 19248 - DNA, 20 bp, Artificial Sequence
  Synthetic
acaaaccgatcgcgaattgg

SEQ ID NO: 19249 - DNA, 20 bp, Artificial Sequence
  Synthetic
cgcaaatgattacgcccctc

SEQ ID NO: 19250 - DNA, 22 bp, Artificial Sequence
  Synthetic
gccctgatagaaggagctatgg

SEQ ID NO: 19251 - DNA, 20 bp, Artificial Sequence
  Synthetic
ttggaggtggcatcctttcc

SEQ ID NO: 19252 - DNA, 20 bp, Artificial Sequence
  Synthetic
accggccaaactccatcaag

SEQ ID NO: 19253 - DNA, 24 bp, Artificial Sequence
  Synthetic
ccagcagctacattgctactaaag

SEQ ID NO: 19254 - DNA, 25 bp, Artificial Sequence
  Synthetic
tgaatgcgcagatcgtatatctaaa

SEQ ID NO: 19255 - DNA, 22 bp, Artificial Sequence
  Synthetic
aggttttcatatgctggttccc

SEQ ID NO: 19256 - DNA, 22 bp, Artificial Sequence
  Synthetic
acccgctgctgaattattttgt

SEQ ID NO: 19257 - DNA, 23 bp, Artificial Sequence
  Synthetic
gacaaaccatgattcacctcgat

SEQ ID NO: 19258 - DNA, 20 bp, Artificial Sequence
  Synthetic
ccgcatctgtaagctcacag

SEQ ID NO: 19259 - DNA, 20 bp, Artificial Sequence
  Synthetic
tcatcttcccgacggatgct

SEQ ID NO: 19260 - DNA, 25 bp, Artificial Sequence
  Synthetic
gccagattcgccttatttcttcttt

SEQ ID NO: 19261 - DNA, 23 bp, Artificial Sequence
  Synthetic
tctccagaagttccgatcattga

SEQ ID NO: 19262 - DNA, 21 bp, Artificial Sequence
  Synthetic
ggcccagtacctgcttcttag

SEQ ID NO: 19263 - DNA, 23 bp, Artificial Sequence
  Synthetic
ccttggaaccgattcttacactg

SEQ ID NO: 19264 - DNA, 23 bp, Artificial Sequence
  Synthetic
tgtactttaacacagccactgcc

SEQ ID NO: 19265 - DNA, 25 bp, Artificial Sequence
  Synthetic
cactagaatcaggataacaggagca

SEQ ID NO: 19266 - DNA, 25 bp, Artificial Sequence
  Synthetic
aaaccgtttcttgaactaatgcttt

SEQ ID NO: 19267 - DNA, 22 bp, Artificial Sequence
  Synthetic
tcagaccgtgtttaaagaagcg

SEQ ID NO: 19268 - DNA, 22 bp, Artificial Sequence
  Synthetic
ttgtgtaggctgaagctactgt

SEQ ID NO: 19269 - DNA, 25 bp, Artificial Sequence
  Synthetic
tccacatccttggtaaaggtagtct

SEQ ID NO: 19270 - DNA, 23 bp, Artificial Sequence
  Synthetic
aagctgttgttgcaattttttgc

SEQ ID NO: 19271 - DNA, 25 bp, Artificial Sequence
  Synthetic
cctgttatctagtcctccaacaact

SEQ ID NO: 19272 - DNA, 20 bp, Artificial Sequence
  Synthetic
cctgacagcaactccctcat

SEQ ID NO: 19273 - DNA, 24 bp, Artificial Sequence
  Synthetic
tggttacagtggtatcagttccac

SEQ ID NO: 19274 - DNA, 25 bp, Artificial Sequence
  Synthetic
agcttcagatcttgcattttcaatt

SEQ ID NO: 19275 - DNA, 25 bp, Artificial Sequence
  Synthetic
cagatcaatttttgtgtcaagaggg

SEQ ID NO: 19276 - DNA, 25 bp, Artificial Sequence
  Synthetic
gttgaatagcttagtgacacctcct

SEQ ID NO: 19277 - DNA, 21 bp, Artificial Sequence
  Synthetic
tagcaacctccatggcctccg

SEQ ID NO: 19278 - DNA, 23 bp, Artificial Sequence
  Synthetic
ggaacactttcactgcctgtatt

SEQ ID NO: 19279 - DNA, 20 bp, Artificial Sequence
  Synthetic
tcaatgggctggacaaggtc

SEQ ID NO: 19280 - DNA, 25 bp, Artificial Sequence
  Synthetic
ccatctacatcactacaatcagctt

SEQ ID NO: 19281 - DNA, 24 bp, Artificial Sequence
  Synthetic
tgcgttgaggcgaaatagtaatag

SEQ ID NO: 19282 - DNA, 20 bp, Artificial Sequence
  Synthetic
caaagctgctactacgctgc

SEQ ID NO: 19283 - DNA, 21 bp, Artificial Sequence
  Synthetic
cattgaaacggtcgctgagag

SEQ ID NO: 19284 - DNA, 24 bp, Artificial Sequence
  Synthetic
gtgcgtcttgagcaaatctgatat

SEQ ID NO: 19285 - DNA, 20 bp, Artificial Sequence
  Synthetic
tttggatccccctggaggcg

SEQ ID NO: 19286 - DNA, 18 bp, Artificial Sequence
  Synthetic
tcccccgttcccttccgt

SEQ ID NO: 19287 - DNA, 25 bp, Artificial Sequence
  Synthetic
gaccatgtagtactgaagcaatcat

SEQ ID NO: 19288 - DNA, 20 bp, Artificial Sequence
  Synthetic
ggcaccaaagcaggcctaat

SEQ ID NO: 19289 - DNA, 25 bp, Artificial Sequence
  Synthetic
ccaagtctgctaacccttatatagc

SEQ ID NO: 19290 - DNA, 25 bp, Artificial Sequence
  Synthetic
tcgtttcttccattttaagctagga

SEQ ID NO: 19291 - DNA, 22 bp, Artificial Sequence
  Synthetic
tccctgacaccttaggcactaa

SEQ ID NO: 19292 - DNA, 25 bp, Artificial Sequence
  Synthetic
agcatggtgtacatcctaaaacaaa

SEQ ID NO: 19293 - DNA, 25 bp, Artificial Sequence
  Synthetic
ccatagaaaaaacatgagttgccat

SEQ ID NO: 19294 - DNA, 25 bp, Artificial Sequence
  Synthetic
ggccgattaaataattgtgcatcag

SEQ ID NO: 19295 - DNA, 24 bp, Artificial Sequence
  Synthetic
caccactatgaaaaatctacgccc

SEQ ID NO: 19296 - DNA, 21 bp, Artificial Sequence
  Synthetic
gctagactgcacacaacactc

SEQ ID NO: 19297 - DNA, 20 bp, Artificial Sequence
  Synthetic
atttccgggattgcacaggc

SEQ ID NO: 19298 - DNA, 25 bp, Artificial Sequence
  Synthetic
tgcaatctcataacataacgtggat

SEQ ID NO: 19299 - DNA, 25 bp, Artificial Sequence
  Synthetic
aatccaacctttaaaatcacacgag

SEQ ID NO: 19300 - DNA, 25 bp, Artificial Sequence
  Synthetic
gccacacttgtgttgaacataatca

SEQ ID NO: 19301 - DNA, 25 bp, Artificial Sequence
  Synthetic
ccaatcttaaaacaagaaaggccat

SEQ ID NO: 19302 - DNA, 24 bp, Artificial Sequence
  Synthetic
ccagccttggccatataaacatta

SEQ ID NO: 19303 - DNA, 25 bp, Artificial Sequence
  Synthetic
agtttcctcaccttctacatcatct

SEQ ID NO: 19304 - DNA, 25 bp, Artificial Sequence
  Synthetic
ccaaggtatcaacaaacaactgact

SEQ ID NO: 19305 - DNA, 21 bp, Artificial Sequence
  Synthetic
gccccctgtagagacataaca

SEQ ID NO: 19306 - DNA, 25 bp, Artificial Sequence
  Synthetic
tctgtttcgtaaacaatggaacgtc

SEQ ID NO: 19307 - DNA, 25 bp, Artificial Sequence
  Synthetic
aacaggcacaaacctattagtgaaa

SEQ ID NO: 19308 - DNA, 25 bp, Artificial Sequence
  Synthetic
tctggagcattaagcaagaaacatt

SEQ ID NO: 19309 - DNA, 23 bp, Artificial Sequence
  Synthetic
tgtaccaaaatgcataacagcgt

SEQ ID NO: 19310 - DNA, 25 bp, Artificial Sequence
  Synthetic
acaccatctactttctcgaatgttt

SEQ ID NO: 19311 - DNA, 25 bp, Artificial Sequence
  Synthetic
ccatcgtcaacatcatccactttta

SEQ ID NO: 19312 - DNA, 25 bp, Artificial Sequence
  Synthetic
ccagcaacctaaaactccaatgtaa

SEQ ID NO: 19313 - DNA, 25 bp, Artificial Sequence
  Synthetic
gcggcctcaacagtaataaaagtat

SEQ ID NO: 19314 - DNA, 25 bp, Artificial Sequence
  Synthetic
actgattaaaagcatccacagacca

SEQ ID NO: 19315 - DNA, 25 bp, Artificial Sequence
  Synthetic
accatatcgtaacactttggtaggg

SEQ ID NO: 19316 - DNA, 20 bp, Artificial Sequence
  Synthetic
acgcacgatacgtacaagcc

SEQ ID NO: 19317 - DNA, 25 bp, Artificial Sequence
  Synthetic
acaacaattacagcgagtatagcac

SEQ ID NO: 19318 - DNA, 25 bp, Artificial Sequence
  Synthetic
gttggtaaagcacatcactaccatt

SEQ ID NO: 19319 - DNA, 25 bp, Artificial Sequence
  Synthetic
cgcataaaaaggaacccttaatggt

SEQ ID NO: 19320 - DNA, 25 bp, Artificial Sequence
  Synthetic
acaaggtcagatttaacttggctaa

SEQ ID NO: 19321 - DNA, 25 bp, Artificial Sequence
  Synthetic
acagtgtaaaaagcacaggagttat

SEQ ID NO: 19322 - DNA, 25 bp, Artificial Sequence
  Synthetic
ccatgtgtaagtaccaaaaagggaa

SEQ ID NO: 19323 - DNA, 20 bp, Artificial Sequence
  Synthetic
acctccaatacccaacagct

SEQ ID NO: 19324 - DNA, 25 bp, Artificial Sequence
  Synthetic
tcaacgaagctagccatattaacaa

SEQ ID NO: 19325 - DNA, 25 bp, Artificial Sequence
  Synthetic
acccgcataggtaacatagacatta

SEQ ID NO: 19326 - DNA, 25 bp, Artificial Sequence
  Synthetic
cagcttgcaatctaactgtagaaga

SEQ ID NO: 19327 - DNA, 24 bp, Artificial Sequence
  Synthetic
cgtaatttgcacaacccatcaaca

SEQ ID NO: 19328 - DNA, 25 bp, Artificial Sequence
  Synthetic
gctgaaaacggcaacaattaacttt

SEQ ID NO: 19329 - DNA, 25 bp, Artificial Sequence
  Synthetic
agtgttaaaacgcctactaagccta

SEQ ID NO: 19330 - DNA, 25 bp, Artificial Sequence
  Synthetic
cagcagcatataaaagcaagtcttt

SEQ ID NO: 19331 - DNA, 25 bp, Artificial Sequence
  Synthetic
aatggatagccagcactcttatcat

SEQ ID NO: 19332 - DNA, 25 bp, Artificial Sequence
  Synthetic
ccaccataaaatttagtggtgccta

SEQ ID NO: 19333 - DNA, 25 bp, Artificial Sequence
  Synthetic
gcttctgaagagcacgtatactaag

SEQ ID NO: 19334 - DNA, 22 bp, Artificial Sequence
  Synthetic
caagcattgtgtgttgtgaaca

SEQ ID NO: 19335 - DNA, 24 bp, Artificial Sequence
  Synthetic
aaggactcatcagtgaacttttgt

SEQ ID NO: 19336 - DNA, 25 bp, Artificial Sequence
  Synthetic
cgctctgtacattcattagctagta

SEQ ID NO: 19337 - DNA, 25 bp, Artificial Sequence
  Synthetic
acgtctcaagcacactataaacact

SEQ ID NO: 19338 - DNA, 25 bp, Artificial Sequence
  Synthetic
acacatacttacgagtggtgtcatt

SEQ ID NO: 19339 - DNA, 25 bp, Artificial Sequence
  Synthetic
gcttagctgcaaagttctgactatt

SEQ ID NO: 19340 - DNA, 25 bp, Artificial Sequence
  Synthetic
ccgctataactcttgctacaatctt

SEQ ID NO: 19341 - DNA, 25 bp, Artificial Sequence
  Synthetic
cacaacaaaatcaattcctgtggaa

SEQ ID NO: 19342 - DNA, 22 bp, Artificial Sequence
  Synthetic
tcacgccctacttttgcaaagt

SEQ ID NO: 19343 - DNA, 24 bp, Artificial Sequence
  Synthetic
tggttgggcatcatagaacttaaa

SEQ ID NO: 19344 - DNA, 25 bp, Artificial Sequence
  Synthetic
atccatatacacacaaggcgtatct

SEQ ID NO: 19345 - DNA, 25 bp, Artificial Sequence
  Synthetic
tcgatcttagccacaactttatcat

SEQ ID NO: 19346 - DNA, 23 bp, Artificial Sequence
  Synthetic
tcgtggaaatgtaaacgccatta

SEQ ID NO: 19347 - DNA, 25 bp, Artificial Sequence
  Synthetic
ccaccaataatcttctggttgaagt

SEQ ID NO: 19348 - DNA, 20 bp, Artificial Sequence
  Synthetic
ggcttccagtcagatgcagc

SEQ ID NO: 19349 - DNA, 25 bp, Artificial Sequence
  Synthetic
tctgcattccaagaaaactctgtta

SEQ ID NO: 19350 - DNA, 20 bp, Artificial Sequence
  Synthetic
tgtgtggcgctgtttgtatt

SEQ ID NO: 19351 - DNA, 23 bp, Artificial Sequence
  Synthetic
tgatgaggggttgatggtgattt

SEQ ID NO: 19352 - DNA, 24 bp, Artificial Sequence
  Synthetic
aaggcgtaaaattaacaccctcat

SEQ ID NO: 19353 - DNA, 25 bp, Artificial Sequence
  Synthetic
acagattgctttcgtaggaacagtt

SEQ ID NO: 19354 - DNA, 24 bp, Artificial Sequence
  Synthetic
tgattgtacgtggttgtactacca

SEQ ID NO: 19355 - DNA, 25 bp, Artificial Sequence
  Synthetic
gcttactattacaagtcagaggcat

SEQ ID NO: 19356 - DNA, 23 bp, Artificial Sequence
  Synthetic
tcccaatttaatggagagggcac

SEQ ID NO: 19357 - DNA, 25 bp, Artificial Sequence
  Synthetic
tcgaggcttaaaaacagaatcttct

SEQ ID NO: 19358 - DNA, 20 bp, Artificial Sequence
  Synthetic
caagacccgaacagtgctca

SEQ ID NO: 19359 - DNA, 20 bp, Artificial Sequence
  Synthetic
agagttagcgtgaaaggccg

SEQ ID NO: 19360 - DNA, 24 bp, Artificial Sequence
  Synthetic
gacaaatgcagcacaatcaatagt

SEQ ID NO: 19361 - DNA, 22 bp, Artificial Sequence
  Synthetic
actttgcacacaaatgaggtcc

SEQ ID NO: 19362 - DNA, 25 bp, Artificial Sequence
  Synthetic
gcggtaagacgaccattaataagtc

SEQ ID NO: 19363 - DNA, 25 bp, Artificial Sequence
  Synthetic
ccactcttaggagctatacctctat

SEQ ID NO: 19364 - DNA, 25 bp, Artificial Sequence
  Synthetic
ccttgagattgatgtagctctgatt

SEQ ID NO: 19365 - DNA, 25 bp, Artificial Sequence
  Synthetic
acaagcatcttctaattctgagaca

SEQ ID NO: 19366 - DNA, 25 bp, Artificial Sequence
  Synthetic
ggcctaacatacattgttcctttca

SEQ ID NO: 19367 - DNA, 25 bp, Artificial Sequence
  Synthetic
gcttaccaggagtaaaagacatcct

SEQ ID NO: 19368 - DNA, 21 bp, Artificial Sequence
  Synthetic
agcgacccagtagactccgtc

SEQ ID NO: 19369 - DNA, 21 bp, Artificial Sequence
  Synthetic
cagccatgtcaggtgttacac

SEQ ID NO: 19370 - DNA, 22 bp, Artificial Sequence
  Synthetic
aacctaattgcgccgttatagc

SEQ ID NO: 19371 - DNA, 20 bp, Artificial Sequence
  Synthetic
ggttaccaccagatgccgac

SEQ ID NO: 19372 - DNA, 22 bp, Artificial Sequence
  Synthetic
actttctgcttgggcattagca

SEQ ID NO: 19373 - DNA, 22 bp, Artificial Sequence
  Synthetic
tccattcaagtcctccgatgag

SEQ ID NO: 19374 - DNA, 22 bp, Artificial Sequence
  Synthetic
ggtcaaggaatggggcatcacc

SEQ ID NO: 19375 - DNA, 22 bp, Artificial Sequence
  Synthetic
gcttgggaatgagcattaacca

SEQ ID NO: 19376 - DNA, 22 bp, Artificial Sequence
  Synthetic
tccattcaagtcctccgatgag

SEQ ID NO: 19377 - DNA, 22 bp, Artificial Sequence
  Synthetic
tggaggctgcacgacactcgta

SEQ ID NO: 19378 - DNA, 20 bp, Artificial Sequence
  Synthetic
ccaacgatctgtccgccacc

SEQ ID NO: 19379 - DNA, 21 bp, Artificial Sequence
  Synthetic
ccccatgaggtcggcgaatcc

SEQ ID NO: 19380 - DNA, 22 bp, Artificial Sequence
  Synthetic
tggggtccagcacgtagatgta

SEQ ID NO: 19381 - DNA, 20 bp, Artificial Sequence
  Synthetic
ccaccaccatacccacagcg

SEQ ID NO: 19382 - DNA, 22 bp, Artificial Sequence
  Synthetic
ggtctgtcatcagaaggaccgg

SEQ ID NO: 19383 - DNA, 20 bp, Artificial Sequence
  Synthetic
gccgctgggacttcagcagg

SEQ ID NO: 19384 - DNA, 21 bp, Artificial Sequence
  Synthetic
cgatcctcgatatcgcagcgc

SEQ ID NO: 19385 - DNA, 21 bp, Artificial Sequence
  Synthetic
cagcgtgaccaggttctccaa

SEQ ID NO: 19386 - DNA, 22 bp, Artificial Sequence
  Synthetic
gtggccactgctaggtctttga

SEQ ID NO: 19387 - DNA, 20 bp, Artificial Sequence
  Synthetic
aggaaggtctgggtagccgt

SEQ ID NO: 19388 - DNA, 22 bp, Artificial Sequence
  Synthetic
gaagggcacataacgggacctc

SEQ ID NO: 19389 - DNA, 20 bp, Artificial Sequence
  Synthetic
gtgcggatgttggggtcgat

SEQ ID NO: 19390 - DNA, 20 bp, Artificial Sequence
  Synthetic
tctacctcgacccgttcggc

SEQ ID NO: 19391 - DNA, 20 bp, Artificial Sequence
  Synthetic
gcgcacacagtggcttggta

SEQ ID NO: 19392 - DNA, 21 bp, Artificial Sequence
  Synthetic
gtctggaacgagtgctggctt

SEQ ID NO: 19393 - DNA, 22 bp, Artificial Sequence
  Synthetic
tttggttggtcgtcaggggact

SEQ ID NO: 19394 - DNA, 19 bp, Artificial Sequence
  Synthetic
tgtcggcgcagtatggctg

SEQ ID NO: 19395 - DNA, 21 bp, Artificial Sequence
  Synthetic
ggaaatgaagggcagcccagg

SEQ ID NO: 19396 - DNA, 21 bp, Artificial Sequence
  Synthetic
cttggcacggacacttgagct

SEQ ID NO: 19397 - DNA, 21 bp, Artificial Sequence
  Synthetic
gatgaggcctatgcgtctggc

SEQ ID NO: 19398 - DNA, 21 bp, Artificial Sequence
  Synthetic
gtccttttcctccgaggggga

SEQ ID NO: 19399 - DNA, 22 bp, Artificial Sequence
  Synthetic
cgccggtccaagaatacgacat

SEQ ID NO: 19400 - DNA, 21 bp, Artificial Sequence
  Synthetic
ccctgctggacaaggagcgaa

SEQ ID NO: 19401 - DNA, 22 bp, Artificial Sequence
  Synthetic
gcctccggttcaaggttacagc

SEQ ID NO: 19402 - DNA, 22 bp, Artificial Sequence
  Synthetic
tcagccaccacgaccaaatcat

SEQ ID NO: 19403 - DNA, 23 bp, Artificial Sequence
  Synthetic
ccacggtggtttttgtgagtatc

SEQ ID NO: 19404 - DNA, 24 bp, Artificial Sequence
  Synthetic
gtcattggtccattcctattccac

SEQ ID NO: 19405 - DNA, 24 bp, Artificial Sequence
  Synthetic
ttggttatcgttagttgcgattcc

SEQ ID NO: 19406 - DNA, 21 bp, Artificial Sequence
  Synthetic
gtgggtctgctgatactgcag

SEQ ID NO: 19407 - DNA, 25 bp, Artificial Sequence
  Synthetic
cctcatgcactcttatcttcaatgt

SEQ ID NO: 19408 - DNA, 25 bp, Artificial Sequence
  Synthetic
cgcatccttctgaaaatgtcttaaa

SEQ ID NO: 19409 - DNA, 20 bp, Artificial Sequence
  Synthetic
ttcactgacctcctcgggag

SEQ ID NO: 19410 - DNA, 24 bp, Artificial Sequence
  Synthetic
cctcatttgttggaacagagttct

SEQ ID NO: 19411 - DNA, 21 bp, Artificial Sequence
  Synthetic
tcccctcagaacagcggactc

SEQ ID NO: 19412 - DNA, 21 bp, Artificial Sequence
  Synthetic
gccaacctctcaggacagcct

SEQ ID NO: 19413 - DNA, 22 bp, Artificial Sequence
  Synthetic
tccgcacactttggtgaatcca

SEQ ID NO: 19414 - DNA, 20 bp, Artificial Sequence
  Synthetic
tgagctcggacctgtccctg

SEQ ID NO: 19415 - DNA, 22 bp, Artificial Sequence
  Synthetic
cgcaaagcagaagaacacgagg

SEQ ID NO: 19416 - DNA, 21 bp, Artificial Sequence
  Synthetic
ggtccgaagatggccaggagt

SEQ ID NO: 19417 - DNA, 22 bp, Artificial Sequence
  Synthetic
cacgtgatgagcttggtctcca

SEQ ID NO: 19418 - DNA, 20 bp, Artificial Sequence
  Synthetic
gcgatggtcctcgttccggc

SEQ ID NO: 19419 - DNA, 22 bp, Artificial Sequence
  Synthetic
acaccggggatctcatggttgt

SEQ ID NO: 19420 - DNA, 21 bp, Artificial Sequence
  Synthetic
taagcacctcctgagcacccg

SEQ ID NO: 19421 - DNA, 21 bp, Artificial Sequence
  Synthetic
agtaggccacggcattgatgc

SEQ ID NO: 19422 - DNA, 21 bp, Artificial Sequence
  Synthetic
acagaggacggacgagtcgaa

SEQ ID NO: 19423 - DNA, 20 bp, Artificial Sequence
  Synthetic
gggtgcgtcagggtgacttc

SEQ ID NO: 19424 - DNA, 22 bp, Artificial Sequence
  Synthetic
ggtgataacctctgcttggcgg

SEQ ID NO: 19425 - DNA, 22 bp, Artificial Sequence
  Synthetic
ccctgcaagaatgtccacgagg

SEQ ID NO: 19426 - DNA, 19 bp, Artificial Sequence
  Synthetic
tatggcagtgacgcgggcg

SEQ ID NO: 19427 - DNA, 22 bp, Artificial Sequence
  Synthetic
ctccacatgttcctgcaggtcc

SEQ ID NO: 19428 - DNA, 21 bp, Artificial Sequence
  Synthetic
aggtaattgcgaccccaccgg

SEQ ID NO: 19429 - DNA, 22 bp, Artificial Sequence
  Synthetic
cgaatctccgagacttccgcag

SEQ ID NO: 19430 - DNA, 20 bp, Artificial Sequence
  Synthetic
gactcaacgtcggagtcggg

SEQ ID NO: 19431 - DNA, 22 bp, Artificial Sequence
  Synthetic
gctgcaagcttcctctacggat

SEQ ID NO: 19432 - DNA, 20 bp, Artificial Sequence
  Synthetic
ggccatcttctcgcacacgc

SEQ ID NO: 19433 - DNA, 19 bp, Artificial Sequence
  Synthetic
ttgtcagtacgccgctcgc

SEQ ID NO: 19434 - DNA, 20 bp, Artificial Sequence
  Synthetic
gtcttgctgtctcccacgcg

SEQ ID NO: 19435 - DNA, 20 bp, Artificial Sequence
  Synthetic
tgtctccaagctcgcaaggg

SEQ ID NO: 19436 - DNA, 20 bp, Artificial Sequence
  Synthetic
tgcacccatggacatagctt

SEQ ID NO: 19437 - DNA, 24 bp, Artificial Sequence
  Synthetic
tgtagcatctgatcagctgtgtat

SEQ ID NO: 19438 - DNA, 20 bp, Artificial Sequence
  Synthetic
tggttccaccgcatctgtat

SEQ ID NO: 19439 - DNA, 22 bp, Artificial Sequence
  Synthetic
ccccagctttatggcgtctagc

SEQ ID NO: 19440 - DNA, 23 bp, Artificial Sequence
  Synthetic
cattggcatggtagcacttgtat

SEQ ID NO: 19441 - DNA, 25 bp, Artificial Sequence
  Synthetic
gctcatacaaaagtatgatttgcca

SEQ ID NO: 19442 - DNA, 25 bp, Artificial Sequence
  Synthetic
accttcgaaaaaagcatttccaatt

SEQ ID NO: 19443 - DNA, 23 bp, Artificial Sequence
  Synthetic
accctcgtatgagacttttcctg

SEQ ID NO: 19444 - DNA, 22 bp, Artificial Sequence
  Synthetic
tctttggacccttgtcgctgct

SEQ ID NO: 19445 - DNA, 21 bp, Artificial Sequence
  Synthetic
ccaaaacaaacacagcagcag

SEQ ID NO: 19446 - DNA, 22 bp, Artificial Sequence
  Synthetic
ggtggtgccctctactttggga

SEQ ID NO: 19447 - DNA, 22 bp, Artificial Sequence
  Synthetic
gttgtggcagaggatgtaactt

SEQ ID NO: 19448 - DNA, 23 bp, Artificial Sequence
  Synthetic
ggttccatttcaatgtcctcgat

SEQ ID NO: 19449 - DNA, 22 bp, Artificial Sequence
  Synthetic
tccgtgctgagaactttagaca

SEQ ID NO: 19450 - DNA, 25 bp, Artificial Sequence
  Synthetic
aggcacgtcagacttatttaattgt

SEQ ID NO: 19451 - DNA, 23 bp, Artificial Sequence
  Synthetic
gccataatatccggggtcaatgt

SEQ ID NO: 19452 - DNA, 25 bp, Artificial Sequence
  Synthetic
cacaggaacagcaattacacaaatt

SEQ ID NO: 19453 - DNA, 20 bp, Artificial Sequence
  Synthetic
atcgtacacctgtcccacag

SEQ ID NO: 19454 - DNA, 25 bp, Artificial Sequence
  Synthetic
atccatatcgtctatcaggttggac

SEQ ID NO: 19455 - DNA, 25 bp, Artificial Sequence
  Synthetic
gtcccagtttgtataaggaaacaca

SEQ ID NO: 19456 - DNA, 20 bp, Artificial Sequence
  Synthetic
ggggtagaggggtatgcggt

SEQ ID NO: 19457 - DNA, 22 bp, Artificial Sequence
  Synthetic
gttcccactgcttcaggagctg

SEQ ID NO: 19458 - DNA, 25 bp, Artificial Sequence
  Synthetic
ctaacgatgaataacctgtagtccc

SEQ ID NO: 19459 - DNA, 24 bp, Artificial Sequence
  Synthetic
tcctggatcagcagtgataactat

SEQ ID NO: 19460 - DNA, 23 bp, Artificial Sequence
  Synthetic
tcatcatcaaaggcgggattttc

SEQ ID NO: 19461 - DNA, 25 bp, Artificial Sequence
  Synthetic
catcaggtactataggtctgtcagt

SEQ ID NO: 19462 - DNA, 25 bp, Artificial Sequence
  Synthetic
cccttctacatattcatccgtactc

SEQ ID NO: 19463 - DNA, 25 bp, Artificial Sequence
  Synthetic
gggatgacctgatgtactaatacct

SEQ ID NO: 19464 - DNA, 25 bp, Artificial Sequence
  Synthetic
acatgtcaccatcctgaatagtagt

SEQ ID NO: 19465 - DNA, 25 bp, Artificial Sequence
  Synthetic
cctgctgagcaccataaataaagtt

SEQ ID NO: 19466 - DNA, 20 bp, Artificial Sequence
  Synthetic
tggcgccaaaaacttaccga

SEQ ID NO: 19467 - DNA, 21 bp, Artificial Sequence
  Synthetic
ggtctaccgttgtctgtctca

SEQ ID NO: 19468 - DNA, 24 bp, Artificial Sequence
  Synthetic
ccttttcaaacccttcagtatccc

SEQ ID NO: 19469 - DNA, 25 bp, Artificial Sequence
  Synthetic
catcgttcccttcaatttttctctt

SEQ ID NO: 19470 - DNA, 21 bp, Artificial Sequence
  Synthetic
agctctagtgggtttgatgca

SEQ ID NO: 19471 - DNA, 24 bp, Artificial Sequence
  Synthetic
gctttttttcaatatccccctgca

SEQ ID NO: 19472 - DNA, 25 bp, Artificial Sequence
  Synthetic
cattgatcaaaaaggtcattgctcc

SEQ ID NO: 19473 - DNA, 23 bp, Artificial Sequence
  Synthetic
acgttatcattagctgtgcttgt

SEQ ID NO: 19474 - DNA, 25 bp, Artificial Sequence
  Synthetic
ggtcagttttcataacctcttggtc

SEQ ID NO: 19475 - DNA, 25 bp, Artificial Sequence
  Synthetic
ggttttgaaatctccaagatcaggg

SEQ ID NO: 19476 - DNA, 25 bp, Artificial Sequence
  Synthetic
gcatggataacagggaatcttgttt

SEQ ID NO: 19477 - DNA, 25 bp, Artificial Sequence
  Synthetic
agcgacaatctatcttcacatgatt

SEQ ID NO: 19478 - DNA, 24 bp, Artificial Sequence
  Synthetic
cacaatggacaagaaaaaccatcc

SEQ ID NO: 19479 - DNA, 25 bp, Artificial Sequence
  Synthetic
caccaagaattattaacgccaagaa

SEQ ID NO: 19480 - DNA, 24 bp, Artificial Sequence
  Synthetic
caccacacttacccatgtacatat

SEQ ID NO: 19481 - DNA, 25 bp, Artificial Sequence
  Synthetic
cagctttaacaagtctagcaacatt

SEQ ID NO: 19482 - DNA, 25 bp, Artificial Sequence
  Synthetic
gcaacataagacaagctacattcac

SEQ ID NO: 19483 - DNA, 21 bp, Artificial Sequence
  Synthetic
acctgcacaattacagccaat

SEQ ID NO: 19484 - DNA, 25 bp, Artificial Sequence
  Synthetic
tgagcacaaatatcatgtccaacta

SEQ ID NO: 19485 - DNA, 25 bp, Artificial Sequence
  Synthetic
accagctttattacaaccatagaca

SEQ ID NO: 19486 - DNA, 25 bp, Artificial Sequence
  Synthetic
caacatctgaatcaatggaacaaca

SEQ ID NO: 19487 - DNA, 25 bp, Artificial Sequence
  Synthetic
agcattcttcataacaccatctgaa

SEQ ID NO: 19488 - DNA, 20 bp, Artificial Sequence
  Synthetic
acaagttgacagccctgcat

SEQ ID NO: 19489 - DNA, 25 bp, Artificial Sequence
  Synthetic
gcaataacattaacagtctggacgt

SEQ ID NO: 19490 - DNA, 24 bp, Artificial Sequence
  Synthetic
gttagtaagtgctaggtctgccat

SEQ ID NO: 19491 - DNA, 25 bp, Artificial Sequence
  Synthetic
gcaccaccataagaatcttggttaa

SEQ ID NO: 19492 - DNA, 25 bp, Artificial Sequence
  Synthetic
accattgaccatacaaatcttggtt

SEQ ID NO: 19493 - DNA, 25 bp, Artificial Sequence
  Synthetic
ggtgtgtgtcaacatctaagttcat

SEQ ID NO: 19494 - DNA, 25 bp, Artificial Sequence
  Synthetic
gtgggcagaacattacgtttagtat

SEQ ID NO: 19495 - DNA, 25 bp, Artificial Sequence
  Synthetic
cgggccaaaactaaactactaacaa

SEQ ID NO: 19496 - DNA, 25 bp, Artificial Sequence
  Synthetic
gctctatcaaaagaacactgtcagt

SEQ ID NO: 19497 - DNA, 25 bp, Artificial Sequence
  Synthetic
tgccagaacataatcatcaacttct

SEQ ID NO: 19498 - DNA, 25 bp, Artificial Sequence
  Synthetic
acaccaatggaacactataaacact

SEQ ID NO: 19499 - DNA, 23 bp, Artificial Sequence
  Synthetic
tgttccaatgttttcgcgagtag

SEQ ID NO: 19500 - DNA, 25 bp, Artificial Sequence
  Synthetic
aaacctttaggattgcctatgtcat

SEQ ID NO: 19501 - DNA, 25 bp, Artificial Sequence
  Synthetic
gcgcttcttaaaggaacgtaatcaa

SEQ ID NO: 19502 - DNA, 25 bp, Artificial Sequence
  Synthetic
caactttatccacaatcacaccatt

SEQ ID NO: 19503 - DNA, 25 bp, Artificial Sequence
  Synthetic
cgcatattaacaggaacagctaatg

SEQ ID NO: 19504 - DNA, 21 bp, Artificial Sequence
  Synthetic
accaataggacaggaagcaga

SEQ ID NO: 19505 - DNA, 25 bp, Artificial Sequence
  Synthetic
cgaagaggaagaagaaggtgagtta

SEQ ID NO: 19506 - DNA, 25 bp, Artificial Sequence
  Synthetic
gcagttaaacgaccattaataagcc

SEQ ID NO: 19507 - DNA, 25 bp, Artificial Sequence
  Synthetic
tgaccacgaataacagtagcagtta

SEQ ID NO: 19508 - DNA, 21 bp, Artificial Sequence
  Synthetic
ggtcagcccaagaagttttct

SEQ ID NO: 19509 - DNA, 23 bp, Artificial Sequence
  Synthetic
gcttttggcgaggttttgttaaa

SEQ ID NO: 19510 - DNA, 25 bp, Artificial Sequence
  Synthetic
agagtcaaactgttctggtaattgt

SEQ ID NO: 19511 - DNA, 25 bp, Artificial Sequence
  Synthetic
cctctccatactctttcattgcttt

SEQ ID NO: 19512 - DNA, 21 bp, Artificial Sequence
  Synthetic
cctctgttggccatttcttgt

SEQ ID NO: 19513 - DNA, 23 bp, Artificial Sequence
  Synthetic
gtttgattggtcttggtgttgtc

SEQ ID NO: 19514 - DNA, 25 bp, Artificial Sequence
  Synthetic
tcatgtttttagtccttgggatctt

SEQ ID NO: 19515 - DNA, 22 bp, Artificial Sequence
  Synthetic
ctcctcatgcttgcaatgtact

SEQ ID NO: 19516 - DNA, 20 bp, Artificial Sequence
  Synthetic
atgtggctcaagtctcgggt

SEQ ID NO: 19517 - DNA, 25 bp, Artificial Sequence
  Synthetic
ggccatgcttctgatttattctcaa

SEQ ID NO: 19518 - DNA, 23 bp, Artificial Sequence
  Synthetic
caccaaccattcttccaacagat

SEQ ID NO: 19519 - DNA, 22 bp, Artificial Sequence
  Synthetic
tctccagaagttccggtcatta

SEQ ID NO: 19520 - DNA, 20 bp, Artificial Sequence
  Synthetic
tgagtgcagaccgtgccaga

SEQ ID NO: 19521 - DNA, 25 bp, Artificial Sequence
  Synthetic
gggatcactcttgttcctctaatga

SEQ ID NO: 19522 - DNA, 20 bp, Artificial Sequence
  Synthetic
attccaaaggacgacgcgac

SEQ ID NO: 19523 - DNA, 20 bp, Artificial Sequence
  Synthetic
tggatggggtgtccggggag

SEQ ID NO: 19524 - DNA, 23 bp, Artificial Sequence
  Synthetic
gcctcttcttgaagtcgtctaag

SEQ ID NO: 19525 - DNA, 25 bp, Artificial Sequence
  Synthetic
ctcgctttcttcttataggcatgtt

SEQ ID NO: 19526 - DNA, 20 bp, Artificial Sequence
  Synthetic
ttaccaaaaggacgcccagt

SEQ ID NO: 19527 - DNA, 23 bp, Artificial Sequence
  Synthetic
catccaatacagcagaaacaccc

SEQ ID NO: 19528 - DNA, 25 bp, Artificial Sequence
  Synthetic
gtctccaatctttgtgtaggagtac

SEQ ID NO: 19529 - DNA, 22 bp, Artificial Sequence
  Synthetic
ctggagcatactcagttaaccg

SEQ ID NO: 19530 - DNA, 23 bp, Artificial Sequence
  Synthetic
gctggtgcacatcctacaataaa

SEQ ID NO: 19531 - DNA, 25 bp, Artificial Sequence
  Synthetic
tgtcatccgtaaataatctggccat

SEQ ID NO: 19532 - DNA, 25 bp, Artificial Sequence
  Synthetic
aaaagctaattgccattgatcaagt

SEQ ID NO: 19533 - DNA, 25 bp, Artificial Sequence
  Synthetic
ccatttagcaggcctatctgataca

SEQ ID NO: 19534 - DNA, 24 bp, Artificial Sequence
  Synthetic
caccaactgttactgaagaactga

SEQ ID NO: 19535 - DNA, 25 bp, Artificial Sequence
  Synthetic
gaaacaaacttccaaatgtgtgcat

SEQ ID NO: 19536 - DNA, 25 bp, Artificial Sequence
  Synthetic
accggttctctttgtaatcatacaa

SEQ ID NO: 19537 - DNA, 21 bp, Artificial Sequence
  Synthetic
tcggactgacgaaaggaatcc

SEQ ID NO: 19538 - DNA, 21 bp, Artificial Sequence
  Synthetic
gccatattttcaccgagtgcc

SEQ ID NO: 19539 - DNA, 25 bp, Artificial Sequence
  Synthetic
gctgtaaaatagttcctcctcatgc

SEQ ID NO: 19540 - DNA, 20 bp, Artificial Sequence
  Synthetic
tcccatttgtgtggctccag

SEQ ID NO: 19541 - DNA, 25 bp, Artificial Sequence
  Synthetic
gccatgtttccgatttgttttcaaa

SEQ ID NO: 19542 - DNA, 25 bp, Artificial Sequence
  Synthetic
acatgtctctcatactgagtagctt

SEQ ID NO: 19543 - DNA, 21 bp, Artificial Sequence
  Synthetic
cctaggcatcagcatgtacca

SEQ ID NO: 19544 - DNA, 25 bp, Artificial Sequence
  Synthetic
cgctcgaattgagttatcattccat

SEQ ID NO: 19545 - DNA, 25 bp, Artificial Sequence
  Synthetic
cactcttctctttctctggaaatgt

SEQ ID NO: 19546 - DNA, 24 bp, Artificial Sequence
  Synthetic
gtccagattgctcaagtttttcac

SEQ ID NO: 19547 - DNA, 20 bp, Artificial Sequence
  Synthetic
gcccatcccaccagtatgtg

SEQ ID NO: 19548 - DNA, 25 bp, Artificial Sequence
  Synthetic
tcatgtcagccgattcattaattcc

SEQ ID NO: 19549 - DNA, 25 bp, Artificial Sequence
  Synthetic
tggtacatttgttcatcctcaagaa

SEQ ID NO: 19550 - DNA, 23 bp, Artificial Sequence
  Synthetic
attgccaaattcagccatcctat

SEQ ID NO: 19551 - DNA, 25 bp, Artificial Sequence
  Synthetic
acacaatgtcatgtacagtaggttt

SEQ ID NO: 19552 - DNA, 22 bp, Artificial Sequence
  Synthetic
cctgtgcatgtaatagcgcttg

SEQ ID NO: 19553 - DNA, 22 bp, Artificial Sequence
  Synthetic
ctcaggtgtgtctcctgttact

SEQ ID NO: 19554 - DNA, 22 bp, Artificial Sequence
  Synthetic
acactggattgccattgctatc

SEQ ID NO: 19555 - DNA, 25 bp, Artificial Sequence
  Synthetic
aatttgaaatgttggtaccacgtgg

SEQ ID NO: 19556 - DNA, 21 bp, Artificial Sequence
  Synthetic
agcaattgcagtagcggatac

SEQ ID NO: 19557 - DNA, 25 bp, Artificial Sequence
  Synthetic
ccacagattcaattacaacaggtgg

SEQ ID NO: 19558 - DNA, 25 bp, Artificial Sequence
  Synthetic
tcccagatgtaggggtagtaataaa

SEQ ID NO: 19559 - DNA, 25 bp, Artificial Sequence
  Synthetic
ggcctatgtaaacgaacaatatcca

SEQ ID NO: 19560 - DNA, 24 bp, Artificial Sequence
  Synthetic
tcaggtaatgtaacccgaaacact

SEQ ID NO: 19561 - DNA, 25 bp, Artificial Sequence
  Synthetic
gggtttgtttataatccactgacac

SEQ ID NO: 19562 - DNA, 20 bp, Artificial Sequence
  Synthetic
ctgtccccatatgcatctgc

SEQ ID NO: 19563 - DNA, 24 bp, Artificial Sequence
  Synthetic
tcttgtgactaaaacatccgagct

SEQ ID NO: 19564 - DNA, 24 bp, Artificial Sequence
  Synthetic
tgcattgttgtttggtcctgatat

SEQ ID NO: 19565 - DNA, 20 bp, Artificial Sequence
  Synthetic
ccaattgtccctgcatgtgc

SEQ ID NO: 19566 - DNA, 23 bp, Artificial Sequence
  Synthetic
gctgtgcttattgtcctccctag

SEQ ID NO: 19567 - DNA, 21 bp, Artificial Sequence
  Synthetic
gccatatggtccacagtggtc

SEQ ID NO: 19568 - DNA, 25 bp, Artificial Sequence
  Synthetic
agggtaatgaactgtacttgttgtt

SEQ ID NO: 19569 - DNA, 20 bp, Artificial Sequence
  Synthetic
gtacgccaccatcaagggag

SEQ ID NO: 19570 - DNA, 21 bp, Artificial Sequence
  Synthetic
tgctaatgggtctgctgacac

SEQ ID NO: 19571 - DNA, 24 bp, Artificial Sequence
  Synthetic
tcccaaccattgtgaattcttcat

SEQ ID NO: 19572 - DNA, 25 bp, Artificial Sequence
  Synthetic
cccacatcattgatgacgaataagt

SEQ ID NO: 19573 - DNA, 22 bp, Artificial Sequence
  Synthetic
gcagcaaaggggagaagtttta

SEQ ID NO: 19574 - DNA, 25 bp, Artificial Sequence
  Synthetic
gtcttctttgcccaaaatgagaaat

SEQ ID NO: 19575 - DNA, 25 bp, Artificial Sequence
  Synthetic
tcttggtttggattccatcagaatt

SEQ ID NO: 19576 - DNA, 25 bp, Artificial Sequence
  Synthetic
agcgtgtcaactctaaataattgct

SEQ ID NO: 19577 - DNA, 25 bp, Artificial Sequence
  Synthetic
gacactctttgtggagaaatgtgaa

SEQ ID NO: 19578 - DNA, 22 bp, Artificial Sequence
  Synthetic
acttcttcaggagatgggacac

SEQ ID NO: 19579 - DNA, 24 bp, Artificial Sequence
  Synthetic
cagcttcacctaatggtctgtaac

SEQ ID NO: 19580 - DNA, 25 bp, Artificial Sequence
  Synthetic
ggtagcagtagagtcagtgattgta

SEQ ID NO: 19581 - DNA, 20 bp, Artificial Sequence
  Synthetic
gctacttctgccaagtcccg

SEQ ID NO: 19582 - DNA, 25 bp, Artificial Sequence
  Synthetic
cgttgtagctagtatgtcgtcaact

SEQ ID NO: 19583 - DNA, 25 bp, Artificial Sequence
  Synthetic
ctttgttaaagtaaggatggcctgt

SEQ ID NO: 19584 - DNA, 25 bp, Artificial Sequence
  Synthetic
ctgctttatcttcttgtaaacggct

SEQ ID NO: 19585 - DNA, 21 bp, Artificial Sequence
  Synthetic
ggtgttaagaatgcaccccca

SEQ ID NO: 19586 - DNA, 22 bp, Artificial Sequence
  Synthetic
gtttctaatgccctcctccgtg

SEQ ID NO: 19587 - DNA, 25 bp, Artificial Sequence
  Synthetic
gcattttcatccccattagtcaatg

SEQ ID NO: 19588 - DNA, 25 bp, Artificial Sequence
  Synthetic
cgcggaggatctgttattatttgat

SEQ ID NO: 19589 - DNA, 25 bp, Artificial Sequence
  Synthetic
aaagcacttctcatatacacatcca

SEQ ID NO: 19590 - DNA, 21 bp, Artificial Sequence
  Synthetic
gtttgtatgccctgccttctg

SEQ ID NO: 19591 - DNA, 25 bp, Artificial Sequence
  Synthetic
atgtctataaagtacaggccatccg

SEQ ID NO: 19592 - DNA, 25 bp, Artificial Sequence
  Synthetic
gctgtgctaatacactgaaataagc

SEQ ID NO: 19593 - DNA, 21 bp, Artificial Sequence
  Synthetic
tgggaacatagccagaggccc

SEQ ID NO: 19594 - DNA, 24 bp, Artificial Sequence
  Synthetic
aggatgcccatatacagagatgta

SEQ ID NO: 19595 - DNA, 23 bp, Artificial Sequence
  Synthetic
aggccacttcttgtacgaatagt

SEQ ID NO: 19596 - DNA, 23 bp, Artificial Sequence
  Synthetic
agccacaaagacatctgcaaaat

SEQ ID NO: 19597 - DNA, 24 bp, Artificial Sequence
  Synthetic
caaacaaggagtacagcctactac

SEQ ID NO: 19598 - DNA, 22 bp, Artificial Sequence
  Synthetic
gccagcgtctgacttaacattt

SEQ ID NO: 19599 - DNA, 25 bp, Artificial Sequence
  Synthetic
ccagtttgagataaaaatctgcgac

SEQ ID NO: 19600 - DNA, 24 bp, Artificial Sequence
  Synthetic
aatattacaaaacatcgctgccgg

SEQ ID NO: 19601 - DNA, 21 bp, Artificial Sequence
  Synthetic
cctcctcctcaggatcaccat

SEQ ID NO: 19602 - DNA, 25 bp, Artificial Sequence
  Synthetic
tgcccctcatttaattcaagagaat

SEQ ID NO: 19603 - DNA, 21 bp, Artificial Sequence
  Synthetic
tgtgacagcttccaaccttgg

SEQ ID NO: 19604 - DNA, 25 bp, Artificial Sequence
  Synthetic
taacccagttttcacaacatgatct

SEQ ID NO: 19605 - DNA, 25 bp, Artificial Sequence
  Synthetic
atgtcccagtttgtgaatatgtttg

SEQ ID NO: 19606 - DNA, 20 bp, Artificial Sequence
  Synthetic
tgctcgttggatcttcggcg

SEQ ID NO: 19607 - DNA, 25 bp, Artificial Sequence
  Synthetic
gctggtgtaatgtctaatgtagcaa

SEQ ID NO: 19608 - DNA, 20 bp, Artificial Sequence
  Synthetic
aggtgtactggtacgtggag

SEQ ID NO: 19609 - DNA, 24 bp, Artificial Sequence
  Synthetic
ctgcagatgtttctgaaaaccgag

SEQ ID NO: 19610 - DNA, 25 bp, Artificial Sequence
  Synthetic
tgttgcaaatatcagctgtgcatta

SEQ ID NO: 19611 - DNA, 21 bp, Artificial Sequence
  Synthetic
cgtttgcgtcgcctaagaaga

SEQ ID NO: 19612 - DNA, 25 bp, Artificial Sequence
  Synthetic
gctctgtctatcattgcaaatttgt

SEQ ID NO: 19613 - DNA, 25 bp, Artificial Sequence
  Synthetic
gcatttgttttggatccattgaaac

SEQ ID NO: 19614 - DNA, 24 bp, Artificial Sequence
  Synthetic
agtgtgccaagtgattgtttctta

SEQ ID NO: 19615 - DNA, 20 bp, Artificial Sequence
  Synthetic
ctgcccatctccacgcgaag

SEQ ID NO: 19616 - DNA, 22 bp, Artificial Sequence
  Synthetic
gccgtgctgcacctcaaacatt

SEQ ID NO: 19617 - DNA, 22 bp, Artificial Sequence
  Synthetic
ctgaactaagactgggtgtcca

SEQ ID NO: 19618 - DNA, 21 bp, Artificial Sequence
  Synthetic
cgaggcaggcttacatgggag

SEQ ID NO: 19619 - DNA, 19 bp, Artificial Sequence
  Synthetic
cgggctggtccagggactt

SEQ ID NO: 19620 - DNA, 19 bp, Artificial Sequence
  Synthetic
cgcagggcaagacgaggga

SEQ ID NO: 19621 - DNA, 21 bp, Artificial Sequence
  Synthetic
cacgctggagggacattgtcc

SEQ ID NO: 19622 - DNA, 25 bp, Artificial Sequence
  Synthetic
cccagctcattttggaaaataaaca

SEQ ID NO: 19623 - DNA, 19 bp, Artificial Sequence
  Synthetic
tgcgccgcctaatgcatcc

SEQ ID NO: 19624 - DNA, 19 bp, Artificial Sequence
  Synthetic
tccttcttccacggcgccg

SEQ ID NO: 19625 - DNA, 19 bp, Artificial Sequence
  Synthetic
tcgagctcgctggcgtgag

SEQ ID NO: 19626 - DNA, 20 bp, Artificial Sequence
  Synthetic
acttgtaggcccggggaccc

SEQ ID NO: 19627 - DNA, 22 bp, Artificial Sequence
  Synthetic
cccacaccatcagcagcgtctt

SEQ ID NO: 19628 - DNA, 20 bp, Artificial Sequence
  Synthetic
cccccatcactctcccaggc

SEQ ID NO: 19629 - DNA, 19 bp, Artificial Sequence
  Synthetic
actcggcctggtctcggct

SEQ ID NO: 19630 - DNA, 20 bp, Artificial Sequence
  Synthetic
ccctgcgacccccttaaccc

SEQ ID NO: 19631 - DNA, 19 bp, Artificial Sequence
  Synthetic
agcactcggcggggctttc

SEQ ID NO: 19632 - DNA, 21 bp, Artificial Sequence
  Synthetic
aattaggaaggcgctgggggc

SEQ ID NO: 19633 - DNA, 19 bp, Artificial Sequence
  Synthetic
cgtccctggccacgaagga

SEQ ID NO: 19634 - DNA, 20 bp, Artificial Sequence
  Synthetic
gcaaccaggcccactgcaag

SEQ ID NO: 19635 - DNA, 19 bp, Artificial Sequence
  Synthetic
agacccaccacctcgtgcc

SEQ ID NO: 19636 - DNA, 20 bp, Artificial Sequence
  Synthetic
cggaagaggaggaggaggcg

SEQ ID NO: 19637 - DNA, 20 bp, Artificial Sequence
  Synthetic
ggggtggtgaggatgcagct

SEQ ID NO: 19638 - DNA, 22 bp, Artificial Sequence
  Synthetic
cgttgcaggcctccttcaaaag

SEQ ID NO: 19639 - DNA, 19 bp, Artificial Sequence
  Synthetic
tcatccccctgcgtgtcgg

SEQ ID NO: 19640 - DNA, 19 bp, Artificial Sequence
  Synthetic
tgtcaaccggccccgcaac

SEQ ID NO: 19641 - DNA, 19 bp, Artificial Sequence
  Synthetic
tgcggcagaggctaagcgc

SEQ ID NO: 19642 - DNA, 20 bp, Artificial Sequence
  Synthetic
ctctccagtgcggtgttgct

SEQ ID NO: 19643 - DNA, 19 bp, Artificial Sequence
  Synthetic
tctcgtcccacctggcgga

SEQ ID NO: 19644 - DNA, 19 bp, Artificial Sequence
  Synthetic
tcacgtccctggccgagct

SEQ ID NO: 19645 - DNA, 21 bp, Artificial Sequence
  Synthetic
accgcgttaacatctcggcca

SEQ ID NO: 19646 - DNA, 22 bp, Artificial Sequence
  Synthetic
ggcttccgcctgttttgtttgt

SEQ ID NO: 19647 - DNA, 21 bp, Artificial Sequence
  Synthetic
cggagttgatgaaaggggccg

SEQ ID NO: 19648 - DNA, 20 bp, Artificial Sequence
  Synthetic
aactccacgctgcgtccatc

SEQ ID NO: 19649 - DNA, 19 bp, Artificial Sequence
  Synthetic
agacgaggcacaggcaccc

SEQ ID NO: 19650 - DNA, 22 bp, Artificial Sequence
  Synthetic
accggtgacaccaagtccatct

SEQ ID NO: 19651 - DNA, 22 bp, Artificial Sequence
  Synthetic
tgttcaggttttgctcaaggaa

SEQ ID NO: 19652 - DNA, 22 bp, Artificial Sequence
  Synthetic
cgccaaccaacacctccctcta

SEQ ID NO: 19653 - DNA, 22 bp, Artificial Sequence
  Synthetic
ggagtccggacagtttcatgct

SEQ ID NO: 19654 - DNA, 22 bp, Artificial Sequence
  Synthetic
ggcagacatccgcgattacctt

SEQ ID NO: 19655 - DNA, 19 bp, Artificial Sequence
  Synthetic
tggccctgatcctgagccg

SEQ ID NO: 19656 - DNA, 20 bp, Artificial Sequence
  Synthetic
tcacgtcctctaccccggcg

SEQ ID NO: 19657 - DNA, 22 bp, Artificial Sequence
  Synthetic
cgtgtgctgcctggaacacaat

SEQ ID NO: 19658 - DNA, 19 bp, Artificial Sequence
  Synthetic
actcgggagtctctggccc

SEQ ID NO: 19659 - DNA, 22 bp, Artificial Sequence
  Synthetic
accgtctatagcgcctttgggt

SEQ ID NO: 19660 - DNA, 22 bp, Artificial Sequence
  Synthetic
cgcgcaggcttactttttgcat

SEQ ID NO: 19661 - DNA, 22 bp, Artificial Sequence
  Synthetic
cagggggatctttacgtgggtg

SEQ ID NO: 19662 - DNA, 22 bp, Artificial Sequence
  Synthetic
acctgggcttatgcagacgagt

SEQ ID NO: 19663 - DNA, 20 bp, Artificial Sequence
  Synthetic
ggtggtctgccaaagctgct

SEQ ID NO: 19664 - DNA, 21 bp, Artificial Sequence
  Synthetic
ctgcgaagagcgtcactgtgt

SEQ ID NO: 19665 - DNA, 20 bp, Artificial Sequence
  Synthetic
tgttcaacgcggtcaaggcc

SEQ ID NO: 19666 - DNA, 20 bp, Artificial Sequence
  Synthetic
tggttggggctgcttcccag

SEQ ID NO: 19667 - DNA, 19 bp, Artificial Sequence
  Synthetic
aactgcgagggggcctggt

SEQ ID NO: 19668 - DNA, 21 bp, Artificial Sequence
  Synthetic
acaggcaactacatggggccg

SEQ ID NO: 19669 - DNA, 19 bp, Artificial Sequence
  Synthetic
caacccggcagagctccag

SEQ ID NO: 19670 - DNA, 22 bp, Artificial Sequence
  Synthetic
agcgtcccctgttaggtccttg

SEQ ID NO: 19671 - DNA, 21 bp, Artificial Sequence
  Synthetic
ggtcctaactggtcaggggca

SEQ ID NO: 19672 - DNA, 19 bp, Artificial Sequence
  Synthetic
agcagctggccccgaatcc

SEQ ID NO: 19673 - DNA, 19 bp, Artificial Sequence
  Synthetic
cctacacgaccgccaaggg

SEQ ID NO: 19674 - DNA, 20 bp, Artificial Sequence
  Synthetic
gttgagaccgtcctggcagg

SEQ ID NO: 19675 - DNA, 19 bp, Artificial Sequence
  Synthetic
ttccccaggcagtcccagc

SEQ ID NO: 19676 - DNA, 22 bp, Artificial Sequence
  Synthetic
cccggactcgttttacggactc

SEQ ID NO: 19677 - DNA, 22 bp, Artificial Sequence
  Synthetic
caacgggactgtcatggaaatt

SEQ ID NO: 19678 - DNA, 20 bp, Artificial Sequence
  Synthetic
gcggctgaacgtgactaccc

SEQ ID NO: 19679 - DNA, 19 bp, Artificial Sequence
  Synthetic
atcctgccagcgggagagg

SEQ ID NO: 19680 - DNA, 19 bp, Artificial Sequence
  Synthetic
tggaggggggccaaagagg

SEQ ID NO: 19681 - DNA, 22 bp, Artificial Sequence
  Synthetic
caccagtttctttccgcggtgg

SEQ ID NO: 19682 - DNA, 22 bp, Artificial Sequence
  Synthetic
ggcacaggagcgattaagtcct

SEQ ID NO: 19683 - DNA, 22 bp, Artificial Sequence
  Synthetic
tggccaacatgacttccgtcaa

SEQ ID NO: 19684 - DNA, 22 bp, Artificial Sequence
  Synthetic
cagatccacgaccgcatccagt

SEQ ID NO: 19685 - DNA, 19 bp, Artificial Sequence
  Synthetic
aggcgaccccatgatgcgg

SEQ ID NO: 19686 - DNA, 21 bp, Artificial Sequence
  Synthetic
ggggtgacgaggatggaaagg

SEQ ID NO: 19687 - DNA, 19 bp, Artificial Sequence
  Synthetic
tggctcgctgctgtgacgc

SEQ ID NO: 19688 - DNA, 20 bp, Artificial Sequence
  Synthetic
cgagggtgccgcctttgaga

SEQ ID NO: 19689 - DNA, 19 bp, Artificial Sequence
  Synthetic
tggcggtgccggtgaatcc

SEQ ID NO: 19690 - DNA, 19 bp, Artificial Sequence
  Synthetic
tggaggcctcgcacgagac

SEQ ID NO: 19691 - DNA, 20 bp, Artificial Sequence
  Synthetic
acaggaggtagcggtggggc

SEQ ID NO: 19692 - DNA, 21 bp, Artificial Sequence
  Synthetic
cgctcctttgtggcatcaccg

SEQ ID NO: 19693 - DNA, 18 bp, Artificial Sequence
  Synthetic
tggtttgcgaggctgggc

SEQ ID NO: 19694 - DNA, 21 bp, Artificial Sequence
  Synthetic
gctcatcatcagcgtcctgcg

SEQ ID NO: 19695 - DNA, 22 bp, Artificial Sequence
  Synthetic
gctacctcatgttcagggccat

SEQ ID NO: 19696 - DNA, 20 bp, Artificial Sequence
  Synthetic
cccttggtcacgcttggctg

SEQ ID NO: 19697 - DNA, 25 bp, Artificial Sequence
  Synthetic
tgccaatatctaagttgccttagtt

SEQ ID NO: 19698 - DNA, 22 bp, Artificial Sequence
  Synthetic
gctggcaaattgctcgtgacaa

SEQ ID NO: 19699 - DNA, 25 bp, Artificial Sequence
  Synthetic
ttgccgtaccaattccatatatgat

SEQ ID NO: 19700 - DNA, 25 bp, Artificial Sequence
  Synthetic
tggtggttctattagcatgtttgtt

SEQ ID NO: 19701 - DNA, 25 bp, Artificial Sequence
  Synthetic
gcatctttcacatatttggcttgac

SEQ ID NO: 19702 - DNA, 22 bp, Artificial Sequence
  Synthetic
aaccgtaataggctcatgcaaa

SEQ ID NO: 19703 - DNA, 21 bp, Artificial Sequence
  Synthetic
gcacgtgttgccagtgtttaa

SEQ ID NO: 19704 - DNA, 20 bp, Artificial Sequence
  Synthetic
attgcttaggcactgcgtcc

SEQ ID NO: 19705 - DNA, 22 bp, Artificial Sequence
  Synthetic
ggtgtcctgggtgctagacaca

SEQ ID NO: 19706 - DNA, 22 bp, Artificial Sequence
  Synthetic
ggcctctatgcccttaggaata

SEQ ID NO: 19707 - DNA, 20 bp, Artificial Sequence
  Synthetic
gctggttgtgtggtagtcac

SEQ ID NO: 19708 - DNA, 20 bp, Artificial Sequence
  Synthetic
tagtggcatgggaggtggaa

SEQ ID NO: 19709 - DNA, 21 bp, Artificial Sequence
  Synthetic
acttgcctggcgaataggaaa

SEQ ID NO: 19710 - DNA, 25 bp, Artificial Sequence
  Synthetic
gcattttcagtgtcattaagcttgt

SEQ ID NO: 19711 - DNA, 21 bp, Artificial Sequence
  Synthetic
ccaagggaacgtcagacctat

SEQ ID NO: 19712 - DNA, 24 bp, Artificial Sequence
  Synthetic
aaggcttgttaaacaactgtgact

SEQ ID NO: 19713 - DNA, 23 bp, Artificial Sequence
  Synthetic
aagactagcagtaggaggtggta

SEQ ID NO: 19714 - DNA, 20 bp, Artificial Sequence
  Synthetic
caccggacagggggggttat

SEQ ID NO: 19715 - DNA, 25 bp, Artificial Sequence
  Synthetic
tgcacggtgagtaacacatgtatta

SEQ ID NO: 19716 - DNA, 25 bp, Artificial Sequence
  Synthetic
ccaaactttgattcaccttttcctg

SEQ ID NO: 19717 - DNA, 25 bp, Artificial Sequence
  Synthetic
cgacaaactctcttctgctaaaaga

SEQ ID NO: 19718 - DNA, 25 bp, Artificial Sequence
  Synthetic
gctttattgcaatcctctgctaact

SEQ ID NO: 19719 - DNA, 25 bp, Artificial Sequence
  Synthetic
ggtaaccgtttctctactttttcct

SEQ ID NO: 19720 - DNA, 25 bp, Artificial Sequence
  Synthetic
gtcatttggcgcatttcatatcttt

SEQ ID NO: 19721 - DNA, 25 bp, Artificial Sequence
  Synthetic
tgaaacagtttttgggttgggtatt

SEQ ID NO: 19722 - DNA, 22 bp, Artificial Sequence
  Synthetic
cttcgtcctccagctcgaagac

SEQ ID NO: 19723 - DNA, 20 bp, Artificial Sequence
  Synthetic
gacgaaatccagtggcaccc

SEQ ID NO: 19724 - DNA, 25 bp, Artificial Sequence
  Synthetic
gctatgtcttcttggccatgtagaa

SEQ ID NO: 19725 - DNA, 24 bp, Artificial Sequence
  Synthetic
tggtaatgcaccttttgtgtcaaa

SEQ ID NO: 19726 - DNA, 25 bp, Artificial Sequence
  Synthetic
tctacgtttcaataaagcaggatgt

SEQ ID NO: 19727 - DNA, 24 bp, Artificial Sequence
  Synthetic
acctgcttaggatccatactaaga

SEQ ID NO: 19728 - DNA, 25 bp, Artificial Sequence
  Synthetic
cgctctgttaaatctacgttccaaa

SEQ ID NO: 19729 - DNA, 21 bp, Artificial Sequence
  Synthetic
aacacgcaggttatgttcagg

SEQ ID NO: 19730 - DNA, 21 bp, Artificial Sequence
  Synthetic
cctcgccaaagcccagctatt

SEQ ID NO: 19731 - DNA, 22 bp, Artificial Sequence
  Synthetic
tctccaccaccagccttactgt

SEQ ID NO: 19732 - DNA, 22 bp, Artificial Sequence
  Synthetic
tccatccccgggatgcctacta

SEQ ID NO: 19733 - DNA, 22 bp, Artificial Sequence
  Synthetic
gtcgcgtcaatatccacttgcg

SEQ ID NO: 19734 - DNA, 20 bp, Artificial Sequence
  Synthetic
tgacaccctctgcaactgtg

SEQ ID NO: 19735 - DNA, 25 bp, Artificial Sequence
  Synthetic
ccaattatttcactagcattgccca

SEQ ID NO: 19736 - DNA, 20 bp, Artificial Sequence
  Synthetic
tgctctgcccgtttgtaatg

SEQ ID NO: 19737 - DNA, 22 bp, Artificial Sequence
  Synthetic
gtggagttggcataggaaatca

SEQ ID NO: 19738 - DNA, 25 bp, Artificial Sequence
  Synthetic
acaggaaatgcattaggaaaggtaa

SEQ ID NO: 19739 - DNA, 24 bp, Artificial Sequence
  Synthetic
tcatcatcaccgctttgtacatat

SEQ ID NO: 19740 - DNA, 21 bp, Artificial Sequence
  Synthetic
ccgagtcgctgacgcttatgc

SEQ ID NO: 19741 - DNA, 20 bp, Artificial Sequence
  Synthetic
gccaggtggaggttactttg

SEQ ID NO: 19742 - DNA, 25 bp, Artificial Sequence
  Synthetic
ggaaggatagacagccaaaagaaga

SEQ ID NO: 19743 - DNA, 21 bp, Artificial Sequence
  Synthetic
cccccccatctctatcacgta

SEQ ID NO: 19744 - DNA, 21 bp, Artificial Sequence
  Synthetic
gggatgtatccagtgcgccca

SEQ ID NO: 19745 - DNA, 25 bp, Artificial Sequence
  Synthetic
caggattgtcataggtaacaagtgt

SEQ ID NO: 19746 - DNA, 25 bp, Artificial Sequence
  Synthetic
cactatagggttttttcctgattgc

SEQ ID NO: 19747 - DNA, 23 bp, Artificial Sequence
  Synthetic
ccatagtaagattgtcccgggtg

SEQ ID NO: 19748 - DNA, 20 bp, Artificial Sequence
  Synthetic
caccatatggctcagctgcc

SEQ ID NO: 19749 - DNA, 21 bp, Artificial Sequence
  Synthetic
gcagataccattgttagggcc

SEQ ID NO: 19750 - DNA, 21 bp, Artificial Sequence
  Synthetic
aaggaacccgtgtacagacac

SEQ ID NO: 19751 - DNA, 20 bp, Artificial Sequence
  Synthetic
ccgaaatcggtccgggggta

SEQ ID NO: 19752 - DNA, 21 bp, Artificial Sequence
  Synthetic
cgccatggctagacgctttct

SEQ ID NO: 19753 - DNA, 22 bp, Artificial Sequence
  Synthetic
cggcaacaagtatactccgcca

SEQ ID NO: 19754 - DNA, 22 bp, Artificial Sequence
  Synthetic
gtaccccatgaggtcggcaaag

SEQ ID NO: 19755 - DNA, 22 bp, Artificial Sequence
  Synthetic
ccggtatccagcactgagatgc

SEQ ID NO: 19756 - DNA, 22 bp, Artificial Sequence
  Synthetic
cccaatgagccccgctaatgat

SEQ ID NO: 19757 - DNA, 22 bp, Artificial Sequence
  Synthetic
tcgggacatcctgacgagttga

SEQ ID NO: 19758 - DNA, 21 bp, Artificial Sequence
  Synthetic
gctctagtacggcagggtggt

SEQ ID NO: 19759 - DNA, 22 bp, Artificial Sequence
  Synthetic
cgtggtggagtgcaacaaagga

SEQ ID NO: 19760 - DNA, 22 bp, Artificial Sequence
  Synthetic
cccttgatgtaccaagcagcca

SEQ ID NO: 19761 - DNA, 20 bp, Artificial Sequence
  Synthetic
gtaagcaggcccaagcaccg

SEQ ID NO: 19762 - DNA, 21 bp, Artificial Sequence
  Synthetic
gaggacctcccgaccaagtcg

SEQ ID NO: 19763 - DNA, 20 bp, Artificial Sequence
  Synthetic
cgtgagccggccagagtctt

SEQ ID NO: 19764 - DNA, 22 bp, Artificial Sequence
  Synthetic
caggtggtgtgctgttgtcact

SEQ ID NO: 19765 - DNA, 22 bp, Artificial Sequence
  Synthetic
ccacggcatggcattcatcaca

SEQ ID NO: 19766 - DNA, 22 bp, Artificial Sequence
  Synthetic
cgaccactacgtctccctgagt

SEQ ID NO: 19767 - DNA, 22 bp, Artificial Sequence
  Synthetic
ggtctccgatggtgtgagctca

SEQ ID NO: 19768 - DNA, 22 bp, Artificial Sequence
  Synthetic
cacgggatgtgtgagggtgacc

SEQ ID NO: 19769 - DNA, 22 bp, Artificial Sequence
  Synthetic
gcctgcacagtgggttgtatgt

SEQ ID NO: 19770 - DNA, 21 bp, Artificial Sequence
  Synthetic
cgacgagagcccccgaaatgc

SEQ ID NO: 19771 - DNA, 22 bp, Artificial Sequence
  Synthetic
cactggccctccgtgtaacaat

SEQ ID NO: 19772 - DNA, 22 bp, Artificial Sequence
  Synthetic
gcagtctccgccgtgatatgag

SEQ ID NO: 19773 - DNA, 21 bp, Artificial Sequence
  Synthetic
ccggtaaagctggtgggaacc

SEQ ID NO: 19774 - DNA, 19 bp, Artificial Sequence
  Synthetic
tccaagctccccctcgagg

SEQ ID NO: 19775 - DNA, 22 bp, Artificial Sequence
  Synthetic
ggaggccgctagcttaatgtcc

SEQ ID NO: 19776 - DNA, 22 bp, Artificial Sequence
  Synthetic
ccatcaccgcctgaggaagttt

SEQ ID NO: 19777 - DNA, 22 bp, Artificial Sequence
  Synthetic
ccctgcagctttacaagccgct

SEQ ID NO: 19778 - DNA, 22 bp, Artificial Sequence
  Synthetic
gtggtagggtctctggtcaggt

SEQ ID NO: 19779 - DNA, 22 bp, Artificial Sequence
  Synthetic
ccccaagttttctgagggctga

SEQ ID NO: 19780 - DNA, 20 bp, Artificial Sequence
  Synthetic
caggctgcataggcaaggcg

SEQ ID NO: 19781 - DNA, 20 bp, Artificial Sequence
  Synthetic
gcacgggcaactaccaccaa

SEQ ID NO: 19782 - DNA, 20 bp, Artificial Sequence
  Synthetic
acgtcaaaggctgccaccag

SEQ ID NO: 19783 - DNA, 21 bp, Artificial Sequence
  Synthetic
gctccgaccgaacaacaacca

SEQ ID NO: 19784 - DNA, 20 bp, Artificial Sequence
  Synthetic
aacagtaccgacaagcccgg

SEQ ID NO: 19785 - DNA, 20 bp, Artificial Sequence
  Synthetic
ccttggctttgcagcttggc

SEQ ID NO: 19786 - DNA, 20 bp, Artificial Sequence
  Synthetic
gaccgcgccccagtatttcg

SEQ ID NO: 19787 - DNA, 22 bp, Artificial Sequence
  Synthetic
cgcgcagtttgccgttgacttg

SEQ ID NO: 19788 - DNA, 20 bp, Artificial Sequence
  Synthetic
ggcgttaaaaagccgagcgg

SEQ ID NO: 19789 - DNA, 21 bp, Artificial Sequence
  Synthetic
cccgaatggcagatacaggca

SEQ ID NO: 19790 - DNA, 18 bp, Artificial Sequence
  Synthetic
attggcacgccgatccgc

SEQ ID NO: 19791 - DNA, 19 bp, Artificial Sequence
  Synthetic
tcgggctgcccatgaccct

SEQ ID NO: 19792 - DNA, 20 bp, Artificial Sequence
  Synthetic
cgcgcggcagttgatacagg

SEQ ID NO: 19793 - DNA, 20 bp, Artificial Sequence
  Synthetic
gccgccaaaggcaaaggacg

SEQ ID NO: 19794 - DNA, 22 bp, Artificial Sequence
  Synthetic
gcccatttgtaaccggttctgc

SEQ ID NO: 19795 - DNA, 19 bp, Artificial Sequence
  Synthetic
aacggcggcctgattaccg

SEQ ID NO: 19796 - DNA, 19 bp, Artificial Sequence
  Synthetic
agttgccgcacctgccctc

SEQ ID NO: 19797 - DNA, 19 bp, Artificial Sequence
  Synthetic
gaatcggggcgaactcggg

SEQ ID NO: 19798 - DNA, 20 bp, Artificial Sequence
  Synthetic
cgccagttgaccgaatcggg

SEQ ID NO: 19799 - DNA, 22 bp, Artificial Sequence
  Synthetic
cgcaaagactaccgcagcaacg

SEQ ID NO: 19800 - DNA, 19 bp, Artificial Sequence
  Synthetic
acttcctcgaccgcctcgc

SEQ ID NO: 19801 - DNA, 22 bp, Artificial Sequence
  Synthetic
gcatcctgctcgacaacatcct

SEQ ID NO: 19802 - DNA, 21 bp, Artificial Sequence
  Synthetic
cgaggctttgggcttgggtcc

SEQ ID NO: 19803 - DNA, 21 bp, Artificial Sequence
  Synthetic
gtccgcaacaaaatcgccctg

SEQ ID NO: 19804 - DNA, 20 bp, Artificial Sequence
  Synthetic
agacattgccctccccgagg

SEQ ID NO: 19805 - DNA, 19 bp, Artificial Sequence
  Synthetic
acggcggcgaagagaaagg

SEQ ID NO: 19806 - DNA, 18 bp, Artificial Sequence
  Synthetic
ttggcgttggctcaggcg

SEQ ID NO: 19807 - DNA, 22 bp, Artificial Sequence
  Synthetic
ggcaatttgttcggcaatggcg

SEQ ID NO: 19808 - DNA, 18 bp, Artificial Sequence
  Synthetic
tcgaagatgcctgcgccg

SEQ ID NO: 19809 - DNA, 20 bp, Artificial Sequence
  Synthetic
ccgacaccatccgcctgatg

SEQ ID NO: 19810 - DNA, 19 bp, Artificial Sequence
  Synthetic
cgtgtgcatcggtcctgcc

SEQ ID NO: 19811 - DNA, 19 bp, Artificial Sequence
  Synthetic
tgccgctcgccaaagtcgg

SEQ ID NO: 19812 - DNA, 20 bp, Artificial Sequence
  Synthetic
ttggaaatcgtccgcaccga

SEQ ID NO: 19813 - DNA, 20 bp, Artificial Sequence
  Synthetic
cgcctgaccatgctgttgcg

SEQ ID NO: 19814 - DNA, 22 bp, Artificial Sequence
  Synthetic
cgccgatgccgtacaagaaacc

SEQ ID NO: 19815 - DNA, 18 bp, Artificial Sequence
  Synthetic
agtcgcgcccgtcgacaa

SEQ ID NO: 19816 - DNA, 20 bp, Artificial Sequence
  Synthetic
gcgcaggtggggcaggtaat

SEQ ID NO: 19817 - DNA, 21 bp, Artificial Sequence
  Synthetic
gctgttttcgggcatctggct

SEQ ID NO: 19818 - DNA, 20 bp, Artificial Sequence
  Synthetic
ccgatcataccggtcgcgcc

SEQ ID NO: 19819 - DNA, 20 bp, Artificial Sequence
  Synthetic
ccgatttccaaaaccgcgcc

SEQ ID NO: 19820 - DNA, 19 bp, Artificial Sequence
  Synthetic
acggcagggcggggttttg

SEQ ID NO: 19821 - DNA, 22 bp, Artificial Sequence
  Synthetic
cctgtcgctcggtaaatcagcg

SEQ ID NO: 19822 - DNA, 18 bp, Artificial Sequence
  Synthetic
actgcttcgcgcgcttcg

SEQ ID NO: 19823 - DNA, 20 bp, Artificial Sequence
  Synthetic
gcgttcttccctgcgtttgc

SEQ ID NO: 19824 - DNA, 21 bp, Artificial Sequence
  Synthetic
tcgagcgggcaggctgaaatc

SEQ ID NO: 19825 - DNA, 19 bp, Artificial Sequence
  Synthetic
accgcgccatgctcttggc

SEQ ID NO: 19826 - DNA, 21 bp, Artificial Sequence
  Synthetic
cgcctcgcccgtatccatgta

SEQ ID NO: 19827 - DNA, 19 bp, Artificial Sequence
  Synthetic
ccgcagcattcccacgact

SEQ ID NO: 19828 - DNA, 20 bp, Artificial Sequence
  Synthetic
gcgcgtgaacacggcattcc

SEQ ID NO: 19829 - DNA, 20 bp, Artificial Sequence
  Synthetic
actctccgccctgctcgacc

SEQ ID NO: 19830 - DNA, 22 bp, Artificial Sequence
  Synthetic
ggctgaaaaacgccgtcgaact

SEQ ID NO: 19831 - DNA, 22 bp, Artificial Sequence
  Synthetic
ccatgctgaacaccgccctttc

SEQ ID NO: 19832 - DNA, 22 bp, Artificial Sequence
  Synthetic
tcaagacagaaagctcctgccg

SEQ ID NO: 19833 - DNA, 22 bp, Artificial Sequence
  Synthetic
cgctgttttacacgctgaccga

SEQ ID NO: 19834 - DNA, 19 bp, Artificial Sequence
  Synthetic
tgctgcactttccggcgaa

SEQ ID NO: 19835 - DNA, 22 bp, Artificial Sequence
  Synthetic
gggactgacggtgtcggtattg

SEQ ID NO: 19836 - DNA, 19 bp, Artificial Sequence
  Synthetic
aagctgcgcggtgctgacc

SEQ ID NO: 19837 - DNA, 19 bp, Artificial Sequence
  Synthetic
cctccgcaacgacctgacc

SEQ ID NO: 19838 - DNA, 19 bp, Artificial Sequence
  Synthetic
cgtgcgcgcctaccagatt

SEQ ID NO: 19839 - DNA, 19 bp, Artificial Sequence
  Synthetic
tatggctgcacggcgaggc

SEQ ID NO: 19840 - DNA, 22 bp, Artificial Sequence
  Synthetic
ggcacatttttcacgcttgcca

SEQ ID NO: 19841 - DNA, 22 bp, Artificial Sequence
  Synthetic
cccagcagtttcgccgttttgt

SEQ ID NO: 19842 - DNA, 20 bp, Artificial Sequence
  Synthetic
tgaccgccatgtacaagccg

SEQ ID NO: 19843 - DNA, 21 bp, Artificial Sequence
  Synthetic
cgccgtttatgacgcccccaa

SEQ ID NO: 19844 - DNA, 22 bp, Artificial Sequence
  Synthetic
gctcgcgcgaaaacttaaacca

SEQ ID NO: 19845 - DNA, 19 bp, Artificial Sequence
  Synthetic
gcctgccggggctacatca

SEQ ID NO: 19846 - DNA, 18 bp, Artificial Sequence
  Synthetic
gtcccgaaagccgctgca

SEQ ID NO: 19847 - DNA, 18 bp, Artificial Sequence
  Synthetic
ggcaaggtgcggcagctt

SEQ ID NO: 19848 - DNA, 21 bp, Artificial Sequence
  Synthetic
cgatgacggtggtggcaacca

SEQ ID NO: 19849 - DNA, 20 bp, Artificial Sequence
  Synthetic
atcagcatcggggcggtttc

SEQ ID NO: 19850 - DNA, 19 bp, Artificial Sequence
  Synthetic
acacccgaaacccgcagcg

SEQ ID NO: 19851 - DNA, 19 bp, Artificial Sequence
  Synthetic
gcttcaggacggcatcgcc

SEQ ID NO: 19852 - DNA, 19 bp, Artificial Sequence
  Synthetic
ccgccgacttccgcatacg

SEQ ID NO: 19853 - DNA, 20 bp, Artificial Sequence
  Synthetic
actttccaagtctgcgcggc

SEQ ID NO: 19854 - DNA, 20 bp, Artificial Sequence
  Synthetic
ggagtagcgttgggattcgc

SEQ ID NO: 19855 - DNA, 21 bp, Artificial Sequence
  Synthetic
ttccgacccattctccggaga

SEQ ID NO: 19856 - DNA, 22 bp, Artificial Sequence
  Synthetic
ggtaggatgcggatttcctgct

SEQ ID NO: 19857 - DNA, 22 bp, Artificial Sequence
  Synthetic
gcccacgtcgtttatccgcaag

SEQ ID NO: 19858 - DNA, 22 bp, Artificial Sequence
  Synthetic
gcaactgccttatgccctgacg

SEQ ID NO: 19859 - DNA, 20 bp, Artificial Sequence
  Synthetic
tatgctgccgattgccgccg

SEQ ID NO: 19860 - DNA, 19 bp, Artificial Sequence
  Synthetic
cgcccatgtgcgtgctgat

SEQ ID NO: 19861 - DNA, 21 bp, Artificial Sequence
  Synthetic
cgtcgacggtctgacacacct

SEQ ID NO: 19862 - DNA, 21 bp, Artificial Sequence
  Synthetic
gcaaatatacagccgcagcgg

SEQ ID NO: 19863 - DNA, 20 bp, Artificial Sequence
  Synthetic
tttccggttgccgatacgcc

SEQ ID NO: 19864 - DNA, 20 bp, Artificial Sequence
  Synthetic
gccattaccgccgaaccgag

SEQ ID NO: 19865 - DNA, 22 bp, Artificial Sequence
  Synthetic
cggtattcctgagcgtcggatc

SEQ ID NO: 19866 - DNA, 22 bp, Artificial Sequence
  Synthetic
cggcttggacgttgcacacttt

SEQ ID NO: 19867 - DNA, 20 bp, Artificial Sequence
  Synthetic
cgcgccctatcatgatgccg

SEQ ID NO: 19868 - DNA, 20 bp, Artificial Sequence
  Synthetic
acggcggcatggcaatactg

SEQ ID NO: 19869 - DNA, 19 bp, Artificial Sequence
  Synthetic
gaccaaagccgccaatgcc

SEQ ID NO: 19870 - DNA, 19 bp, Artificial Sequence
  Synthetic
agcttgcccggaaagccgc

SEQ ID NO: 19871 - DNA, 20 bp, Artificial Sequence
  Synthetic
gcaggtcgtcgtcgctgtac

SEQ ID NO: 19872 - DNA, 19 bp, Artificial Sequence
  Synthetic
tctgcctgtccctcagcgc

SEQ ID NO: 19873 - DNA, 21 bp, Artificial Sequence
  Synthetic
ccgtctgcaagcctacgaagg

SEQ ID NO: 19874 - DNA, 19 bp, Artificial Sequence
  Synthetic
ccacgttggcacgcctgtg

SEQ ID NO: 19875 - DNA, 21 bp, Artificial Sequence
  Synthetic
cgcaagaacacaggcaaagcc

SEQ ID NO: 19876 - DNA, 20 bp, Artificial Sequence
  Synthetic
cgctttgccgaactcgacgg

SEQ ID NO: 19877 - DNA, 19 bp, Artificial Sequence
  Synthetic
aaatcccgccctgctcgcc

SEQ ID NO: 19878 - DNA, 19 bp, Artificial Sequence
  Synthetic
ctgaccggcacacccacac

SEQ ID NO: 19879 - DNA, 19 bp, Artificial Sequence
  Synthetic
acgccgacgacctcgaagc

SEQ ID NO: 19880 - DNA, 22 bp, Artificial Sequence
  Synthetic
ccaaaaccgccgtcctacacca

SEQ ID NO: 19881 - DNA, 21 bp, Artificial Sequence
  Synthetic
caacagcatctccgtcagcga

SEQ ID NO: 19882 - DNA, 22 bp, Artificial Sequence
  Synthetic
gccatattcgcaggattgctgc

SEQ ID NO: 19883 - DNA, 20 bp, Artificial Sequence
  Synthetic
ccgacaaagaccgcgcatgg

SEQ ID NO: 19884 - DNA, 22 bp, Artificial Sequence
  Synthetic
catcacccgcatcggtttcaac

SEQ ID NO: 19885 - DNA, 22 bp, Artificial Sequence
  Synthetic
gctatcggagttggaccaggtg

SEQ ID NO: 19886 - DNA, 19 bp, Artificial Sequence
  Synthetic
agccggcggattctgcctg

SEQ ID NO: 19887 - DNA, 19 bp, Artificial Sequence
  Synthetic
accccggggcaaaccatcc

SEQ ID NO: 19888 - DNA, 25 bp, Artificial Sequence
  Synthetic
tccattatttaccaattcctcaccg

SEQ ID NO: 19889 - DNA, 19 bp, Artificial Sequence
  Synthetic
cgccgctacgccatcaacg

SEQ ID NO: 19890 - DNA, 22 bp, Artificial Sequence
  Synthetic
ggcgaacccaaacccagcatca

SEQ ID NO: 19891 - DNA, 22 bp, Artificial Sequence
  Synthetic
gggaaatctttacccacggcgg

SEQ ID NO: 19892 - DNA, 18 bp, Artificial Sequence
  Synthetic
acgcaccgttgccgacat

SEQ ID NO: 19893 - DNA, 19 bp, Artificial Sequence
  Synthetic
agcaggcgcgattaccggc

SEQ ID NO: 19894 - DNA, 19 bp, Artificial Sequence
  Synthetic
acgtcttgagcgtcggccc

SEQ ID NO: 19895 - DNA, 22 bp, Artificial Sequence
  Synthetic
ggcacaccaattgaaccttgcc

SEQ ID NO: 19896 - DNA, 20 bp, Artificial Sequence
  Synthetic
cgacgcactggtcggcaaag

SEQ ID NO: 19897 - DNA, 21 bp, Artificial Sequence
  Synthetic
cgacagcgcatcgaagccatg

SEQ ID NO: 19898 - DNA, 18 bp, Artificial Sequence
  Synthetic
gctgaccgccgacgatgt

SEQ ID NO: 19899 - DNA, 20 bp, Artificial Sequence
  Synthetic
accggttgccgccaaaaaag

SEQ ID NO: 19900 - DNA, 20 bp, Artificial Sequence
  Synthetic
gcgtcaaccgtatgccgctc

SEQ ID NO: 19901 - DNA, 20 bp, Artificial Sequence
  Synthetic
aaacccaagcccgaagacgc

SEQ ID NO: 19902 - DNA, 20 bp, Artificial Sequence
  Synthetic
tcctacggctggttcggctt

SEQ ID NO: 19903 - DNA, 19 bp, Artificial Sequence
  Synthetic
tcggcggcattgcccgatc

SEQ ID NO: 19904 - DNA, 21 bp, Artificial Sequence
  Synthetic
gatgggttggttcgatgccgt

SEQ ID NO: 19905 - DNA, 19 bp, Artificial Sequence
  Synthetic
ccttgccgtcgccatcctg

SEQ ID NO: 19906 - DNA, 20 bp, Artificial Sequence
  Synthetic
tacgccttttcggacggcgc

SEQ ID NO: 19907 - DNA, 19 bp, Artificial Sequence
  Synthetic
aactgaccgcgctgctcgg

SEQ ID NO: 19908 - DNA, 19 bp, Artificial Sequence
  Synthetic
accgactacgtcgtcgccg

SEQ ID NO: 19909 - DNA, 22 bp, Artificial Sequence
  Synthetic
gctccataagccctaccgcctg

SEQ ID NO: 19910 - DNA, 20 bp, Artificial Sequence
  Synthetic
cgatgccgaatacgaccgcc

SEQ ID NO: 19911 - DNA, 20 bp, Artificial Sequence
  Synthetic
ccgcactggacgcattctgc

SEQ ID NO: 19912 - DNA, 19 bp, Artificial Sequence
  Synthetic
ccatcccgggcatccgcta

SEQ ID NO: 19913 - DNA, 22 bp, Artificial Sequence
  Synthetic
gcgttttccatcggcatcgaac

SEQ ID NO: 19914 - DNA, 22 bp, Artificial Sequence
  Synthetic
ggaaaagctgtttgccaaccgg

SEQ ID NO: 19915 - DNA, 22 bp, Artificial Sequence
  Synthetic
ccgatacgcgccatcgatactt

SEQ ID NO: 19916 - DNA, 21 bp, Artificial Sequence
  Synthetic
acggaacagcagcaaaggctc

SEQ ID NO: 19917 - DNA, 20 bp, Artificial Sequence
  Synthetic
cgcgcagttgttccagcgat

SEQ ID NO: 19918 - DNA, 21 bp, Artificial Sequence
  Synthetic
caccctgtacgaaacgctcgc

SEQ ID NO: 19919 - DNA, 22 bp, Artificial Sequence
  Synthetic
gccataatgcgcgctttgtagg

SEQ ID NO: 19920 - DNA, 20 bp, Artificial Sequence
  Synthetic
tcggcggtggtgatgtgttc

SEQ ID NO: 19921 - DNA, 20 bp, Artificial Sequence
  Synthetic
ggtaacggcggcgaccaatg

SEQ ID NO: 19922 - DNA, 20 bp, Artificial Sequence
  Synthetic
tccatcgcgtccgccagtat

SEQ ID NO: 19923 - DNA, 19 bp, Artificial Sequence
  Synthetic
acatccacaccgccgagcg

SEQ ID NO: 19924 - DNA, 20 bp, Artificial Sequence
  Synthetic
gcggaagcggtcgacgtatc

SEQ ID NO: 19925 - DNA, 22 bp, Artificial Sequence
  Synthetic
ggcaggaaatcctatgccgtcg

SEQ ID NO: 19926 - DNA, 18 bp, Artificial Sequence
  Synthetic
ggaaaccgccgccgacaa

SEQ ID NO: 19927 - DNA, 19 bp, Artificial Sequence
  Synthetic
tgccggtggacattggtgc

SEQ ID NO: 19928 - DNA, 22 bp, Artificial Sequence
  Synthetic
cctgcatcagatagctgcggaa

SEQ ID NO: 19929 - DNA, 21 bp, Artificial Sequence
  Synthetic
cggcgcgaatttaaacggaaa

SEQ ID NO: 19930 - DNA, 20 bp, Artificial Sequence
  Synthetic
atccccaatatgccgtcagc

SEQ ID NO: 19931 - DNA, 18 bp, Artificial Sequence
  Synthetic
tgggacagctcggggcaa

SEQ ID NO: 19932 - DNA, 19 bp, Artificial Sequence
  Synthetic
ctcgcgcatatggacgcgg

SEQ ID NO: 19933 - DNA, 22 bp, Artificial Sequence
  Synthetic
gcgtctgcctcgatacccaaac

SEQ ID NO: 19934 - DNA, 19 bp, Artificial Sequence
  Synthetic
tccacgcgcctgccagttg

SEQ ID NO: 19935 - DNA, 20 bp, Artificial Sequence
  Synthetic
tgaggctgttgcggacggat

SEQ ID NO: 19936 - DNA, 20 bp, Artificial Sequence
  Synthetic
ttcaagacgacggcggactg

SEQ ID NO: 19937 - DNA, 18 bp, Artificial Sequence
  Synthetic
tccatcgcgcgcggctat

SEQ ID NO: 19938 - DNA, 22 bp, Artificial Sequence
  Synthetic
gcctgcttccggccattctgat

SEQ ID NO: 19939 - DNA, 19 bp, Artificial Sequence
  Synthetic
acgacgtttccggcctgcc

SEQ ID NO: 19940 - DNA, 20 bp, Artificial Sequence
  Synthetic
ggtgtacggaatcgtcgccg

SEQ ID NO: 19941 - DNA, 20 bp, Artificial Sequence
  Synthetic
ttcggttcgggcttgttggg

SEQ ID NO: 19942 - DNA, 21 bp, Artificial Sequence
  Synthetic
tggcgcacggcatcgatatgt

SEQ ID NO: 19943 - DNA, 20 bp, Artificial Sequence
  Synthetic
tttccgtggcgatgtcgtaa

SEQ ID NO: 19944 - DNA, 20 bp, Artificial Sequence
  Synthetic
ttgacggccttccattttgg

SEQ ID NO: 19945 - DNA, 24 bp, Artificial Sequence
  Synthetic
ccctttggatattgcgctcaattt

SEQ ID NO: 19946 - DNA, 20 bp, Artificial Sequence
  Synthetic
cacagcattcccggggtgtc

SEQ ID NO: 19947 - DNA, 22 bp, Artificial Sequence
  Synthetic
cctcaggcaaatacgcggacaa

SEQ ID NO: 19948 - DNA, 21 bp, Artificial Sequence
  Synthetic
tgccgtctgaagcaccgtttg

SEQ ID NO: 19949 - DNA, 19 bp, Artificial Sequence
  Synthetic
cgcgccacccatgcattgg

SEQ ID NO: 19950 - DNA, 25 bp, Artificial Sequence
  Synthetic
gttgatttgaaaaaaatgccgtctg

SEQ ID NO: 19951 - DNA, 22 bp, Artificial Sequence
  Synthetic
acacccgaccaccaaaagctgg

SEQ ID NO: 19952 - DNA, 25 bp, Artificial Sequence
  Synthetic
gtctgaatgtttcgacaatccgatt

SEQ ID NO: 19953 - DNA, 20 bp, Artificial Sequence
  Synthetic
cacaaccgccgacatcaagc

SEQ ID NO: 19954 - DNA, 22 bp, Artificial Sequence
  Synthetic
gtcaattcgcaccggactgcgt

SEQ ID NO: 19955 - DNA, 19 bp, Artificial Sequence
  Synthetic
tcctcaggctccgccacac

SEQ ID NO: 19956 - DNA, 25 bp, Artificial Sequence
  Synthetic
cattggcaaaaatagcagcacaata

SEQ ID NO: 19957 - DNA, 19 bp, Artificial Sequence
  Synthetic
cgcaccttcgggcagactg

SEQ ID NO: 19958 - DNA, 19 bp, Artificial Sequence
  Synthetic
ttgccggttcggaagccgc

SEQ ID NO: 19959 - DNA, 21 bp, Artificial Sequence
  Synthetic
cgcatgaagattggcttccgc

SEQ ID NO: 19960 - DNA, 22 bp, Artificial Sequence
  Synthetic
cgcttcaaggtagccttttgcc

SEQ ID NO: 19961 - DNA, 19 bp, Artificial Sequence
  Synthetic
ggcgtgttggttgatgccg

SEQ ID NO: 19962 - DNA, 25 bp, Artificial Sequence
  Synthetic
gcgaaagtttccgtaaaaatatcgg

SEQ ID NO: 19963 - DNA, 20 bp, Artificial Sequence
  Synthetic
ccgccgcccaagattggaat

SEQ ID NO: 19964 - DNA, 22 bp, Artificial Sequence
  Synthetic
acttcaaactgcgcggacaacc

SEQ ID NO: 19965 - DNA, 22 bp, Artificial Sequence
  Synthetic
cgccgtacctatgcgtgtgaaa

SEQ ID NO: 19966 - DNA, 20 bp, Artificial Sequence
  Synthetic
acggtttcgtcgacggcacg

SEQ ID NO: 19967 - DNA, 22 bp, Artificial Sequence
  Synthetic
gctctacttcgcagccgtcaac

SEQ ID NO: 19968 - DNA, 22 bp, Artificial Sequence
  Synthetic
tggtattcgtcatcggcatcgc

SEQ ID NO: 19969 - DNA, 22 bp, Artificial Sequence
  Synthetic
gcatttccaatcccgacaccgt

SEQ ID NO: 19970 - DNA, 20 bp, Artificial Sequence
  Synthetic
catcgtcaggcgagcaaccg

SEQ ID NO: 19971 - DNA, 22 bp, Artificial Sequence
  Synthetic
atcggacgaattggcacggatt

SEQ ID NO: 19972 - DNA, 19 bp, Artificial Sequence
  Synthetic
tgctcgacaacggcgttcc

SEQ ID NO: 19973 - DNA, 19 bp, Artificial Sequence
  Synthetic
cgtcgccgccataaaacgc

SEQ ID NO: 19974 - DNA, 19 bp, Artificial Sequence
  Synthetic
atccgcagcccgacggttc

SEQ ID NO: 19975 - DNA, 19 bp, Artificial Sequence
  Synthetic
attgcgcgacatcgtccga

SEQ ID NO: 19976 - DNA, 22 bp, Artificial Sequence
  Synthetic
cgcccgataaagctgcgtaagt

SEQ ID NO: 19977 - DNA, 22 bp, Artificial Sequence
  Synthetic
gcccgaaccgatgaagcaatcc

SEQ ID NO: 19978 - DNA, 20 bp, Artificial Sequence
  Synthetic
gccgattttgcctttgccgc

SEQ ID NO: 19979 - DNA, 21 bp, Artificial Sequence
  Synthetic
acgaagtggaagccgtgttgg

SEQ ID NO: 19980 - DNA, 19 bp, Artificial Sequence
  Synthetic
agtcgaacccgccgccaag

SEQ ID NO: 19981 - DNA, 22 bp, Artificial Sequence
  Synthetic
tcttcgcggaagatttcgcctt

SEQ ID NO: 19982 - DNA, 19 bp, Artificial Sequence
  Synthetic
agtccgctacacgcaaggc

SEQ ID NO: 19983 - DNA, 21 bp, Artificial Sequence
  Synthetic
ggcttccaacgcgtcatccag

SEQ ID NO: 19984 - DNA, 20 bp, Artificial Sequence
  Synthetic
tgtcttcggcaaccacaccg

SEQ ID NO: 19985 - DNA, 20 bp, Artificial Sequence
  Synthetic
gcgcattttgcccgaacgca

SEQ ID NO: 19986 - DNA, 20 bp, Artificial Sequence
  Synthetic
aacggtctttgaggcggctg

SEQ ID NO: 19987 - DNA, 18 bp, Artificial Sequence
  Synthetic
aagctcggcggcgcaaag

SEQ ID NO: 19988 - DNA, 20 bp, Artificial Sequence
  Synthetic
cgaagccccggaatttgcct

SEQ ID NO: 19989 - DNA, 20 bp, Artificial Sequence
  Synthetic
gccaaaccgccgtggacatc

SEQ ID NO: 19990 - DNA, 22 bp, Artificial Sequence
  Synthetic
cggaattccgcgcatttgcaga

SEQ ID NO: 19991 - DNA, 22 bp, Artificial Sequence
  Synthetic
ctgccctttctgcaaagccgtt

SEQ ID NO: 19992 - DNA, 21 bp, Artificial Sequence
  Synthetic
gaacaggtattccggcgcgga

SEQ ID NO: 19993 - DNA, 20 bp, Artificial Sequence
  Synthetic
atcggcaggctgaaacactc

SEQ ID NO: 19994 - DNA, 19 bp, Artificial Sequence
  Synthetic
gcgcgctggatgccaaagt

SEQ ID NO: 19995 - DNA, 18 bp, Artificial Sequence
  Synthetic
gcgtgctgctgccggaaa

SEQ ID NO: 19996 - DNA, 21 bp, Artificial Sequence
  Synthetic
gctgaccactgaaaacacgcc

SEQ ID NO: 19997 - DNA, 23 bp, Artificial Sequence
  Synthetic
accgtcatatgccttattgtcgt

SEQ ID NO: 19998 - DNA, 22 bp, Artificial Sequence
  Synthetic
gcccggtcaaaagcgcaaaaag

SEQ ID NO: 19999 - DNA, 21 bp, Artificial Sequence
  Synthetic
agctacaccccgaaacatccg

SEQ ID NO: 20000 - DNA, 19 bp, Artificial Sequence
  Synthetic
gcacggcgatgcggaagtg

SEQ ID NO: 20001 - DNA, 21 bp, Artificial Sequence
  Synthetic
gcggcggcggtttttgtagat

SEQ ID NO: 20002 - DNA, 19 bp, Artificial Sequence
  Synthetic
ccagcggtttgcaatcgcc

SEQ ID NO: 20003 - DNA, 20 bp, Artificial Sequence
  Synthetic
taccgcgtctttgccgactg

SEQ ID NO: 20004 - DNA, 22 bp, Artificial Sequence
  Synthetic
ccgatacggggtaaggcaggat

SEQ ID NO: 20005 - DNA, 19 bp, Artificial Sequence
  Synthetic
gtttgcgccgccgtctttg

SEQ ID NO: 20006 - DNA, 21 bp, Artificial Sequence
  Synthetic
gttcctcgtaggctgcctgcg

SEQ ID NO: 20007 - DNA, 20 bp, Artificial Sequence
  Synthetic
ggtcgtacagggcgttgccg

SEQ ID NO: 20008 - DNA, 25 bp, Artificial Sequence
  Synthetic
agtgccatttcattctaacttcctt

SEQ ID NO: 20009 - DNA, 22 bp, Artificial Sequence
  Synthetic
gcttcatctgctttgtgcgggt

SEQ ID NO: 20010 - DNA, 21 bp, Artificial Sequence
  Synthetic
cgaccacatcggacaatcccg

SEQ ID NO: 20011 - DNA, 22 bp, Artificial Sequence
  Synthetic
gtttccgttcgggcaatggttc

SEQ ID NO: 20012 - DNA, 20 bp, Artificial Sequence
  Synthetic
gcccgtcgtcttccacgttg

SEQ ID NO: 20013 - DNA, 22 bp, Artificial Sequence
  Synthetic
ggcggttacttttttgcctgcc

SEQ ID NO: 20014 - DNA, 18 bp, Artificial Sequence
  Synthetic
gcagcttcggcttcggct

SEQ ID NO: 20015 - DNA, 20 bp, Artificial Sequence
  Synthetic
cgcccgatataggcttccgc

SEQ ID NO: 20016 - DNA, 19 bp, Artificial Sequence
  Synthetic
cgttgacactgcccgcgaa

SEQ ID NO: 20017 - DNA, 19 bp, Artificial Sequence
  Synthetic
ccctgcgtttcaagcccga

SEQ ID NO: 20018 - DNA, 19 bp, Artificial Sequence
  Synthetic
tccaatacgccgcccaggg

SEQ ID NO: 20019 - DNA, 21 bp, Artificial Sequence
  Synthetic
ccgcctgataaatgttgcgcg

SEQ ID NO: 20020 - DNA, 18 bp, Artificial Sequence
  Synthetic
tcaaacccgcgttgcgcc

SEQ ID NO: 20021 - DNA, 18 bp, Artificial Sequence
  Synthetic
atcgcggctgtcctgctc

SEQ ID NO: 20022 - DNA, 19 bp, Artificial Sequence
  Synthetic
cgggcgtgtgtctgaaccg

SEQ ID NO: 20023 - DNA, 22 bp, Artificial Sequence
  Synthetic
cgaacgggaacacatccgcctt

SEQ ID NO: 20024 - DNA, 20 bp, Artificial Sequence
  Synthetic
cggcaagaagcggcggtatg

SEQ ID NO: 20025 - DNA, 22 bp, Artificial Sequence
  Synthetic
cggacaggagggcgtttgatgt

SEQ ID NO: 20026 - DNA, 19 bp, Artificial Sequence
  Synthetic
gcgggggcttcgagtttcg

SEQ ID NO: 20027 - DNA, 19 bp, Artificial Sequence
  Synthetic
acaccgccgcaccgtatcc

SEQ ID NO: 20028 - DNA, 18 bp, Artificial Sequence
  Synthetic
ttcccaccgcttccccga

SEQ ID NO: 20029 - DNA, 19 bp, Artificial Sequence
  Synthetic
tccgggcggttttggcgtg

SEQ ID NO: 20030 - DNA, 22 bp, Artificial Sequence
  Synthetic
gccttgagcttgtcgattgccg

SEQ ID NO: 20031 - DNA, 21 bp, Artificial Sequence
  Synthetic
cgcccatcaaccccatcactg

SEQ ID NO: 20032 - DNA, 22 bp, Artificial Sequence
  Synthetic
gcgaagtgggcgaactgatcgt

SEQ ID NO: 20033 - DNA, 18 bp, Artificial Sequence
  Synthetic
ttttggcgggcgcggtgt

SEQ ID NO: 20034 - DNA, 20 bp, Artificial Sequence
  Synthetic
ggctggcaggcgagttttct

SEQ ID NO: 20035 - DNA, 20 bp, Artificial Sequence
  Synthetic
cgacaggggttctttttgct

SEQ ID NO: 20036 - DNA, 20 bp, Artificial Sequence
  Synthetic
ttttcgcaaatcttccgccc

SEQ ID NO: 20037 - DNA, 19 bp, Artificial Sequence
  Synthetic
caggaaatcatcgcgcgcg

SEQ ID NO: 20038 - DNA, 19 bp, Artificial Sequence
  Synthetic
gcacatcgcccccgaaacc

SEQ ID NO: 20039 - DNA, 19 bp, Artificial Sequence
  Synthetic
actgccgacgtgcttgccc

SEQ ID NO: 20040 - DNA, 19 bp, Artificial Sequence
  Synthetic
cgccgacgcccgatttcac

SEQ ID NO: 20041 - DNA, 22 bp, Artificial Sequence
  Synthetic
cggaagacaaatccatgccgcc

SEQ ID NO: 20042 - DNA, 19 bp, Artificial Sequence
  Synthetic
atcagcgcgggcttgtgcc

SEQ ID NO: 20043 - DNA, 21 bp, Artificial Sequence
  Synthetic
cttgcattggaagccttgggc

SEQ ID NO: 20044 - DNA, 21 bp, Artificial Sequence
  Synthetic
gctggccggaaaccatatctc

SEQ ID NO: 20045 - DNA, 19 bp, Artificial Sequence
  Synthetic
tccacccgcacccgacctt

SEQ ID NO: 20046 - DNA, 19 bp, Artificial Sequence
  Synthetic
ccgtacgacgctgaacggc

SEQ ID NO: 20047 - DNA, 20 bp, Artificial Sequence
  Synthetic
ggcatcagcagctccacgct

SEQ ID NO: 20048 - DNA, 20 bp, Artificial Sequence
  Synthetic
ctccgatcggcaactggcaa

SEQ ID NO: 20049 - DNA, 21 bp, Artificial Sequence
  Synthetic
aaggcgcatctgctcgatgtg

SEQ ID NO: 20050 - DNA, 20 bp, Artificial Sequence
  Synthetic
cgccgcgttcgtactgcatg

SEQ ID NO: 20051 - DNA, 19 bp, Artificial Sequence
  Synthetic
atcaggctgcggtgggagc

SEQ ID NO: 20052 - DNA, 18 bp, Artificial Sequence
  Synthetic
aaggcggtgcggacgttg

SEQ ID NO: 20053 - DNA, 22 bp, Artificial Sequence
  Synthetic
cggtgaaacacggcatttggtt

SEQ ID NO: 20054 - DNA, 18 bp, Artificial Sequence
  Synthetic
ggcgggcggcaaagtgtt

SEQ ID NO: 20055 - DNA, 20 bp, Artificial Sequence
  Synthetic
gcagcagcaatgtcggcatt

SEQ ID NO: 20056 - DNA, 20 bp, Artificial Sequence
  Synthetic
cccgcccataaagccatcgg

SEQ ID NO: 20057 - DNA, 20 bp, Artificial Sequence
  Synthetic
gctcgacagccttgccgaca

SEQ ID NO: 20058 - DNA, 19 bp, Artificial Sequence
  Synthetic
tgtttgccgcgctgatccg

SEQ ID NO: 20059 - DNA, 22 bp, Artificial Sequence
  Synthetic
cgacaggcagggagtcggcata

SEQ ID NO: 20060 - DNA, 20 bp, Artificial Sequence
  Synthetic
cggtgtcaacgataaggcac

SEQ ID NO: 20061 - DNA, 22 bp, Artificial Sequence
  Synthetic
accgtaaacgcaggtctgaaat

SEQ ID NO: 20062 - DNA, 22 bp, Artificial Sequence
  Synthetic
gcagcgcaacctcaaaccgaaa

SEQ ID NO: 20063 - DNA, 20 bp, Artificial Sequence
  Synthetic
cgacatctcgacggcaaccg

SEQ ID NO: 20064 - DNA, 20 bp, Artificial Sequence
  Synthetic
cgcccttgcccaacgctata

SEQ ID NO: 20065 - DNA, 19 bp, Artificial Sequence
  Synthetic
tggaaatccgcggcgcagg

SEQ ID NO: 20066 - DNA, 20 bp, Artificial Sequence
  Synthetic
cgaccacgcttctggtcgag

SEQ ID NO: 20067 - DNA, 18 bp, Artificial Sequence
  Synthetic
tcgccctgcacaagctcg

SEQ ID NO: 20068 - DNA, 21 bp, Artificial Sequence
  Synthetic
tgttgttcgtaccggttgcca

SEQ ID NO: 20069 - DNA, 19 bp, Artificial Sequence
  Synthetic
tcctcgccgcctacatcca

SEQ ID NO: 20070 - DNA, 19 bp, Artificial Sequence
  Synthetic
tacagcacccgccacctgc

SEQ ID NO: 20071 - DNA, 22 bp, Artificial Sequence
  Synthetic
cgatctcatccgtatcgccccg

SEQ ID NO: 20072 - DNA, 20 bp, Artificial Sequence
  Synthetic
ggtatcgccgtcggtatggc

SEQ ID NO: 20073 - DNA, 20 bp, Artificial Sequence
  Synthetic
gcaacgacgaactggcgcac

SEQ ID NO: 20074 - DNA, 22 bp, Artificial Sequence
  Synthetic
ccaagttcgcccaatacctgct

SEQ ID NO: 20075 - DNA, 21 bp, Artificial Sequence
  Synthetic
cgggcatcgttgcttttcatt

SEQ ID NO: 20076 - DNA, 22 bp, Artificial Sequence
  Synthetic
tgcccctgcccgatgacataat

SEQ ID NO: 20077 - DNA, 22 bp, Artificial Sequence
  Synthetic
cgcagtcaggggcagaaacttc

SEQ ID NO: 20078 - DNA, 19 bp, Artificial Sequence
  Synthetic
atggtaggcagcacgcgcg

SEQ ID NO: 20079 - DNA, 20 bp, Artificial Sequence
  Synthetic
cggcgcattggcaaaaggtc

SEQ ID NO: 20080 - DNA, 22 bp, Artificial Sequence
  Synthetic
cggcgtttcaaggtggttacga

SEQ ID NO: 20081 - DNA, 22 bp, Artificial Sequence
  Synthetic
cgcacgaccggttcttcgttaa

SEQ ID NO: 20082 - DNA, 19 bp, Artificial Sequence
  Synthetic
ggcgggaatggcggcaaat

SEQ ID NO: 20083 - DNA, 20 bp, Artificial Sequence
  Synthetic
ccagaccgatatgccgtcgc

SEQ ID NO: 20084 - DNA, 18 bp, Artificial Sequence
  Synthetic
ggtttgcgcccgcatgtg

SEQ ID NO: 20085 - DNA, 19 bp, Artificial Sequence
  Synthetic
aaccaccccgacccctgtg

SEQ ID NO: 20086 - DNA, 22 bp, Artificial Sequence
  Synthetic
gcagcgaacacgatacccgtat

SEQ ID NO: 20087 - DNA, 20 bp, Artificial Sequence
  Synthetic
ggcaaagcaaccttagccgc

SEQ ID NO: 20088 - DNA, 18 bp, Artificial Sequence
  Synthetic
atcaccgcgccgctgcaa

SEQ ID NO: 20089 - DNA, 25 bp, Artificial Sequence
  Synthetic
accgcctttaaacaattgaaagaaa

SEQ ID NO: 20090 - DNA, 22 bp, Artificial Sequence
  Synthetic
tcgacattaccgaacaccgcaa

SEQ ID NO: 20091 - DNA, 22 bp, Artificial Sequence
  Synthetic
ccagcttcgccgacatcttctt

SEQ ID NO: 20092 - DNA, 21 bp, Artificial Sequence
  Synthetic
aatcccgccgaagaaaccgat

SEQ ID NO: 20093 - DNA, 19 bp, Artificial Sequence
  Synthetic
tccacccacggcgcattcg

SEQ ID NO: 20094 - DNA, 18 bp, Artificial Sequence
  Synthetic
agcgcgccaaatcgaccg

SEQ ID NO: 20095 - DNA, 21 bp, Artificial Sequence
  Synthetic
cggatagacaagttcgcccgc

SEQ ID NO: 20096 - DNA, 22 bp, Artificial Sequence
  Synthetic
gcgtgccattatgggtttccac

SEQ ID NO: 20097 - DNA, 21 bp, Artificial Sequence
  Synthetic
aaatgccggcgatgaaggtca

SEQ ID NO: 20098 - DNA, 19 bp, Artificial Sequence
  Synthetic
ttgtcttgcccacgcccgg

SEQ ID NO: 20099 - DNA, 19 bp, Artificial Sequence
  Synthetic
ggatttgcgcgcccaagct

SEQ ID NO: 20100 - DNA, 21 bp, Artificial Sequence
  Synthetic
tctttgacgaagcggcgcatt

SEQ ID NO: 20101 - DNA, 21 bp, Artificial Sequence
  Synthetic
ccaaagcccttgatcgcgtcc

SEQ ID NO: 20102 - DNA, 18 bp, Artificial Sequence
  Synthetic
gattcccgccgccgtcat

SEQ ID NO: 20103 - DNA, 21 bp, Artificial Sequence
  Synthetic
tgcctgaaacggctaaatcct

SEQ ID NO: 20104 - DNA, 23 bp, Artificial Sequence
  Synthetic
cctgcactcatcaatcctgattt

SEQ ID NO: 20105 - DNA, 22 bp, Artificial Sequence
  Synthetic
gccatttgccgatgattggggc

SEQ ID NO: 20106 - DNA, 19 bp, Artificial Sequence
  Synthetic
tgttgtcgttgtgggcggg

SEQ ID NO: 20107 - DNA, 20 bp, Artificial Sequence
  Synthetic
ccgggtttcacatcgccgta

SEQ ID NO: 20108 - DNA, 22 bp, Artificial Sequence
  Synthetic
ggaacacggcatcgacacactc

SEQ ID NO: 20109 - DNA, 18 bp, Artificial Sequence
  Synthetic
gcgcatcgatttgggcgc

SEQ ID NO: 20110 - DNA, 20 bp, Artificial Sequence
  Synthetic
cgtatgtccggcgcgtcagg

SEQ ID NO: 20111 - DNA, 19 bp, Artificial Sequence
  Synthetic
cagcgcgaagtgttggcgg

SEQ ID NO: 20112 - DNA, 20 bp, Artificial Sequence
  Synthetic
cgtgccacttgttgccgtcg

SEQ ID NO: 20113 - DNA, 20 bp, Artificial Sequence
  Synthetic
gagccgtccacgttggagac

SEQ ID NO: 20114 - DNA, 20 bp, Artificial Sequence
  Synthetic
atttcgtggtgtccgggcag

SEQ ID NO: 20115 - DNA, 21 bp, Artificial Sequence
  Synthetic
cactcttcgccattcccgcga

SEQ ID NO: 20116 - DNA, 19 bp, Artificial Sequence
  Synthetic
caacgtcggcgcactggac

SEQ ID NO: 20117 - DNA, 19 bp, Artificial Sequence
  Synthetic
acggacgcgggcaagacac

SEQ ID NO: 20118 - DNA, 20 bp, Artificial Sequence
  Synthetic
acgagtgcggctacggaatc

SEQ ID NO: 20119 - DNA, 22 bp, Artificial Sequence
  Synthetic
cgcgggaatccggtaaccgaaa

SEQ ID NO: 20120 - DNA, 19 bp, Artificial Sequence
  Synthetic
acgcctacctgctgaccgg

SEQ ID NO: 20121 - DNA, 22 bp, Artificial Sequence
  Synthetic
gttccacacgctcaacaaagcc

SEQ ID NO: 20122 - DNA, 21 bp, Artificial Sequence
  Synthetic
aagtcatgctccatgccgtca

SEQ ID NO: 20123 - DNA, 20 bp, Artificial Sequence
  Synthetic
tggctgcggtacacaatgcc

SEQ ID NO: 20124 - DNA, 20 bp, Artificial Sequence
  Synthetic
gcatcgccaaccgcctgttg

SEQ ID NO: 20125 - DNA, 22 bp, Artificial Sequence
  Synthetic
gcgcaccttatcgccgaacaaa

SEQ ID NO: 20126 - DNA, 20 bp, Artificial Sequence
  Synthetic
agctgatgcggcagatggtg

SEQ ID NO: 20127 - DNA, 20 bp, Artificial Sequence
  Synthetic
ccttcatcgcccgatacggc

SEQ ID NO: 20128 - DNA, 24 bp, Artificial Sequence
  Synthetic
cgaatgctgcaaatttgtttgatg

SEQ ID NO: 20129 - DNA, 22 bp, Artificial Sequence
  Synthetic
ccaagccaaaccggtaacctgt

SEQ ID NO: 20130 - DNA, 21 bp, Artificial Sequence
  Synthetic
gcgtgggtcattttggcgttg

SEQ ID NO: 20131 - DNA, 23 bp, Artificial Sequence
  Synthetic
atgaccaaggacaaaatggactt

SEQ ID NO: 20132 - DNA, 21 bp, Artificial Sequence
  Synthetic
cgccaagcgtaaaccattcat

SEQ ID NO: 20133 - DNA, 23 bp, Artificial Sequence
  Synthetic
gctttggttccttcacatgtcag

SEQ ID NO: 20134 - DNA, 23 bp, Artificial Sequence
  Synthetic
acacggtgcttgatacctttcaa

SEQ ID NO: 20135 - DNA, 21 bp, Artificial Sequence
  Synthetic
ggactactgtggctaccgtaa

SEQ ID NO: 20136 - DNA, 24 bp, Artificial Sequence
  Synthetic
ctgaatttttcagttgcctcacct

SEQ ID NO: 20137 - DNA, 24 bp, Artificial Sequence
  Synthetic
ttgtctgtttgggtgtatgaatca

SEQ ID NO: 20138 - DNA, 25 bp, Artificial Sequence
  Synthetic
gccaaagtaaatggtactaaagctg

SEQ ID NO: 20139 - DNA, 22 bp, Artificial Sequence
  Synthetic
accgcccggacagcttttgata

SEQ ID NO: 20140 - DNA, 22 bp, Artificial Sequence
  Synthetic
cgtggaagaaggcggcaaggta

SEQ ID NO: 20141 - DNA, 21 bp, Artificial Sequence
  Synthetic
ctttggcagtggcgatgttgc

SEQ ID NO: 20142 - DNA, 20 bp, Artificial Sequence
  Synthetic
ccgtcggcaatcagcggaac

SEQ ID NO: 20143 - DNA, 20 bp, Artificial Sequence
  Synthetic
cttggctcatcgcgcccaag

SEQ ID NO: 20144 - DNA, 19 bp, Artificial Sequence
  Synthetic
cgttcgatgcgcccctgat

SEQ ID NO: 20145 - DNA, 19 bp, Artificial Sequence
  Synthetic
acgggtttgacgatgcccg

SEQ ID NO: 20146 - DNA, 20 bp, Artificial Sequence
  Synthetic
ccgatgaccttgcccgcttc

SEQ ID NO: 20147 - DNA, 20 bp, Artificial Sequence
  Synthetic
cgcttcggtcaggcagttca

SEQ ID NO: 20148 - DNA, 18 bp, Artificial Sequence
  Synthetic
tcgtccacgcctgcggtt

SEQ ID NO: 20149 - DNA, 20 bp, Artificial Sequence
  Synthetic
atcctcgccgtcctcgagcc

SEQ ID NO: 20150 - DNA, 19 bp, Artificial Sequence
  Synthetic
atatgccggactcgcgccg

SEQ ID NO: 20151 - DNA, 20 bp, Artificial Sequence
  Synthetic
acacggtgagggacgaagcc

SEQ ID NO: 20152 - DNA, 19 bp, Artificial Sequence
  Synthetic
ttgtgcggacgcgtggtcg

SEQ ID NO: 20153 - DNA, 21 bp, Artificial Sequence
  Synthetic
ccggacagatattgccggtgt

SEQ ID NO: 20154 - DNA, 18 bp, Artificial Sequence
  Synthetic
agccgtggtcgaagccga

SEQ ID NO: 20155 - DNA, 21 bp, Artificial Sequence
  Synthetic
gcaattccaccatccccaccg

SEQ ID NO: 20156 - DNA, 18 bp, Artificial Sequence
  Synthetic
acctaccgccgccgcaat

SEQ ID NO: 20157 - DNA, 20 bp, Artificial Sequence
  Synthetic
tatcggcatcaggcagcagc

SEQ ID NO: 20158 - DNA, 19 bp, Artificial Sequence
  Synthetic
ggcggcatcgaaggcttcg

SEQ ID NO: 20159 - DNA, 20 bp, Artificial Sequence
  Synthetic
gctgcgtgaggactcggtcg

SEQ ID NO: 20160 - DNA, 20 bp, Artificial Sequence
  Synthetic
caaaccgcaaaccgtccgca

SEQ ID NO: 20161 - DNA, 20 bp, Artificial Sequence
  Synthetic
aggacggggtgctgaaacac

SEQ ID NO: 20162 - DNA, 20 bp, Artificial Sequence
  Synthetic
tctgttcattgtcccgcgcc

SEQ ID NO: 20163 - DNA, 22 bp, Artificial Sequence
  Synthetic
gcgtgcggattgaaatgcatct

SEQ ID NO: 20164 - DNA, 21 bp, Artificial Sequence
  Synthetic
ggtatccgaacacctgccgac

SEQ ID NO: 20165 - DNA, 22 bp, Artificial Sequence
  Synthetic
tggttttgtctgcctatgccgt

SEQ ID NO: 20166 - DNA, 21 bp, Artificial Sequence
  Synthetic
tgcgagaattggcggaggaaa

SEQ ID NO: 20167 - DNA, 19 bp, Artificial Sequence
  Synthetic
gcgcatcgtcatccggcat

SEQ ID NO: 20168 - DNA, 20 bp, Artificial Sequence
  Synthetic
gcctcgctgccttcgagatt

SEQ ID NO: 20169 - DNA, 20 bp, Artificial Sequence
  Synthetic
acgacggacagcaaaacgcc

SEQ ID NO: 20170 - DNA, 20 bp, Artificial Sequence
  Synthetic
aaagccgcgagtggtcatgg

SEQ ID NO: 20171 - DNA, 23 bp, Artificial Sequence
  Synthetic
gttcagacggcattttgtatgga

SEQ ID NO: 20172 - DNA, 19 bp, Artificial Sequence
  Synthetic
tcttcgaggcgttcgcggg

SEQ ID NO: 20173 - DNA, 22 bp, Artificial Sequence
  Synthetic
cgggtaatctttccgaaaccgt

SEQ ID NO: 20174 - DNA, 21 bp, Artificial Sequence
  Synthetic
agcctgctttgcgtatccacg

SEQ ID NO: 20175 - DNA, 22 bp, Artificial Sequence
  Synthetic
aggtattcgagataggcgcggg

SEQ ID NO: 20176 - DNA, 19 bp, Artificial Sequence
  Synthetic
acgaatcgccgtcttgcgc

SEQ ID NO: 20177 - DNA, 18 bp, Artificial Sequence
  Synthetic
acccccaagccgcattgg

SEQ ID NO: 20178 - DNA, 20 bp, Artificial Sequence
  Synthetic
tttgccgtcttcgatgccca

SEQ ID NO: 20179 - DNA, 20 bp, Artificial Sequence
  Synthetic
ttgccgaagccagatcgcac

SEQ ID NO: 20180 - DNA, 20 bp, Artificial Sequence
  Synthetic
tcgaccaaatcgccgatggg

SEQ ID NO: 20181 - DNA, 19 bp, Artificial Sequence
  Synthetic
tcctttcgggcgcgagact

SEQ ID NO: 20182 - DNA, 19 bp, Artificial Sequence
  Synthetic
tccgcatcagccacatcgg

SEQ ID NO: 20183 - DNA, 22 bp, Artificial Sequence
  Synthetic
ccgataccacacccgaatacgc

SEQ ID NO: 20184 - DNA, 18 bp, Artificial Sequence
  Synthetic
tgggcaagccattccgcc

SEQ ID NO: 20185 - DNA, 18 bp, Artificial Sequence
  Synthetic
cctcaaccgccgcatgca

SEQ ID NO: 20186 - DNA, 20 bp, Artificial Sequence
  Synthetic
ccgctgattgcaccgctcat

SEQ ID NO: 20187 - DNA, 21 bp, Artificial Sequence
  Synthetic
caccgtaagcgagcgtcaact

SEQ ID NO: 20188 - DNA, 20 bp, Artificial Sequence
  Synthetic
ggtactgcttcctttgccgg

SEQ ID NO: 20189 - DNA, 21 bp, Artificial Sequence
  Synthetic
ccttcggcgtgcatttggaca

SEQ ID NO: 20190 - DNA, 22 bp, Artificial Sequence
  Synthetic
cgatgtttgggcaaagtggctg

SEQ ID NO: 20191 - DNA, 19 bp, Artificial Sequence
  Synthetic
tcaggtgcgcgctcatcgg

SEQ ID NO: 20192 - DNA, 20 bp, Artificial Sequence
  Synthetic
acatcaatgccaagccgggc

SEQ ID NO: 20193 - DNA, 19 bp, Artificial Sequence
  Synthetic
tcacccacgccgtgctgtc

SEQ ID NO: 20194 - DNA, 18 bp, Artificial Sequence
  Synthetic
tccgcgccggctttttcg

SEQ ID NO: 20195 - DNA, 20 bp, Artificial Sequence
  Synthetic
gcaaagagtttcggggcggc

SEQ ID NO: 20196 - DNA, 20 bp, Artificial Sequence
  Synthetic
cggatatttctgcctgcccg

SEQ ID NO: 20197 - DNA, 19 bp, Artificial Sequence
  Synthetic
ccgtctggttgcgttggcg

SEQ ID NO: 20198 - DNA, 21 bp, Artificial Sequence
  Synthetic
cgggaactgggtgtgggaaat

SEQ ID NO: 20199 - DNA, 22 bp, Artificial Sequence
  Synthetic
aaagtgcgtcaaggcagagtct

SEQ ID NO: 20200 - DNA, 19 bp, Artificial Sequence
  Synthetic
aaatcccgtcccgcacgcg

SEQ ID NO: 20201 - DNA, 20 bp, Artificial Sequence
  Synthetic
tgcgccccctcatgattgag

SEQ ID NO: 20202 - DNA, 18 bp, Artificial Sequence
  Synthetic
tgccgcgcacgatgcttg

SEQ ID NO: 20203 - DNA, 19 bp, Artificial Sequence
  Synthetic
acgtcggtcagggcaacgc

SEQ ID NO: 20204 - DNA, 20 bp, Artificial Sequence
  Synthetic
atggttttgcccggcgagtc

SEQ ID NO: 20205 - DNA, 22 bp, Artificial Sequence
  Synthetic
gggcgaggaatagtcgatgacg

SEQ ID NO: 20206 - DNA, 22 bp, Artificial Sequence
  Synthetic
cgtagaagcggctgaacagggt

SEQ ID NO: 20207 - DNA, 22 bp, Artificial Sequence
  Synthetic
ggtcagcagtgccaaaacccaa

SEQ ID NO: 20208 - DNA, 20 bp, Artificial Sequence
  Synthetic
aaacggcatattcgcccgcg

SEQ ID NO: 20209 - DNA, 23 bp, Artificial Sequence
  Synthetic
cgtacccgaaaacgaatacatcg

SEQ ID NO: 20210 - DNA, 19 bp, Artificial Sequence
  Synthetic
ggtttggcggcggaaaccg

SEQ ID NO: 20211 - DNA, 23 bp, Artificial Sequence
  Synthetic
gcatcgtattgactgcctttcaa

SEQ ID NO: 20212 - DNA, 20 bp, Artificial Sequence
  Synthetic
ccaattcgtgcgtgtcttca

SEQ ID NO: 20213 - DNA, 20 bp, Artificial Sequence
  Synthetic
aaccgaagtcaaaccgccgg

SEQ ID NO: 20214 - DNA, 24 bp, Artificial Sequence
  Synthetic
cacagggtcaaaatacagttcagt

SEQ ID NO: 20215 - DNA, 22 bp, Artificial Sequence
  Synthetic
ggacagtttggcagacggtgtg

SEQ ID NO: 20216 - DNA, 21 bp, Artificial Sequence
  Synthetic
gtgccaccgtcttttttgtga

SEQ ID NO: 20217 - DNA, 22 bp, Artificial Sequence
  Synthetic
tcgggcttttggtcattttcag

SEQ ID NO: 20218 - DNA, 21 bp, Artificial Sequence
  Synthetic
ccgtcttggttttccagtgca

SEQ ID NO: 20219 - DNA, 22 bp, Artificial Sequence
  Synthetic
tcgaattgcagcgtgaatgcgc

SEQ ID NO: 20220 - DNA, 19 bp, Artificial Sequence
  Synthetic
tcggtggtccgctcggaag

SEQ ID NO: 20221 - DNA, 20 bp, Artificial Sequence
  Synthetic
atccattccctctcccgtgg

SEQ ID NO: 20222 - DNA, 23 bp, Artificial Sequence
  Synthetic
ctcaaaaaataccagcccgagag

SEQ ID NO: 20223 - DNA, 22 bp, Artificial Sequence
  Synthetic
gcgcgttgagatagacggcgag

SEQ ID NO: 20224 - DNA, 21 bp, Artificial Sequence
  Synthetic
gcggagaactgtttgaccgcg

SEQ ID NO: 20225 - DNA, 21 bp, Artificial Sequence
  Synthetic
acgccgtctgaaaaaaccttt

SEQ ID NO: 20226 - DNA, 20 bp, Artificial Sequence
  Synthetic
gccatgcgcccaaacagatg

SEQ ID NO: 20227 - DNA, 22 bp, Artificial Sequence
  Synthetic
gcgcctgctgcttaagatatgc

SEQ ID NO: 20228 - DNA, 19 bp, Artificial Sequence
  Synthetic
tttccagtcgccgccgtct

SEQ ID NO: 20229 - DNA, 22 bp, Artificial Sequence
  Synthetic
aaacacccgcttcaaaacccac

SEQ ID NO: 20230 - DNA, 18 bp, Artificial Sequence
  Synthetic
tttgaccgcgccgacacg

SEQ ID NO: 20231 - DNA, 20 bp, Artificial Sequence
  Synthetic
aaacggcggtcgattttgtc

SEQ ID NO: 20232 - DNA, 18 bp, Artificial Sequence
  Synthetic
tgccgcccgtgcaaactg

SEQ ID NO: 20233 - DNA, 22 bp, Artificial Sequence
  Synthetic
acgaaccgttgggctacatcaa

SEQ ID NO: 20234 - DNA, 22 bp, Artificial Sequence
  Synthetic
tcttcgccgtaaattaccgcca

SEQ ID NO: 20235 - DNA, 21 bp, Artificial Sequence
  Synthetic
ccgaacttgctgtccactccg

SEQ ID NO: 20236 - DNA, 19 bp, Artificial Sequence
  Synthetic
ggaatgtgccgctgccgaa

SEQ ID NO: 20237 - DNA, 21 bp, Artificial Sequence
  Synthetic
cctgttgggtttgcgcgatga

SEQ ID NO: 20238 - DNA, 22 bp, Artificial Sequence
  Synthetic
tcttgatgggcgtcttgcgtat

SEQ ID NO: 20239 - DNA, 20 bp, Artificial Sequence
  Synthetic
atcagaagcggtagcgcacg

SEQ ID NO: 20240 - DNA, 22 bp, Artificial Sequence
  Synthetic
ccgataagtttccgtgcggaca

SEQ ID NO: 20241 - DNA, 21 bp, Artificial Sequence
  Synthetic
ctcttgtcgtgcggacggttt

SEQ ID NO: 20242 - DNA, 20 bp, Artificial Sequence
  Synthetic
aaacgatacggcaagcgcga

SEQ ID NO: 20243 - DNA, 20 bp, Artificial Sequence
  Synthetic
cctgtcaagcccgtgtgcag

SEQ ID NO: 20244 - DNA, 22 bp, Artificial Sequence
  Synthetic
ggcggatgatacggaggctttg

SEQ ID NO: 20245 - DNA, 19 bp, Artificial Sequence
  Synthetic
gcgggggtgcgaaggaaat

SEQ ID NO: 20246 - DNA, 19 bp, Artificial Sequence
  Synthetic
gcgcgtttccccgttgacg

SEQ ID NO: 20247 - DNA, 20 bp, Artificial Sequence
  Synthetic
tcggggataaggcgggcgag

SEQ ID NO: 20248 - DNA, 20 bp, Artificial Sequence
  Synthetic
gcgacgcggctttcgaacag

SEQ ID NO: 20249 - DNA, 20 bp, Artificial Sequence
  Synthetic
ggcttatccggtgatggcgg

SEQ ID NO: 20250 - DNA, 22 bp, Artificial Sequence
  Synthetic
cccgtgatgaagtcccgggatt

SEQ ID NO: 20251 - DNA, 18 bp, Artificial Sequence
  Synthetic
acgagctgggcggtgtgt

SEQ ID NO: 20252 - DNA, 20 bp, Artificial Sequence
  Synthetic
gcggttacggaggcggacaa

SEQ ID NO: 20253 - DNA, 21 bp, Artificial Sequence
  Synthetic
ctgttgtcgcagcgtgtggag

SEQ ID NO: 20254 - DNA, 19 bp, Artificial Sequence
  Synthetic
ttgcggaatcggcgggcag

SEQ ID NO: 20255 - DNA, 19 bp, Artificial Sequence
  Synthetic
gggctgtacgcgcttaccg

SEQ ID NO: 20256 - DNA, 19 bp, Artificial Sequence
  Synthetic
acgagaagggggcggcttt

SEQ ID NO: 20257 - DNA, 20 bp, Artificial Sequence
  Synthetic
accaactcctaccgcagcca

SEQ ID NO: 20258 - DNA, 22 bp, Artificial Sequence
  Synthetic
gcggaagtatggtacaggcggt

SEQ ID NO: 20259 - DNA, 19 bp, Artificial Sequence
  Synthetic
gggcaatgcacgccgaaca

SEQ ID NO: 20260 - DNA, 20 bp, Artificial Sequence
  Synthetic
gccgcctgcccgatattggg

SEQ ID NO: 20261 - DNA, 18 bp, Artificial Sequence
  Synthetic
atcgggcgttcgggcatc

SEQ ID NO: 20262 - DNA, 22 bp, Artificial Sequence
  Synthetic
cggcctgtaaattccgcgtacg

SEQ ID NO: 20263 - DNA, 19 bp, Artificial Sequence
  Synthetic
ttacggcccggaccaacgc

SEQ ID NO: 20264 - DNA, 19 bp, Artificial Sequence
  Synthetic
gcggtccgcagtcgcattt

SEQ ID NO: 20265 - DNA, 20 bp, Artificial Sequence
  Synthetic
cgaagtatcgcccgccgaaa

SEQ ID NO: 20266 - DNA, 25 bp, Artificial Sequence
  Synthetic
aggttatccaaaaggtttacagcct

SEQ ID NO: 20267 - DNA, 19 bp, Artificial Sequence
  Synthetic
aacagcctgctgtcgcccg

SEQ ID NO: 20268 - DNA, 20 bp, Artificial Sequence
  Synthetic
atacgcggcggcaaagaaca

SEQ ID NO: 20269 - DNA, 22 bp, Artificial Sequence
  Synthetic
cggctgttgaccaaaatctgcg

SEQ ID NO: 20270 - DNA, 18 bp, Artificial Sequence
  Synthetic
cgcgcagggtgttgcctt

SEQ ID NO: 20271 - DNA, 19 bp, Artificial Sequence
  Synthetic
tggtggacaattccgcgcc

SEQ ID NO: 20272 - DNA, 21 bp, Artificial Sequence
  Synthetic
acgtaaaacctgcaatgcgcc

SEQ ID NO: 20273 - DNA, 22 bp, Artificial Sequence
  Synthetic
gtcgccttcgatgatgacggtt

SEQ ID NO: 20274 - DNA, 20 bp, Artificial Sequence
  Synthetic
cgatggttggcaaccgtgcg

SEQ ID NO: 20275 - DNA, 21 bp, Artificial Sequence
  Synthetic
attaatacgccccagccgccc

SEQ ID NO: 20276 - DNA, 20 bp, Artificial Sequence
  Synthetic
ataggcagaatgaccgcagc

SEQ ID NO: 20277 - DNA, 20 bp, Artificial Sequence
  Synthetic
accggagtggacgaacctct

SEQ ID NO: 20278 - DNA, 18 bp, Artificial Sequence
  Synthetic
cgcaagctgtttcggcgg

SEQ ID NO: 20279 - DNA, 20 bp, Artificial Sequence
  Synthetic
cggtcgaggaggcaatccgt

SEQ ID NO: 20280 - DNA, 21 bp, Artificial Sequence
  Synthetic
gcaccttcgtcgcggatttcg

SEQ ID NO: 20281 - DNA, 19 bp, Artificial Sequence
  Synthetic
ttggtcgccgagctgccag

SEQ ID NO: 20282 - DNA, 19 bp, Artificial Sequence
  Synthetic
accatttggtcgcggtggg

SEQ ID NO: 20283 - DNA, 22 bp, Artificial Sequence
  Synthetic
cgatttgcccgtttacgccctg

SEQ ID NO: 20284 - DNA, 22 bp, Artificial Sequence
  Synthetic
acaggatggatttcgcccagcc

SEQ ID NO: 20285 - DNA, 19 bp, Artificial Sequence
  Synthetic
ggacgacttcgcgttccgc

SEQ ID NO: 20286 - DNA, 20 bp, Artificial Sequence
  Synthetic
acgagggcatgacgaccgtg

SEQ ID NO: 20287 - DNA, 22 bp, Artificial Sequence
  Synthetic
gctacggcaatcagtgtcaggt

SEQ ID NO: 20288 - DNA, 19 bp, Artificial Sequence
  Synthetic
atgccgtgcagggcttggg

SEQ ID NO: 20289 - DNA, 22 bp, Artificial Sequence
  Synthetic
cggcccattcgtcttggttgat

SEQ ID NO: 20290 - DNA, 18 bp, Artificial Sequence
  Synthetic
cgttgcgcggcagcttgt

SEQ ID NO: 20291 - DNA, 19 bp, Artificial Sequence
  Synthetic
ccgggtgcaagcagggttt

SEQ ID NO: 20292 - DNA, 23 bp, Artificial Sequence
  Synthetic
gaggcaaccggcaattattatga

SEQ ID NO: 20293 - DNA, 22 bp, Artificial Sequence
  Synthetic
cgggcgttgtgtgttttgttgt

SEQ ID NO: 20294 - DNA, 21 bp, Artificial Sequence
  Synthetic
gcaggttgtcggctttgacgt

SEQ ID NO: 20295 - DNA, 20 bp, Artificial Sequence
  Synthetic
cgtacatcacgccggtcagg

SEQ ID NO: 20296 - DNA, 19 bp, Artificial Sequence
  Synthetic
cttggcaggcttcgcagcg

SEQ ID NO: 20297 - DNA, 18 bp, Artificial Sequence
  Synthetic
aaaggcagacgcggtcgc

SEQ ID NO: 20298 - DNA, 18 bp, Artificial Sequence
  Synthetic
tgggcgcgcaagaagtcg

SEQ ID NO: 20299 - DNA, 20 bp, Artificial Sequence
  Synthetic
acgtgcagcaggcggatttg

SEQ ID NO: 20300 - DNA, 20 bp, Artificial Sequence
  Synthetic
gcggtgtggcgcaggaattg

SEQ ID NO: 20301 - DNA, 21 bp, Artificial Sequence
  Synthetic
acatcggcagcatcctcgaaa

SEQ ID NO: 20302 - DNA, 19 bp, Artificial Sequence
  Synthetic
acggtttgcaggcagtcgc

SEQ ID NO: 20303 - DNA, 20 bp, Artificial Sequence
  Synthetic
ccgatgacccagaagccgac

SEQ ID NO: 20304 - DNA, 19 bp, Artificial Sequence
  Synthetic
aactcgccttcgcctgcgg

SEQ ID NO: 20305 - DNA, 22 bp, Artificial Sequence
  Synthetic
cggggaaggaaataccgatggg

SEQ ID NO: 20306 - DNA, 19 bp, Artificial Sequence
  Synthetic
tccattttggtcggcggcg

SEQ ID NO: 20307 - DNA, 22 bp, Artificial Sequence
  Synthetic
ggcgcggatgcacttgaagaag

SEQ ID NO: 20308 - DNA, 22 bp, Artificial Sequence
  Synthetic
ccagtatttcagacggccccgc

SEQ ID NO: 20309 - DNA, 21 bp, Artificial Sequence
  Synthetic
tttggcaaaaccgggcggaac

SEQ ID NO: 20310 - DNA, 22 bp, Artificial Sequence
  Synthetic
cgggcaggttgagggtgaaatc

SEQ ID NO: 20311 - DNA, 20 bp, Artificial Sequence
  Synthetic
cctgccggattgcttgtccg

SEQ ID NO: 20312 - DNA, 18 bp, Artificial Sequence
  Synthetic
cgacttcgatgccgccgt

SEQ ID NO: 20313 - DNA, 20 bp, Artificial Sequence
  Synthetic
tgccttggaacatccccatc

SEQ ID NO: 20314 - DNA, 22 bp, Artificial Sequence
  Synthetic
ggaaaggtaaaacacgacgcgc

SEQ ID NO: 20315 - DNA, 21 bp, Artificial Sequence
  Synthetic
cccaggtcttttgcgtcgtcc

SEQ ID NO: 20316 - DNA, 22 bp, Artificial Sequence
  Synthetic
ggcgtattcgagataggcgcgt

SEQ ID NO: 20317 - DNA, 22 bp, Artificial Sequence
  Synthetic
gcgggttgagggtggaaaagaa

SEQ ID NO: 20318 - DNA, 22 bp, Artificial Sequence
  Synthetic
gcacggtcgatgtatctgaccg

SEQ ID NO: 20319 - DNA, 19 bp, Artificial Sequence
  Synthetic
cggcaaggtgttcgccgag

SEQ ID NO: 20320 - DNA, 24 bp, Artificial Sequence
  Synthetic
cgggttcttgccatcaaatttaac

SEQ ID NO: 20321 - DNA, 23 bp, Artificial Sequence
  Synthetic
agttcaaaggctacacgtcaaat

SEQ ID NO: 20322 - DNA, 20 bp, Artificial Sequence
  Synthetic
acaagtaatcccgcgtcccg

SEQ ID NO: 20323 - DNA, 25 bp, Artificial Sequence
  Synthetic
ccgtccgttctaaaatttgaccaat

SEQ ID NO: 20324 - DNA, 21 bp, Artificial Sequence
  Synthetic
ggttcgggctttcacaacgga

SEQ ID NO: 20325 - DNA, 20 bp, Artificial Sequence
  Synthetic
gacttggggcttctggctgc

SEQ ID NO: 20326 - DNA, 19 bp, Artificial Sequence
  Synthetic
tatggcaatcggcgcctgc

SEQ ID NO: 20327 - DNA, 22 bp, Artificial Sequence
  Synthetic
cggctcagggattcgacaatgt

SEQ ID NO: 20328 - DNA, 22 bp, Artificial Sequence
  Synthetic
ctcgccggacaattcattgctg

SEQ ID NO: 20329 - DNA, 20 bp, Artificial Sequence
  Synthetic
gctcgggcttttaccgcgtc

SEQ ID NO: 20330 - DNA, 22 bp, Artificial Sequence
  Synthetic
acggctttttctttgggctcgg

SEQ ID NO: 20331 - DNA, 22 bp, Artificial Sequence
  Synthetic
cggatatcgagctgcacagccg

SEQ ID NO: 20332 - DNA, 20 bp, Artificial Sequence
  Synthetic
ccaccacacgccatgtcgaa

SEQ ID NO: 20333 - DNA, 19 bp, Artificial Sequence
  Synthetic
tggttcgagggcaggctgg

SEQ ID NO: 20334 - DNA, 19 bp, Artificial Sequence
  Synthetic
tggcggcaaccttcggtac

SEQ ID NO: 20335 - DNA, 20 bp, Artificial Sequence
  Synthetic
caatccctgcgtgcttcggg

SEQ ID NO: 20336 - DNA, 22 bp, Artificial Sequence
  Synthetic
tccactgcttgccctcaacaag

SEQ ID NO: 20337 - DNA, 19 bp, Artificial Sequence
  Synthetic
tcgccagcttgcctgtccg

SEQ ID NO: 20338 - DNA, 21 bp, Artificial Sequence
  Synthetic
cccgttgcgtttcggaatgcc

SEQ ID NO: 20339 - DNA, 21 bp, Artificial Sequence
  Synthetic
gttggaagtttgacgggggct

SEQ ID NO: 20340 - DNA, 25 bp, Artificial Sequence
  Synthetic
tccgttcaattgcttatttgttcaa

SEQ ID NO: 20341 - DNA, 20 bp, Artificial Sequence
  Synthetic
ctgcctgcgggaatgtcgaa

SEQ ID NO: 20342 - DNA, 22 bp, Artificial Sequence
  Synthetic
acggacagatggatcggcattt

SEQ ID NO: 20343 - DNA, 19 bp, Artificial Sequence
  Synthetic
tatgcggcggcagggcttc

SEQ ID NO: 20344 - DNA, 18 bp, Artificial Sequence
  Synthetic
tacagttccgcgccgcac

SEQ ID NO: 20345 - DNA, 21 bp, Artificial Sequence
  Synthetic
cggcttgaccacccagaactg

SEQ ID NO: 20346 - DNA, 20 bp, Artificial Sequence
  Synthetic
attgctcaacgccgcttcga

SEQ ID NO: 20347 - DNA, 19 bp, Artificial Sequence
  Synthetic
tgctcttctcgccgacagc

SEQ ID NO: 20348 - DNA, 19 bp, Artificial Sequence
  Synthetic
ggcggtcgcttcgtccaac

SEQ ID NO: 20349 - DNA, 19 bp, Artificial Sequence
  Synthetic
cgctgtgggtgtcggtcag

SEQ ID NO: 20350 - DNA, 21 bp, Artificial Sequence
  Synthetic
ggttcgatcatcagcgtgccg

SEQ ID NO: 20351 - DNA, 19 bp, Artificial Sequence
  Synthetic
cgcgagagtacggatgcgc

SEQ ID NO: 20352 - DNA, 19 bp, Artificial Sequence
  Synthetic
agacaagggtgcggcagcc

SEQ ID NO: 20353 - DNA, 19 bp, Artificial Sequence
  Synthetic
gcgcagggacgcatcgtta

SEQ ID NO: 20354 - DNA, 20 bp, Artificial Sequence
  Synthetic
ccacacaagccatcctgccc

SEQ ID NO: 20355 - DNA, 19 bp, Artificial Sequence
  Synthetic
agcgcacacccaaacctgg

SEQ ID NO: 20356 - DNA, 20 bp, Artificial Sequence
  Synthetic
aagtcatcgacaacgcggcg

SEQ ID NO: 20357 - DNA, 20 bp, Artificial Sequence
  Synthetic
tgggcttgaaagtcgtgcgc

SEQ ID NO: 20358 - DNA, 21 bp, Artificial Sequence
  Synthetic
gcctgtaccgttgccgtcatg

SEQ ID NO: 20359 - DNA, 22 bp, Artificial Sequence
  Synthetic
gcccaagcccttatcctgcaaa

SEQ ID NO: 20360 - DNA, 19 bp, Artificial Sequence
  Synthetic
tgggacgaaacccggggct

SEQ ID NO: 20361 - DNA, 19 bp, Artificial Sequence
  Synthetic
ggcggacgcgttgaaggtg

SEQ ID NO: 20362 - DNA, 18 bp, Artificial Sequence
  Synthetic
aaggcgtggctttcggcg

SEQ ID NO: 20363 - DNA, 19 bp, Artificial Sequence
  Synthetic
agccgtgcgctatacccgc

SEQ ID NO: 20364 - DNA, 20 bp, Artificial Sequence
  Synthetic
tgaatggttgtggcagcccg

SEQ ID NO: 20365 - DNA, 20 bp, Artificial Sequence
  Synthetic
cggcttgggacattgcctcc

SEQ ID NO: 20366 - DNA, 20 bp, Artificial Sequence
  Synthetic
gcggtcggacacgtcaaact

SEQ ID NO: 20367 - DNA, 18 bp, Artificial Sequence
  Synthetic
cccggtgccgtgcagatt

SEQ ID NO: 20368 - DNA, 19 bp, Artificial Sequence
  Synthetic
agccggggcggaagtttcc

SEQ ID NO: 20369 - DNA, 21 bp, Artificial Sequence
  Synthetic
gcgcagacgttttctgacggc

SEQ ID NO: 20370 - DNA, 19 bp, Artificial Sequence
  Synthetic
gccaatatcggtgcggcgc

SEQ ID NO: 20371 - DNA, 22 bp, Artificial Sequence
  Synthetic
agcagcagctacaatgtcggac

SEQ ID NO: 20372 - DNA, 20 bp, Artificial Sequence
  Synthetic
cctcgaatggggcggacagt

SEQ ID NO: 20373 - DNA, 20 bp, Artificial Sequence
  Synthetic
cgacatccgcaccgcattgg

SEQ ID NO: 20374 - DNA, 22 bp, Artificial Sequence
  Synthetic
gaccgaagaccaaggcttcgtt

SEQ ID NO: 20375 - DNA, 21 bp, Artificial Sequence
  Synthetic
ccgaaacctatatcggggcgc

SEQ ID NO: 20376 - DNA, 20 bp, Artificial Sequence
  Synthetic
ccaaacatcccgccaaaggc

SEQ ID NO: 20377 - DNA, 21 bp, Artificial Sequence
  Synthetic
ccgcttcctcgacagcgaaag

SEQ ID NO: 20378 - DNA, 21 bp, Artificial Sequence
  Synthetic
cgacggtcggagaatgggtgg

SEQ ID NO: 20379 - DNA, 21 bp, Artificial Sequence
  Synthetic
cctggaagcaggcggtagacc

SEQ ID NO: 20380 - DNA, 20 bp, Artificial Sequence
  Synthetic
gggcaacgtcatcgaagcgg

SEQ ID NO: 20381 - DNA, 20 bp, Artificial Sequence
  Synthetic
tttggggcggcaagttcgtg

SEQ ID NO: 20382 - DNA, 21 bp, Artificial Sequence
  Synthetic
gccgctattccgacgaatggc

SEQ ID NO: 20383 - DNA, 20 bp, Artificial Sequence
  Synthetic
atgcggcaggtttgatggat

SEQ ID NO: 20384 - DNA, 21 bp, Artificial Sequence
  Synthetic
gcgttttgctggcggatgtag

SEQ ID NO: 20385 - DNA, 18 bp, Artificial Sequence
  Synthetic
tcgcgcaaaagcccggag

SEQ ID NO: 20386 - DNA, 21 bp, Artificial Sequence
  Synthetic
ccgaatacgccgacaccgacg

SEQ ID NO: 20387 - DNA, 20 bp, Artificial Sequence
  Synthetic
gggcaacataagcggcggac

SEQ ID NO: 20388 - DNA, 22 bp, Artificial Sequence
  Synthetic
cgccgtctttgcctacacccat

SEQ ID NO: 20389 - DNA, 21 bp, Artificial Sequence
  Synthetic
accacggcaggttacggattg

SEQ ID NO: 20390 - DNA, 22 bp, Artificial Sequence
  Synthetic
gttccgctgattaaggccttgc

SEQ ID NO: 20391 - DNA, 18 bp, Artificial Sequence
  Synthetic
ccgaaccgtgcctgctgt

SEQ ID NO: 20392 - DNA, 19 bp, Artificial Sequence
  Synthetic
cgccgaagaacagtccggt

SEQ ID NO: 20393 - DNA, 20 bp, Artificial Sequence
  Synthetic
tggcaatgctgtcttcgcgg

SEQ ID NO: 20394 - DNA, 19 bp, Artificial Sequence
  Synthetic
ttgtccgcacgaaccgccg

SEQ ID NO: 20395 - DNA, 18 bp, Artificial Sequence
  Synthetic
gcgcgctttggcaaacga

SEQ ID NO: 20396 - DNA, 18 bp, Artificial Sequence
  Synthetic
tgcccgcgccgattttgg

SEQ ID NO: 20397 - DNA, 22 bp, Artificial Sequence
  Synthetic
acagataacctgcggcggcaaa

SEQ ID NO: 20398 - DNA, 19 bp, Artificial Sequence
  Synthetic
gccttgccgaacgcgaacg

SEQ ID NO: 20399 - DNA, 20 bp, Artificial Sequence
  Synthetic
cgtgttgcacagccggatgg

SEQ ID NO: 20400 - DNA, 19 bp, Artificial Sequence
  Synthetic
agcagcgcgtctccatcgc

SEQ ID NO: 20401 - DNA, 21 bp, Artificial Sequence
  Synthetic
cgtcgtcgccgtagacatcaa

SEQ ID NO: 20402 - DNA, 22 bp, Artificial Sequence
  Synthetic
cccttctgccttctggacgaag

SEQ ID NO: 20403 - DNA, 22 bp, Artificial Sequence
  Synthetic
ccctgatcaacgccaaacgcta

SEQ ID NO: 20404 - DNA, 19 bp, Artificial Sequence
  Synthetic
tggcggaagagcagaccgt

SEQ ID NO: 20405 - DNA, 21 bp, Artificial Sequence
  Synthetic
gcaggcggcatggctttcaga

SEQ ID NO: 20406 - DNA, 20 bp, Artificial Sequence
  Synthetic
agcaggaagccgccgacttt

SEQ ID NO: 20407 - DNA, 19 bp, Artificial Sequence
  Synthetic
cgaggcaaaccgcatccgc

SEQ ID NO: 20408 - DNA, 20 bp, Artificial Sequence
  Synthetic
ggcaaaactgcccgccacat

SEQ ID NO: 20409 - DNA, 22 bp, Artificial Sequence
  Synthetic
ggcgatttgctgctgaatcgga

SEQ ID NO: 20410 - DNA, 22 bp, Artificial Sequence
  Synthetic
gccttcttcgacttggctgtcg

SEQ ID NO: 20411 - DNA, 20 bp, Artificial Sequence
  Synthetic
tgctctacctggccgggttt

SEQ ID NO: 20412 - DNA, 22 bp, Artificial Sequence
  Synthetic
cacttgcccgcttttttgcagc

SEQ ID NO: 20413 - DNA, 22 bp, Artificial Sequence
  Synthetic
gatgttttcggggaacacggct

SEQ ID NO: 20414 - DNA, 19 bp, Artificial Sequence
  Synthetic
cggtcatcagggcggtgtc

SEQ ID NO: 20415 - DNA, 21 bp, Artificial Sequence
  Synthetic
gtaggtctcggtgtcatcgcc

SEQ ID NO: 20416 - DNA, 20 bp, Artificial Sequence
  Synthetic
acgtgattgccgaacagggc

SEQ ID NO: 20417 - DNA, 20 bp, Artificial Sequence
  Synthetic
aaagcaggtgccaaccgctt

SEQ ID NO: 20418 - DNA, 18 bp, Artificial Sequence
  Synthetic
acgccaccgacaccacca

SEQ ID NO: 20419 - DNA, 21 bp, Artificial Sequence
  Synthetic
ccgccgcgaaaaactggaaac

SEQ ID NO: 20420 - DNA, 21 bp, Artificial Sequence
  Synthetic
cggcgtatcgctcaaaatgcc

SEQ ID NO: 20421 - DNA, 18 bp, Artificial Sequence
  Synthetic
tgccgccgcattgctgac

SEQ ID NO: 20422 - DNA, 19 bp, Artificial Sequence
  Synthetic
caaaccgaaagcgcgggcc

SEQ ID NO: 20423 - DNA, 20 bp, Artificial Sequence
  Synthetic
ggcacaccaaaaatcatggc

SEQ ID NO: 20424 - DNA, 22 bp, Artificial Sequence
  Synthetic
gctgctgattatctgccgtaaa

SEQ ID NO: 20425 - DNA, 21 bp, Artificial Sequence
  Synthetic
cggtgtgccattggtagattt

SEQ ID NO: 20426 - DNA, 23 bp, Artificial Sequence
  Synthetic
gtcccacaattcaaaaccgtctt

SEQ ID NO: 20427 - DNA, 25 bp, Artificial Sequence
  Synthetic
ggctgtttttcaggttgcttaattt

SEQ ID NO: 20428 - DNA, 21 bp, Artificial Sequence
  Synthetic
tttgagcttgtcagcagccga

SEQ ID NO: 20429 - DNA, 23 bp, Artificial Sequence
  Synthetic
tgccaaacaccgacataatcatc

SEQ ID NO: 20430 - DNA, 25 bp, Artificial Sequence
  Synthetic
cgcttgtttacgagttttcaaacaa

SEQ ID NO: 20431 - DNA, 20 bp, Artificial Sequence
  Synthetic
gccctgccacaaacagattt

SEQ ID NO: 20432 - DNA, 24 bp, Artificial Sequence
  Synthetic
gtggcaatgaatggaatattgtcc

SEQ ID NO: 20433 - DNA, 21 bp, Artificial Sequence
  Synthetic
agactgttcccgataactcgc

SEQ ID NO: 20434 - DNA, 25 bp, Artificial Sequence
  Synthetic
gccttaatccaacaaaaaatgacga

SEQ ID NO: 20435 - DNA, 21 bp, Artificial Sequence
  Synthetic
agcgcgttattgttcaacagc

SEQ ID NO: 20436 - DNA, 22 bp, Artificial Sequence
  Synthetic
gtcggtgtgattgccgccatta

SEQ ID NO: 20437 - DNA, 19 bp, Artificial Sequence
  Synthetic
tatcgacctgcgccgccct

SEQ ID NO: 20438 - DNA, 24 bp, Artificial Sequence
  Synthetic
cagaaatcggttattgacgaagtg

SEQ ID NO: 20439 - DNA, 18 bp, Artificial Sequence
  Synthetic
tgcggtgatgtcggcagg

SEQ ID NO: 20440 - DNA, 19 bp, Artificial Sequence
  Synthetic
ggcgcgtaccgttttggca

SEQ ID NO: 20441 - DNA, 19 bp, Artificial Sequence
  Synthetic
gcgtcggcgtggatggaga

SEQ ID NO: 20442 - DNA, 22 bp, Artificial Sequence
  Synthetic
gcttctcttcggcaggattgga

SEQ ID NO: 20443 - DNA, 19 bp, Artificial Sequence
  Synthetic
aggtcgaggcgggcgaaac

SEQ ID NO: 20444 - DNA, 19 bp, Artificial Sequence
  Synthetic
cgacgcattgggcaagccc

SEQ ID NO: 20445 - DNA, 22 bp, Artificial Sequence
  Synthetic
acgccgaacaaatcaggcagtt

SEQ ID NO: 20446 - DNA, 19 bp, Artificial Sequence
  Synthetic
atggatgggcggatggcgg

SEQ ID NO: 20447 - DNA, 22 bp, Artificial Sequence
  Synthetic
gcggcaatcaagcatttcggac

SEQ ID NO: 20448 - DNA, 19 bp, Artificial Sequence
  Synthetic
tgcccccgttttggctgcc

SEQ ID NO: 20449 - DNA, 22 bp, Artificial Sequence
  Synthetic
cgcaccggcattcacatctgtt

SEQ ID NO: 20450 - DNA, 22 bp, Artificial Sequence
  Synthetic
tcttgatgggcgtcttgcgtat

SEQ ID NO: 20451 - DNA, 21 bp, Artificial Sequence
  Synthetic
cggggaatcagaagcggtagc

SEQ ID NO: 20452 - DNA, 18 bp, Artificial Sequence
  Synthetic
acgcggggtttgggcaac

SEQ ID NO: 20453 - DNA, 20 bp, Artificial Sequence
  Synthetic
cccaaagccgttcccgttgc

SEQ ID NO: 20454 - DNA, 22 bp, Artificial Sequence
  Synthetic
acacgccgtcgatttggtgatt

SEQ ID NO: 20455 - DNA, 19 bp, Artificial Sequence
  Synthetic
tttcccggcctgcccaacg

SEQ ID NO: 20456 - DNA, 20 bp, Artificial Sequence
  Synthetic
gaagtgcgcttcgggcatcc

SEQ ID NO: 20457 - DNA, 20 bp, Artificial Sequence
  Synthetic
ccgattacaccgcctccagc

SEQ ID NO: 20458 - DNA, 18 bp, Artificial Sequence
  Synthetic
tgcgtccgccggcgattt

SEQ ID NO: 20459 - DNA, 22 bp, Artificial Sequence
  Synthetic
ccaaatgcctgacggtgcagtg

SEQ ID NO: 20460 - DNA, 21 bp, Artificial Sequence
  Synthetic
tcgaatttttcggcgagggcg

SEQ ID NO: 20461 - DNA, 20 bp, Artificial Sequence
  Synthetic
gcggtttggaagcggaaacc

SEQ ID NO: 20462 - DNA, 22 bp, Artificial Sequence
  Synthetic
cccgatacggttgaggtcgtcc

SEQ ID NO: 20463 - DNA, 22 bp, Artificial Sequence
  Synthetic
gcgacatcaagttgccaaacgg

SEQ ID NO: 20464 - DNA, 19 bp, Artificial Sequence
  Synthetic
tcgggcgcggagagtggtt

SEQ ID NO: 20465 - DNA, 18 bp, Artificial Sequence
  Synthetic
gatgcgccgcaaatccgc

SEQ ID NO: 20466 - DNA, 16 bp, Artificial Sequence
  Synthetic
aaaacggcgggcgcgt

SEQ ID NO: 20467 - DNA, 21 bp, Artificial Sequence
  Synthetic
ccgcaaacccacctcgtcaaa

SEQ ID NO: 20468 - DNA, 22 bp, Artificial Sequence
  Synthetic
tgagtttgaacgatgtggcgga

SEQ ID NO: 20469 - DNA, 22 bp, Artificial Sequence
  Synthetic
gggcgcggataaagtcgtcgta

SEQ ID NO: 20470 - DNA, 20 bp, Artificial Sequence
  Synthetic
ccgtcaacaaggcgcaacag

SEQ ID NO: 20471 - DNA, 18 bp, Artificial Sequence
  Synthetic
agcgaacagcggcgcaac

SEQ ID NO: 20472 - DNA, 21 bp, Artificial Sequence
  Synthetic
gcacacgtcatcggatttacc

SEQ ID NO: 20473 - DNA, 22 bp, Artificial Sequence
  Synthetic
gcgcacacgaattaagcatcga

SEQ ID NO: 20474 - DNA, 21 bp, Artificial Sequence
  Synthetic
tgaagaaaaggcgggcgagcc

SEQ ID NO: 20475 - DNA, 22 bp, Artificial Sequence
  Synthetic
tgccgtctgaaacacattaagg

SEQ ID NO: 20476 - DNA, 22 bp, Artificial Sequence
  Synthetic
ccgttttggaacgcgtcatcgc

SEQ ID NO: 20477 - DNA, 21 bp, Artificial Sequence
  Synthetic
cggaaatgccgttgccttcgt

SEQ ID NO: 20478 - DNA, 19 bp, Artificial Sequence
  Synthetic
tcgcgcacttcggcaatgg

SEQ ID NO: 20479 - DNA, 21 bp, Artificial Sequence
  Synthetic
ggtttgttcggcaggtttggc

SEQ ID NO: 20480 - DNA, 19 bp, Artificial Sequence
  Synthetic
gttgatcaggcgcgccact

SEQ ID NO: 20481 - DNA, 20 bp, Artificial Sequence
  Synthetic
ccgagtaggaagccagcggg

SEQ ID NO: 20482 - DNA, 21 bp, Artificial Sequence
  Synthetic
tccccagttgtggtagcggta

SEQ ID NO: 20483 - DNA, 19 bp, Artificial Sequence
  Synthetic
tgccgctgtgggtcagtgc

SEQ ID NO: 20484 - DNA, 20 bp, Artificial Sequence
  Synthetic
gctgccggtggcgaaggtaa

SEQ ID NO: 20485 - DNA, 22 bp, Artificial Sequence
  Synthetic
cctcgcctttcagacgatggat

SEQ ID NO: 20486 - DNA, 20 bp, Artificial Sequence
  Synthetic
ggcggcttcgtcgcacaaac

SEQ ID NO: 20487 - DNA, 19 bp, Artificial Sequence
  Synthetic
tgccgacggacgaacgctg

SEQ ID NO: 20488 - DNA, 19 bp, Artificial Sequence
  Synthetic
cgcacgcgaacagggcttg

SEQ ID NO: 20489 - DNA, 18 bp, Artificial Sequence
  Synthetic
attgccgccgcccaacaa

SEQ ID NO: 20490 - DNA, 21 bp, Artificial Sequence
  Synthetic
tgtttgtgctggcgtttgtgc

SEQ ID NO: 20491 - DNA, 22 bp, Artificial Sequence
  Synthetic
gaacaaaagctgctccgtcccg

SEQ ID NO: 20492 - DNA, 22 bp, Artificial Sequence
  Synthetic
tctcaatctgcaggtgctgaaa

SEQ ID NO: 20493 - DNA, 20 bp, Artificial Sequence
  Synthetic
gtctgtgcctgtgtcctgca

SEQ ID NO: 20494 - DNA, 20 bp, Artificial Sequence
  Synthetic
ggcaatcccgccgatgttca

SEQ ID NO: 20495 - DNA, 19 bp, Artificial Sequence
  Synthetic
cggagagcgcgtcggattt

SEQ ID NO: 20496 - DNA, 22 bp, Artificial Sequence
  Synthetic
cacagtttcggcaaggctttcc

SEQ ID NO: 20497 - DNA, 20 bp, Artificial Sequence
  Synthetic
cgtattgaccgcaccggcag

SEQ ID NO: 20498 - DNA, 19 bp, Artificial Sequence
  Synthetic
ctgggtgtcggctacctgc

SEQ ID NO: 20499 - DNA, 19 bp, Artificial Sequence
  Synthetic
gcaaccatggcctcgaccg

SEQ ID NO: 20500 - DNA, 22 bp, Artificial Sequence
  Synthetic
ggcaggcactttaatcatggcg

SEQ ID NO: 20501 - DNA, 22 bp, Artificial Sequence
  Synthetic
ggcgacaacttggatatgggca

SEQ ID NO: 20502 - DNA, 20 bp, Artificial Sequence
  Synthetic
aaaagctgcacgcggtttgc

SEQ ID NO: 20503 - DNA, 22 bp, Artificial Sequence
  Synthetic
cgggcgaggttttgggtgtaac

SEQ ID NO: 20504 - DNA, 20 bp, Artificial Sequence
  Synthetic
cgcccaaacactgctgcaaa

SEQ ID NO: 20505 - DNA, 22 bp, Artificial Sequence
  Synthetic
ttggtgcaacgcctctacacat

SEQ ID NO: 20506 - DNA, 22 bp, Artificial Sequence
  Synthetic
acggctacaacgaggtcaacct

SEQ ID NO: 20507 - DNA, 20 bp, Artificial Sequence
  Synthetic
ccgacggataagcgacgtgc

SEQ ID NO: 20508 - DNA, 21 bp, Artificial Sequence
  Synthetic
tatgcgggctttttccacgcc

SEQ ID NO: 20509 - DNA, 19 bp, Artificial Sequence
  Synthetic
tggacgcttggcaaccggc

SEQ ID NO: 20510 - DNA, 21 bp, Artificial Sequence
  Synthetic
gcgaatgtctgccatgttcgg

SEQ ID NO: 20511 - DNA, 19 bp, Artificial Sequence
  Synthetic
cgctcctgaccgccctgtt

SEQ ID NO: 20512 - DNA, 22 bp, Artificial Sequence
  Synthetic
gtacaagtaatcccgcgtcccg

SEQ ID NO: 20513 - DNA, 19 bp, Artificial Sequence
  Synthetic
ccgacaaacaggccgcacc

SEQ ID NO: 20514 - DNA, 19 bp, Artificial Sequence
  Synthetic
agggccgcaccaaatcggc

SEQ ID NO: 20515 - DNA, 23 bp, Artificial Sequence
  Synthetic
gccattaaaagaccagggcattc

SEQ ID NO: 20516 - DNA, 22 bp, Artificial Sequence
  Synthetic
tgctgattgtcgtattcggcgg

SEQ ID NO: 20517 - DNA, 20 bp, Artificial Sequence
  Synthetic
agtcgcgcatgtgcctgaaa

SEQ ID NO: 20518 - DNA, 22 bp, Artificial Sequence
  Synthetic
ggaagaaacggcaatgacggct

SEQ ID NO: 20519 - DNA, 21 bp, Artificial Sequence
  Synthetic
gtggacgatgcctacgaagcc

SEQ ID NO: 20520 - DNA, 21 bp, Artificial Sequence
  Synthetic
tgccgcaactgccacttcaaa

SEQ ID NO: 20521 - DNA, 20 bp, Artificial Sequence
  Synthetic
caggttcggtcgtcgtgtcc

SEQ ID NO: 20522 - DNA, 22 bp, Artificial Sequence
  Synthetic
gccgcacccaccatcattgaag

SEQ ID NO: 20523 - DNA, 19 bp, Artificial Sequence
  Synthetic
ggtgggcggacgctattcc

SEQ ID NO: 20524 - DNA, 20 bp, Artificial Sequence
  Synthetic
cgctgcatacggctttgcgc

SEQ ID NO: 20525 - DNA, 19 bp, Artificial Sequence
  Synthetic
ccgattccgccggtcagtc

SEQ ID NO: 20526 - DNA, 24 bp, Artificial Sequence
  Synthetic
ccgcgtacatactcaactccataa

SEQ ID NO: 20527 - DNA, 20 bp, Artificial Sequence
  Synthetic
cccgaggttgaagccgtgtg

SEQ ID NO: 20528 - DNA, 19 bp, Artificial Sequence
  Synthetic
gcacacatggcggctgcac

SEQ ID NO: 20529 - DNA, 21 bp, Artificial Sequence
  Synthetic
cgaaaagcgtgccgccttgtg

SEQ ID NO: 20530 - DNA, 21 bp, Artificial Sequence
  Synthetic
gcgttcttcccactgctgcaa

SEQ ID NO: 20531 - DNA, 25 bp, Artificial Sequence
  Synthetic
gcttgaaaaaacgtgttttaaggga

SEQ ID NO: 20532 - DNA, 22 bp, Artificial Sequence
  Synthetic
cggaaaaaatgtcggggatggc

SEQ ID NO: 20533 - DNA, 20 bp, Artificial Sequence
  Synthetic
cctgtccggcatccagacag

SEQ ID NO: 20534 - DNA, 22 bp, Artificial Sequence
  Synthetic
cgcatcatcagcgtgttgtcgg

SEQ ID NO: 20535 - DNA, 22 bp, Artificial Sequence
  Synthetic
ggcagaaaaaatccgcgctcaa

SEQ ID NO: 20536 - DNA, 19 bp, Artificial Sequence
  Synthetic
cgaagtcagcaccgcgcct

SEQ ID NO: 20537 - DNA, 19 bp, Artificial Sequence
  Synthetic
gccattcgatgacggcggc

SEQ ID NO: 20538 - DNA, 19 bp, Artificial Sequence
  Synthetic
ttgccgccgcgttgttcta

SEQ ID NO: 20539 - DNA, 20 bp, Artificial Sequence
  Synthetic
tttgagtgccgacgagaacc

SEQ ID NO: 20540 - DNA, 22 bp, Artificial Sequence
  Synthetic
gccgccgatttggatgtcactt

SEQ ID NO: 20541 - DNA, 22 bp, Artificial Sequence
  Synthetic
cgtcatcctgcccaaacttgcc

SEQ ID NO: 20542 - DNA, 21 bp, Artificial Sequence
  Synthetic
tcggtagggctgaacattgcc

SEQ ID NO: 20543 - DNA, 21 bp, Artificial Sequence
  Synthetic
gctcaaacccggacaggtcgg

SEQ ID NO: 20544 - DNA, 20 bp, Artificial Sequence
  Synthetic
cggcgcggaaagtaccatcc

SEQ ID NO: 20545 - DNA, 22 bp, Artificial Sequence
  Synthetic
cattgccgaaaaagtccgccag

SEQ ID NO: 20546 - DNA, 19 bp, Artificial Sequence
  Synthetic
gtcaaagctgccgccacgg

SEQ ID NO: 20547 - DNA, 18 bp, Artificial Sequence
  Synthetic
accgaacaaggcggacgg

SEQ ID NO: 20548 - DNA, 19 bp, Artificial Sequence
  Synthetic
accctcggttcgacctgcc

SEQ ID NO: 20549 - DNA, 20 bp, Artificial Sequence
  Synthetic
tttgcaccctgcggcaaatg

SEQ ID NO: 20550 - DNA, 22 bp, Artificial Sequence
  Synthetic
cggtgtttgccgcgtatcgaat

SEQ ID NO: 20551 - DNA, 22 bp, Artificial Sequence
  Synthetic
gctttcgtcggagaggacggta

SEQ ID NO: 20552 - DNA, 21 bp, Artificial Sequence
  Synthetic
gctccctgcttagcggaacgg

SEQ ID NO: 20553 - DNA, 19 bp, Artificial Sequence
  Synthetic
gcgtttccggcccgaacag

SEQ ID NO: 20554 - DNA, 19 bp, Artificial Sequence
  Synthetic
gggcggcggtaaaggcgtt

SEQ ID NO: 20555 - DNA, 19 bp, Artificial Sequence
  Synthetic
tcttctgcaaccgcccgcg

SEQ ID NO: 20556 - DNA, 19 bp, Artificial Sequence
  Synthetic
ccattgccgccagttccca

SEQ ID NO: 20557 - DNA, 18 bp, Artificial Sequence
  Synthetic
tttgggcgcgcaccgtaa

SEQ ID NO: 20558 - DNA, 20 bp, Artificial Sequence
  Synthetic
ctgccactcgacgtgttcgc

SEQ ID NO: 20559 - DNA, 22 bp, Artificial Sequence
  Synthetic
cgttttttgcgggtgctggctt

SEQ ID NO: 20560 - DNA, 18 bp, Artificial Sequence
  Synthetic
agctggcggcaggtttcg

SEQ ID NO: 20561 - DNA, 22 bp, Artificial Sequence
  Synthetic
cgccattacctacgcgctgatg

SEQ ID NO: 20562 - DNA, 19 bp, Artificial Sequence
  Synthetic
gcattacggcgcgttggca

SEQ ID NO: 20563 - DNA, 20 bp, Artificial Sequence
  Synthetic
atcggcacaattcccgctgc

SEQ ID NO: 20564 - DNA, 20 bp, Artificial Sequence
  Synthetic
gacggaaggggagggcaaag

SEQ ID NO: 20565 - DNA, 22 bp, Artificial Sequence
  Synthetic
agcgcgatgatttggatgctga

SEQ ID NO: 20566 - DNA, 20 bp, Artificial Sequence
  Synthetic
aggggagggcgttcagacgg

SEQ ID NO: 20567 - DNA, 19 bp, Artificial Sequence
  Synthetic
tttccgcacacgcccagcc

SEQ ID NO: 20568 - DNA, 21 bp, Artificial Sequence
  Synthetic
ccgtgcgcgaaaaaagcaacc

SEQ ID NO: 20569 - DNA, 19 bp, Artificial Sequence
  Synthetic
agtccggatgccaagccgc

SEQ ID NO: 20570 - DNA, 18 bp, Artificial Sequence
  Synthetic
gtgtgggcggcgttgttg

SEQ ID NO: 20571 - DNA, 22 bp, Artificial Sequence
  Synthetic
tgtgtaatcacgatgccgccga

SEQ ID NO: 20572 - DNA, 20 bp, Artificial Sequence
  Synthetic
gcgggattggtttcggtggg

SEQ ID NO: 20573 - DNA, 20 bp, Artificial Sequence
  Synthetic
gcatattggtgcgcggatcg

SEQ ID NO: 20574 - DNA, 20 bp, Artificial Sequence
  Synthetic
gcttcggtctcggaagcagg

SEQ ID NO: 20575 - DNA, 20 bp, Artificial Sequence
  Synthetic
gtcccaaaactggctgccca

SEQ ID NO: 20576 - DNA, 21 bp, Artificial Sequence
  Synthetic
caagaaatcctcgccgtcggc

SEQ ID NO: 20577 - DNA, 18 bp, Artificial Sequence
  Synthetic
tccacgaaaccggccacg

SEQ ID NO: 20578 - DNA, 19 bp, Artificial Sequence
  Synthetic
ggcatcaccgaacgcgtcg

SEQ ID NO: 20579 - DNA, 22 bp, Artificial Sequence
  Synthetic
ccgccggagattttgtagctgt

SEQ ID NO: 20580 - DNA, 20 bp, Artificial Sequence
  Synthetic
cgttggtcggggcggtaacg

SEQ ID NO: 20581 - DNA, 19 bp, Artificial Sequence
  Synthetic
acgccgacttcgccctgac

SEQ ID NO: 20582 - DNA, 18 bp, Artificial Sequence
  Synthetic
gggctttttcggcggcga

SEQ ID NO: 20583 - DNA, 21 bp, Artificial Sequence
  Synthetic
gcttccgatggcggcttacgg

SEQ ID NO: 20584 - DNA, 19 bp, Artificial Sequence
  Synthetic
agacggagttggggcagcc

SEQ ID NO: 20585 - DNA, 21 bp, Artificial Sequence
  Synthetic
tgcgttcgttgcgtttgaggt

SEQ ID NO: 20586 - DNA, 21 bp, Artificial Sequence
  Synthetic
cggaagttgtcgcgcattgtg

SEQ ID NO: 20587 - DNA, 21 bp, Artificial Sequence
  Synthetic
ggtcatccgatggcacagctt

SEQ ID NO: 20588 - DNA, 19 bp, Artificial Sequence
  Synthetic
cgcgtgcgtttgaggtggt

SEQ ID NO: 20589 - DNA, 21 bp, Artificial Sequence
  Synthetic
ccaaagcgggtttcaggcgtt

SEQ ID NO: 20590 - DNA, 21 bp, Artificial Sequence
  Synthetic
caggaaggtggcgacatcgac

SEQ ID NO: 20591 - DNA, 17 bp, Artificial Sequence
  Synthetic
tcgttgcggctgccgtt

SEQ ID NO: 20592 - DNA, 20 bp, Artificial Sequence
  Synthetic
agcggatcggcaatgctgac

SEQ ID NO: 20593 - DNA, 19 bp, Artificial Sequence
  Synthetic
ttcccgtgcctgttccgcc

SEQ ID NO: 20594 - DNA, 19 bp, Artificial Sequence
  Synthetic
accgcgctcgatttggcgg

SEQ ID NO: 20595 - DNA, 22 bp, Artificial Sequence
  Synthetic
ccgatgtggattttgccggaca

SEQ ID NO: 20596 - DNA, 22 bp, Artificial Sequence
  Synthetic
cggcgtaacaaatcgtgcaggt

SEQ ID NO: 20597 - DNA, 18 bp, Artificial Sequence
  Synthetic
acgctgtgctgggtgcga

SEQ ID NO: 20598 - DNA, 22 bp, Artificial Sequence
  Synthetic
gacggtaaatttggcggcttcg

SEQ ID NO: 20599 - DNA, 20 bp, Artificial Sequence
  Synthetic
gcgccgatgaggacgttcat

SEQ ID NO: 20600 - DNA, 22 bp, Artificial Sequence
  Synthetic
gaccatgcgtgcgttgatttgg

SEQ ID NO: 20601 - DNA, 19 bp, Artificial Sequence
  Synthetic
gccggatttcgctgccgtt

SEQ ID NO: 20602 - DNA, 22 bp, Artificial Sequence
  Synthetic
cgcatattggtgctgagccaga

SEQ ID NO: 20603 - DNA, 21 bp, Artificial Sequence
  Synthetic
cgcggatggctttctcgactt

SEQ ID NO: 20604 - DNA, 19 bp, Artificial Sequence
  Synthetic
tgccgctgaaatacgcgca

SEQ ID NO: 20605 - DNA, 22 bp, Artificial Sequence
  Synthetic
cgactttgacgggcaggtagtt

SEQ ID NO: 20606 - DNA, 20 bp, Artificial Sequence
  Synthetic
cgatgtgtccgaccgtaccg

SEQ ID NO: 20607 - DNA, 19 bp, Artificial Sequence
  Synthetic
accactgcagtcgccacgc

SEQ ID NO: 20608 - DNA, 21 bp, Artificial Sequence
  Synthetic
tcgtgaaatactcgcgcgtcc

SEQ ID NO: 20609 - DNA, 19 bp, Artificial Sequence
  Synthetic
gtttcggggaaacgggcga

SEQ ID NO: 20610 - DNA, 25 bp, Artificial Sequence
  Synthetic
gctactcgtgctaaattgatttgtg

SEQ ID NO: 20611 - DNA, 23 bp, Artificial Sequence
  Synthetic
ggagttaaccatggctgaacaaa

SEQ ID NO: 20612 - DNA, 20 bp, Artificial Sequence
  Synthetic
agctgctgttcggtgttcaa

SEQ ID NO: 20613 - DNA, 25 bp, Artificial Sequence
  Synthetic
gcaaacagatttaaggcaaaacaac

SEQ ID NO: 20614 - DNA, 19 bp, Artificial Sequence
  Synthetic
aaagcctcgccctcctgcc

SEQ ID NO: 20615 - DNA, 20 bp, Artificial Sequence
  Synthetic
cggttacctgacccgtcgtc

SEQ ID NO: 20616 - DNA, 21 bp, Artificial Sequence
  Synthetic
caacctctgggcggtaaagct

SEQ ID NO: 20617 - DNA, 22 bp, Artificial Sequence
  Synthetic
cgataccgatgccgtctgaacc

SEQ ID NO: 20618 - DNA, 19 bp, Artificial Sequence
  Synthetic
ggcagaaatggggcgcgaa

SEQ ID NO: 20619 - DNA, 22 bp, Artificial Sequence
  Synthetic
cgtgcgggttcgactttaacct

SEQ ID NO: 20620 - DNA, 20 bp, Artificial Sequence
  Synthetic
gcaaaaagaagccgcgtggg

SEQ ID NO: 20621 - DNA, 20 bp, Artificial Sequence
  Synthetic
ccagcggctgtatcgaacgg

SEQ ID NO: 20622 - DNA, 19 bp, Artificial Sequence
  Synthetic
tgtgggagtgggcgaacgc

SEQ ID NO: 20623 - DNA, 21 bp, Artificial Sequence
  Synthetic
ggcggtttcggcggaacacat

SEQ ID NO: 20624 - DNA, 19 bp, Artificial Sequence
  Synthetic
gtcgtggtcggtgctggtt

SEQ ID NO: 20625 - DNA, 18 bp, Artificial Sequence
  Synthetic
gcgcgcggtcgttgatgt

SEQ ID NO: 20626 - DNA, 25 bp, Artificial Sequence
  Synthetic
gctttctgttgaaatggagtctgat

SEQ ID NO: 20627 - DNA, 18 bp, Artificial Sequence
  Synthetic
acgtggtgaaagccggcg

SEQ ID NO: 20628 - DNA, 19 bp, Artificial Sequence
  Synthetic
atccatcggcgtggggcag

SEQ ID NO: 20629 - DNA, 20 bp, Artificial Sequence
  Synthetic
ggaatgcccgaaagcagcct

SEQ ID NO: 20630 - DNA, 20 bp, Artificial Sequence
  Synthetic
ggctggacgatacgcagctg

SEQ ID NO: 20631 - DNA, 22 bp, Artificial Sequence
  Synthetic
tgcgatgaagctgtggaaggaa

SEQ ID NO: 20632 - DNA, 21 bp, Artificial Sequence
  Synthetic
cgaccttggacggcaaagtca

SEQ ID NO: 20633 - DNA, 20 bp, Artificial Sequence
  Synthetic
aaagcccttccttcgacagc

SEQ ID NO: 20634 - DNA, 19 bp, Artificial Sequence
  Synthetic
cagccgttacctcggggga

SEQ ID NO: 20635 - DNA, 22 bp, Artificial Sequence
  Synthetic
tccacgatacggtcgacggttt

SEQ ID NO: 20636 - DNA, 21 bp, Artificial Sequence
  Synthetic
ccatactttccctgctgcgga

SEQ ID NO: 20637 - DNA, 19 bp, Artificial Sequence
  Synthetic
gggttcgcctagctgccag

SEQ ID NO: 20638 - DNA, 21 bp, Artificial Sequence
  Synthetic
aggatgatggcggtgctgtac

SEQ ID NO: 20639 - DNA, 19 bp, Artificial Sequence
  Synthetic
ggtggcggatgtcgggact

SEQ ID NO: 20640 - DNA, 21 bp, Artificial Sequence
  Synthetic
acgcctgattcgaggttcagc

SEQ ID NO: 20641 - DNA, 19 bp, Artificial Sequence
  Synthetic
agtacggtgccggcgatgc

SEQ ID NO: 20642 - DNA, 21 bp, Artificial Sequence
  Synthetic
ggagatgtagccggtcagggc

SEQ ID NO: 20643 - DNA, 19 bp, Artificial Sequence
  Synthetic
tgcggagggtgccgagttc

SEQ ID NO: 20644 - DNA, 19 bp, Artificial Sequence
  Synthetic
ttccctttgagccggggcg

SEQ ID NO: 20645 - DNA, 22 bp, Artificial Sequence
  Synthetic
cgcgctgttctttgaacgacga

SEQ ID NO: 20646 - DNA, 20 bp, Artificial Sequence
  Synthetic
atcaatacgccggcgcaggc

SEQ ID NO: 20647 - DNA, 21 bp, Artificial Sequence
  Synthetic
ggcaacgtcggcgatgtcttt

SEQ ID NO: 20648 - DNA, 21 bp, Artificial Sequence
  Synthetic
cttcggcacactgcttaccct

SEQ ID NO: 20649 - DNA, 22 bp, Artificial Sequence
  Synthetic
ggcttcgttggggatggagatt

SEQ ID NO: 20650 - DNA, 20 bp, Artificial Sequence
  Synthetic
tttccccgaaaccctgccag

SEQ ID NO: 20651 - DNA, 19 bp, Artificial Sequence
  Synthetic
aagtcggcgcgggcaaagg

SEQ ID NO: 20652 - DNA, 20 bp, Artificial Sequence
  Synthetic
tccacaggtttgttcaagcc

SEQ ID NO: 20653 - DNA, 20 bp, Artificial Sequence
  Synthetic
tctgcaatctgttccgcacg

SEQ ID NO: 20654 - DNA, 21 bp, Artificial Sequence
  Synthetic
gcctgttttaatcggatcggt

SEQ ID NO: 20655 - DNA, 25 bp, Artificial Sequence
  Synthetic
cctttttttcaaatgcgccaactta

SEQ ID NO: 20656 - DNA, 20 bp, Artificial Sequence
  Synthetic
ccgtcggcatcaccctcatc

SEQ ID NO: 20657 - DNA, 21 bp, Artificial Sequence
  Synthetic
gcgcggtgttcgacaaatacc

SEQ ID NO: 20658 - DNA, 20 bp, Artificial Sequence
  Synthetic
agcctcccttcccgacttgg

SEQ ID NO: 20659 - DNA, 21 bp, Artificial Sequence
  Synthetic
cgggcaggctttgggtttgaa

SEQ ID NO: 20660 - DNA, 19 bp, Artificial Sequence
  Synthetic
tcaagggcggccgcctttc

SEQ ID NO: 20661 - DNA, 22 bp, Artificial Sequence
  Synthetic
agctgtttaaagaccgcctgct

SEQ ID NO: 20662 - DNA, 20 bp, Artificial Sequence
  Synthetic
aaatcccgtcctggttcggc

SEQ ID NO: 20663 - DNA, 22 bp, Artificial Sequence
  Synthetic
cgcgcaggttatttcttcacgc

SEQ ID NO: 20664 - DNA, 21 bp, Artificial Sequence
  Synthetic
cccggctcggatgtcgatttg

SEQ ID NO: 20665 - DNA, 19 bp, Artificial Sequence
  Synthetic
tttcggcagcaccccttcc

SEQ ID NO: 20666 - DNA, 23 bp, Artificial Sequence
  Synthetic
tgatggagcacctactagtatgg

SEQ ID NO: 20667 - DNA, 19 bp, Artificial Sequence
  Synthetic
caaaccgcctcgcgcaaac

SEQ ID NO: 20668 - DNA, 21 bp, Artificial Sequence
  Synthetic
ccagcaggttgccgaaaatgc

SEQ ID NO: 20669 - DNA, 20 bp, Artificial Sequence
  Synthetic
cccaacccgaacaccaccac

SEQ ID NO: 20670 - DNA, 22 bp, Artificial Sequence
  Synthetic
tgcgccaaaacaaccaaaccaa

SEQ ID NO: 20671 - DNA, 19 bp, Artificial Sequence
  Synthetic
gcaccgcccgcattcagga

SEQ ID NO: 20672 - DNA, 19 bp, Artificial Sequence
  Synthetic
ctttggcgaggcagacgcg

SEQ ID NO: 20673 - DNA, 19 bp, Artificial Sequence
  Synthetic
gggtggatttgccggcgtt

SEQ ID NO: 20674 - DNA, 21 bp, Artificial Sequence
  Synthetic
gtgtttgaggaagcggtggcc

SEQ ID NO: 20675 - DNA, 21 bp, Artificial Sequence
  Synthetic
cgcggttgctccaccatgtat

SEQ ID NO: 20676 - DNA, 19 bp, Artificial Sequence
  Synthetic
gcggcgaatacatcagcgc

SEQ ID NO: 20677 - DNA, 20 bp, Artificial Sequence
  Synthetic
gcgggcgcgaaaaatatgcg

SEQ ID NO: 20678 - DNA, 19 bp, Artificial Sequence
  Synthetic
aagttgccgccgccgatat

SEQ ID NO: 20679 - DNA, 20 bp, Artificial Sequence
  Synthetic
cgttgagctgctgcggcttc

SEQ ID NO: 20680 - DNA, 22 bp, Artificial Sequence
  Synthetic
agcgaacccaactcatactgcg

SEQ ID NO: 20681 - DNA, 21 bp, Artificial Sequence
  Synthetic
cacggaaaccgacctgtcgtc

SEQ ID NO: 20682 - DNA, 19 bp, Artificial Sequence
  Synthetic
tatgcgccccgccgaatcc

SEQ ID NO: 20683 - DNA, 22 bp, Artificial Sequence
  Synthetic
caaacacggcaggcttctttcc

SEQ ID NO: 20684 - DNA, 19 bp, Artificial Sequence
  Synthetic
acaccgccgtctcacgcag

SEQ ID NO: 20685 - DNA, 19 bp, Artificial Sequence
  Synthetic
accccggctacatcgccag

SEQ ID NO: 20686 - DNA, 19 bp, Artificial Sequence
  Synthetic
atcccccgagcacaccagc

SEQ ID NO: 20687 - DNA, 19 bp, Artificial Sequence
  Synthetic
tgcaggaaaacggcagcct

SEQ ID NO: 20688 - DNA, 19 bp, Artificial Sequence
  Synthetic
tttcctggctgccgctggc

SEQ ID NO: 20689 - DNA, 18 bp, Artificial Sequence
  Synthetic
cagcacgggtacgctgct

SEQ ID NO: 20690 - DNA, 22 bp, Artificial Sequence
  Synthetic
ccagacgggcgaggtaaaccat

SEQ ID NO: 20691 - DNA, 20 bp, Artificial Sequence
  Synthetic
cgcggataggcgtttttgcg

SEQ ID NO: 20692 - DNA, 20 bp, Artificial Sequence
  Synthetic
ctgccgagcaggtctttggc

SEQ ID NO: 20693 - DNA, 22 bp, Artificial Sequence
  Synthetic
gccatacctttgctgttgccga

SEQ ID NO: 20694 - DNA, 18 bp, Artificial Sequence
  Synthetic
aaccggcatcgcccaacg

SEQ ID NO: 20695 - DNA, 19 bp, Artificial Sequence
  Synthetic
ggcaggctggcggtttacc

SEQ ID NO: 20696 - DNA, 22 bp, Artificial Sequence
  Synthetic
tgccattacgtcgtcgttgact

SEQ ID NO: 20697 - DNA, 20 bp, Artificial Sequence
  Synthetic
ttccaagttgcgttgggcgt

SEQ ID NO: 20698 - DNA, 21 bp, Artificial Sequence
  Synthetic
ggtcaggtgcaccatcagcag

SEQ ID NO: 20699 - DNA, 21 bp, Artificial Sequence
  Synthetic
tccgcacacacttccaaggtt

SEQ ID NO: 20700 - DNA, 21 bp, Artificial Sequence
  Synthetic
gccccatcatggttttgggct

SEQ ID NO: 20701 - DNA, 22 bp, Artificial Sequence
  Synthetic
gccgctgttcgaacgcaaatcc

SEQ ID NO: 20702 - DNA, 19 bp, Artificial Sequence
  Synthetic
agtctgcgcccaaatcggc

SEQ ID NO: 20703 - DNA, 20 bp, Artificial Sequence
  Synthetic
ttgccgcatcgaagttcggc

SEQ ID NO: 20704 - DNA, 25 bp, Artificial Sequence
  Synthetic
tgacatttttagaatgatgccgtct

SEQ ID NO: 20705 - DNA, 21 bp, Artificial Sequence
  Synthetic
gcggacgtgatggcgaaaatg

SEQ ID NO: 20706 - DNA, 22 bp, Artificial Sequence
  Synthetic
gccctcgccgaagtagtcgttg

SEQ ID NO: 20707 - DNA, 18 bp, Artificial Sequence
  Synthetic
cggacgcttgcagcacct

SEQ ID NO: 20708 - DNA, 18 bp, Artificial Sequence
  Synthetic
aattgcgcgtccggccag

SEQ ID NO: 20709 - DNA, 19 bp, Artificial Sequence
  Synthetic
cgtcaacgccgccaacgac

SEQ ID NO: 20710 - DNA, 18 bp, Artificial Sequence
  Synthetic
ccccgtgttgccgcaaac

SEQ ID NO: 20711 - DNA, 21 bp, Artificial Sequence
  Synthetic
gcaaaatcaaacgcgtgcgcc

SEQ ID NO: 20712 - DNA, 20 bp, Artificial Sequence
  Synthetic
acgcataccgccgacctttc

SEQ ID NO: 20713 - DNA, 19 bp, Artificial Sequence
  Synthetic
cctcggctgcgccaatttg

SEQ ID NO: 20714 - DNA, 22 bp, Artificial Sequence
  Synthetic
cggcaagcaggaaaaaaacgct

SEQ ID NO: 20715 - DNA, 18 bp, Artificial Sequence
  Synthetic
ctgccgcatctgtgccca

SEQ ID NO: 20716 - DNA, 20 bp, Artificial Sequence
  Synthetic
gtacgttccacgccgtttct

SEQ ID NO: 20717 - DNA, 19 bp, Artificial Sequence
  Synthetic
acaagccccgattccccgg

SEQ ID NO: 20718 - DNA, 21 bp, Artificial Sequence
  Synthetic
catcgttgccgggtattgccc

SEQ ID NO: 20719 - DNA, 22 bp, Artificial Sequence
  Synthetic
ccaaatccgccaactctaccga

SEQ ID NO: 20720 - DNA, 19 bp, Artificial Sequence
  Synthetic
tcgccttgggctgacgcag

SEQ ID NO: 20721 - DNA, 20 bp, Artificial Sequence
  Synthetic
gcgcccgaaaaacagcttgc

SEQ ID NO: 20722 - DNA, 19 bp, Artificial Sequence
  Synthetic
acattccggaccgcccctc

SEQ ID NO: 20723 - DNA, 21 bp, Artificial Sequence
  Synthetic
gcataccgcccgccaaaaaga

SEQ ID NO: 20724 - DNA, 21 bp, Artificial Sequence
  Synthetic
gtccagccacgtctttaccgc

SEQ ID NO: 20725 - DNA, 19 bp, Artificial Sequence
  Synthetic
ggcttccaaaccagccgcc

SEQ ID NO: 20726 - DNA, 22 bp, Artificial Sequence
  Synthetic
tgcaccgatatgcccgaactct

SEQ ID NO: 20727 - DNA, 20 bp, Artificial Sequence
  Synthetic
gcaaccgcagcaactacgcc

SEQ ID NO: 20728 - DNA, 22 bp, Artificial Sequence
  Synthetic
ccgtcggacaactcgtcttctt

SEQ ID NO: 20729 - DNA, 19 bp, Artificial Sequence
  Synthetic
aaccaggcaggccggcttg

SEQ ID NO: 20730 - DNA, 19 bp, Artificial Sequence
  Synthetic
ttgcgacaggacgggcagc

SEQ ID NO: 20731 - DNA, 19 bp, Artificial Sequence
  Synthetic
cgcgacattctgcgcggag

SEQ ID NO: 20732 - DNA, 21 bp, Artificial Sequence
  Synthetic
cgagttccacacccaagccaa

SEQ ID NO: 20733 - DNA, 19 bp, Artificial Sequence
  Synthetic
cggtatgttcggcggcgtt

SEQ ID NO: 20734 - DNA, 19 bp, Artificial Sequence
  Synthetic
ggcgcgccatccatgttcc

SEQ ID NO: 20735 - DNA, 18 bp, Artificial Sequence
  Synthetic
gcctccgtcggcgcattt

SEQ ID NO: 20736 - DNA, 21 bp, Artificial Sequence
  Synthetic
gccgtctgaaagccgtttgcg

SEQ ID NO: 20737 - DNA, 20 bp, Artificial Sequence
  Synthetic
cgtccgaagcgtttggcgta

SEQ ID NO: 20738 - DNA, 22 bp, Artificial Sequence
  Synthetic
tccggctacaagtgataaggtg

SEQ ID NO: 20739 - DNA, 21 bp, Artificial Sequence
  Synthetic
ccggctgacgattttggggct

SEQ ID NO: 20740 - DNA, 20 bp, Artificial Sequence
  Synthetic
tcgccgcaaaattccgaccc

SEQ ID NO: 20741 - DNA, 20 bp, Artificial Sequence
  Synthetic
cgctgcaaacccacggcaaa

SEQ ID NO: 20742 - DNA, 22 bp, Artificial Sequence
  Synthetic
cgggttactttggcagggtcga

SEQ ID NO: 20743 - DNA, 21 bp, Artificial Sequence
  Synthetic
tggcataatcgagcagcagca

SEQ ID NO: 20744 - DNA, 20 bp, Artificial Sequence
  Synthetic
gcctgcgtaattccggcaac

SEQ ID NO: 20745 - DNA, 20 bp, Artificial Sequence
  Synthetic
ccatacagccggccgccttc

SEQ ID NO: 20746 - DNA, 22 bp, Artificial Sequence
  Synthetic
gagggttttgtcaccggagagg

SEQ ID NO: 20747 - DNA, 19 bp, Artificial Sequence
  Synthetic
acatcggcatcagcgcggg

SEQ ID NO: 20748 - DNA, 20 bp, Artificial Sequence
  Synthetic
cgacctgcgccaaatcggta

SEQ ID NO: 20749 - DNA, 19 bp, Artificial Sequence
  Synthetic
acgcgggcttcagctacgg

SEQ ID NO: 20750 - DNA, 19 bp, Artificial Sequence
  Synthetic
gtcatcgacagcgaccccg

SEQ ID NO: 20751 - DNA, 22 bp, Artificial Sequence
  Synthetic
cgttcaacgtcgtcatccgcac

SEQ ID NO: 20752 - DNA, 19 bp, Artificial Sequence
  Synthetic
cagacccgaaaaaccgcgc

SEQ ID NO: 20753 - DNA, 21 bp, Artificial Sequence
  Synthetic
cggcatttccacgccgcaatc

SEQ ID NO: 20754 - DNA, 21 bp, Artificial Sequence
  Synthetic
ccgtcaaagccgttgccgaaa

SEQ ID NO: 20755 - DNA, 22 bp, Artificial Sequence
  Synthetic
ggggttttcaggcggcatgaaa

SEQ ID NO: 20756 - DNA, 20 bp, Artificial Sequence
  Synthetic
cagccaggcaaacgccatca

SEQ ID NO: 20757 - DNA, 19 bp, Artificial Sequence
  Synthetic
tcagggtaacgcctgccgc

SEQ ID NO: 20758 - DNA, 19 bp, Artificial Sequence
  Synthetic
ccgcgttcgaccacggttt

SEQ ID NO: 20759 - DNA, 18 bp, Artificial Sequence
  Synthetic
ttgccgccgcattgggca

SEQ ID NO: 20760 - DNA, 21 bp, Artificial Sequence
  Synthetic
gcggtagtagccgtagcggat

SEQ ID NO: 20761 - DNA, 19 bp, Artificial Sequence
  Synthetic
gctgatggtgcgcgaaacg

SEQ ID NO: 20762 - DNA, 19 bp, Artificial Sequence
  Synthetic
tgcctgcccttccaatgcc

SEQ ID NO: 20763 - DNA, 20 bp, Artificial Sequence
  Synthetic
ccccaaatgccgaccagggt

SEQ ID NO: 20764 - DNA, 18 bp, Artificial Sequence
  Synthetic
acgcgtttgttggcggcg

SEQ ID NO: 20765 - DNA, 21 bp, Artificial Sequence
  Synthetic
gggcatcgccgtattggtacg

SEQ ID NO: 20766 - DNA, 19 bp, Artificial Sequence
  Synthetic
ggcaaatgccgtctgcgcg

SEQ ID NO: 20767 - DNA, 22 bp, Artificial Sequence
  Synthetic
ggcgcgtatgtgctgcacctta

SEQ ID NO: 20768 - DNA, 19 bp, Artificial Sequence
  Synthetic
gcccgaagaaacccgccaa

SEQ ID NO: 20769 - DNA, 21 bp, Artificial Sequence
  Synthetic
cgcgccattttgaaagacgcg

SEQ ID NO: 20770 - DNA, 19 bp, Artificial Sequence
  Synthetic
gccgacggcgtatgtgcat

SEQ ID NO: 20771 - DNA, 21 bp, Artificial Sequence
  Synthetic
cccctgatcaaccacggcttt

SEQ ID NO: 20772 - DNA, 21 bp, Artificial Sequence
  Synthetic
gccaaagaagccggagccaaa

SEQ ID NO: 20773 - DNA, 19 bp, Artificial Sequence
  Synthetic
ttcggcaaccccgcaaccg

SEQ ID NO: 20774 - DNA, 25 bp, Artificial Sequence
  Synthetic
gtgctaaatctaccaagttgcaaat

SEQ ID NO: 20775 - DNA, 21 bp, Artificial Sequence
  Synthetic
tggtaaggtgtcacttgctcc

SEQ ID NO: 20776 - DNA, 25 bp, Artificial Sequence
  Synthetic
tgcttagtctttctttttctggaga

SEQ ID NO: 20777 - DNA, 25 bp, Artificial Sequence
  Synthetic
gtaacccagctaggcaatttgttat

SEQ ID NO: 20778 - DNA, 22 bp, Artificial Sequence
  Synthetic
cgatgcccatttgtattgcaac

SEQ ID NO: 20779 - DNA, 25 bp, Artificial Sequence
  Synthetic
tcctggcatcttcaaaaaacaatag

SEQ ID NO: 20780 - DNA, 24 bp, Artificial Sequence
  Synthetic
tccatctatacctccagcacttta

SEQ ID NO: 20781 - DNA, 23 bp, Artificial Sequence
  Synthetic
gaacaatagatgaagcaccaggc

SEQ ID NO: 20782 - DNA, 25 bp, Artificial Sequence
  Synthetic
tggaacctgtgttgtgtatctagta

SEQ ID NO: 20783 - DNA, 23 bp, Artificial Sequence
  Synthetic
ccctgtgtgtctgtagtggtaac

SEQ ID NO: 20784 - DNA, 25 bp, Artificial Sequence
  Synthetic
caaactaaccgttctctttgaggat

SEQ ID NO: 20785 - DNA, 25 bp, Artificial Sequence
  Synthetic
tgacgagcataaagttgttctcttt

SEQ ID NO: 20786 - DNA, 25 bp, Artificial Sequence
  Synthetic
gggatccattgcattaatatgagct

SEQ ID NO: 20787 - DNA, 25 bp, Artificial Sequence
  Synthetic
aagcagtcaggatattcaagtacaa

SEQ ID NO: 20788 - DNA, 24 bp, Artificial Sequence
  Synthetic
tcttctccatactctttcattgcc

SEQ ID NO: 20789 - DNA, 25 bp, Artificial Sequence
  Synthetic
tccttgtaatcatacaaatctggca

SEQ ID NO: 20790 - DNA, 21 bp, Artificial Sequence
  Synthetic
ctgaaaacaaggaggcccatc

SEQ ID NO: 20791 - DNA, 24 bp, Artificial Sequence
  Synthetic
agctgactcgttttcttcatgttt

SEQ ID NO: 20792 - DNA, 23 bp, Artificial Sequence
  Synthetic
tctcatgcttgcaatgtgttcaa

SEQ ID NO: 20793 - DNA, 21 bp, Artificial Sequence
  Synthetic
tcacaaagtttaccacgtcgg

SEQ ID NO: 20794 - DNA, 25 bp, Artificial Sequence
  Synthetic
gtctttctctttgacagaggactcg

SEQ ID NO: 20795 - DNA, 21 bp, Artificial Sequence
  Synthetic
tctgttcgctgaaggggtcct

SEQ ID NO: 20796 - DNA, 20 bp, Artificial Sequence
  Synthetic
tggctccactggtccccaat

SEQ ID NO: 20797 - DNA, 20 bp, Artificial Sequence
  Synthetic
gacgcacgtccactcggatg

SEQ ID NO: 20798 - DNA, 21 bp, Artificial Sequence
  Synthetic
catgcaaggagtcccggagtc

SEQ ID NO: 20799 - DNA, 21 bp, Artificial Sequence
  Synthetic
ccaggggaggattcaccgaca

SEQ ID NO: 20800 - DNA, 23 bp, Artificial Sequence
  Synthetic
aggatcctcgaacatagctgttt

SEQ ID NO: 20801 - DNA, 25 bp, Artificial Sequence
  Synthetic
ggcatttgacatctatgacacctta

SEQ ID NO: 20802 - DNA, 20 bp, Artificial Sequence
  Synthetic
gttcgtagcagcgtaggtca

SEQ ID NO: 20803 - DNA, 24 bp, Artificial Sequence
  Synthetic
ctcctcatttgtaccttcacagtc

SEQ ID NO: 20804 - DNA, 22 bp, Artificial Sequence
  Synthetic
ttaaattgcgcactgcctttgt

SEQ ID NO: 20805 - DNA, 24 bp, Artificial Sequence
  Synthetic
ccaaatctaatctggaccaggtgg

SEQ ID NO: 20806 - DNA, 25 bp, Artificial Sequence
  Synthetic
cgtgtttattaacgactgcaatgct

SEQ ID NO: 20807 - DNA, 25 bp, Artificial Sequence
  Synthetic
cgtaatactgcttatatgccccttg

SEQ ID NO: 20808 - DNA, 21 bp, Artificial Sequence
  Synthetic
cggtggtgtcaggtccactga

SEQ ID NO: 20809 - DNA, 24 bp, Artificial Sequence
  Synthetic
aggggctccagattgtataatact

SEQ ID NO: 20810 - DNA, 20 bp, Artificial Sequence
  Synthetic
agatgtaagggccggacgat

SEQ ID NO: 20811 - DNA, 24 bp, Artificial Sequence
  Synthetic
atgttgtaggggaatatgacatgc

SEQ ID NO: 20812 - DNA, 23 bp, Artificial Sequence
  Synthetic
gcatacgtttacggcgtttatgg

SEQ ID NO: 20813 - DNA, 20 bp, Artificial Sequence
  Synthetic
aggatcaggtaggtgcactc

SEQ ID NO: 20814 - DNA, 25 bp, Artificial Sequence
  Synthetic
cacgttgtgtctgtgtatttttaca

SEQ ID NO: 20815 - DNA, 25 bp, Artificial Sequence
  Synthetic
cccccgccttattataaaaatgtct

SEQ ID NO: 20816 - DNA, 25 bp, Artificial Sequence
  Synthetic
acacaccttacataacataccacaa

SEQ ID NO: 20817 - DNA, 20 bp, Artificial Sequence
  Synthetic
ctccacccttctgcagacgg

SEQ ID NO: 20818 - DNA, 22 bp, Artificial Sequence
  Synthetic
ggaccctatcaggcagtacggt

SEQ ID NO: 20819 - DNA, 22 bp, Artificial Sequence
  Synthetic
ccagcaagcgtactatctggca

SEQ ID NO: 20820 - DNA, 20 bp, Artificial Sequence
  Synthetic
tgtacggattggcgggaacc

SEQ ID NO: 20821 - DNA, 23 bp, Artificial Sequence
  Synthetic
caccagggattgtataggggtac

SEQ ID NO: 20822 - DNA, 25 bp, Artificial Sequence
  Synthetic
gtggaattcacagggtcataaaagt

SEQ ID NO: 20823 - DNA, 22 bp, Artificial Sequence
  Synthetic
agctgaagcaggcgtaaccaaa

SEQ ID NO: 20824 - DNA, 21 bp, Artificial Sequence
  Synthetic
cgatgctgcactggatgttaa

SEQ ID NO: 20825 - DNA, 22 bp, Artificial Sequence
  Synthetic
gcatagccaaccctgcgaaaac

SEQ ID NO: 20826 - DNA, 22 bp, Artificial Sequence
  Synthetic
ccagctccacatggtggttgat

SEQ ID NO: 20827 - DNA, 23 bp, Artificial Sequence
  Synthetic
tgggggcaattaaaatttgcact

SEQ ID NO: 20828 - DNA, 21 bp, Artificial Sequence
  Synthetic
ggtgtagggattactccaggg

SEQ ID NO: 20829 - DNA, 24 bp, Artificial Sequence
  Synthetic
agtttgagcttctgttgatgacaa

SEQ ID NO: 20830 - DNA, 25 bp, Artificial Sequence
  Synthetic
cccaagaaaggtgttaagtttttca

SEQ ID NO: 20831 - DNA, 22 bp, Artificial Sequence
  Synthetic
ggccactcacccatcaagcatt

SEQ ID NO: 20832 - DNA, 20 bp, Artificial Sequence
  Synthetic
tcagttgggtccggtctagc

SEQ ID NO: 20833 - DNA, 22 bp, Artificial Sequence
  Synthetic
ggtggtgaaggagggaggtttg

SEQ ID NO: 20834 - DNA, 24 bp, Artificial Sequence
  Synthetic
cagttttgaagctaatcacgtcgg

SEQ ID NO: 20835 - DNA, 20 bp, Artificial Sequence
  Synthetic
gtccagaacagccttgcggg

SEQ ID NO: 20836 - DNA, 22 bp, Artificial Sequence
  Synthetic
cctcgggtgtgatggtactgtc

SEQ ID NO: 20837 - DNA, 22 bp, Artificial Sequence
  Synthetic
gcgctcttccaaattacggtgc

SEQ ID NO: 20838 - DNA, 22 bp, Artificial Sequence
  Synthetic
gcagatcttctacaggcaccgt

SEQ ID NO: 20839 - DNA, 20 bp, Artificial Sequence
  Synthetic
aaagtggtgtaccgagccac

SEQ ID NO: 20840 - DNA, 22 bp, Artificial Sequence
  Synthetic
ggcttcacccgaaacggttctg

SEQ ID NO: 20841 - DNA, 23 bp, Artificial Sequence
  Synthetic
cagtggttatcaggatggcaatt

SEQ ID NO: 20842 - DNA, 25 bp, Artificial Sequence
  Synthetic
ggaaagcctaatcgaattgtcctta

SEQ ID NO: 20843 - DNA, 20 bp, Artificial Sequence
  Synthetic
acacaaacatgcagccatgc

SEQ ID NO: 20844 - DNA, 20 bp, Artificial Sequence
  Synthetic
gaggatagcaggagcactcc

SEQ ID NO: 20845 - DNA, 20 bp, Artificial Sequence
  Synthetic
tccatcatcaaaggcccagc

SEQ ID NO: 20846 - DNA, 25 bp, Artificial Sequence
  Synthetic
atcgtacttttcagcagtatccaat

SEQ ID NO: 20847 - DNA, 25 bp, Artificial Sequence
  Synthetic
tgaagtagcaaaaacacacactctt

SEQ ID NO: 20848 - DNA, 25 bp, Artificial Sequence
  Synthetic
tgtgaagcattatccacatcatcaa

SEQ ID NO: 20849 - DNA, 24 bp, Artificial Sequence
  Synthetic
tgtacctgagaaacatttgcagtt

SEQ ID NO: 20850 - DNA, 25 bp, Artificial Sequence
  Synthetic
tcgtctaacaagccaattttaccat

SEQ ID NO: 20851 - DNA, 21 bp, Artificial Sequence
  Synthetic
gcgatggggtcttggagtacc

SEQ ID NO: 20852 - DNA, 20 bp, Artificial Sequence
  Synthetic
cttgtcgcgcaagtagtcga

SEQ ID NO: 20853 - DNA, 25 bp, Artificial Sequence
  Synthetic
ggaagtgcttcaggaattggtttta

SEQ ID NO: 20854 - DNA, 21 bp, Artificial Sequence
  Synthetic
gaaagtaggatccggtgcagc

SEQ ID NO: 20855 - DNA, 25 bp, Artificial Sequence
  Synthetic
gcattaggattttctgtgtcaagca

SEQ ID NO: 20856 - DNA, 25 bp, Artificial Sequence
  Synthetic
cctgatttgtcctgttgtaatcgtc

SEQ ID NO: 20857 - DNA, 21 bp, Artificial Sequence
  Synthetic
cagaaccggtatgcaatagcc

SEQ ID NO: 20858 - DNA, 24 bp, Artificial Sequence
  Synthetic
ctgatgatctttcgacgatgtagg

SEQ ID NO: 20859 - DNA, 23 bp, Artificial Sequence
  Synthetic
cgaaaagaatgctctttcccctg

SEQ ID NO: 20860 - DNA, 24 bp, Artificial Sequence
  Synthetic
tgaaagaacgtgtccataccatgg

SEQ ID NO: 20861 - DNA, 20 bp, Artificial Sequence
  Synthetic
taccagccagcgactagtcc

SEQ ID NO: 20862 - DNA, 25 bp, Artificial Sequence
  Synthetic
atgctcatcgagtgttttttgattt

SEQ ID NO: 20863 - DNA, 22 bp, Artificial Sequence
  Synthetic
cggttccgcagaccactatggc

SEQ ID NO: 20864 - DNA, 22 bp, Artificial Sequence
  Synthetic
gcggcaacaagtaaactccacc

SEQ ID NO: 20865 - DNA, 21 bp, Artificial Sequence
  Synthetic
tgacagcgtgggggtgatttg

SEQ ID NO: 20866 - DNA, 21 bp, Artificial Sequence
  Synthetic
acagtatgggtgcggccatca

SEQ ID NO: 20867 - DNA, 20 bp, Artificial Sequence
  Synthetic
ttggtcgaatgcggcaaggg

SEQ ID NO: 20868 - DNA, 22 bp, Artificial Sequence
  Synthetic
acaaaccccgtggagttcatcc

SEQ ID NO: 20869 - DNA, 20 bp, Artificial Sequence
  Synthetic
gtgtggtggtgtgcaggagc

SEQ ID NO: 20870 - DNA, 19 bp, Artificial Sequence
  Synthetic
cccatgattccctgcggcc

SEQ ID NO: 20871 - DNA, 21 bp, Artificial Sequence
  Synthetic
ccacccttaacctgcaacggg

SEQ ID NO: 20872 - DNA, 22 bp, Artificial Sequence
  Synthetic
cgcggagaatacgatgggttct

SEQ ID NO: 20873 - DNA, 21 bp, Artificial Sequence
  Synthetic
gccccatggaagagtgtccac

SEQ ID NO: 20874 - DNA, 20 bp, Artificial Sequence
  Synthetic
aacacctaccacatgcccgg

SEQ ID NO: 20875 - DNA, 21 bp, Artificial Sequence
  Synthetic
ctccggtcctgatgttggggt

SEQ ID NO: 20876 - DNA, 22 bp, Artificial Sequence
  Synthetic
acgcccagactggtcaattgtt

SEQ ID NO: 20877 - DNA, 20 bp, Artificial Sequence
  Synthetic
tctccctgtacggcccctac

SEQ ID NO: 20878 - DNA, 22 bp, Artificial Sequence
  Synthetic
gagtggggccagttaaagtcgg

SEQ ID NO: 20879 - DNA, 20 bp, Artificial Sequence
  Synthetic
aagaggggaggtcaccgcgg

SEQ ID NO: 20880 - DNA, 18 bp, Artificial Sequence
  Synthetic
atgtggcgccgcagaacg

SEQ ID NO: 20881 - DNA, 20 bp, Artificial Sequence
  Synthetic
aagggcactccggggagttg

SEQ ID NO: 20882 - DNA, 20 bp, Artificial Sequence
  Synthetic
acgccatccagctccgtgaa

SEQ ID NO: 20883 - DNA, 20 bp, Artificial Sequence
  Synthetic
gcaggtggccttgagagagg

SEQ ID NO: 20884 - DNA, 19 bp, Artificial Sequence
  Synthetic
gcaggtggtatcgggcagc

SEQ ID NO: 20885 - DNA, 22 bp, Artificial Sequence
  Synthetic
gccccagtccaggtgtatgaca

SEQ ID NO: 20886 - DNA, 22 bp, Artificial Sequence
  Synthetic
cgccgtatccgtacttggaacg

SEQ ID NO: 20887 - DNA, 22 bp, Artificial Sequence
  Synthetic
gtcgtcaccacataccaggagc

SEQ ID NO: 20888 - DNA, 21 bp, Artificial Sequence
  Synthetic
gcactatccgagcccacaagg

SEQ ID NO: 20889 - DNA, 20 bp, Artificial Sequence
  Synthetic
atggcggccctacctccctg

SEQ ID NO: 20890 - DNA, 20 bp, Artificial Sequence
  Synthetic
tactgcgtaggtgcactagg

SEQ ID NO: 20891 - DNA, 22 bp, Artificial Sequence
  Synthetic
ggtgttcacgtgcctccgatag

SEQ ID NO: 20892 - DNA, 25 bp, Artificial Sequence
  Synthetic
gtggttgaatgactttgacttttga

SEQ ID NO: 20893 - DNA, 25 bp, Artificial Sequence
  Synthetic
cgcttattatagcagccaacatagg

SEQ ID NO: 20894 - DNA, 20 bp, Artificial Sequence
  Synthetic
tccaagcaccttttacgggc

SEQ ID NO: 20895 - DNA, 25 bp, Artificial Sequence
  Synthetic
gaccaccagttacatatgccataat

SEQ ID NO: 20896 - DNA, 22 bp, Artificial Sequence
  Synthetic
acctaagttgagtgatcgcaac

SEQ ID NO: 20897 - DNA, 21 bp, Artificial Sequence
  Synthetic
caggagacaatgcgcagtatt

SEQ ID NO: 20898 - DNA, 21 bp, Artificial Sequence
  Synthetic
tgcatcgtcctcttcttcctc

SEQ ID NO: 20899 - DNA, 25 bp, Artificial Sequence
  Synthetic
aggtgtatgttagcagcatttacaa

SEQ ID NO: 20900 - DNA, 22 bp, Artificial Sequence
  Synthetic
aagactgaagtggtttagcacc

SEQ ID NO: 20901 - DNA, 22 bp, Artificial Sequence
  Synthetic
tcacctaccatgtaaggtgcat

SEQ ID NO: 20902 - DNA, 25 bp, Artificial Sequence
  Synthetic
gctctaacatccatgcatataggca

SEQ ID NO: 20903 - DNA, 24 bp, Artificial Sequence
  Synthetic
tgatgacgaagtgaggtatccatt

SEQ ID NO: 20904 - DNA, 24 bp, Artificial Sequence
  Synthetic
agcttcactacgtagtgtgtcatc

SEQ ID NO: 20905 - DNA, 25 bp, Artificial Sequence
  Synthetic
ggtagtagttttctgaccacaatgt

SEQ ID NO: 20906 - DNA, 23 bp, Artificial Sequence
  Synthetic
tggtcctttgtactctgacatct

SEQ ID NO: 20907 - DNA, 22 bp, Artificial Sequence
  Synthetic
ccactacatcgccattcaagtc

SEQ ID NO: 20908 - DNA, 25 bp, Artificial Sequence
  Synthetic
tggtttaagtatgacattgcctaca

SEQ ID NO: 20909 - DNA, 25 bp, Artificial Sequence
  Synthetic
ggaaaagaaccttcacagaaatcca

SEQ ID NO: 20910 - DNA, 21 bp, Artificial Sequence
  Synthetic
ctaaccattgcagaaacgggt

SEQ ID NO: 20911 - DNA, 23 bp, Artificial Sequence
  Synthetic
gtcagtagggttgattggtcttt

SEQ ID NO: 20912 - DNA, 25 bp, Artificial Sequence
  Synthetic
gcaacaagtgccttaagtttttcca

SEQ ID NO: 20913 - DNA, 25 bp, Artificial Sequence
  Synthetic
gcagctgttcagataaagacatgta

SEQ ID NO: 20914 - DNA, 25 bp, Artificial Sequence
  Synthetic
accagcatgtttatttgcaaaacaa

SEQ ID NO: 20915 - DNA, 25 bp, Artificial Sequence
  Synthetic
tctggacgaagctcactataagaaa

SEQ ID NO: 20916 - DNA, 20 bp, Artificial Sequence
  Synthetic
ccaccagccactactgaagc

SEQ ID NO: 20917 - DNA, 25 bp, Artificial Sequence
  Synthetic
cgctacgcaattttaggtacatttc

SEQ ID NO: 20918 - DNA, 20 bp, Artificial Sequence
  Synthetic
aaccactctgcagaacagca

SEQ ID NO: 20919 - DNA, 25 bp, Artificial Sequence
  Synthetic
cggacaaatttatacttgggtgtct

SEQ ID NO: 20920 - DNA, 25 bp, Artificial Sequence
  Synthetic
acatgatcttgtgtcaaaggttcat

SEQ ID NO: 20921 - DNA, 24 bp, Artificial Sequence
  Synthetic
gaccactgtgtactttgaacaaga

SEQ ID NO: 20922 - DNA, 25 bp, Artificial Sequence
  Synthetic
cgacaccagaatagttagaggttac

SEQ ID NO: 20923 - DNA, 25 bp, Artificial Sequence
  Synthetic
cctccaatacccaacaacttaatgt

SEQ ID NO: 20924 - DNA, 25 bp, Artificial Sequence
  Synthetic
acaacctattaatgtctacagcacc

SEQ ID NO: 20925 - DNA, 24 bp, Artificial Sequence
  Synthetic
gcactagttacttttgccctcttg

SEQ ID NO: 20926 - DNA, 22 bp, Artificial Sequence
  Synthetic
gtcgtagtgctactggactcag

SEQ ID NO: 20927 - DNA, 24 bp, Artificial Sequence
  Synthetic
gcaggtacttctgtagcatttcca

SEQ ID NO: 20928 - DNA, 22 bp, Artificial Sequence
  Synthetic
gggtcattagcacaagtggtag

SEQ ID NO: 20929 - DNA, 25 bp, Artificial Sequence
  Synthetic
ccatgtcaccatctactctaaactt

SEQ ID NO: 20930 - DNA, 20 bp, Artificial Sequence
  Synthetic
cctacaatgcctgcatcacg

SEQ ID NO: 20931 - DNA, 25 bp, Artificial Sequence
  Synthetic
ggatacacctatcatccaaacagtt

SEQ ID NO: 20932 - DNA, 25 bp, Artificial Sequence
  Synthetic
tgacagtttgaaaagcaacattgtt

SEQ ID NO: 20933 - DNA, 23 bp, Artificial Sequence
  Synthetic
acagatagagacaccagctacgg

SEQ ID NO: 20934 - DNA, 23 bp, Artificial Sequence
  Synthetic
cgttagctaacctgtagaaacgg

SEQ ID NO: 20935 - DNA, 25 bp, Artificial Sequence
  Synthetic
cggcatcatcagaaagaatcatcat

SEQ ID NO: 20936 - DNA, 25 bp, Artificial Sequence
  Synthetic
agacatcagcatactcctgattagg

SEQ ID NO: 20937 - DNA, 25 bp, Artificial Sequence
  Synthetic
gcaaacatagggattaacagacaac

SEQ ID NO: 20938 - DNA, 20 bp, Artificial Sequence
  Synthetic
ttcctcagtggctttgagcg

SEQ ID NO: 20939 - DNA, 22 bp, Artificial Sequence
  Synthetic
gtgttgggtacaagccagtaat

SEQ ID NO: 20940 - DNA, 25 bp, Artificial Sequence
  Synthetic
agcattgacaacactcaagtcataa

SEQ ID NO: 20941 - DNA, 25 bp, Artificial Sequence
  Synthetic
tgattgcagatgaaacatcatgtgt

SEQ ID NO: 20942 - DNA, 25 bp, Artificial Sequence
  Synthetic
cgacgtggtatttctagacttgtaa

SEQ ID NO: 20943 - DNA, 20 bp, Artificial Sequence
  Synthetic
aaagccaatccacgcacgaa

SEQ ID NO: 20944 - DNA, 20 bp, Artificial Sequence
  Synthetic
gtaagctcaaagccatgcgc

SEQ ID NO: 20945 - DNA, 23 bp, Artificial Sequence
  Synthetic
caatgcagacttcacaaccatgt

SEQ ID NO: 20946 - DNA, 23 bp, Artificial Sequence
  Synthetic
catcacagcctggtaagttcaag

SEQ ID NO: 20947 - DNA, 25 bp, Artificial Sequence
  Synthetic
cctggtaaatgtattccacaggtta

SEQ ID NO: 20948 - DNA, 25 bp, Artificial Sequence
  Synthetic
acaagacagtaagtgaagaacaagc

SEQ ID NO: 20949 - DNA, 25 bp, Artificial Sequence
  Synthetic
cctcgagcttatatcgctgtatgaa

SEQ ID NO: 20950 - DNA, 25 bp, Artificial Sequence
  Synthetic
ccaaagcatgaatgaaatttcagca

SEQ ID NO: 20951 - DNA, 25 bp, Artificial Sequence
  Synthetic
ccaattaaagtagaatctgcgtcgg

SEQ ID NO: 20952 - DNA, 23 bp, Artificial Sequence
  Synthetic
tgccaagatagttagccccaatt

SEQ ID NO: 20953 - DNA, 21 bp, Artificial Sequence
  Synthetic
tgtctgtgtacccatgggttt

SEQ ID NO: 20954 - DNA, 25 bp, Artificial Sequence
  Synthetic
acttgagcataaatgtagttggctt

SEQ ID NO: 20955 - DNA, 25 bp, Artificial Sequence
  Synthetic
gcaaagatcattcaacttagtggca

SEQ ID NO: 20956 - DNA, 25 bp, Artificial Sequence
  Synthetic
gccaataacaattaagagcaggtgg

SEQ ID NO: 20957 - DNA, 25 bp, Artificial Sequence
  Synthetic
agcatttgttccaggtgtaattaca

SEQ ID NO: 20958 - DNA, 25 bp, Artificial Sequence
  Synthetic
agcaatggtgttattagagtaagca

SEQ ID NO: 20959 - DNA, 24 bp, Artificial Sequence
  Synthetic
gcattcgccatattgcttcatgaa

SEQ ID NO: 20960 - DNA, 25 bp, Artificial Sequence
  Synthetic
tgcagttgatgttgttgtaagtgat

SEQ ID NO: 20961 - DNA, 23 bp, Artificial Sequence
  Synthetic
ggacataaggtggtagccctttc

SEQ ID NO: 20962 - DNA, 25 bp, Artificial Sequence
  Synthetic
gctcttctttgaatgagtcaagctc

SEQ ID NO: 20963 - DNA, 20 bp, Artificial Sequence
  Synthetic
aagagcatgcacccttgagg

SEQ ID NO: 20964 - DNA, 23 bp, Artificial Sequence
  Synthetic
gcaaatgaactggaagcccttat

SEQ ID NO: 20965 - DNA, 25 bp, Artificial Sequence
  Synthetic
gtgaaatagccatgtacaacgacat

SEQ ID NO: 20966 - DNA, 25 bp, Artificial Sequence
  Synthetic
gcaagaataccacgaaagcaagaaa

SEQ ID NO: 20967 - DNA, 25 bp, Artificial Sequence
  Synthetic
cctgttccgattagaataggcaaat

SEQ ID NO: 20968 - DNA, 20 bp, Artificial Sequence
  Synthetic
acagcgccctagggagtgtc

SEQ ID NO: 20969 - DNA, 24 bp, Artificial Sequence
  Synthetic
cctgatagtgatatagctcgcaag

SEQ ID NO: 20970 - DNA, 25 bp, Artificial Sequence
  Synthetic
acatgaggtttattagatgcacagc

SEQ ID NO: 20971 - DNA, 22 bp, Artificial Sequence
  Synthetic
ccattgcgtcctccattctggt

SEQ ID NO: 20972 - DNA, 22 bp, Artificial Sequence
  Synthetic
tgccaatgtggtctttgggtgt

SEQ ID NO: 20973 - DNA, 25 bp, Artificial Sequence
  Synthetic
agcagatttcttagtgacagtttgg

SEQ ID NO: 20974 - DNA, 23 bp, Artificial Sequence
  Synthetic
gttcagcagtatgacgttgtctt

SEQ ID NO: 20975 - DNA, 25 bp, Artificial Sequence
  Synthetic
cctacttgtgctgtttagttacgag

SEQ ID NO: 20976 - DNA, 21 bp, Artificial Sequence
  Synthetic
gggaagggtgggaaaaactgg

SEQ ID NO: 20977 - DNA, 21 bp, Artificial Sequence
  Synthetic
caagaagggtgagcaggcagc

SEQ ID NO: 20978 - DNA, 25 bp, Artificial Sequence
  Synthetic
gcacccatgatgacaatctatacac

SEQ ID NO: 20979 - DNA, 22 bp, Artificial Sequence
  Synthetic
cacaagcttcaactgttggtga

SEQ ID NO: 20980 - DNA, 20 bp, Artificial Sequence
  Synthetic
agggcatcaggcaatttcca

SEQ ID NO: 20981 - DNA, 25 bp, Artificial Sequence
  Synthetic
ccaactgtcatcactaggtctttta

SEQ ID NO: 20982 - DNA, 25 bp, Artificial Sequence
  Synthetic
ctgagtggtactaaacacaacctta

SEQ ID NO: 20983 - DNA, 25 bp, Artificial Sequence
  Synthetic
ggttgtgaggcaatatctactggta

SEQ ID NO: 20984 - DNA, 22 bp, Artificial Sequence
  Synthetic
ccccacatcccacactaaatgt

SEQ ID NO: 20985 - DNA, 23 bp, Artificial Sequence
  Synthetic
tgtgagtactccttcttgtgtgt

SEQ ID NO: 20986 - DNA, 25 bp, Artificial Sequence
  Synthetic
ttcctgattgccatgtgtaatcatc

SEQ ID NO: 20987 - DNA, 24 bp, Artificial Sequence
  Synthetic
cgaggacaccatgcttttatatgt

SEQ ID NO: 20988 - DNA, 25 bp, Artificial Sequence
  Synthetic
tcacatcattaccttcagtgtttgt

SEQ ID NO: 20989 - DNA, 25 bp, Artificial Sequence
  Synthetic
cacactggaattttctcaggtcaat

SEQ ID NO: 20990 - DNA, 25 bp, Artificial Sequence
  Synthetic
acgcacagagtttctctttaagaaa

SEQ ID NO: 20991 - DNA, 23 bp, Artificial Sequence
  Synthetic
tttaggatctgggggcaaagaat

SEQ ID NO: 20992 - DNA, 25 bp, Artificial Sequence
  Synthetic
tgaagatactgttggtggtgttagt

SEQ ID NO: 20993 - DNA, 24 bp, Artificial Sequence
  Synthetic
accctgaagtgtacagaacaattt

SEQ ID NO: 20994 - DNA, 25 bp, Artificial Sequence
  Synthetic
gcaaatcataggaatcagagacctt

SEQ ID NO: 20995 - DNA, 22 bp, Artificial Sequence
  Synthetic
ccttgtacaaaacacccccaca

SEQ ID NO: 20996 - DNA, 25 bp, Artificial Sequence
  Synthetic
gtgactatacctgggtttttgtgga

SEQ ID NO: 20997 - DNA, 25 bp, Artificial Sequence
  Synthetic
ctcatcagctctgaatcctctttta

SEQ ID NO: 20998 - DNA, 25 bp, Artificial Sequence
  Synthetic
ggtagaagcactaacacacagtcta

SEQ ID NO: 20999 - DNA, 25 bp, Artificial Sequence
  Synthetic
cttcacaagctacctgtacattaga

SEQ ID NO: 21000 - DNA, 25 bp, Artificial Sequence
  Synthetic
ccatcaaatgcatttctcatatgca

SEQ ID NO: 21001 - DNA, 25 bp, Artificial Sequence
  Synthetic
tgtgatgtgatctctaaggtctgta

SEQ ID NO: 21002 - DNA, 25 bp, Artificial Sequence
  Synthetic
tgacaggagcaagaatagttttgtt

SEQ ID NO: 21003 - DNA, 20 bp, Artificial Sequence
  Synthetic
ttcacagtcatgccccaacc

SEQ ID NO: 21004 - DNA, 23 bp, Artificial Sequence
  Synthetic
ggaagatgctccaggttctactg

SEQ ID NO: 21005 - DNA, 24 bp, Artificial Sequence
  Synthetic
ctctgtgattggtacctgctctat

SEQ ID NO: 21006 - DNA, 25 bp, Artificial Sequence
  Synthetic
tcggggacaaatacctttaaaactg

SEQ ID NO: 21007 - DNA, 23 bp, Artificial Sequence
  Synthetic
gacgttccctgtctgaattgtat

SEQ ID NO: 21008 - DNA, 25 bp, Artificial Sequence
  Synthetic
gctgttctcgctttccaaaaaagaa

SEQ ID NO: 21009 - DNA, 25 bp, Artificial Sequence
  Synthetic
gccattcttccaatattctgggatt

SEQ ID NO: 21010 - DNA, 24 bp, Artificial Sequence
  Synthetic
tgaccccatgagtcagataaaaca

SEQ ID NO: 21011 - DNA, 24 bp, Artificial Sequence
  Synthetic
gaaggtaacaccaactcttccaaa

SEQ ID NO: 21012 - DNA, 25 bp, Artificial Sequence
  Synthetic
ccaatctgcagtttgtaattcaaga

SEQ ID NO: 21013 - DNA, 25 bp, Artificial Sequence
  Synthetic
agtctcggactcaaatctacaagat

SEQ ID NO: 21014 - DNA, 22 bp, Artificial Sequence
  Synthetic
tgatcctgcagtacatcgaaac

SEQ ID NO: 21015 - DNA, 25 bp, Artificial Sequence
  Synthetic
tggaactagtaacgacagaggaaat

SEQ ID NO: 21016 - DNA, 22 bp, Artificial Sequence
  Synthetic
ggctcttggttctctggtggtt

SEQ ID NO: 21017 - DNA, 25 bp, Artificial Sequence
  Synthetic
cctctggatttatcacatccaaagg

SEQ ID NO: 21018 - DNA, 24 bp, Artificial Sequence
  Synthetic
ggtttgaacctgttgtacaaaacg

SEQ ID NO: 21019 - DNA, 25 bp, Artificial Sequence
  Synthetic
gttgaaaaaggtccagttggctatc

SEQ ID NO: 21020 - DNA, 23 bp, Artificial Sequence
  Synthetic
tgctttgccttctccatcttcta

SEQ ID NO: 21021 - DNA, 25 bp, Artificial Sequence
  Synthetic
acatcttctcatttttctctcagct

SEQ ID NO: 21022 - DNA, 23 bp, Artificial Sequence
  Synthetic
tgtctttgctgtgttcatagctg

SEQ ID NO: 21023 - DNA, 25 bp, Artificial Sequence
  Synthetic
agtttccatctgttcataagatcgt

SEQ ID NO: 21024 - DNA, 25 bp, Artificial Sequence
  Synthetic
tcctctttgtcatacagaatcagct

SEQ ID NO: 21025 - DNA, 20 bp, Artificial Sequence
  Synthetic
tgagtgcagaccgtgccaga

SEQ ID NO: 21026 - DNA, 24 bp, Artificial Sequence
  Synthetic
ctgatgaagcttgagactctcaga

SEQ ID NO: 21027 - DNA, 25 bp, Artificial Sequence
  Synthetic
cccaaaagagctctttcatttgatc

SEQ ID NO: 21028 - DNA, 25 bp, Artificial Sequence
  Synthetic
gccaccccaaataaacaaaggatta

SEQ ID NO: 21029 - DNA, 20 bp, Artificial Sequence
  Synthetic
tccatcttgctttctggcgc

SEQ ID NO: 21030 - DNA, 25 bp, Artificial Sequence
  Synthetic
gaggcgtgtataaaaagaaatgtgt

SEQ ID NO: 21031 - DNA, 25 bp, Artificial Sequence
  Synthetic
cagtaccttccattgattagccttt

SEQ ID NO: 21032 - DNA, 25 bp, Artificial Sequence
  Synthetic
gcaaaaggataattagcagcttctg

SEQ ID NO: 21033 - DNA, 25 bp, Artificial Sequence
  Synthetic
tgcaaaacattaaactctgctactg

SEQ ID NO: 21034 - DNA, 25 bp, Artificial Sequence
  Synthetic
ttcagtaagaccgatagcttccaaa

SEQ ID NO: 21035 - DNA, 25 bp, Artificial Sequence
  Synthetic
agccataaaaccaatattgtgcttt

SEQ ID NO: 21036 - DNA, 25 bp, Artificial Sequence
  Synthetic
ccaactttgattcggttaaattcct

SEQ ID NO: 21037 - DNA, 24 bp, Artificial Sequence
  Synthetic
caaagaagcaagcctaagcctaaa

SEQ ID NO: 21038 - DNA, 25 bp, Artificial Sequence
  Synthetic
gcctgcaaaatcttacctaagtcat

SEQ ID NO: 21039 - DNA, 22 bp, Artificial Sequence
  Synthetic
agcacaacaaaacaagccattt

SEQ ID NO: 21040 - DNA, 25 bp, Artificial Sequence
  Synthetic
cacaaaacctttcaagagacgtttg

SEQ ID NO: 21041 - DNA, 23 bp, Artificial Sequence
  Synthetic
gcaattaatggctgatttgcgga

SEQ ID NO: 21042 - DNA, 25 bp, Artificial Sequence
  Synthetic
cccaaatctacggctgataaagatt

SEQ ID NO: 21043 - DNA, 20 bp, Artificial Sequence
  Synthetic
tacgagatccccaacgttgg

SEQ ID NO: 21044 - DNA, 20 bp, Artificial Sequence
  Synthetic
gcagggcgtaactttgctaa

SEQ ID NO: 21045 - DNA, 24 bp, Artificial Sequence
  Synthetic
gcaatagctcctccattgacatta

SEQ ID NO: 21046 - DNA, 22 bp, Artificial Sequence
  Synthetic
accagtgcatcaattaacgctt

SEQ ID NO: 21047 - DNA, 25 bp, Artificial Sequence
  Synthetic
tgaggttaatcgaccaaaatcttct

SEQ ID NO: 21048 - DNA, 25 bp, Artificial Sequence
  Synthetic
gagcaacccttcaagataaacatct

SEQ ID NO: 21049 - DNA, 25 bp, Artificial Sequence
  Synthetic
gcttcttttgtagctactagtgtcg

SEQ ID NO: 21050 - DNA, 20 bp, Artificial Sequence
  Synthetic
acaatggggcatttccgatg

SEQ ID NO: 21051 - DNA, 24 bp, Artificial Sequence
  Synthetic
gaccttgaaagtggcaaagtttta

SEQ ID NO: 21052 - DNA, 25 bp, Artificial Sequence
  Synthetic
gcatttttattaccacaagctgcca

SEQ ID NO: 21053 - DNA, 25 bp, Artificial Sequence
  Synthetic
ccagtcacaaaatcttctgctgtta

SEQ ID NO: 21054 - DNA, 25 bp, Artificial Sequence
  Synthetic
caacattcttagcatcccagtagtt

SEQ ID NO: 21055 - DNA, 25 bp, Artificial Sequence
  Synthetic
acgaaaatccttgttgttaagagct

SEQ ID NO: 21056 - DNA, 25 bp, Artificial Sequence
  Synthetic
ctaattgaactgggaaggttacacc

SEQ ID NO: 21057 - DNA, 20 bp, Artificial Sequence
  Synthetic
tgtgtcatcagccagctgta

SEQ ID NO: 21058 - DNA, 20 bp, Artificial Sequence
  Synthetic
ggtgtccactcttgtgcctg

SEQ ID NO: 21059 - DNA, 22 bp, Artificial Sequence
  Synthetic
tgcttggggtaatggctcactg

SEQ ID NO: 21060 - DNA, 23 bp, Artificial Sequence
  Synthetic
cattggattgtaggcatggtttg

SEQ ID NO: 21061 - DNA, 22 bp, Artificial Sequence
  Synthetic
tctgtaatactgccgcgatctg

SEQ ID NO: 21062 - DNA, 20 bp, Artificial Sequence
  Synthetic
caggttttcgaggtgttgca

SEQ ID NO: 21063 - DNA, 24 bp, Artificial Sequence
  Synthetic
cagttggatgagttaggatcatcc

SEQ ID NO: 21064 - DNA, 25 bp, Artificial Sequence
  Synthetic
ggtttgaccatagagtcatattggt

SEQ ID NO: 21065 - DNA, 25 bp, Artificial Sequence
  Synthetic
ccaaaatcatctgattgagcagcta

SEQ ID NO: 21066 - DNA, 23 bp, Artificial Sequence
  Synthetic
ggacgtaattgccctcactattg

SEQ ID NO: 21067 - DNA, 25 bp, Artificial Sequence
  Synthetic
gctgctggtgttttagcaatgataa

SEQ ID NO: 21068 - DNA, 25 bp, Artificial Sequence
  Synthetic
cttctgtgccatacataccatagtt

SEQ ID NO: 21069 - DNA, 25 bp, Artificial Sequence
  Synthetic
aggaatagctcgctctttagggtaa

SEQ ID NO: 21070 - DNA, 21 bp, Artificial Sequence
  Synthetic
tgaaactgattggggctaacg

SEQ ID NO: 21071 - DNA, 23 bp, Artificial Sequence
  Synthetic
tgccttcaaaaatggcagctaaa

SEQ ID NO: 21072 - DNA, 25 bp, Artificial Sequence
  Synthetic
gctccgtatggtaaatagcttgtaa

SEQ ID NO: 21073 - DNA, 25 bp, Artificial Sequence
  Synthetic
gccgattagccttaagtttggttaa

SEQ ID NO: 21074 - DNA, 25 bp, Artificial Sequence
  Synthetic
cgtcatacaacctggtaaataaggt

SEQ ID NO: 21075 - DNA, 22 bp, Artificial Sequence
  Synthetic
ggcttatgcgcttgtttgtaag

SEQ ID NO: 21076 - DNA, 25 bp, Artificial Sequence
  Synthetic
ccgatttttacacacagttgtccta

SEQ ID NO: 21077 - DNA, 25 bp, Artificial Sequence
  Synthetic
agctaattgaacatctgctccaaca

SEQ ID NO: 21078 - DNA, 25 bp, Artificial Sequence
  Synthetic
aatcagattggcctttggtaattgt

SEQ ID NO: 21079 - DNA, 25 bp, Artificial Sequence
  Synthetic
gtgattcttgaagagtaccagcttt

SEQ ID NO: 21080 - DNA, 25 bp, Artificial Sequence
  Synthetic
cggtaccagtcttttctttgttgta

SEQ ID NO: 21081 - DNA, 24 bp, Artificial Sequence
  Synthetic
cacctccccataaaaatcccattt

SEQ ID NO: 21082 - DNA, 25 bp, Artificial Sequence
  Synthetic
cggtatattaagcgacataccagtc

SEQ ID NO: 21083 - DNA, 25 bp, Artificial Sequence
  Synthetic
gcgtcgtaaatggtattggattgat

SEQ ID NO: 21084 - DNA, 25 bp, Artificial Sequence
  Synthetic
ggtgattgacatgttcttgagtcaa

SEQ ID NO: 21085 - DNA, 25 bp, Artificial Sequence
  Synthetic
ggcaacaaatcagcaatcttgttaa

SEQ ID NO: 21086 - DNA, 25 bp, Artificial Sequence
  Synthetic
gatcgcctttgttactagattctct

SEQ ID NO: 21087 - DNA, 25 bp, Artificial Sequence
  Synthetic
ccacatatttgctttcttctagggt

SEQ ID NO: 21088 - DNA, 25 bp, Artificial Sequence
  Synthetic
ggtctaaaagagcaactcgattcaa

SEQ ID NO: 21089 - DNA, 22 bp, Artificial Sequence
  Synthetic
gccccaaagccttagaaagatt

SEQ ID NO: 21090 - DNA, 24 bp, Artificial Sequence
  Synthetic
cccttaagcatggtgataccgttt

SEQ ID NO: 21091 - DNA, 25 bp, Artificial Sequence
  Synthetic
ggtctccatgcaaatgagtaatgaa

SEQ ID NO: 21092 - DNA, 25 bp, Artificial Sequence
  Synthetic
cgtctagggttccttctaagtcttt

SEQ ID NO: 21093 - DNA, 21 bp, Artificial Sequence
  Synthetic
gcttcatgagcgatttgtgct

SEQ ID NO: 21094 - DNA, 21 bp, Artificial Sequence
  Synthetic
tccaactcgaggcattctttg

SEQ ID NO: 21095 - DNA, 21 bp, Artificial Sequence
  Synthetic
tccgataagggcaaacttggt

SEQ ID NO: 21096 - DNA, 25 bp, Artificial Sequence
  Synthetic
ccgctgttaaaaactcatctaaggc

SEQ ID NO: 21097 - DNA, 22 bp, Artificial Sequence
  Synthetic
ttaggcgtgtcaagaagacctt

SEQ ID NO: 21098 - DNA, 23 bp, Artificial Sequence
  Synthetic
tgagggcttcaactaaagcatcc

SEQ ID NO: 21099 - DNA, 21 bp, Artificial Sequence
  Synthetic
agccccatcagcaatcatttg

SEQ ID NO: 21100 - DNA, 25 bp, Artificial Sequence
  Synthetic
caaacgtcttgtgttacctcttgat

SEQ ID NO: 21101 - DNA, 21 bp, Artificial Sequence
  Synthetic
tgacatcgtgtacgcgtacaa

SEQ ID NO: 21102 - DNA, 23 bp, Artificial Sequence
  Synthetic
gttcacaaatcgcacctgctaaa

SEQ ID NO: 21103 - DNA, 25 bp, Artificial Sequence
  Synthetic
aagagattgctcaatagcttgtgtt

SEQ ID NO: 21104 - DNA, 23 bp, Artificial Sequence
  Synthetic
ggaaaagccaagaaatctgctgg

SEQ ID NO: 21105 - DNA, 23 bp, Artificial Sequence
  Synthetic
agcacccgcattcataaaaacag

SEQ ID NO: 21106 - DNA, 25 bp, Artificial Sequence
  Synthetic
gccctttaagatttgcttccatgat

SEQ ID NO: 21107 - DNA, 24 bp, Artificial Sequence
  Synthetic
ggttacttgattttcgttgtgcag

SEQ ID NO: 21108 - DNA, 24 bp, Artificial Sequence
  Synthetic
ggccttcaattcccttgtcaaatt

SEQ ID NO: 21109 - DNA, 22 bp, Artificial Sequence
  Synthetic
agcaacacgttggcaaaccatt

SEQ ID NO: 21110 - DNA, 22 bp, Artificial Sequence
  Synthetic
tattgccaccccatttgccatt

SEQ ID NO: 21111 - DNA, 25 bp, Artificial Sequence
  Synthetic
tggaggaattatggaaaatcaggaa

SEQ ID NO: 21112 - DNA, 23 bp, Artificial Sequence
  Synthetic
ttacctttcctttgcctacgttg

SEQ ID NO: 21113 - DNA, 25 bp, Artificial Sequence
  Synthetic
cggaagaaaaagatggtattgatgc

SEQ ID NO: 21114 - DNA, 25 bp, Artificial Sequence
  Synthetic
acaggctggtaccaattactcatta

SEQ ID NO: 21115 - DNA, 25 bp, Artificial Sequence
  Synthetic
ccagttacgtctttggaaaatgttt

SEQ ID NO: 21116 - DNA, 24 bp, Artificial Sequence
  Synthetic
gaatgtgccaagttgcaaaaatct

SEQ ID NO: 21117 - DNA, 23 bp, Artificial Sequence
  Synthetic
cttagtgactacacgcccaaaag

SEQ ID NO: 21118 - DNA, 20 bp, Artificial Sequence
  Synthetic
tgacgtgacagtcgaaagca

SEQ ID NO: 21119 - DNA, 24 bp, Artificial Sequence
  Synthetic
aggtctgcgctaagatatggtata

SEQ ID NO: 21120 - DNA, 21 bp, Artificial Sequence
  Synthetic
gaaggagatttcggacgaacc

SEQ ID NO: 21121 - DNA, 25 bp, Artificial Sequence
  Synthetic
tgcatttaatcttggagagcaagaa

SEQ ID NO: 21122 - DNA, 25 bp, Artificial Sequence
  Synthetic
tgctcttcctagatctcaaaaaagg

SEQ ID NO: 21123 - DNA, 21 bp, Artificial Sequence
  Synthetic
ggtggcggtgtagtggtttta

SEQ ID NO: 21124 - DNA, 22 bp, Artificial Sequence
  Synthetic
tgcagccttgcttgttaaacaa

SEQ ID NO: 21125 - DNA, 25 bp, Artificial Sequence
  Synthetic
aggaactatcatatcaggaggtctt

SEQ ID NO: 21126 - DNA, 25 bp, Artificial Sequence
  Synthetic
actcgaaaccatacagaagaaatga

SEQ ID NO: 21127 - DNA, 25 bp, Artificial Sequence
  Synthetic
cgcgaaatgctaagattatcggtaa

SEQ ID NO: 21128 - DNA, 25 bp, Artificial Sequence
  Synthetic
tcagccttctatcttgattttgcta

SEQ ID NO: 21129 - DNA, 23 bp, Artificial Sequence
  Synthetic
gcagatattcttcgactttgggt

SEQ ID NO: 21130 - DNA, 24 bp, Artificial Sequence
  Synthetic
ccaaatggcgagtttacaaaagaa

SEQ ID NO: 21131 - DNA, 24 bp, Artificial Sequence
  Synthetic
tctgtttctgatttccgtcaagat

SEQ ID NO: 21132 - DNA, 21 bp, Artificial Sequence
  Synthetic
gttacccttgagtcagggaca

SEQ ID NO: 21133 - DNA, 25 bp, Artificial Sequence
  Synthetic
cgattcaacctctttatactacgcc

SEQ ID NO: 21134 - DNA, 25 bp, Artificial Sequence
  Synthetic
cgtaaggagatggatttagcagaat

SEQ ID NO: 21135 - DNA, 20 bp, Artificial Sequence
  Synthetic
aaacagcctttccaatgcgc

SEQ ID NO: 21136 - DNA, 25 bp, Artificial Sequence
  Synthetic
agaggtaaatctcagtgaaacacaa

SEQ ID NO: 21137 - DNA, 25 bp, Artificial Sequence
  Synthetic
aggattaaaccgagtataagcgtag

SEQ ID NO: 21138 - DNA, 20 bp, Artificial Sequence
  Synthetic
ccttttcacggcggtaacac

SEQ ID NO: 21139 - DNA, 22 bp, Artificial Sequence
  Synthetic
gccccctgtgagataaggtagt

SEQ ID NO: 21140 - DNA, 22 bp, Artificial Sequence
  Synthetic
tggacttaccgctggtgtacca

SEQ ID NO: 21141 - DNA, 22 bp, Artificial Sequence
  Synthetic
gggcttagtgatccggtggtac

SEQ ID NO: 21142 - DNA, 22 bp, Artificial Sequence
  Synthetic
cgcagtgaataggcccaagcaa

SEQ ID NO: 21143 - DNA, 20 bp, Artificial Sequence
  Synthetic
gagtccggctaagcagtgag

SEQ ID NO: 21144 - DNA, 22 bp, Artificial Sequence
  Synthetic
tgtaccggggctaaaacagttt

SEQ ID NO: 21145 - DNA, 22 bp, Artificial Sequence
  Synthetic
cctacaacaagttcgagcccgt

SEQ ID NO: 21146 - DNA, 20 bp, Artificial Sequence
  Synthetic
tgagaggtcttgtggggcct

SEQ ID NO: 21147 - DNA, 25 bp, Artificial Sequence
  Synthetic
cgaaacgtaaagaagaagttgacct

SEQ ID NO: 21148 - DNA, 20 bp, Artificial Sequence
  Synthetic
gcagacaaccaaccagctgt

SEQ ID NO: 21149 - DNA, 24 bp, Artificial Sequence
  Synthetic
tgcaggattgtcattgtcagaaat

SEQ ID NO: 21150 - DNA, 24 bp, Artificial Sequence
  Synthetic
tccttgaattaggtgatggtgtct

SEQ ID NO: 21151 - DNA, 25 bp, Artificial Sequence
  Synthetic
tcgtacaactccttcagtagtatca

SEQ ID NO: 21152 - DNA, 25 bp, Artificial Sequence
  Synthetic
ccagcgatggtagttgtttataact

SEQ ID NO: 21153 - DNA, 21 bp, Artificial Sequence
  Synthetic
tcgttctcaggatctggcaaa

SEQ ID NO: 21154 - DNA, 25 bp, Artificial Sequence
  Synthetic
cgtaggtctgttagtttggtaaaca

SEQ ID NO: 21155 - DNA, 25 bp, Artificial Sequence
  Synthetic
gcagtttgctattccaagaaacttt

SEQ ID NO: 21156 - DNA, 23 bp, Artificial Sequence
  Synthetic
tggcaaaactagagaagttggga

SEQ ID NO: 21157 - DNA, 23 bp, Artificial Sequence
  Synthetic
gtcacatcacctcgtctatcacg

SEQ ID NO: 21158 - DNA, 20 bp, Artificial Sequence
  Synthetic
atttggtgagcacgagggat

SEQ ID NO: 21159 - DNA, 25 bp, Artificial Sequence
  Synthetic
acgatcgctggattctaaatttttg

SEQ ID NO: 21160 - DNA, 20 bp, Artificial Sequence
  Synthetic
ttgccgtattgctgttccgt

SEQ ID NO: 21161 - DNA, 25 bp, Artificial Sequence
  Synthetic
tctggtagtttttctttgaccttct

SEQ ID NO: 21162 - DNA, 25 bp, Artificial Sequence
  Synthetic
cataggctggcgatcaataaagatc

SEQ ID NO: 21163 - DNA, 25 bp, Artificial Sequence
  Synthetic
gagtttatcaaacgcttgaaaggct

SEQ ID NO: 21164 - DNA, 24 bp, Artificial Sequence
  Synthetic
agggtttgattttgccaaatcttg

SEQ ID NO: 21165 - DNA, 24 bp, Artificial Sequence
  Synthetic
cccgttcaaattggctcttgtatt

SEQ ID NO: 21166 - DNA, 20 bp, Artificial Sequence
  Synthetic
ggcttcttgttcagggaggg

SEQ ID NO: 21167 - DNA, 20 bp, Artificial Sequence
  Synthetic
acatgatgcgctcagaaggg

SEQ ID NO: 21168 - DNA, 25 bp, Artificial Sequence
  Synthetic
cagaaaaagcagctgaattggtaca

SEQ ID NO: 21169 - DNA, 25 bp, Artificial Sequence
  Synthetic
aggaccgtcatgaatactaaaatgt

SEQ ID NO: 21170 - DNA, 20 bp, Artificial Sequence
  Synthetic
attgcggtgtgaagacctgc

SEQ ID NO: 21171 - DNA, 25 bp, Artificial Sequence
  Synthetic
tccctacctagaagtttgtacttgt

SEQ ID NO: 21172 - DNA, 24 bp, Artificial Sequence
  Synthetic
gccaaatcgtaaacaacgttggaa

SEQ ID NO: 21173 - DNA, 23 bp, Artificial Sequence
  Synthetic
agaagcttcgcaatcactatcaa

SEQ ID NO: 21174 - DNA, 25 bp, Artificial Sequence
  Synthetic
cgatcagtgggttattggttatacg

SEQ ID NO: 21175 - DNA, 21 bp, Artificial Sequence
  Synthetic
agcgtgacaaccaatccattg

SEQ ID NO: 21176 - DNA, 25 bp, Artificial Sequence
  Synthetic
agtgaaaatccgactttcagaagtt

SEQ ID NO: 21177 - DNA, 22 bp, Artificial Sequence
  Synthetic
gcattagcaaaggcggtagccg

SEQ ID NO: 21178 - DNA, 21 bp, Artificial Sequence
  Synthetic
atgcaacggcggatgttgttg

SEQ ID NO: 21179 - DNA, 20 bp, Artificial Sequence
  Synthetic
gtccggcaacaacgcctcag

SEQ ID NO: 21180 - DNA, 21 bp, Artificial Sequence
  Synthetic
gggcatggggcaaggatttgc

SEQ ID NO: 21181 - DNA, 21 bp, Artificial Sequence
  Synthetic
gtgagggcgtactcatcggtg

SEQ ID NO: 21182 - DNA, 22 bp, Artificial Sequence
  Synthetic
tgacacccaatcccgacactgt

SEQ ID NO: 21183 - DNA, 22 bp, Artificial Sequence
  Synthetic
gcgcggatggtccaattatcca

SEQ ID NO: 21184 - DNA, 20 bp, Artificial Sequence
  Synthetic
ccaagatgcaggcgggggag

SEQ ID NO: 21185 - DNA, 22 bp, Artificial Sequence
  Synthetic
cctcataaactgccgccccatc

SEQ ID NO: 21186 - DNA, 21 bp, Artificial Sequence
  Synthetic
actcctgataggccacctgca

SEQ ID NO: 21187 - DNA, 22 bp, Artificial Sequence
  Synthetic
gccctccattgcgccttaagtt

SEQ ID NO: 21188 - DNA, 22 bp, Artificial Sequence
  Synthetic
actgtagccgccattctgttgg

SEQ ID NO: 21189 - DNA, 20 bp, Artificial Sequence
  Synthetic
gcctgtggccgaatgcttcg

SEQ ID NO: 21190 - DNA, 20 bp, Artificial Sequence
  Synthetic
aacagacggagcgactcccg

SEQ ID NO: 21191 - DNA, 21 bp, Artificial Sequence
  Synthetic
cgaacggagcaggtggtacaa

SEQ ID NO: 21192 - DNA, 22 bp, Artificial Sequence
  Synthetic
ctgcgtacgagccaacatcact

SEQ ID NO: 21193 - DNA, 19 bp, Artificial Sequence
  Synthetic
ttgagggccagaccaggct

SEQ ID NO: 21194 - DNA, 19 bp, Artificial Sequence
  Synthetic
attggtccgttggggcggg

SEQ ID NO: 21195 - DNA, 20 bp, Artificial Sequence
  Synthetic
ccaccgacgtggggactgtt

SEQ ID NO: 21196 - DNA, 22 bp, Artificial Sequence
  Synthetic
gcgatattcaacctggagggcg

SEQ ID NO: 21197 - DNA, 22 bp, Artificial Sequence
  Synthetic
ctctgcagagggcaaggtcacc

SEQ ID NO: 21198 - DNA, 25 bp, Artificial Sequence
  Synthetic
ctatcagagtcagtggtgttgtaat

SEQ ID NO: 21199 - DNA, 25 bp, Artificial Sequence
  Synthetic
cctaaccagtttacaaacttgacga

SEQ ID NO: 21200 - DNA, 21 bp, Artificial Sequence
  Synthetic
ccaaaagcaacaaaacggcat

SEQ ID NO: 21201 - DNA, 25 bp, Artificial Sequence
  Synthetic
ccacaattgcatttaacaaaagcat

SEQ ID NO: 21202 - DNA, 25 bp, Artificial Sequence
  Synthetic
gctagcagcaaatttaacatcttct

SEQ ID NO: 21203 - DNA, 25 bp, Artificial Sequence
  Synthetic
caacaatcttacctttagggcaaac

SEQ ID NO: 21204 - DNA, 25 bp, Artificial Sequence
  Synthetic
gctcccaaacattataacagtcctt

SEQ ID NO: 21205 - DNA, 25 bp, Artificial Sequence
  Synthetic
caagcaattttaccaaaacacgtct

SEQ ID NO: 21206 - DNA, 25 bp, Artificial Sequence
  Synthetic
gcaacttaatatgttgcccaatgac

SEQ ID NO: 21207 - DNA, 25 bp, Artificial Sequence
  Synthetic
acaacactcacctttttgaaaaagt

SEQ ID NO: 21208 - DNA, 25 bp, Artificial Sequence
  Synthetic
agaaacacagtttacaaggtgtgaa

SEQ ID NO: 21209 - DNA, 25 bp, Artificial Sequence
  Synthetic
cacacaacgaccaagatttttatca

SEQ ID NO: 21210 - DNA, 25 bp, Artificial Sequence
  Synthetic
tggagctacagataagacagtatca

SEQ ID NO: 21211 - DNA, 23 bp, Artificial Sequence
  Synthetic
aaccatctttaagcacactagca

SEQ ID NO: 21212 - DNA, 25 bp, Artificial Sequence
  Synthetic
caaacttagcctcatgccattgatt

SEQ ID NO: 21213 - DNA, 25 bp, Artificial Sequence
  Synthetic
acacgtccatcattaacataccatt

SEQ ID NO: 21214 - DNA, 24 bp, Artificial Sequence
  Synthetic
gcataatctaacatagccttggct

SEQ ID NO: 21215 - DNA, 24 bp, Artificial Sequence
  Synthetic
gacactgaaaaattatgcaaacgc

SEQ ID NO: 21216 - DNA, 25 bp, Artificial Sequence
  Synthetic
actaggttggtcatcaaaattacca

SEQ ID NO: 21217 - DNA, 25 bp, Artificial Sequence
  Synthetic
tgaagtccattagcaaccatgtatt

SEQ ID NO: 21218 - DNA, 25 bp, Artificial Sequence
  Synthetic
ggcacgcttcaattgtttaataagt

SEQ ID NO: 21219 - DNA, 25 bp, Artificial Sequence
  Synthetic
gaacaggtctaccatcattgtcttt

SEQ ID NO: 21220 - DNA, 25 bp, Artificial Sequence
  Synthetic
tccagaattaacagccaattcagtt

SEQ ID NO: 21221 - DNA, 25 bp, Artificial Sequence
  Synthetic
caacaaccacaaacattacacacat

SEQ ID NO: 21222 - DNA, 24 bp, Artificial Sequence
  Synthetic
gccaaagcaccagaaaagttaagt

SEQ ID NO: 21223 - DNA, 23 bp, Artificial Sequence
  Synthetic
acgcatttaagcatagctctagc

SEQ ID NO: 21224 - DNA, 25 bp, Artificial Sequence
  Synthetic
cctaactgagtgtgtgttaacatct

SEQ ID NO: 21225 - DNA, 25 bp, Artificial Sequence
  Synthetic
gcacgttctttaccactaatagcat

SEQ ID NO: 21226 - DNA, 25 bp, Artificial Sequence
  Synthetic
gcctataaaacctatctgttgcagt

SEQ ID NO: 21227 - DNA, 25 bp, Artificial Sequence
  Synthetic
ggtaccatctttgtcaactatttgc

SEQ ID NO: 21228 - DNA, 24 bp, Artificial Sequence
  Synthetic
ccagcagcttgcaatattgtagaa

SEQ ID NO: 21229 - DNA, 25 bp, Artificial Sequence
  Synthetic
gctagaatacttctcttggtttgca

SEQ ID NO: 21230 - DNA, 22 bp, Artificial Sequence
  Synthetic
gccacaaacatgagcactttca

SEQ ID NO: 21231 - DNA, 21 bp, Artificial Sequence
  Synthetic
ggaaccaacataaccccactg

SEQ ID NO: 21232 - DNA, 25 bp, Artificial Sequence
  Synthetic
tgggttgcataatcataatccaaca

SEQ ID NO: 21233 - DNA, 25 bp, Artificial Sequence
  Synthetic
gcaacattagtaggcaatgttgttt

SEQ ID NO: 21234 - DNA, 23 bp, Artificial Sequence
  Synthetic
caccacaacatccacctataagg

SEQ ID NO: 21235 - DNA, 21 bp, Artificial Sequence
  Synthetic
acacctttgtcagaaccagca

SEQ ID NO: 21236 - DNA, 25 bp, Artificial Sequence
  Synthetic
gttgaagaattgtcaggaacaccta

SEQ ID NO: 21237 - DNA, 25 bp, Artificial Sequence
  Synthetic
tggcacataaaaagtacgagttaca

SEQ ID NO: 21238 - DNA, 20 bp, Artificial Sequence
  Synthetic
agaccccgtccactagtgtg

SEQ ID NO: 21239 - DNA, 25 bp, Artificial Sequence
  Synthetic
atgagtagtgttgatagtgctgttt

SEQ ID NO: 21240 - DNA, 25 bp, Artificial Sequence
  Synthetic
agtctcaggcaaaacattatcatca

SEQ ID NO: 21241 - DNA, 22 bp, Artificial Sequence
  Synthetic
gtctggttggttacatggtgtc

SEQ ID NO: 21242 - DNA, 25 bp, Artificial Sequence
  Synthetic
gctaaacaacaaatcttccaaagca

SEQ ID NO: 21243 - DNA, 25 bp, Artificial Sequence
  Synthetic
gcctgaattgaattagaaatggcct

SEQ ID NO: 21244 - DNA, 20 bp, Artificial Sequence
  Synthetic
ggttgacgcagaacatagcc

SEQ ID NO: 21245 - DNA, 25 bp, Artificial Sequence
  Synthetic
caacaaaacacaagaagactcaaca

SEQ ID NO: 21246 - DNA, 25 bp, Artificial Sequence
  Synthetic
ggcacactactattagacatcgttt

SEQ ID NO: 21247 - DNA, 24 bp, Artificial Sequence
  Synthetic
gcagccatcaccggtaagtaataa

SEQ ID NO: 21248 - DNA, 24 bp, Artificial Sequence
  Synthetic
ggaaatttcttcctagcagctctg

SEQ ID NO: 21249 - DNA, 22 bp, Artificial Sequence
  Synthetic
cgtttgcgattaccaagactgg

SEQ ID NO: 21250 - DNA, 25 bp, Artificial Sequence
  Synthetic
ggtgacttcgactggttatcaaaac

SEQ ID NO: 21251 - DNA, 25 bp, Artificial Sequence
  Synthetic
cagtgctaacctcactatcaaagaa

SEQ ID NO: 21252 - DNA, 25 bp, Artificial Sequence
  Synthetic
cggtacctcataagactcctgataa

SEQ ID NO: 21253 - DNA, 24 bp, Artificial Sequence
  Synthetic
tcaccaagtgaggtttcctctaac

SEQ ID NO: 21254 - DNA, 23 bp, Artificial Sequence
  Synthetic
acaggttttgttgctcttgtacg

SEQ ID NO: 21255 - DNA, 25 bp, Artificial Sequence
  Synthetic
ccccatgtaaaaacagttgaagaca

SEQ ID NO: 21256 - DNA, 25 bp, Artificial Sequence
  Synthetic
gcgaaatggaaaagaacttgttctt

SEQ ID NO: 21257 - DNA, 20 bp, Artificial Sequence
  Synthetic
aacctcaagtgtgctgccac

SEQ ID NO: 21258 - DNA, 20 bp, Artificial Sequence
  Synthetic
tgctgggcggtgtcactctc

SEQ ID NO: 21259 - DNA, 23 bp, Artificial Sequence
  Synthetic
caagaaacttctctcgttgagcc

SEQ ID NO: 21260 - DNA, 25 bp, Artificial Sequence
  Synthetic
tcagcaattgttgtatgctcaattt

SEQ ID NO: 21261 - DNA, 25 bp, Artificial Sequence
  Synthetic
gttggtattgggaagtctctaccta

SEQ ID NO: 21262 - DNA, 21 bp, Artificial Sequence
  Synthetic
ctaccaaggggatatcctcgc

SEQ ID NO: 21263 - DNA, 22 bp, Artificial Sequence
  Synthetic
cactggtgtctgagcaagagca

SEQ ID NO: 21264 - DNA, 25 bp, Artificial Sequence
  Synthetic
tggaactaatgactgttgtttgact

SEQ ID NO: 21265 - DNA, 23 bp, Artificial Sequence
  Synthetic
gttgcatggtagaagagattggt

SEQ ID NO: 21266 - DNA, 25 bp, Artificial Sequence
  Synthetic
ttgtctagaatctccatttgcatga

SEQ ID NO: 21267 - DNA, 25 bp, Artificial Sequence
  Synthetic
gcttgaacaacatctaaagggacat

SEQ ID NO: 21268 - DNA, 22 bp, Artificial Sequence
  Synthetic
tcgctgaagccagtaagatcta

SEQ ID NO: 21269 - DNA, 25 bp, Artificial Sequence
  Synthetic
gggattaacaaaaagaaaggacagc

SEQ ID NO: 21270 - DNA, 20 bp, Artificial Sequence
  Synthetic
gttggcaaaccgtctttggg

SEQ ID NO: 21271 - DNA, 22 bp, Artificial Sequence
  Synthetic
cagttctctgatggagagcaga

SEQ ID NO: 21272 - DNA, 22 bp, Artificial Sequence
  Synthetic
ggaatttccctgactttgtggt

SEQ ID NO: 21273 - DNA, 23 bp, Artificial Sequence
  Synthetic
tgtcaacttcatttggcaacgat

SEQ ID NO: 21274 - DNA, 25 bp, Artificial Sequence
  Synthetic
gcaatatccattcaggtgtttttcc

SEQ ID NO: 21275 - DNA, 25 bp, Artificial Sequence
  Synthetic
gctgcaaccaaaaatgacttttact

SEQ ID NO: 21276 - DNA, 25 bp, Artificial Sequence
  Synthetic
gcacttgctcttgttttattaaggt

SEQ ID NO: 21277 - DNA, 24 bp, Artificial Sequence
  Synthetic
cctctaccagttccaataccaaga

SEQ ID NO: 21278 - DNA, 24 bp, Artificial Sequence
  Synthetic
ggaagatcagaagcagggtgaatt

SEQ ID NO: 21279 - DNA, 20 bp, Artificial Sequence
  Synthetic
gtgtcaaagctggatgcacg

SEQ ID NO: 21280 - DNA, 25 bp, Artificial Sequence
  Synthetic
ctcctgctttgtcatgatcactatt

SEQ ID NO: 21281 - DNA, 25 bp, Artificial Sequence
  Synthetic
gggcacatcagataaatttccttgt

SEQ ID NO: 21282 - DNA, 25 bp, Artificial Sequence
  Synthetic
tgggaacagcaaaataattgtctgt

SEQ ID NO: 21283 - DNA, 25 bp, Artificial Sequence
  Synthetic
cataccgtacttaaggagtcacatc

SEQ ID NO: 21284 - DNA, 22 bp, Artificial Sequence
  Synthetic
gacccacctcaatttgtgttgt

SEQ ID NO: 21285 - DNA, 22 bp, Artificial Sequence
  Synthetic
gctcaaacccttcaattccagc

SEQ ID NO: 21286 - DNA, 20 bp, Artificial Sequence
  Synthetic
gggtgcttgaggaaggttcc

SEQ ID NO: 21287 - DNA, 20 bp, Artificial Sequence
  Synthetic
gactcccaccgcagtttcag

SEQ ID NO: 21288 - DNA, 25 bp, Artificial Sequence
  Synthetic
gggaaaatttagcctatagcctagg

SEQ ID NO: 21289 - DNA, 20 bp, Artificial Sequence
  Synthetic
acactgcaaggtgacgttcc

SEQ ID NO: 21290 - DNA, 25 bp, Artificial Sequence
  Synthetic
gcagtcctatcaactgattgaatca

SEQ ID NO: 21291 - DNA, 25 bp, Artificial Sequence
  Synthetic
atgccaaatcttgcatatgtatggt

SEQ ID NO: 21292 - DNA, 25 bp, Artificial Sequence
  Synthetic
accaaactctaattgtcaattccca

SEQ ID NO: 21293 - DNA, 25 bp, Artificial Sequence
  Synthetic
atgagtaattttgatcccaccaccc

SEQ ID NO: 21294 - DNA, 25 bp, Artificial Sequence
  Synthetic
gccaggaacaaaacaaaacagtaat

SEQ ID NO: 21295 - DNA, 25 bp, Artificial Sequence
  Synthetic
cgttagaaggagaggtcaatctgtt

SEQ ID NO: 21296 - DNA, 21 bp, Artificial Sequence
  Synthetic
tgttgtgatagctcccacagg

SEQ ID NO: 21297 - DNA, 25 bp, Artificial Sequence
  Synthetic
tgaaacaagttgaaaaaccacctca

SEQ ID NO: 21298 - DNA, 25 bp, Artificial Sequence
  Synthetic
gcttcctgcattctatatgactctc

SEQ ID NO: 21299 - DNA, 25 bp, Artificial Sequence
  Synthetic
aatccaaacctccttaaagctctag

SEQ ID NO: 21300 - DNA, 22 bp, Artificial Sequence
  Synthetic
cctcatctgttgtgttttggcc

SEQ ID NO: 21301 - DNA, 25 bp, Artificial Sequence
  Synthetic
caacccacttgtgattagtaacaga

SEQ ID NO: 21302 - DNA, 24 bp, Artificial Sequence
  Synthetic
caactccaaactgaaccaagttct

SEQ ID NO: 21303 - DNA, 22 bp, Artificial Sequence
  Synthetic
tgcccaagattgcattctgtat

SEQ ID NO: 21304 - DNA, 25 bp, Artificial Sequence
  Synthetic
gccattggatcaatttcagctttag

SEQ ID NO: 21305 - DNA, 25 bp, Artificial Sequence
  Synthetic
gcaataaaccattttcatccaacca

SEQ ID NO: 21306 - DNA, 25 bp, Artificial Sequence
  Synthetic
cctgtatggaaacctggattcaaat

SEQ ID NO: 21307 - DNA, 20 bp, Artificial Sequence
  Synthetic
ttgccgtgctgttgtcattt

SEQ ID NO: 21308 - DNA, 22 bp, Artificial Sequence
  Synthetic
tttgctgcgttcaacaaaaagg

SEQ ID NO: 21309 - DNA, 25 bp, Artificial Sequence
  Synthetic
cccccaaatgtacagtttgtcaaat

SEQ ID NO: 21310 - DNA, 24 bp, Artificial Sequence
  Synthetic
cgtattttgaagtaaccccgagga

SEQ ID NO: 21311 - DNA, 25 bp, Artificial Sequence
  Synthetic
ccattttctatgaaacccgcgattg

SEQ ID NO: 21312 - DNA, 23 bp, Artificial Sequence
  Synthetic
cgcgttgtatgaccagagatcta

SEQ ID NO: 21313 - DNA, 25 bp, Artificial Sequence
  Synthetic
aggatccaatctttgtatcctgact

SEQ ID NO: 21314 - DNA, 25 bp, Artificial Sequence
  Synthetic
tccatctcaacaatgaacagagatc

SEQ ID NO: 21315 - DNA, 25 bp, Artificial Sequence
  Synthetic
tcgtcccttgactgttttttcataa

SEQ ID NO: 21316 - DNA, 20 bp, Artificial Sequence
  Synthetic
caggtcaatgggcaggacaa

SEQ ID NO: 21317 - DNA, 25 bp, Artificial Sequence
  Synthetic
acacccttctttaggatcaatacct

SEQ ID NO: 21318 - DNA, 22 bp, Artificial Sequence
  Synthetic
gctaagctgctgcaactctttc

SEQ ID NO: 21319 - DNA, 25 bp, Artificial Sequence
  Synthetic
cccgacaacaagtcttattgctatt

SEQ ID NO: 21320 - DNA, 20 bp, Artificial Sequence
  Synthetic
tgaagccacccatgaccatg

SEQ ID NO: 21321 - DNA, 20 bp, Artificial Sequence
  Synthetic
atgtgccagctgccttacag

SEQ ID NO: 21322 - DNA, 20 bp, Artificial Sequence
  Synthetic
actgaaggtgcaacagggtc

SEQ ID NO: 21323 - DNA, 20 bp, Artificial Sequence
  Synthetic
ttgagtgccaacctgtgctc

SEQ ID NO: 21324 - DNA, 23 bp, Artificial Sequence
  Synthetic
accacaatgatgacatctgcaaa

SEQ ID NO: 21325 - DNA, 22 bp, Artificial Sequence
  Synthetic
cggtaagtgtaccctaaaggcc

SEQ ID NO: 21326 - DNA, 20 bp, Artificial Sequence
  Synthetic
ccaatgttcccccaagcagg

SEQ ID NO: 21327 - DNA, 25 bp, Artificial Sequence
  Synthetic
cctctacaaaacatatgtctggcat

SEQ ID NO: 21328 - DNA, 25 bp, Artificial Sequence
  Synthetic
caatgtcacagtagttaccaggatg

SEQ ID NO: 21329 - DNA, 21 bp, Artificial Sequence
  Synthetic
cagcagaaagccggattgaat

SEQ ID NO: 21330 - DNA, 22 bp, Artificial Sequence
  Synthetic
tgacacaaacatgcaaccatgc

SEQ ID NO: 21331 - DNA, 22 bp, Artificial Sequence
  Synthetic
tcgaggataacaggaacactcc

SEQ ID NO: 21332 - DNA, 20 bp, Artificial Sequence
  Synthetic
tcccatccacacgtcatctc

SEQ ID NO: 21333 - DNA, 18 bp, Artificial Sequence
  Synthetic
gctgctccagcgtgtcgt

SEQ ID NO: 21334 - DNA, 21 bp, Artificial Sequence
  Synthetic
gctctcccactccaacacggg

SEQ ID NO: 21335 - DNA, 22 bp, Artificial Sequence
  Synthetic
tgcggagatgtggagagaaacg

SEQ ID NO: 21336 - DNA, 22 bp, Artificial Sequence
  Synthetic
acgtatacgaagggtggctcgt

SEQ ID NO: 21337 - DNA, 18 bp, Artificial Sequence
  Synthetic
tccgttgtgctcgacgcc

SEQ ID NO: 21338 - DNA, 22 bp, Artificial Sequence
  Synthetic
gcgtatcctcgtctgccctctg

SEQ ID NO: 21339 - DNA, 22 bp, Artificial Sequence
  Synthetic
gcggggctttctttgagttcgc

SEQ ID NO: 21340 - DNA, 19 bp, Artificial Sequence
  Synthetic
tctcgccgaggacgcgttc

SEQ ID NO: 21341 - DNA, 21 bp, Artificial Sequence
  Synthetic
ataccattcccaaccatccct

SEQ ID NO: 21342 - DNA, 20 bp, Artificial Sequence
  Synthetic
tggttaagctgggcgattgt

SEQ ID NO: 21343 - DNA, 20 bp, Artificial Sequence
  Synthetic
tgtgagtcaaaacggaggct

SEQ ID NO: 21344 - DNA, 21 bp, Artificial Sequence
  Synthetic
ccatttcccacaaagtctgcc

SEQ ID NO: 21345 - DNA, 22 bp, Artificial Sequence
  Synthetic
tgcaagtttgtaaggcgtgttt

SEQ ID NO: 21346 - DNA, 25 bp, Artificial Sequence
  Synthetic
cctctatgttgcgaaagtatgcttt

SEQ ID NO: 21347 - DNA, 23 bp, Artificial Sequence
  Synthetic
tctgcggtaaacctgtactagat

SEQ ID NO: 21348 - DNA, 20 bp, Artificial Sequence
  Synthetic
cagtgcgacacaactaacga

SEQ ID NO: 21349 - DNA, 21 bp, Artificial Sequence
  Synthetic
cgccccggctttataacattt

SEQ ID NO: 21350 - DNA, 21 bp, Artificial Sequence
  Synthetic
gttgctgtccggttgtaacat

SEQ ID NO: 21351 - DNA, 20 bp, Artificial Sequence
  Synthetic
ttttccccccctgatcggag

SEQ ID NO: 21352 - DNA, 20 bp, Artificial Sequence
  Synthetic
accctcgggaaggttctctt

SEQ ID NO: 21353 - DNA, 20 bp, Artificial Sequence
  Synthetic
atcgcgcaatcgaaccattc

SEQ ID NO: 21354 - DNA, 23 bp, Artificial Sequence
  Synthetic
gcaatgtgatcaacgacgtttta

SEQ ID NO: 21355 - DNA, 24 bp, Artificial Sequence
  Synthetic
caaagcaattcctctatcgcagaa

SEQ ID NO: 21356 - DNA, 22 bp, Artificial Sequence
  Synthetic
cctgtaaactggtctgcttgca

SEQ ID NO: 21357 - DNA, 22 bp, Artificial Sequence
  Synthetic
aatctctaacccgtcatctcca

SEQ ID NO: 21358 - DNA, 25 bp, Artificial Sequence
  Synthetic
cacaaatcatcgtcgaacaataagg

SEQ ID NO: 21359 - DNA, 22 bp, Artificial Sequence
  Synthetic
gattccgccgtactgaaaaaac

SEQ ID NO: 21360 - DNA, 21 bp, Artificial Sequence
  Synthetic
ggcagaacagagaccccccct

SEQ ID NO: 21361 - DNA, 19 bp, Artificial Sequence
  Synthetic
cgcgaagtgttccgcgacg

SEQ ID NO: 21362 - DNA, 20 bp, Artificial Sequence
  Synthetic
gggcgttcgttccgcacata

SEQ ID NO: 21363 - DNA, 19 bp, Artificial Sequence
  Synthetic
gcgatctccacctcgcgtg

SEQ ID NO: 21364 - DNA, 21 bp, Artificial Sequence
  Synthetic
aggaaaacgagtacgcgcacc

SEQ ID NO: 21365 - DNA, 24 bp, Artificial Sequence
  Synthetic
ccgacttcgataaacctcttggtt

SEQ ID NO: 21366 - DNA, 25 bp, Artificial Sequence
  Synthetic
tcctttttcaatttcttcttcccct

SEQ ID NO: 21367 - DNA, 22 bp, Artificial Sequence
  Synthetic
tggaacttctggtagctcatgg

SEQ ID NO: 21368 - DNA, 20 bp, Artificial Sequence
  Synthetic
catctcctgtggcccacttg

SEQ ID NO: 21369 - DNA, 25 bp, Artificial Sequence
  Synthetic
agggagccaattttaaagacagtat

SEQ ID NO: 21370 - DNA, 25 bp, Artificial Sequence
  Synthetic
tgagtcccaatactgaaagttttgg

SEQ ID NO: 21371 - DNA, 25 bp, Artificial Sequence
  Synthetic
gaaggttaacagagtgtgttactgt

SEQ ID NO: 21372 - DNA, 20 bp, Artificial Sequence
  Synthetic
tcctgggtaacacgttccat

SEQ ID NO: 21373 - DNA, 23 bp, Artificial Sequence
  Synthetic
agagactttgttggtcagcacta

SEQ ID NO: 21374 - DNA, 25 bp, Artificial Sequence
  Synthetic
cgtggactggtgtatctgaaatgat

SEQ ID NO: 21375 - DNA, 20 bp, Artificial Sequence
  Synthetic
tctaccatccctgtccaccc

SEQ ID NO: 21376 - DNA, 19 bp, Artificial Sequence
  Synthetic
agcacgagccaaggggacg

SEQ ID NO: 21377 - DNA, 19 bp, Artificial Sequence
  Synthetic
aggtgcgtacacggccacc

SEQ ID NO: 21378 - DNA, 20 bp, Artificial Sequence
  Synthetic
tcgttcaggtcaagcgccag

SEQ ID NO: 21379 - DNA, 21 bp, Artificial Sequence
  Synthetic
gcaggagtcggtcgatcgtct

SEQ ID NO: 21380 - DNA, 19 bp, Artificial Sequence
  Synthetic
gccggcgagcgtttgcttg

SEQ ID NO: 21381 - DNA, 20 bp, Artificial Sequence
  Synthetic
ctcatacgccacggggtccc

SEQ ID NO: 21382 - DNA, 19 bp, Artificial Sequence
  Synthetic
gcctccgctgcctatcgga

SEQ ID NO: 21383 - DNA, 20 bp, Artificial Sequence
  Synthetic
ggagaagaggtggcggctca

SEQ ID NO: 21384 - DNA, 19 bp, Artificial Sequence
  Synthetic
ttgcgtcgcttcgagcccg

SEQ ID NO: 21385 - DNA, 21 bp, Artificial Sequence
  Synthetic
gccaagctgtctcgcggatac

SEQ ID NO: 21386 - DNA, 20 bp, Artificial Sequence
  Synthetic
gtatgacggccccagattcg

SEQ ID NO: 21387 - DNA, 21 bp, Artificial Sequence
  Synthetic
atgagaacagctgctctctgt

SEQ ID NO: 21388 - DNA, 22 bp, Artificial Sequence
  Synthetic
cgtctgactgtttgcgattctg

SEQ ID NO: 21389 - DNA, 20 bp, Artificial Sequence
  Synthetic
cgtgcctgctttttagcgtg

SEQ ID NO: 21390 - DNA, 21 bp, Artificial Sequence
  Synthetic
tctcggattgcgtcgttatga

SEQ ID NO: 21391 - DNA, 23 bp, Artificial Sequence
  Synthetic
gcccagagagattgcaactactt

SEQ ID NO: 21392 - DNA, 20 bp, Artificial Sequence
  Synthetic
cggcccattggaacgaacat

SEQ ID NO: 21393 - DNA, 25 bp, Artificial Sequence
  Synthetic
cggtatacgcgtttagtagaatgct

SEQ ID NO: 21394 - DNA, 20 bp, Artificial Sequence
  Synthetic
gcgtgtttagtgggtgcagt

SEQ ID NO: 21395 - DNA, 24 bp, Artificial Sequence
  Synthetic
tcagacctctcatcgttcacataa

SEQ ID NO: 21396 - DNA, 22 bp, Artificial Sequence
  Synthetic
tggaagtccgacagatgcaata

SEQ ID NO: 21397 - DNA, 24 bp, Artificial Sequence
  Synthetic
agtcttagtgaggactgactttga

SEQ ID NO: 21398 - DNA, 24 bp, Artificial Sequence
  Synthetic
tcagacatgggaagcaagatacaa

SEQ ID NO: 21399 - DNA, 21 bp, Artificial Sequence
  Synthetic
acacaaggcaattttagccct

SEQ ID NO: 21400 - DNA, 21 bp, Artificial Sequence
  Synthetic
cgcccatatgctaaacgaacg

SEQ ID NO: 21401 - DNA, 25 bp, Artificial Sequence
  Synthetic
ggactagtgttcgcattagagaatc

SEQ ID NO: 21402 - DNA, 21 bp, Artificial Sequence
  Synthetic
cggcctggaatacaagaccat

SEQ ID NO: 21403 - DNA, 22 bp, Artificial Sequence
  Synthetic
accatgacctcgagaatctctc

SEQ ID NO: 21404 - DNA, 22 bp, Artificial Sequence
  Synthetic
agacgttcgagacctgttcaaa

SEQ ID NO: 21405 - DNA, 23 bp, Artificial Sequence
  Synthetic
acaaccattgagtgagaatacgc

SEQ ID NO: 21406 - DNA, 19 bp, Artificial Sequence
  Synthetic
cgagccaaggggacgatcc

SEQ ID NO: 21407 - DNA, 21 bp, Artificial Sequence
  Synthetic
cgtctccgatccgtcaggacc

SEQ ID NO: 21408 - DNA, 21 bp, Artificial Sequence
  Synthetic
tctcgctccgcttggttttcc

SEQ ID NO: 21409 - DNA, 21 bp, Artificial Sequence
  Synthetic
gtctgcggaccccgatgtaaa

SEQ ID NO: 21410 - DNA, 20 bp, Artificial Sequence
  Synthetic
cctcgccttgcaaactccgt

SEQ ID NO: 21411 - DNA, 25 bp, Artificial Sequence
  Synthetic
ccctcttgagcttcctatacagttt

SEQ ID NO: 21412 - DNA, 23 bp, Artificial Sequence
  Synthetic
agcgacggtaaatgcatttgaaa

SEQ ID NO: 21413 - DNA, 22 bp, Artificial Sequence
  Synthetic
ccgatcaaggaatggggcatca

SEQ ID NO: 21414 - DNA, 25 bp, Artificial Sequence
  Synthetic
ggcctattatcttttgcctaggcat

SEQ ID NO: 21415 - DNA, 25 bp, Artificial Sequence
  Synthetic
agtttctccaagcgaatctctgtat

SEQ ID NO: 21416 - DNA, 23 bp, Artificial Sequence
  Synthetic
ccagatcaggttttttgggttgg

SEQ ID NO: 21417 - DNA, 24 bp, Artificial Sequence
  Synthetic
tcttcttccactgttggtgcatat

SEQ ID NO: 21418 - DNA, 21 bp, Artificial Sequence
  Synthetic
ggttgctcacgctgtctattg

SEQ ID NO: 21419 - DNA, 21 bp, Artificial Sequence
  Synthetic
tctgtacctgaatcgtctgcc

SEQ ID NO: 21420 - DNA, 25 bp, Artificial Sequence
  Synthetic
cggactaagttgctgtataacatca

SEQ ID NO: 21421 - DNA, 22 bp, Artificial Sequence
  Synthetic
tgccgcactactgtttctctat

SEQ ID NO: 21422 - DNA, 22 bp, Artificial Sequence
  Synthetic
cccattatcatatgcccactgc

SEQ ID NO: 21423 - DNA, 20 bp, Artificial Sequence
  Synthetic
tcctggcacaaatctaggcg

SEQ ID NO: 21424 - DNA, 25 bp, Artificial Sequence
  Synthetic
cgtccatggctctaagttatattca

SEQ ID NO: 21425 - DNA, 24 bp, Artificial Sequence
  Synthetic
tgtttccagtgtccacgtattttc

SEQ ID NO: 21426 - DNA, 25 bp, Artificial Sequence
  Synthetic
ggtgtgtggtagatgtaacatgtac

SEQ ID NO: 21427 - DNA, 22 bp, Artificial Sequence
  Synthetic
cacaggcaaatatggtgtacct

SEQ ID NO: 21428 - DNA, 25 bp, Artificial Sequence
  Synthetic
ctctgtattgatgtccagacacttt

SEQ ID NO: 21429 - DNA, 25 bp, Artificial Sequence
  Synthetic
acccataccccaatattctccaata

SEQ ID NO: 21430 - DNA, 25 bp, Artificial Sequence
  Synthetic
cacacatacacaatcatcgttttgt

SEQ ID NO: 21431 - DNA, 25 bp, Artificial Sequence
  Synthetic
agtgtaattaaaggtgtggcaacct

SEQ ID NO: 21432 - DNA, 25 bp, Artificial Sequence
  Synthetic
tggtcgctcttctgtattttcaaat

SEQ ID NO: 21433 - DNA, 21 bp, Artificial Sequence
  Synthetic
gccccgtacactgaacaattg

SEQ ID NO: 21434 - DNA, 25 bp, Artificial Sequence
  Synthetic
caggtcaatctcagtttgtggtata

SEQ ID NO: 21435 - DNA, 24 bp, Artificial Sequence
  Synthetic
cgttttaatttctgcagcgtctgt

SEQ ID NO: 21436 - DNA, 23 bp, Artificial Sequence
  Synthetic
cacatccatatcacttcctgacc

SEQ ID NO: 21437 - DNA, 25 bp, Artificial Sequence
  Synthetic
ccactgcaccattttagatagttca

SEQ ID NO: 21438 - DNA, 22 bp, Artificial Sequence
  Synthetic
tgtactattggcttccagtccc

SEQ ID NO: 21439 - DNA, 25 bp, Artificial Sequence
  Synthetic
ggaccatgtcctttcaaaaaaacat

SEQ ID NO: 21440 - DNA, 22 bp, Artificial Sequence
  Synthetic
acgttttatggccgtcatgtat

SEQ ID NO: 21441 - DNA, 20 bp, Artificial Sequence
  Synthetic
cgggctctgtggttctggga

SEQ ID NO: 21442 - DNA, 25 bp, Artificial Sequence
  Synthetic
gcacagtttacatttgtccaatgat

SEQ ID NO: 21443 - DNA, 25 bp, Artificial Sequence
  Synthetic
gcaaaaacacaaaactaacacacaa

SEQ ID NO: 21444 - DNA, 20 bp, Artificial Sequence
  Synthetic
tacctcaccagtttggggga

SEQ ID NO: 21445 - DNA, 20 bp, Artificial Sequence
  Synthetic
atcaggatcaggtgccacac

SEQ ID NO: 21446 - DNA, 21 bp, Artificial Sequence
  Synthetic
gccataacgcaaatgtggagc

SEQ ID NO: 21447 - DNA, 22 bp, Artificial Sequence
  Synthetic
tgtcctctaagctagtggcaac

SEQ ID NO: 21448 - DNA, 23 bp, Artificial Sequence
  Synthetic
gtaaaagcatagttggcagccta

SEQ ID NO: 21449 - DNA, 20 bp, Artificial Sequence
  Synthetic
gaggggagggaaaaactggc

SEQ ID NO: 21450 - DNA, 22 bp, Artificial Sequence
  Synthetic
aggctggaccactgttaccagt

SEQ ID NO: 21451 - DNA, 22 bp, Artificial Sequence
  Synthetic
gcctcaacagatggtgattgta

SEQ ID NO: 21452 - DNA, 23 bp, Artificial Sequence
  Synthetic
caccagaaaattcagcacacatg

SEQ ID NO: 21453 - DNA, 25 bp, Artificial Sequence
  Synthetic
caaaggctgtgatgtaatgtctact

SEQ ID NO: 21454 - DNA, 21 bp, Artificial Sequence
  Synthetic
tccaacatcccacacaacatg

SEQ ID NO: 21455 - DNA, 24 bp, Artificial Sequence
  Synthetic
tgtcctgtccattatagtcagtgt

SEQ ID NO: 21456 - DNA, 25 bp, Artificial Sequence
  Synthetic
ccagaatattgacatattggtgcct

SEQ ID NO: 21457 - DNA, 25 bp, Artificial Sequence
  Synthetic
cagcacagtgaaattgtctaagatc

SEQ ID NO: 21458 - DNA, 22 bp, Artificial Sequence
  Synthetic
tggtgaaccattgcaaccaatt

SEQ ID NO: 21459 - DNA, 25 bp, Artificial Sequence
  Synthetic
tgtctccttcttttgtcttcttcca

SEQ ID NO: 21460 - DNA, 25 bp, Artificial Sequence
  Synthetic
cctcagcttgtacttacctggataa

SEQ ID NO: 21461 - DNA, 25 bp, Artificial Sequence
  Synthetic
agcaacgaatagtaatgctctgtaa

SEQ ID NO: 21462 - DNA, 25 bp, Artificial Sequence
  Synthetic
tgaaccatctgtactttcatcgaaa

SEQ ID NO: 21463 - DNA, 25 bp, Artificial Sequence
  Synthetic
tgcctcaattacttcttctaaagca

SEQ ID NO: 21464 - DNA, 25 bp, Artificial Sequence
  Synthetic
accatttgactgcaatctctaacat

SEQ ID NO: 21465 - DNA, 25 bp, Artificial Sequence
  Synthetic
ggtagtttaatttgttgtgggactc

SEQ ID NO: 21466 - DNA, 25 bp, Artificial Sequence
  Synthetic
ctcagaggcatactgtgatttactt

SEQ ID NO: 21467 - DNA, 22 bp, Artificial Sequence
  Synthetic
ggcctcctctcaggggaattga

SEQ ID NO: 21468 - DNA, 24 bp, Artificial Sequence
  Synthetic
cacgtttatttctacctgctctgt

SEQ ID NO: 21469 - DNA, 21 bp, Artificial Sequence
  Synthetic
tggattaccccctacaccacc

SEQ ID NO: 21470 - DNA, 20 bp, Artificial Sequence
  Synthetic
agtctgcatcaggagcagct

SEQ ID NO: 21471 - DNA, 25 bp, Artificial Sequence
  Synthetic
gctctgtttgtgatggtataatggt

SEQ ID NO: 21472 - DNA, 25 bp, Artificial Sequence
  Synthetic
tgggtatgtgttaggattttcaaca

SEQ ID NO: 21473 - DNA, 25 bp, Artificial Sequence
  Synthetic
gggaagcaagtttattatcctgctt

SEQ ID NO: 21474 - DNA, 25 bp, Artificial Sequence
  Synthetic
gcgtaagggtcagttttttccttat

SEQ ID NO: 21475 - DNA, 19 bp, Artificial Sequence
  Synthetic
actgtcgccagtggggtgc

SEQ ID NO: 21476 - DNA, 25 bp, Artificial Sequence
  Synthetic
acactatttgtcaccataagcaagt

SEQ ID NO: 21477 - DNA, 23 bp, Artificial Sequence
  Synthetic
tgcttcaacagttggtgacatta

SEQ ID NO: 21478 - DNA, 21 bp, Artificial Sequence
  Synthetic
acagattttgcccgaagatgc

SEQ ID NO: 21479 - DNA, 25 bp, Artificial Sequence
  Synthetic
agggtcccattacaattaaagaagg

SEQ ID NO: 21480 - DNA, 20 bp, Artificial Sequence
  Synthetic
cttggcagccgtgttggtaa

SEQ ID NO: 21481 - DNA, 25 bp, Artificial Sequence
  Synthetic
gtggtagaaaagagagtgttgctaa

SEQ ID NO: 21482 - DNA, 24 bp, Artificial Sequence
  Synthetic
accttgtctatgtagtcctcaact

SEQ ID NO: 21483 - DNA, 25 bp, Artificial Sequence
  Synthetic
catgctcttggaagtttatatccca

SEQ ID NO: 21484 - DNA, 25 bp, Artificial Sequence
  Synthetic
tctggggacatcataaccatcataa

SEQ ID NO: 21485 - DNA, 25 bp, Artificial Sequence
  Synthetic
tcagtcctgtggttaataaagtgtt

SEQ ID NO: 21486 - DNA, 25 bp, Artificial Sequence
  Synthetic
gtcgtgtgcttctaatttaactggt

SEQ ID NO: 21487 - DNA, 23 bp, Artificial Sequence
  Synthetic
gctaccaaaggcactccctaatt

SEQ ID NO: 21488 - DNA, 25 bp, Artificial Sequence
  Synthetic
ggtctagtgatgtttaaccactgac

SEQ ID NO: 21489 - DNA, 25 bp, Artificial Sequence
  Synthetic
acttcttgttgatcatacccatcaa

SEQ ID NO: 21490 - DNA, 25 bp, Artificial Sequence
  Synthetic
ggtacccttgcaagatcttaagatc

SEQ ID NO: 21491 - DNA, 23 bp, Artificial Sequence
  Synthetic
ccaagccctgaaatatagctgtt

SEQ ID NO: 21492 - DNA, 23 bp, Artificial Sequence
  Synthetic
actcaggtttcttcttgggtgta

SEQ ID NO: 21493 - DNA, 24 bp, Artificial Sequence
  Synthetic
cctatgatattacctgtgttggcc

SEQ ID NO: 21494 - DNA, 22 bp, Artificial Sequence
  Synthetic
gtgaggtctacttccaatcgtg

SEQ ID NO: 21495 - DNA, 25 bp, Artificial Sequence
  Synthetic
ccttgtgtctttagtagcgttgttt

SEQ ID NO: 21496 - DNA, 23 bp, Artificial Sequence
  Synthetic
gcatgcatttgtgaccaaaacac

SEQ ID NO: 21497 - DNA, 25 bp, Artificial Sequence
  Synthetic
tgcattgagtaaacaggatgtatca

SEQ ID NO: 21498 - DNA, 25 bp, Artificial Sequence
  Synthetic
cttctcttgtcttcctgatgtgtat

SEQ ID NO: 21499 - DNA, 20 bp, Artificial Sequence
  Synthetic
ttgtcggcccattcctgttc

SEQ ID NO: 21500 - DNA, 25 bp, Artificial Sequence
  Synthetic
ggagctcttctttcttctcttttgt

SEQ ID NO: 21501 - DNA, 25 bp, Artificial Sequence
  Synthetic
tgtgaattcttcatacccctcatgt

SEQ ID NO: 21502 - DNA, 21 bp, Artificial Sequence
  Synthetic
cctcaggagttgatgcatggg

SEQ ID NO: 21503 - DNA, 25 bp, Artificial Sequence
  Synthetic
tgtttcactaacctcttcaggagat

SEQ ID NO: 21504 - DNA, 20 bp, Artificial Sequence
  Synthetic
gacttgcttccgggctaggc

SEQ ID NO: 21505 - DNA, 21 bp, Artificial Sequence
  Synthetic
ggatttaacacggacgcggaa

SEQ ID NO: 21506 - DNA, 20 bp, Artificial Sequence
  Synthetic
cttcgtttgggtcgttctcc

SEQ ID NO: 21507 - DNA, 22 bp, Artificial Sequence
  Synthetic
ggtctgttcccggtgatattga

SEQ ID NO: 21508 - DNA, 22 bp, Artificial Sequence
  Synthetic
cccacgtcctgcaacaaatcct

SEQ ID NO: 21509 - DNA, 20 bp, Artificial Sequence
  Synthetic
gtctccaaaacccggagcac

SEQ ID NO: 21510 - DNA, 20 bp, Artificial Sequence
  Synthetic
tctgtccccgctgcctcatc

SEQ ID NO: 21511 - DNA, 20 bp, Artificial Sequence
  Synthetic
cttgcaatctgggcgcaggg

SEQ ID NO: 21512 - DNA, 22 bp, Artificial Sequence
  Synthetic
cggtacagactcccaggtagca

SEQ ID NO: 21513 - DNA, 21 bp, Artificial Sequence
  Synthetic
gatgccgttcaggttcaccct

SEQ ID NO: 21514 - DNA, 19 bp, Artificial Sequence
  Synthetic
tgctggaagcactgggcgc

SEQ ID NO: 21515 - DNA, 20 bp, Artificial Sequence
  Synthetic
cacctctaccgggtcctgga

SEQ ID NO: 21516 - DNA, 20 bp, Artificial Sequence
  Synthetic
tgcacaacatgaacccccgg

SEQ ID NO: 21517 - DNA, 19 bp, Artificial Sequence
  Synthetic
aaccgggtgcggcaagtcc

SEQ ID NO: 21518 - DNA, 22 bp, Artificial Sequence
  Synthetic
ccccgaaacgaggaagtctgct

SEQ ID NO: 21519 - DNA, 21 bp, Artificial Sequence
  Synthetic
ctgtacgccctgcaatccctc

SEQ ID NO: 21520 - DNA, 22 bp, Artificial Sequence
  Synthetic
gccttcgtctcagagtggtccg

SEQ ID NO: 21521 - DNA, 21 bp, Artificial Sequence
  Synthetic
tgacaacctgagtgccgaggt

SEQ ID NO: 21522 - DNA, 19 bp, Artificial Sequence
  Synthetic
cgcgtcaggattgtgcccg

SEQ ID NO: 21523 - DNA, 19 bp, Artificial Sequence
  Synthetic
tacgtgcgcgccagcatcc

SEQ ID NO: 21524 - DNA, 20 bp, Artificial Sequence
  Synthetic
cgctcaagcttacgccctcc

SEQ ID NO: 21525 - DNA, 22 bp, Artificial Sequence
  Synthetic
cgcccgcgattcatggaactat

SEQ ID NO: 21526 - DNA, 19 bp, Artificial Sequence
  Synthetic
ccccaagctggtcgccctt

SEQ ID NO: 21527 - DNA, 22 bp, Artificial Sequence
  Synthetic
cgccactcctgaagttcctcct

SEQ ID NO: 21528 - DNA, 20 bp, Artificial Sequence
  Synthetic
gttcaaagtcacggggcccg

SEQ ID NO: 21529 - DNA, 19 bp, Artificial Sequence
  Synthetic
cgccgtctttacgcggcac

SEQ ID NO: 21530 - DNA, 20 bp, Artificial Sequence
  Synthetic
ccaccgcccccagaggaaat

SEQ ID NO: 21531 - DNA, 21 bp, Artificial Sequence
  Synthetic
cggtcgatcttgacgcgctta

SEQ ID NO: 21532 - DNA, 19 bp, Artificial Sequence
  Synthetic
gctcaggggcgttggggtt

SEQ ID NO: 21533 - DNA, 19 bp, Artificial Sequence
  Synthetic
atgctcgaggacctggccc

SEQ ID NO: 21534 - DNA, 19 bp, Artificial Sequence
  Synthetic
ctcgaaccggggtacacgc

SEQ ID NO: 21535 - DNA, 19 bp, Artificial Sequence
  Synthetic
aaaagggggctcgctcgcc

SEQ ID NO: 21536 - DNA, 22 bp, Artificial Sequence
  Synthetic
ggtgcgcacgtggttgttgaaa

SEQ ID NO: 21537 - DNA, 22 bp, Artificial Sequence
  Synthetic
gggcacgtacggcgtcttgtaa

SEQ ID NO: 21538 - DNA, 22 bp, Artificial Sequence
  Synthetic
gggcttgctgctgggacatcta

SEQ ID NO: 21539 - DNA, 19 bp, Artificial Sequence
  Synthetic
gctgttgtagcggcccacg

SEQ ID NO: 21540 - DNA, 22 bp, Artificial Sequence
  Synthetic
cccgcgtaggttcttgaaagcc

SEQ ID NO: 21541 - DNA, 22 bp, Artificial Sequence
  Synthetic
cgtactgcggcggaattttctg

SEQ ID NO: 21542 - DNA, 21 bp, Artificial Sequence
  Synthetic
cgggagccaatgcgggttcaa

SEQ ID NO: 21543 - DNA, 22 bp, Artificial Sequence
  Synthetic
agcgtaggtcttccagcggttt

SEQ ID NO: 21544 - DNA, 21 bp, Artificial Sequence
  Synthetic
catcacgctctcgtacgaggg

SEQ ID NO: 21545 - DNA, 22 bp, Artificial Sequence
  Synthetic
ggtcccagcccagcttgaaatt

SEQ ID NO: 21546 - DNA, 25 bp, Artificial Sequence
  Synthetic
aggagcattaactttagcagcattt

SEQ ID NO: 21547 - DNA, 21 bp, Artificial Sequence
  Synthetic
gctgggtggagcgaaaggtga

SEQ ID NO: 21548 - DNA, 20 bp, Artificial Sequence
  Synthetic
tgcccagggccttgtagacg

SEQ ID NO: 21549 - DNA, 22 bp, Artificial Sequence
  Synthetic
gcgtcagcgactacggagtcaa

SEQ ID NO: 21550 - DNA, 19 bp, Artificial Sequence
  Synthetic
tttccgcgcctgggtctgg

SEQ ID NO: 21551 - DNA, 19 bp, Artificial Sequence
  Synthetic
caacacgcgctgcaccctg

SEQ ID NO: 21552 - DNA, 19 bp, Artificial Sequence
  Synthetic
ggtgtccagcacgtcctcc

SEQ ID NO: 21553 - DNA, 19 bp, Artificial Sequence
  Synthetic
aggctcggtggccgtggat

SEQ ID NO: 21554 - DNA, 22 bp, Artificial Sequence
  Synthetic
cggcgggatcttcctcggtaat

SEQ ID NO: 21555 - DNA, 21 bp, Artificial Sequence
  Synthetic
cgttccaggtgcccatgaacg

SEQ ID NO: 21556 - DNA, 22 bp, Artificial Sequence
  Synthetic
gcatcttccatctccaccaccg

SEQ ID NO: 21557 - DNA, 19 bp, Artificial Sequence
  Synthetic
tgccagttctgggcctggc

SEQ ID NO: 21558 - DNA, 22 bp, Artificial Sequence
  Synthetic
ggagccaccgtggggtttctaa

SEQ ID NO: 21559 - DNA, 22 bp, Artificial Sequence
  Synthetic
aattgttatgtcagcgcctccc

SEQ ID NO: 21560 - DNA, 23 bp, Artificial Sequence
  Synthetic
acccagagaatctagcaaaagct

SEQ ID NO: 21561 - DNA, 20 bp, Artificial Sequence
  Synthetic
tggtgttggtgggcagtgtg

SEQ ID NO: 21562 - DNA, 20 bp, Artificial Sequence
  Synthetic
gttgcccagggaactctgca

SEQ ID NO: 21563 - DNA, 22 bp, Artificial Sequence
  Synthetic
acgctgcgcttaatctcgaact

SEQ ID NO: 21564 - DNA, 19 bp, Artificial Sequence
  Synthetic
cctggcgcatggtaggtgc

SEQ ID NO: 21565 - DNA, 20 bp, Artificial Sequence
  Synthetic
gtagacggcctcgatgacgc

SEQ ID NO: 21566 - DNA, 19 bp, Artificial Sequence
  Synthetic
tctgcttaagccggcggtc

SEQ ID NO: 21567 - DNA, 22 bp, Artificial Sequence
  Synthetic
gcacctgtggcgattgtagcat

SEQ ID NO: 21568 - DNA, 22 bp, Artificial Sequence
  Synthetic
ccccgagattgctgttcccaaa

SEQ ID NO: 21569 - DNA, 20 bp, Artificial Sequence
  Synthetic
tacccgaatatgcagcgcgg

SEQ ID NO: 21570 - DNA, 21 bp, Artificial Sequence
  Synthetic
gctcaagtgtctgcacgggac

SEQ ID NO: 21571 - DNA, 20 bp, Artificial Sequence
  Synthetic
tgctgatggaacgctaccgc

SEQ ID NO: 21572 - DNA, 22 bp, Artificial Sequence
  Synthetic
cgaggaggacgtggttccactg

SEQ ID NO: 21573 - DNA, 22 bp, Artificial Sequence
  Synthetic
tcctgtgggggttctagacgag

SEQ ID NO: 21574 - DNA, 20 bp, Artificial Sequence
  Synthetic
tcgacgctgcgcttaagcac

SEQ ID NO: 21575 - DNA, 22 bp, Artificial Sequence
  Synthetic
tgtagtgcagggtctcctcgac

SEQ ID NO: 21576 - DNA, 22 bp, Artificial Sequence
  Synthetic
gcccgtccacaacgttttaagg

SEQ ID NO: 21577 - DNA, 19 bp, Artificial Sequence
  Synthetic
actcaagcagcccctcgcc

SEQ ID NO: 21578 - DNA, 21 bp, Artificial Sequence
  Synthetic
gatcgtgccctgggtgatgac

SEQ ID NO: 21579 - DNA, 20 bp, Artificial Sequence
  Synthetic
acgaggaggcttgaccggag

SEQ ID NO: 21580 - DNA, 22 bp, Artificial Sequence
  Synthetic
gctgacctcgactctgctgaaa

SEQ ID NO: 21581 - DNA, 22 bp, Artificial Sequence
  Synthetic
gccagctggacacctgagttag

SEQ ID NO: 21582 - DNA, 20 bp, Artificial Sequence
  Synthetic
ggcctggggagcctgaaaag

SEQ ID NO: 21583 - DNA, 25 bp, Artificial Sequence
  Synthetic
tccagagtagagtcttatttcagct

SEQ ID NO: 21584 - DNA, 25 bp, Artificial Sequence
  Synthetic
caccagggaaaggataattagcaaa

SEQ ID NO: 21585 - DNA, 24 bp, Artificial Sequence
  Synthetic
acctgacataaagcaggccataat

SEQ ID NO: 21586 - DNA, 23 bp, Artificial Sequence
  Synthetic
agctatgcttgatttgtgggttt

SEQ ID NO: 21587 - DNA, 25 bp, Artificial Sequence
  Synthetic
ctttgagcagtattaccttgtccaa

SEQ ID NO: 21588 - DNA, 25 bp, Artificial Sequence
  Synthetic
gaggttctttggtatgtggcttaat

SEQ ID NO: 21589 - DNA, 25 bp, Artificial Sequence
  Synthetic
acaaagtacaaaagaaccacgagaa

SEQ ID NO: 21590 - DNA, 21 bp, Artificial Sequence
  Synthetic
gcagacaatgctgcagacgca

SEQ ID NO: 21591 - DNA, 25 bp, Artificial Sequence
  Synthetic
cgagatcaaaacaggggtagatcat

SEQ ID NO: 21592 - DNA, 22 bp, Artificial Sequence
  Synthetic
cccgtctgctgggtgatgacta

SEQ ID NO: 21593 - DNA, 20 bp, Artificial Sequence
  Synthetic
tgagtgacagaaccccaggg

SEQ ID NO: 21594 - DNA, 25 bp, Artificial Sequence
  Synthetic
aaatgctaccaagtctccattatca

SEQ ID NO: 21595 - DNA, 25 bp, Artificial Sequence
  Synthetic
gccaaggtagatgtttccataaact

SEQ ID NO: 21596 - DNA, 21 bp, Artificial Sequence
  Synthetic
aaggccacccgtactgagaga

SEQ ID NO: 21597 - DNA, 25 bp, Artificial Sequence
  Synthetic
tgggctgctgaataacataatgatt

SEQ ID NO: 21598 - DNA, 23 bp, Artificial Sequence
  Synthetic
cctgggatatgatcctgaccaca

SEQ ID NO: 21599 - DNA, 22 bp, Artificial Sequence
  Synthetic
ggcagcattaactggatgggga

SEQ ID NO: 21600 - DNA, 25 bp, Artificial Sequence
  Synthetic
tggacttacaccaacaatttgtaga

SEQ ID NO: 21601 - DNA, 25 bp, Artificial Sequence
  Synthetic
cctggctttatcacttacattttgg

SEQ ID NO: 21602 - DNA, 21 bp, Artificial Sequence
  Synthetic
ccgatgtgatttttgccggaa

SEQ ID NO: 21603 - DNA, 24 bp, Artificial Sequence
  Synthetic
cgtcagtgtaagttgcctttaagt

SEQ ID NO: 21604 - DNA, 21 bp, Artificial Sequence
  Synthetic
gatgctctcacttctcctgga

SEQ ID NO: 21605 - DNA, 25 bp, Artificial Sequence
  Synthetic
caggatatccatatgtctgaagcaa

SEQ ID NO: 21606 - DNA, 20 bp, Artificial Sequence
  Synthetic
agctccacagtgctggatag

SEQ ID NO: 21607 - DNA, 21 bp, Artificial Sequence
  Synthetic
ccagttcttgttgtcccgatc

SEQ ID NO: 21608 - DNA, 24 bp, Artificial Sequence
  Synthetic
cattctcatagtcagcatcactgc

SEQ ID NO: 21609 - DNA, 22 bp, Artificial Sequence
  Synthetic
cttctccaatttctgtgggctt

SEQ ID NO: 21610 - DNA, 25 bp, Artificial Sequence
  Synthetic
gttgatcaaggattctagcatgtgt

SEQ ID NO: 21611 - DNA, 25 bp, Artificial Sequence
  Synthetic
cttgggttggtaatgacatcagtta

SEQ ID NO: 21612 - DNA, 23 bp, Artificial Sequence
  Synthetic
gctgctgactcttcgttctttga

SEQ ID NO: 21613 - DNA, 24 bp, Artificial Sequence
  Synthetic
tgtctttcccttttgtgaagactg

SEQ ID NO: 21614 - DNA, 24 bp, Artificial Sequence
  Synthetic
gagaggttctactgtcccattttc

SEQ ID NO: 21615 - DNA, 23 bp, Artificial Sequence
  Synthetic
ggagcatggatcgaatctaccat

SEQ ID NO: 21616 - DNA, 24 bp, Artificial Sequence
  Synthetic
ttgagttcggtaatgcaagatctg

SEQ ID NO: 21617 - DNA, 25 bp, Artificial Sequence
  Synthetic
tccattaaaggatagcaaactgctt

SEQ ID NO: 21618 - DNA, 24 bp, Artificial Sequence
  Synthetic
gctgagctttttgagactcttgtc

SEQ ID NO: 21619 - DNA, 25 bp, Artificial Sequence
  Synthetic
gcaccaaagaatctagtttgtggat

SEQ ID NO: 21620 - DNA, 25 bp, Artificial Sequence
  Synthetic
acctgttcagtgtaaatgatgtcat

SEQ ID NO: 21621 - DNA, 25 bp, Artificial Sequence
  Synthetic
gaatgtaactcctcttgagcgatct

SEQ ID NO: 21622 - DNA, 25 bp, Artificial Sequence
  Synthetic
gactggattgtctttaaccctaagt

SEQ ID NO: 21623 - DNA, 21 bp, Artificial Sequence
  Synthetic
cagaaatcgtgtgggtccaga

SEQ ID NO: 21624 - DNA, 23 bp, Artificial Sequence
  Synthetic
tcctgcagctattacagaacatg

SEQ ID NO: 21625 - DNA, 25 bp, Artificial Sequence
  Synthetic
cgtaccctaggaaaatgagtgtatt

SEQ ID NO: 21626 - DNA, 23 bp, Artificial Sequence
  Synthetic
agtgccaacctgaagatctagta

SEQ ID NO: 21627 - DNA, 22 bp, Artificial Sequence
  Synthetic
tggtgggattaacacgtgatgt

SEQ ID NO: 21628 - DNA, 25 bp, Artificial Sequence
  Synthetic
cggataaggttcaaaagtgtaacga

SEQ ID NO: 21629 - DNA, 20 bp, Artificial Sequence
  Synthetic
cgagtcgtccagctgaagac

SEQ ID NO: 21630 - DNA, 25 bp, Artificial Sequence
  Synthetic
cccattttcactgaataactcacct

SEQ ID NO: 21631 - DNA, 25 bp, Artificial Sequence
  Synthetic
tgctatagcttgattgtctccttgt

SEQ ID NO: 21632 - DNA, 25 bp, Artificial Sequence
  Synthetic
gctgtagacatatagttgaaccctc

SEQ ID NO: 21633 - DNA, 25 bp, Artificial Sequence
  Synthetic
gtggattggtcttccataagttaga

SEQ ID NO: 21634 - DNA, 25 bp, Artificial Sequence
  Synthetic
ttctctaaacttaagttagccctgg

SEQ ID NO: 21635 - DNA, 20 bp, Artificial Sequence
  Synthetic
tccctctgacgtttaacccg

SEQ ID NO: 21636 - DNA, 23 bp, Artificial Sequence
  Synthetic
agcatactatcggcatcaggatc

SEQ ID NO: 21637 - DNA, 25 bp, Artificial Sequence
  Synthetic
ggtaagttccaatgctttcaaacaa

SEQ ID NO: 21638 - DNA, 24 bp, Artificial Sequence
  Synthetic
aggatctccagtataagggaatgt

SEQ ID NO: 21639 - DNA, 25 bp, Artificial Sequence
  Synthetic
gtttgtccactcttgtttgttgaat

SEQ ID NO: 21640 - DNA, 25 bp, Artificial Sequence
  Synthetic
tggtcatgttgtctcttactcttct

SEQ ID NO: 21641 - DNA, 24 bp, Artificial Sequence
  Synthetic
ccttcttttcattacctccaaccg

SEQ ID NO: 21642 - DNA, 24 bp, Artificial Sequence
  Synthetic
tcgaacatgtaacctttccctagt

SEQ ID NO: 21643 - DNA, 20 bp, Artificial Sequence
  Synthetic
agtccgtcccaccagtatgt

SEQ ID NO: 21644 - DNA, 24 bp, Artificial Sequence
  Synthetic
agccgattcattaattccagacac

SEQ ID NO: 21645 - DNA, 21 bp, Artificial Sequence
  Synthetic
gcctcccctgatagtcttcat

SEQ ID NO: 21646 - DNA, 25 bp, Artificial Sequence
  Synthetic
actgctagggaagaatttctcaaat

SEQ ID NO: 21647 - DNA, 25 bp, Artificial Sequence
  Synthetic
tgcagagcaggaaaatattagttgg

SEQ ID NO: 21648 - DNA, 22 bp, Artificial Sequence
  Synthetic
ccgtcctgttgtctgttccaca

SEQ ID NO: 21649 - DNA, 22 bp, Artificial Sequence
  Synthetic
acgcacactatcctcctcctct

SEQ ID NO: 21650 - DNA, 25 bp, Artificial Sequence
  Synthetic
gctagtccaaataggtccttgaatt

SEQ ID NO: 21651 - DNA, 25 bp, Artificial Sequence
  Synthetic
ggtatgtttaacagttttcccatgc

SEQ ID NO: 21652 - DNA, 23 bp, Artificial Sequence
  Synthetic
cctcatttcccagcaatgcatat

SEQ ID NO: 21653 - DNA, 22 bp, Artificial Sequence
  Synthetic
gcaaaatagcgacttccctgtg

SEQ ID NO: 21654 - DNA, 24 bp, Artificial Sequence
  Synthetic
ggtctagtaatttctcctggcacg

SEQ ID NO: 21655 - DNA, 21 bp, Artificial Sequence
  Synthetic
tttccaaagaggtggtttgca

SEQ ID NO: 21656 - DNA, 25 bp, Artificial Sequence
  Synthetic
gcacaacaatcctacatatatggca

SEQ ID NO: 21657 - DNA, 20 bp, Artificial Sequence
  Synthetic
tacagtaggaggccgggtgc

SEQ ID NO: 21658 - DNA, 22 bp, Artificial Sequence
  Synthetic
cccctgcctgaggaggttcaat

SEQ ID NO: 21659 - DNA, 22 bp, Artificial Sequence
  Synthetic
ggcaccaaaggctgtaactcca

SEQ ID NO: 21660 - DNA, 25 bp, Artificial Sequence
  Synthetic
gcaacaaataaaaatcagagccctg

SEQ ID NO: 21661 - DNA, 21 bp, Artificial Sequence
  Synthetic
gtgtttttcttgccctgcagc

SEQ ID NO: 21662 - DNA, 25 bp, Artificial Sequence
  Synthetic
agcagccatttgtaaataatcagga

SEQ ID NO: 21663 - DNA, 21 bp, Artificial Sequence
  Synthetic
ataccattgttgtggccctgg

SEQ ID NO: 21664 - DNA, 25 bp, Artificial Sequence
  Synthetic
ggactgcaaaaacctatatgtgtct

SEQ ID NO: 21665 - DNA, 23 bp, Artificial Sequence
  Synthetic
acatgcacaacaacagcatacag

SEQ ID NO: 21666 - DNA, 22 bp, Artificial Sequence
  Synthetic
acagaaatggggaagctgcaca

SEQ ID NO: 21667 - DNA, 25 bp, Artificial Sequence
  Synthetic
cacagtaattgcacaacatgtcaaa

SEQ ID NO: 21668 - DNA, 23 bp, Artificial Sequence
  Synthetic
gctgttatattgcgggcataagt

SEQ ID NO: 21669 - DNA, 25 bp, Artificial Sequence
  Synthetic
tctgtatagtttgagcgttgaaaga

SEQ ID NO: 21670 - DNA, 19 bp, Artificial Sequence
  Synthetic
ggacatgggctgccagacc

SEQ ID NO: 21671 - DNA, 19 bp, Artificial Sequence
  Synthetic
acgggattggtcggccgaa

SEQ ID NO: 21672 - DNA, 20 bp, Artificial Sequence
  Synthetic
taagcaaaggggggatgggt

SEQ ID NO: 21673 - DNA, 20 bp, Artificial Sequence
  Synthetic
tatcccgcatgtaagctggc

SEQ ID NO: 21674 - DNA, 18 bp, Artificial Sequence
  Synthetic
tacaccatgcgcggcggt

SEQ ID NO: 21675 - DNA, 19 bp, Artificial Sequence
  Synthetic
tacgtgcaggcgccacacg

SEQ ID NO: 21676 - DNA, 21 bp, Artificial Sequence
  Synthetic
gctggacacgcccatctcctc

SEQ ID NO: 21677 - DNA, 21 bp, Artificial Sequence
  Synthetic
gcagcacgcaaaagagcaggt

SEQ ID NO: 21678 - DNA, 19 bp, Artificial Sequence
  Synthetic
ccccattgacgcgtctgcc

SEQ ID NO: 21679 - DNA, 21 bp, Artificial Sequence
  Synthetic
ccgaacagaagatgggacgcc

SEQ ID NO: 21680 - DNA, 22 bp, Artificial Sequence
  Synthetic
accgcatctcttggcgtttacc

SEQ ID NO: 21681 - DNA, 20 bp, Artificial Sequence
  Synthetic
acaggcaaaacacgccgtgg

SEQ ID NO: 21682 - DNA, 18 bp, Artificial Sequence
  Synthetic
cgcgcttcagtgcaccgt

SEQ ID NO: 21683 - DNA, 23 bp, Artificial Sequence
  Synthetic
cactgataacatgtaactccgcc

SEQ ID NO: 21684 - DNA, 22 bp, Artificial Sequence
  Synthetic
ggtcacgggcgtgttcagtaat

SEQ ID NO: 21685 - DNA, 20 bp, Artificial Sequence
  Synthetic
cctgccgttgttctttgcgg

SEQ ID NO: 21686 - DNA, 19 bp, Artificial Sequence
  Synthetic
tttgtgggagcgtccggcc

SEQ ID NO: 21687 - DNA, 19 bp, Artificial Sequence
  Synthetic
cggcaccgttgtcgcagta

SEQ ID NO: 21688 - DNA, 19 bp, Artificial Sequence
  Synthetic
ggcttctggttgggcgagc

SEQ ID NO: 21689 - DNA, 22 bp, Artificial Sequence
  Synthetic
ccccgtgttgttctgccgtatt

SEQ ID NO: 21690 - DNA, 20 bp, Artificial Sequence
  Synthetic
gcccgggtatgcgaaaccat

SEQ ID NO: 21691 - DNA, 19 bp, Artificial Sequence
  Synthetic
tgcacctctggcgccacag

SEQ ID NO: 21692 - DNA, 19 bp, Artificial Sequence
  Synthetic
tcagggcgcgtctggtctc

SEQ ID NO: 21693 - DNA, 22 bp, Artificial Sequence
  Synthetic
gtgaatgagggcgcatctacct

SEQ ID NO: 21694 - DNA, 19 bp, Artificial Sequence
  Synthetic
acgcctctgaggacgctgc

SEQ ID NO: 21695 - DNA, 21 bp, Artificial Sequence
  Synthetic
ggccaccgcgtccttcatttc

SEQ ID NO: 21696 - DNA, 22 bp, Artificial Sequence
  Synthetic
cctgttggacgatctcgcacat

SEQ ID NO: 21697 - DNA, 21 bp, Artificial Sequence
  Synthetic
ggcgatgtgctgggggtgata

SEQ ID NO: 21698 - DNA, 21 bp, Artificial Sequence
  Synthetic
cgcgtgaggtgaggtggacat

SEQ ID NO: 21699 - DNA, 19 bp, Artificial Sequence
  Synthetic
ttggggtaacggcgggcac

SEQ ID NO: 21700 - DNA, 18 bp, Artificial Sequence
  Synthetic
tgcgagcaggagggacct

SEQ ID NO: 21701 - DNA, 20 bp, Artificial Sequence
  Synthetic
tccctgggcaggcggaatag

SEQ ID NO: 21702 - DNA, 21 bp, Artificial Sequence
  Synthetic
gcagcagcaggatgagcagca

SEQ ID NO: 21703 - DNA, 22 bp, Artificial Sequence
  Synthetic
gcactcttaccccccgtaacca

SEQ ID NO: 21704 - DNA, 19 bp, Artificial Sequence
  Synthetic
tgtcagaggtgctgcgggc

SEQ ID NO: 21705 - DNA, 21 bp, Artificial Sequence
  Synthetic
ccccggacgtaaaggtcgaag

SEQ ID NO: 21706 - DNA, 19 bp, Artificial Sequence
  Synthetic
ttctgccgggagctgggag

SEQ ID NO: 21707 - DNA, 20 bp, Artificial Sequence
  Synthetic
catgctggccgagagggtgg

SEQ ID NO: 21708 - DNA, 22 bp, Artificial Sequence
  Synthetic
gcgcatcttggagaccctgaag

SEQ ID NO: 21709 - DNA, 25 bp, Artificial Sequence
  Synthetic
ccaaaccatactctttgcaaagcaa

SEQ ID NO: 21710 - DNA, 19 bp, Artificial Sequence
  Synthetic
ccgcactcaaccaccagcc

SEQ ID NO: 21711 - DNA, 20 bp, Artificial Sequence
  Synthetic
tcccccgttacctcctctgg

SEQ ID NO: 21712 - DNA, 20 bp, Artificial Sequence
  Synthetic
catggccgtcttgtaccagt

SEQ ID NO: 21713 - DNA, 25 bp, Artificial Sequence
  Synthetic
cgccttttaggaacaatttaaaggc

SEQ ID NO: 21714 - DNA, 25 bp, Artificial Sequence
  Synthetic
gttgttatcattaggggtggacact

SEQ ID NO: 21715 - DNA, 20 bp, Artificial Sequence
  Synthetic
gagggcaggcacagctgtac

SEQ ID NO: 21716 - DNA, 19 bp, Artificial Sequence
  Synthetic
ttcgtcgtccgaggcgctg

SEQ ID NO: 21717 - DNA, 25 bp, Artificial Sequence
  Synthetic
cccttaggtatactgactcttgtca

SEQ ID NO: 21718 - DNA, 25 bp, Artificial Sequence
  Synthetic
acaaacggacataaaacatcaacaa

SEQ ID NO: 21719 - DNA, 22 bp, Artificial Sequence
  Synthetic
gggtctgtaacggtggaggttg

SEQ ID NO: 21720 - DNA, 22 bp, Artificial Sequence
  Synthetic
gcaatggctgaaggacatccga

SEQ ID NO: 21721 - DNA, 24 bp, Artificial Sequence
  Synthetic
ccgtactgatcacctttgaaacag

SEQ ID NO: 21722 - DNA, 23 bp, Artificial Sequence
  Synthetic
gacttatttgactgcagagtggc

SEQ ID NO: 21723 - DNA, 23 bp, Artificial Sequence
  Synthetic
gggttatcttgcacagttggaag

SEQ ID NO: 21724 - DNA, 25 bp, Artificial Sequence
  Synthetic
acagttacagaacacacaacacatg

SEQ ID NO: 21725 - DNA, 20 bp, Artificial Sequence
  Synthetic
ttgctttcttgcagcagctg

SEQ ID NO: 21726 - DNA, 22 bp, Artificial Sequence
  Synthetic
ggcaatctggagagacagactc

SEQ ID NO: 21727 - DNA, 25 bp, Artificial Sequence
  Synthetic
tctgtagcatcatctataagcccaa

SEQ ID NO: 21728 - DNA, 20 bp, Artificial Sequence
  Synthetic
ggaacatgctgcaggcctag

SEQ ID NO: 21729 - DNA, 22 bp, Artificial Sequence
  Synthetic
ggtttctccggtttgtgcaacc

SEQ ID NO: 21730 - DNA, 25 bp, Artificial Sequence
  Synthetic
ggccaccaaagtatactaaactact

SEQ ID NO: 21731 - DNA, 25 bp, Artificial Sequence
  Synthetic
gttctgtagttatgtcaaagcctgt

SEQ ID NO: 21732 - DNA, 20 bp, Artificial Sequence
  Synthetic
aggatctggagcagcagttg

SEQ ID NO: 21733 - DNA, 22 bp, Artificial Sequence
  Synthetic
tgagggtgagacacaaagagtc

SEQ ID NO: 21734 - DNA, 25 bp, Artificial Sequence
  Synthetic
gccgtggaagtatatttctgtttct

SEQ ID NO: 21735 - DNA, 25 bp, Artificial Sequence
  Synthetic
cgtttaacttatttagcaaggggtg

SEQ ID NO: 21736 - DNA, 25 bp, Artificial Sequence
  Synthetic
cccaaatccaatatcacacatgtct

SEQ ID NO: 21737 - DNA, 20 bp, Artificial Sequence
  Synthetic
gcctgagtaccttgaccagg

SEQ ID NO: 21738 - DNA, 25 bp, Artificial Sequence
  Synthetic
tctgatagatccacatcccaaaagt

SEQ ID NO: 21739 - DNA, 21 bp, Artificial Sequence
  Synthetic
cgtgttgagacagcaccattt

SEQ ID NO: 21740 - DNA, 25 bp, Artificial Sequence
  Synthetic
gcttcccttgagcaatcaaatcaaa

SEQ ID NO: 21741 - DNA, 24 bp, Artificial Sequence
  Synthetic
ctgaaatgttggacccatcagtac

SEQ ID NO: 21742 - DNA, 25 bp, Artificial Sequence
  Synthetic
cctgttcagaagaatttgcagtttc

SEQ ID NO: 21743 - DNA, 23 bp, Artificial Sequence
  Synthetic
gatgttgcactttggtgattcac

SEQ ID NO: 21744 - DNA, 21 bp, Artificial Sequence
  Synthetic
gcgtcacctcctcgctttctc

SEQ ID NO: 21745 - DNA, 25 bp, Artificial Sequence
  Synthetic
ggcaatgtggtagtgactaaaaaca

SEQ ID NO: 21746 - DNA, 25 bp, Artificial Sequence
  Synthetic
ccaaaatagaccacacttccaaaca

SEQ ID NO: 21747 - DNA, 24 bp, Artificial Sequence
  Synthetic
gggggtctagcactgttactatat

SEQ ID NO: 21748 - DNA, 25 bp, Artificial Sequence
  Synthetic
accaaaagactgtgcatctacaaat

SEQ ID NO: 21749 - DNA, 22 bp, Artificial Sequence
  Synthetic
ccatagtgacgtcctcctcaaa

SEQ ID NO: 21750 - DNA, 25 bp, Artificial Sequence
  Synthetic
aggttgcacaggaatataaggtgta

SEQ ID NO: 21751 - DNA, 25 bp, Artificial Sequence
  Synthetic
tcaaagaaaggatgtccaactgtta

SEQ ID NO: 21752 - DNA, 25 bp, Artificial Sequence
  Synthetic
ggattttctgtatcctgcaatttgt

SEQ ID NO: 21753 - DNA, 25 bp, Artificial Sequence
  Synthetic
cgaaccactcggaattgtaaagtaa

SEQ ID NO: 21754 - DNA, 25 bp, Artificial Sequence
  Synthetic
ccacatgagtcaagtcaacatcatt

SEQ ID NO: 21755 - DNA, 25 bp, Artificial Sequence
  Synthetic
cccctgatgtgagtaatagggttaa

SEQ ID NO: 21756 - DNA, 22 bp, Artificial Sequence
  Synthetic
ttcctttgatctctccgaacct

SEQ ID NO: 21757 - DNA, 20 bp, Artificial Sequence
  Synthetic
accatcatggcatgcggatc

SEQ ID NO: 21758 - DNA, 21 bp, Artificial Sequence
  Synthetic
gctccactcttcctgttggaa

SEQ ID NO: 21759 - DNA, 21 bp, Artificial Sequence
  Synthetic
tccaagccacttgtctccatt

SEQ ID NO: 21760 - DNA, 25 bp, Artificial Sequence
  Synthetic
caagtatcttttccaccatcgtgta

SEQ ID NO: 21761 - DNA, 21 bp, Artificial Sequence
  Synthetic
cgcccgattgaaacttaccgt

SEQ ID NO: 21762 - DNA, 25 bp, Artificial Sequence
  Synthetic
ctggccaaactcttcttgtagtatt

SEQ ID NO: 21763 - DNA, 23 bp, Artificial Sequence
  Synthetic
tgaggacacaagaattgcagttc

SEQ ID NO: 21764 - DNA, 21 bp, Artificial Sequence
  Synthetic
ctcaaattcctgctggcgaag

SEQ ID NO: 21765 - DNA, 23 bp, Artificial Sequence
  Synthetic
aggtcaaattgcatagcatctgc

SEQ ID NO: 21766 - DNA, 25 bp, Artificial Sequence
  Synthetic
gtgtccaaagcctttcaaaaaaaga

SEQ ID NO: 21767 - DNA, 20 bp, Artificial Sequence
  Synthetic
cggaggtacgggttgatacc

SEQ ID NO: 21768 - DNA, 25 bp, Artificial Sequence
  Synthetic
ttccatccttataatatgcacctgc

SEQ ID NO: 21769 - DNA, 20 bp, Artificial Sequence
  Synthetic
ggtgtctcgtcgacggtgtc

SEQ ID NO: 21770 - DNA, 22 bp, Artificial Sequence
  Synthetic
ggaccctctggatcctctggaa

SEQ ID NO: 21771 - DNA, 22 bp, Artificial Sequence
  Synthetic
gctagcctcctccagtaacctt

SEQ ID NO: 21772 - DNA, 21 bp, Artificial Sequence
  Synthetic
tccacctattggttgaccacc

SEQ ID NO: 21773 - DNA, 25 bp, Artificial Sequence
  Synthetic
tgctacgtccctttcaaatatttgt

SEQ ID NO: 21774 - DNA, 25 bp, Artificial Sequence
  Synthetic
accagaatgttcccctaatagtgat

SEQ ID NO: 21775 - DNA, 25 bp, Artificial Sequence
  Synthetic
cacagcataaccttccaaatcttgt

SEQ ID NO: 21776 - DNA, 20 bp, Artificial Sequence
  Synthetic
tccgtgctttgtacccttgc

SEQ ID NO: 21777 - DNA, 20 bp, Artificial Sequence
  Synthetic
aacacctaaaggctggccac

SEQ ID NO: 21778 - DNA, 22 bp, Artificial Sequence
  Synthetic
gcagtattgggtatcgcatccc

SEQ ID NO: 21779 - DNA, 25 bp, Artificial Sequence
  Synthetic
gctcatatggatctttcctttctgg

SEQ ID NO: 21780 - DNA, 25 bp, Artificial Sequence
  Synthetic
gctttcaatgtgatgtttttgtcca

SEQ ID NO: 21781 - DNA, 24 bp, Artificial Sequence
  Synthetic
gccccaacagtaagaatgcatttc

SEQ ID NO: 21782 - DNA, 25 bp, Artificial Sequence
  Synthetic
agcttctcttaaaggttgagcaatt

SEQ ID NO: 21783 - DNA, 25 bp, Artificial Sequence
  Synthetic
cctctggagtgtcatcaatggataa

SEQ ID NO: 21784 - DNA, 25 bp, Artificial Sequence
  Synthetic
gcaactgtaggttccgtagaacttt

SEQ ID NO: 21785 - DNA, 25 bp, Artificial Sequence
  Synthetic
gcatacttggatttagccaaacttt

SEQ ID NO: 21786 - DNA, 25 bp, Artificial Sequence
  Synthetic
cagtccatgtaccagtttttccata

SEQ ID NO: 21787 - DNA, 23 bp, Artificial Sequence
  Synthetic
agtgacgctagtgtcaagcaata

SEQ ID NO: 21788 - DNA, 22 bp, Artificial Sequence
  Synthetic
agggcggagagatagaccaaca

SEQ ID NO: 21789 - DNA, 25 bp, Artificial Sequence
  Synthetic
tgtgcttagtactttgtcagtgtta

SEQ ID NO: 21790 - DNA, 20 bp, Artificial Sequence
  Synthetic
cacgtacccttttgacctgg

SEQ ID NO: 21791 - DNA, 20 bp, Artificial Sequence
  Synthetic
cagggatactgtcgccaaca

SEQ ID NO: 21792 - DNA, 24 bp, Artificial Sequence
  Synthetic
gcgtctttaggacagatagtagct

SEQ ID NO: 21793 - DNA, 23 bp, Artificial Sequence
  Synthetic
ggttacaatggtcacagcatgtg

SEQ ID NO: 21794 - DNA, 22 bp, Artificial Sequence
  Synthetic
tgaagagtgccagggaatttcc

SEQ ID NO: 21795 - DNA, 25 bp, Artificial Sequence
  Synthetic
gcactcttctacctgtgatagttca

SEQ ID NO: 21796 - DNA, 25 bp, Artificial Sequence
  Synthetic
gcactagccatttgatgattaacaa

SEQ ID NO: 21797 - DNA, 21 bp, Artificial Sequence
  Synthetic
ccttcccacttcttcagcaga

SEQ ID NO: 21798 - DNA, 23 bp, Artificial Sequence
  Synthetic
ccaaatggtctgtagccagtagc

SEQ ID NO: 21799 - DNA, 23 bp, Artificial Sequence
  Synthetic
tcttcagcagttattgtaggccc

SEQ ID NO: 21800 - DNA, 25 bp, Artificial Sequence
  Synthetic
ggcctactcaggtaattgatatctc

SEQ ID NO: 21801 - DNA, 25 bp, Artificial Sequence
  Synthetic
acaaagggttttctgaatctccata

SEQ ID NO: 21802 - DNA, 25 bp, Artificial Sequence
  Synthetic
tgctgatctgtcttgagaaaatgtt

SEQ ID NO: 21803 - DNA, 25 bp, Artificial Sequence
  Synthetic
tggtactttacaaagacgaaagact

SEQ ID NO: 21804 - DNA, 25 bp, Artificial Sequence
  Synthetic
acatgagtcagtattttgcaaacac

SEQ ID NO: 21805 - DNA, 24 bp, Artificial Sequence
  Synthetic
ccgccaaattttgagtcagtcaaa

SEQ ID NO: 21806 - DNA, 22 bp, Artificial Sequence
  Synthetic
gcttttctgctgcatccaacaa

SEQ ID NO: 21807 - DNA, 20 bp, Artificial Sequence
  Synthetic
atcgacgagctccagagtcg

SEQ ID NO: 21808 - DNA, 25 bp, Artificial Sequence
  Synthetic
tgagttagtgtctacctgtgtaaga

SEQ ID NO: 21809 - DNA, 25 bp, Artificial Sequence
  Synthetic
gcagctgattgatgttctaccaata

SEQ ID NO: 21810 - DNA, 20 bp, Artificial Sequence
  Synthetic
tcggtgtcggtggtcccacc

SEQ ID NO: 21811 - DNA, 22 bp, Artificial Sequence
  Synthetic
ggatcccgagcttcttcttgta

SEQ ID NO: 21812 - DNA, 25 bp, Artificial Sequence
  Synthetic
ggtgtagatggtgtcaatggtctat

SEQ ID NO: 21813 - DNA, 25 bp, Artificial Sequence
  Synthetic
actacagtaggtgtactttctggta

SEQ ID NO: 21814 - DNA, 25 bp, Artificial Sequence
  Synthetic
cttgtttttggtgggttaatagagc

SEQ ID NO: 21815 - DNA, 25 bp, Artificial Sequence
  Synthetic
gtttgtttgggatcaaaagacacat

SEQ ID NO: 21816 - DNA, 24 bp, Artificial Sequence
  Synthetic
ggccatttgcaagtactgtgaata

SEQ ID NO: 21817 - DNA, 25 bp, Artificial Sequence
  Synthetic
agcgtttacctaaagaaaactgtga

SEQ ID NO: 21818 - DNA, 21 bp, Artificial Sequence
  Synthetic
tcataggtaaacaggggtgcg

SEQ ID NO: 21819 - DNA, 25 bp, Artificial Sequence
  Synthetic
cctcttgttaaaacttgacctacct

SEQ ID NO: 21820 - DNA, 25 bp, Artificial Sequence
  Synthetic
cccatcagtttccatctgttcataa

SEQ ID NO: 21821 - DNA, 25 bp, Artificial Sequence
  Synthetic
ccctctcaatatcaatgcagatctt

SEQ ID NO: 21822 - DNA, 25 bp, Artificial Sequence
  Synthetic
ccctctgatgaagcttaacaatctt

SEQ ID NO: 21823 - DNA, 20 bp, Artificial Sequence
  Synthetic
ccagtgaatgctgccatgat

SEQ ID NO: 21824 - DNA, 20 bp, Artificial Sequence
  Synthetic
aagccatgggtacactgtcc

SEQ ID NO: 21825 - DNA, 23 bp, Artificial Sequence
  Synthetic
aggtcaatttcagtttgcggtac

SEQ ID NO: 21826 - DNA, 23 bp, Artificial Sequence
  Synthetic
gcagcgtctgtgtatctgcatat

SEQ ID NO: 21827 - DNA, 25 bp, Artificial Sequence
  Synthetic
gcctatatccatatcactgtctgct

SEQ ID NO: 21828 - DNA, 23 bp, Artificial Sequence
  Synthetic
cgtcattatcaaatgcccattgc

SEQ ID NO: 21829 - DNA, 25 bp, Artificial Sequence
  Synthetic
gaagtcgaccccttgatatcttaaa

SEQ ID NO: 21830 - DNA, 21 bp, Artificial Sequence
  Synthetic
cccatatgcacttcccatgtg

SEQ ID NO: 21831 - DNA, 25 bp, Artificial Sequence
  Synthetic
gcaaagcaaaaacacaaaactaaca

SEQ ID NO: 21832 - DNA, 25 bp, Artificial Sequence
  Synthetic
gccctacacaaagcaaaagtgtaat

SEQ ID NO: 21833 - DNA, 24 bp, Artificial Sequence
  Synthetic
cctcaataactgggggttcaacaa

SEQ ID NO: 21834 - DNA, 20 bp, Artificial Sequence
  Synthetic
gtcaggatcaggtgccacac

SEQ ID NO: 21835 - DNA, 25 bp, Artificial Sequence
  Synthetic
gcctacgccttaaaaagtatacagg

SEQ ID NO: 21836 - DNA, 25 bp, Artificial Sequence
  Synthetic
catctgttttggaattaccagcctt

SEQ ID NO: 21837 - DNA, 22 bp, Artificial Sequence
  Synthetic
tttgtgttcctagtggtgtcca

SEQ ID NO: 21838 - DNA, 20 bp, Artificial Sequence
  Synthetic
ctaagcttgtggcagctggg

SEQ ID NO: 21839 - DNA, 20 bp, Artificial Sequence
  Synthetic
tgcgtttggctgatggtgta

SEQ ID NO: 21840 - DNA, 21 bp, Artificial Sequence
  Synthetic
aaaagggtggaggacataggg

SEQ ID NO: 21841 - DNA, 24 bp, Artificial Sequence
  Synthetic
ccaacagcagtaaagtatgctgat

SEQ ID NO: 21842 - DNA, 25 bp, Artificial Sequence
  Synthetic
cctcaggattgggaaaaaacatttc

SEQ ID NO: 21843 - DNA, 24 bp, Artificial Sequence
  Synthetic
actcgtaacatgtaaggtcagtct

SEQ ID NO: 21844 - DNA, 23 bp, Artificial Sequence
  Synthetic
cccaattacctgaatcagccatc

SEQ ID NO: 21845 - DNA, 25 bp, Artificial Sequence
  Synthetic
tgagataggtcaaattgacagtcct

SEQ ID NO: 21846 - DNA, 20 bp, Artificial Sequence
  Synthetic
tgtccagcatgcaggtgttg

SEQ ID NO: 21847 - DNA, 25 bp, Artificial Sequence
  Synthetic
tgccttccagttttcattagtaagt

SEQ ID NO: 21848 - DNA, 21 bp, Artificial Sequence
  Synthetic
tcgtgatactgcaaggcttgg

SEQ ID NO: 21849 - DNA, 22 bp, Artificial Sequence
  Synthetic
attgccctcaacctttggaatt

SEQ ID NO: 21850 - DNA, 20 bp, Artificial Sequence
  Synthetic
ggcactatggaggtaggacc

SEQ ID NO: 21851 - DNA, 25 bp, Artificial Sequence
  Synthetic
aagcaggcctatgtaactttacaat

SEQ ID NO: 21852 - DNA, 25 bp, Artificial Sequence
  Synthetic
gccacatctgcaaaaaaatatgaca

SEQ ID NO: 21853 - DNA, 22 bp, Artificial Sequence
  Synthetic
gtaccccaatgttcccctaagg

SEQ ID NO: 21854 - DNA, 25 bp, Artificial Sequence
  Synthetic
gccctgttaaataggtgtctaacaa

SEQ ID NO: 21855 - DNA, 22 bp, Artificial Sequence
  Synthetic
aagcggtcgcagaataacttta

SEQ ID NO: 21856 - DNA, 24 bp, Artificial Sequence
  Synthetic
tccattattgtgtcaacctgctct

SEQ ID NO: 21857 - DNA, 20 bp, Artificial Sequence
  Synthetic
gaggtcattggctggactgg

SEQ ID NO: 21858 - DNA, 25 bp, Artificial Sequence
  Synthetic
gtgaatcccccacagtactaaaaga

SEQ ID NO: 21859 - DNA, 25 bp, Artificial Sequence
  Synthetic
ccctttcttgacaattttgtatgca

SEQ ID NO: 21860 - DNA, 25 bp, Artificial Sequence
  Synthetic
catcctccctctataaaacctgcta

SEQ ID NO: 21861 - DNA, 25 bp, Artificial Sequence
  Synthetic
aagttcagcattataagtccagaca

SEQ ID NO: 21862 - DNA, 25 bp, Artificial Sequence
  Synthetic
cccattgattccaattttactccac

SEQ ID NO: 21863 - DNA, 25 bp, Artificial Sequence
  Synthetic
catcagtctccatctgttcgtaaga

SEQ ID NO: 21864 - DNA, 25 bp, Artificial Sequence
  Synthetic
ctcttctgtatataggtcctccagt

SEQ ID NO: 21865 - DNA, 24 bp, Artificial Sequence
  Synthetic
aattccatcaccattgttccaact

SEQ ID NO: 21866 - DNA, 25 bp, Artificial Sequence
  Synthetic
ccctttgatgaagctcaatactctt

SEQ ID NO: 21867 - DNA, 25 bp, Artificial Sequence
  Synthetic
ctcctcggttactaattcatcacat

SEQ ID NO: 21868 - DNA, 21 bp, Artificial Sequence
  Synthetic
gttgcagtcttgggctcaaat

SEQ ID NO: 21869 - DNA, 23 bp, Artificial Sequence
  Synthetic
acatcattactgtaacgcccgtc

SEQ ID NO: 21870 - DNA, 23 bp, Artificial Sequence
  Synthetic
cccatctactagtggttgcaacc

SEQ ID NO: 21871 - DNA, 20 bp, Artificial Sequence
  Synthetic
ccatctgagctgtcgtctgg

SEQ ID NO: 21872 - DNA, 25 bp, Artificial Sequence
  Synthetic
actgcattgtcctcattatttccat

SEQ ID NO: 21873 - DNA, 24 bp, Artificial Sequence
  Synthetic
gtgtctattaggcagtcgatgtcc

SEQ ID NO: 21874 - DNA, 25 bp, Artificial Sequence
  Synthetic
ggccatataccgatatgtaagaagg

SEQ ID NO: 21875 - DNA, 21 bp, Artificial Sequence
  Synthetic
agccatcaacaatagaggcca

SEQ ID NO: 21876 - DNA, 23 bp, Artificial Sequence
  Synthetic
accatccacaacaataggaggtt

SEQ ID NO: 21877 - DNA, 23 bp, Artificial Sequence
  Synthetic
caaccaacaacaaacaactgtgt

SEQ ID NO: 21878 - DNA, 24 bp, Artificial Sequence
  Synthetic
gcaaaatataaagagggagccagc

SEQ ID NO: 21879 - DNA, 22 bp, Artificial Sequence
  Synthetic
ccttttccttaggaggctctgc

SEQ ID NO: 21880 - DNA, 24 bp, Artificial Sequence
  Synthetic
gaacatacctgctggcaaaattgg

SEQ ID NO: 21881 - DNA, 21 bp, Artificial Sequence
  Synthetic
gtccgtctctctgttttggcc

SEQ ID NO: 21882 - DNA, 24 bp, Artificial Sequence
  Synthetic
ttagcagaaatggttcaatggtgt

SEQ ID NO: 21883 - DNA, 23 bp, Artificial Sequence
  Synthetic
cttgttggctgttcatggatact

SEQ ID NO: 21884 - DNA, 20 bp, Artificial Sequence
  Synthetic
ggtttgcaaccccttcctag

SEQ ID NO: 21885 - DNA, 19 bp, Artificial Sequence
  Synthetic
ctcccacccaggcggcata

SEQ ID NO: 21886 - DNA, 21 bp, Artificial Sequence
  Synthetic
ctgctggagaagtgggaagcg

SEQ ID NO: 21887 - DNA, 25 bp, Artificial Sequence
  Synthetic
aaagcagtttctaagtagtgtgtct

SEQ ID NO: 21888 - DNA, 23 bp, Artificial Sequence
  Synthetic
aagaatcaggtcctagcactagc

SEQ ID NO: 21889 - DNA, 25 bp, Artificial Sequence
  Synthetic
cggacattaagtagaccaacattca

SEQ ID NO: 21890 - DNA, 22 bp, Artificial Sequence
  Synthetic
agatgcattagctgagtctgct

SEQ ID NO: 21891 - DNA, 25 bp, Artificial Sequence
  Synthetic
ttgttcaataaatatgctgacgtgg

SEQ ID NO: 21892 - DNA, 23 bp, Artificial Sequence
  Synthetic
ttgctccctacacgtattttcca

SEQ ID NO: 21893 - DNA, 25 bp, Artificial Sequence
  Synthetic
ctatggatctgtctgaaagactgtc

SEQ ID NO: 21894 - DNA, 20 bp, Artificial Sequence
  Synthetic
gctgtggacagtgtggtcag

SEQ ID NO: 21895 - DNA, 25 bp, Artificial Sequence
  Synthetic
actgaaaaatgagaggtaatgctcc

SEQ ID NO: 21896 - DNA, 21 bp, Artificial Sequence
  Synthetic
atcctgtgcaagaaaccgtgg

SEQ ID NO: 21897 - DNA, 24 bp, Artificial Sequence
  Synthetic
ctaaaagtccagaagttgcagttg

SEQ ID NO: 21898 - DNA, 25 bp, Artificial Sequence
  Synthetic
acctaaaacatccagaaggagatgg

SEQ ID NO: 21899 - DNA, 22 bp, Artificial Sequence
  Synthetic
aggagagtcctgctaggagacg

SEQ ID NO: 21900 - DNA, 22 bp, Artificial Sequence
  Synthetic
gcttgggatccgccaataattc

SEQ ID NO: 21901 - DNA, 23 bp, Artificial Sequence
  Synthetic
gacccacaattcctgttgacact

SEQ ID NO: 21902 - DNA, 24 bp, Artificial Sequence
  Synthetic
ttagcaatgcagaagaaggtgtag

SEQ ID NO: 21903 - DNA, 25 bp, Artificial Sequence
  Synthetic
ctgaatttgaaattgaagcccctcc

SEQ ID NO: 21904 - DNA, 25 bp, Artificial Sequence
  Synthetic
taggacgtcctagatacagtgaaac

SEQ ID NO: 21905 - DNA, 23 bp, Artificial Sequence
  Synthetic
cgcaaacgaaaacgaatagctat

SEQ ID NO: 21906 - DNA, 22 bp, Artificial Sequence
  Synthetic
agttcctcatgtctcaggaagt

SEQ ID NO: 21907 - DNA, 25 bp, Artificial Sequence
  Synthetic
acccaactatttattgtaggctgtg

SEQ ID NO: 21908 - DNA, 24 bp, Artificial Sequence
  Synthetic
tagtggttctctagtttccagtga

SEQ ID NO: 21909 - DNA, 21 bp, Artificial Sequence
  Synthetic
tagtggtctgcggaaccggtg

SEQ ID NO: 21910 - DNA, 20 bp, Artificial Sequence
  Synthetic
ggccctagattgggtgtgcg

SEQ ID NO: 21911 - DNA, 19 bp, Artificial Sequence
  Synthetic
ccagggctctggcacatgg

SEQ ID NO: 21912 - DNA, 20 bp, Artificial Sequence
  Synthetic
ccactttggcggtccgctat

SEQ ID NO: 21913 - DNA, 20 bp, Artificial Sequence
  Synthetic
ttgccgcttacgctgtgaga

SEQ ID NO: 21914 - DNA, 22 bp, Artificial Sequence
  Synthetic
cagtgactttgaccaggggtgg

SEQ ID NO: 21915 - DNA, 21 bp, Artificial Sequence
  Synthetic
cccagggtgcccagagtaaca

SEQ ID NO: 21916 - DNA, 22 bp, Artificial Sequence
  Synthetic
tgctccattccactacggagct

SEQ ID NO: 21917 - DNA, 22 bp, Artificial Sequence
  Synthetic
gggaacccatggtatctggtgg

SEQ ID NO: 21918 - DNA, 20 bp, Artificial Sequence
  Synthetic
tccctcctctcaaccctcgg

SEQ ID NO: 21919 - DNA, 22 bp, Artificial Sequence
  Synthetic
cgttgcagtcgagcccgtgata

SEQ ID NO: 21920 - DNA, 22 bp, Artificial Sequence
  Synthetic
tccacctcaacgcagaccttcc

SEQ ID NO: 21921 - DNA, 21 bp, Artificial Sequence
  Synthetic
gcccccaaagtcattgcgttg

SEQ ID NO: 21922 - DNA, 20 bp, Artificial Sequence
  Synthetic
accacgggggctcccataac

SEQ ID NO: 21923 - DNA, 22 bp, Artificial Sequence
  Synthetic
aaatgtgatgagcttgccggga

SEQ ID NO: 21924 - DNA, 21 bp, Artificial Sequence
  Synthetic
gctctcagagacgtgggagga

SEQ ID NO: 21925 - DNA, 22 bp, Artificial Sequence
  Synthetic
tggaagagtgctccaaagctcc

SEQ ID NO: 21926 - DNA, 22 bp, Artificial Sequence
  Synthetic
agtcaacatcctgggtgggtgg

SEQ ID NO: 21927 - DNA, 21 bp, Artificial Sequence
  Synthetic
ggcataccggcactagtgagg

SEQ ID NO: 21928 - DNA, 22 bp, Artificial Sequence
  Synthetic
ggcatcatgaacaccaagtgcc

SEQ ID NO: 21929 - DNA, 22 bp, Artificial Sequence
  Synthetic
tccttcccccgaattcttcagc

SEQ ID NO: 21930 - DNA, 19 bp, Artificial Sequence
  Synthetic
tccaccacccaggcggaag

SEQ ID NO: 21931 - DNA, 22 bp, Artificial Sequence
  Synthetic
ctacaggacatgaccaccccga

SEQ ID NO: 21932 - DNA, 22 bp, Artificial Sequence
  Synthetic
tatcagtgctgcaacctcgacc

SEQ ID NO: 21933 - DNA, 22 bp, Artificial Sequence
  Synthetic
cgagagcaagggagtcgaacgg

SEQ ID NO: 21934 - DNA, 20 bp, Artificial Sequence
  Synthetic
ctggccggctcgatctttcg

SEQ ID NO: 21935 - DNA, 25 bp, Artificial Sequence
  Synthetic
aagaatgaacatcttcccctaatgt

SEQ ID NO: 21936 - DNA, 21 bp, Artificial Sequence
  Synthetic
tcttgggagtggagtcaatga

SEQ ID NO: 21937 - DNA, 24 bp, Artificial Sequence
  Synthetic
cgtgattagaacacacgagtactc

SEQ ID NO: 21938 - DNA, 23 bp, Artificial Sequence
  Synthetic
gacaaattgactcaggggagaca

SEQ ID NO: 21939 - DNA, 23 bp, Artificial Sequence
  Synthetic
agaaggccaaactatcaaatgca

SEQ ID NO: 21940 - DNA, 25 bp, Artificial Sequence
  Synthetic
gcacaaacagccatacaattattca

SEQ ID NO: 21941 - DNA, 24 bp, Artificial Sequence
  Synthetic
acaacataatggaccctgagtaca

SEQ ID NO: 21942 - DNA, 23 bp, Artificial Sequence
  Synthetic
tttgaggcttgctttaacagtgc

SEQ ID NO: 21943 - DNA, 25 bp, Artificial Sequence
  Synthetic
attggataccatgccaataattcca

SEQ ID NO: 21944 - DNA, 20 bp, Artificial Sequence
  Synthetic
ttgtgttacccaggcagctt

SEQ ID NO: 21945 - DNA, 25 bp, Artificial Sequence
  Synthetic
aaatgctaataatttggggagtgca

SEQ ID NO: 21946 - DNA, 25 bp, Artificial Sequence
  Synthetic
catgaagacagaaggaacacttgag

SEQ ID NO: 21947 - DNA, 23 bp, Artificial Sequence
  Synthetic
aggaatggttgatggttggtatg

SEQ ID NO: 21948 - DNA, 25 bp, Artificial Sequence
  Synthetic
gactgatgatcacagacatgagacc

SEQ ID NO: 21949 - DNA, 25 bp, Artificial Sequence
  Synthetic
acactcaacaaagatcaacttctgt

SEQ ID NO: 21950 - DNA, 22 bp, Artificial Sequence
  Synthetic
gccaacagcttctatgaagtgt

SEQ ID NO: 21951 - DNA, 23 bp, Artificial Sequence
  Synthetic
acagaggtacaccaaggaatcaa

SEQ ID NO: 21952 - DNA, 25 bp, Artificial Sequence
  Synthetic
atcagaactgaagcattaatgacca

SEQ ID NO: 21953 - DNA, 22 bp, Artificial Sequence
  Synthetic
caactcacccatccaaccaaac

SEQ ID NO: 21954 - DNA, 23 bp, Artificial Sequence
  Synthetic
aaactcaagaagtgcagtgctag

SEQ ID NO: 21955 - DNA, 25 bp, Artificial Sequence
  Synthetic
tactgttagtcatcacagtgactga

SEQ ID NO: 21956 - DNA, 24 bp, Artificial Sequence
  Synthetic
atccacatggggcaaataatcatt

SEQ ID NO: 21957 - DNA, 25 bp, Artificial Sequence
  Synthetic
gcacaaatcacattatccattctgg

SEQ ID NO: 21958 - DNA, 22 bp, Artificial Sequence
  Synthetic
agcatatgcagcaacaatccaa

SEQ ID NO: 21959 - DNA, 20 bp, Artificial Sequence
  Synthetic
ccctccactcaacctcctcc

SEQ ID NO: 21960 - DNA, 21 bp, Artificial Sequence
  Synthetic
caatccttgctgcagtcacac

SEQ ID NO: 21961 - DNA, 23 bp, Artificial Sequence
  Synthetic
agtgtcttaaccagcaaagtgtt

SEQ ID NO: 21962 - DNA, 24 bp, Artificial Sequence
  Synthetic
tcttcccactagctgaaacatgta

SEQ ID NO: 21963 - DNA, 25 bp, Artificial Sequence
  Synthetic
gcacctaatcatgttcttacaatgg

SEQ ID NO: 21964 - DNA, 20 bp, Artificial Sequence
  Synthetic
gccatgagcaaactcctcac

SEQ ID NO: 21965 - DNA, 24 bp, Artificial Sequence
  Synthetic
tgtaggtagaatgtttgcaatgca

SEQ ID NO: 21966 - DNA, 22 bp, Artificial Sequence
  Synthetic
gaacctacatatcctcacgggc

SEQ ID NO: 21967 - DNA, 25 bp, Artificial Sequence
  Synthetic
tacagtcagtagtagaccatgtgaa

SEQ ID NO: 21968 - DNA, 20 bp, Artificial Sequence
  Synthetic
cctcccgggagagccatagt

SEQ ID NO: 21969 - DNA, 22 bp, Artificial Sequence
  Synthetic
caggggccctagattgggtgtg

SEQ ID NO: 21970 - DNA, 19 bp, Artificial Sequence
  Synthetic
cgcatggcgtccgggttct

SEQ ID NO: 21971 - DNA, 18 bp, Artificial Sequence
  Synthetic
ggtgttgggtggcggtga

SEQ ID NO: 21972 - DNA, 22 bp, Artificial Sequence
  Synthetic
tcatggacatgatcgctggtgc

SEQ ID NO: 21973 - DNA, 22 bp, Artificial Sequence
  Synthetic
tcagttatgccaacggaagcgg

SEQ ID NO: 21974 - DNA, 20 bp, Artificial Sequence
  Synthetic
gcccccttgtgtcatcggag

SEQ ID NO: 21975 - DNA, 19 bp, Artificial Sequence
  Synthetic
agcccgttgctgctgtcca

SEQ ID NO: 21976 - DNA, 22 bp, Artificial Sequence
  Synthetic
cctcgtgttcttctgctttgcg

SEQ ID NO: 21977 - DNA, 21 bp, Artificial Sequence
  Synthetic
aaagtcccctacttcgtgcgc

SEQ ID NO: 21978 - DNA, 22 bp, Artificial Sequence
  Synthetic
ggagaccaagctcatcacgtgg

SEQ ID NO: 21979 - DNA, 21 bp, Artificial Sequence
  Synthetic
ggaacgaggaccatcgcatca

SEQ ID NO: 21980 - DNA, 22 bp, Artificial Sequence
  Synthetic
tccctgtggagaacctagggac

SEQ ID NO: 21981 - DNA, 21 bp, Artificial Sequence
  Synthetic
cgggtgctcaggaggtgctta

SEQ ID NO: 21982 - DNA, 20 bp, Artificial Sequence
  Synthetic
gaagctggtcgcattgggca

SEQ ID NO: 21983 - DNA, 22 bp, Artificial Sequence
  Synthetic
tctgtgagtgctatgacgcggg

SEQ ID NO: 21984 - DNA, 21 bp, Artificial Sequence
  Synthetic
tgaagtcaccctgacgcaccc

SEQ ID NO: 21985 - DNA, 21 bp, Artificial Sequence
  Synthetic
gtcccgccatgcagaggttat

SEQ ID NO: 21986 - DNA, 19 bp, Artificial Sequence
  Synthetic
tgtgggtgctggcctagct

SEQ ID NO: 21987 - DNA, 19 bp, Artificial Sequence
  Synthetic
cgcccgcgtcactgccata

SEQ ID NO: 21988 - DNA, 22 bp, Artificial Sequence
  Synthetic
ctgcaggaacatgtggagtggg

SEQ ID NO: 21989 - DNA, 21 bp, Artificial Sequence
  Synthetic
gcaattaccttgcgagcccga

SEQ ID NO: 21990 - DNA, 21 bp, Artificial Sequence
  Synthetic
tgtggcagaggaggatgagcg

SEQ ID NO: 21991 - DNA, 22 bp, Artificial Sequence
  Synthetic
acgacaacatcctctgagcccg

SEQ ID NO: 21992 - DNA, 22 bp, Artificial Sequence
  Synthetic
agactgcaagttctggacagcc

SEQ ID NO: 21993 - DNA, 20 bp, Artificial Sequence
  Synthetic
gcgtgtgcgagaagatggcc

SEQ ID NO: 21994 - DNA, 21 bp, Artificial Sequence
  Synthetic
ttcaaggggggaaaactgcgg

SEQ ID NO: 21995 - DNA, 20 bp, Artificial Sequence
  Synthetic
cgcgtgggagacagcaagac

SEQ ID NO: 21996 - DNA, 22 bp, Artificial Sequence
  Synthetic
tgcctcagaaaacttggggtcc

SEQ ID NO: 21997 - DNA, 23 bp, Artificial Sequence
  Synthetic
agatccgaaaatcgaaacgaaca

SEQ ID NO: 21998 - DNA, 25 bp, Artificial Sequence
  Synthetic
gtatgactacaaggagaaccgattt

SEQ ID NO: 21999 - DNA, 23 bp, Artificial Sequence
  Synthetic
aagaacatgaggaaaacaagcca

SEQ ID NO: 22000 - DNA, 24 bp, Artificial Sequence
  Synthetic
atgagaaggaactatttcacagcg

SEQ ID NO: 22001 - DNA, 20 bp, Artificial Sequence
  Synthetic
tggagccacacagatgggaa

SEQ ID NO: 22002 - DNA, 23 bp, Artificial Sequence
  Synthetic
aatcagaaacatggccaattgga

SEQ ID NO: 22003 - DNA, 23 bp, Artificial Sequence
  Synthetic
tttgcatcagaatagaccaggca

SEQ ID NO: 22004 - DNA, 24 bp, Artificial Sequence
  Synthetic
agaagcagtaatgagaatgggaga

SEQ ID NO: 22005 - DNA, 20 bp, Artificial Sequence
  Synthetic
agccgcgtactctagctgat

SEQ ID NO: 22006 - DNA, 22 bp, Artificial Sequence
  Synthetic
gcagggagcaattagaagactc

SEQ ID NO: 22007 - DNA, 24 bp, Artificial Sequence
  Synthetic
aattgtagaacgtaaaacagggga

SEQ ID NO: 22008 - DNA, 22 bp, Artificial Sequence
  Synthetic
ggggctatatccctaggacggc

SEQ ID NO: 22009 - DNA, 25 bp, Artificial Sequence
  Synthetic
tgtgctttgatagaaaacatcgagc

SEQ ID NO: 22010 - DNA, 21 bp, Artificial Sequence
  Synthetic
ccaggaaaggcttctagacct

SEQ ID NO: 22011 - DNA, 22 bp, Artificial Sequence
  Synthetic
cgtggacattacaggacacatg

SEQ ID NO: 22012 - DNA, 25 bp, Artificial Sequence
  Synthetic
aaaaggaagcatctaagtatgggga

SEQ ID NO: 22013 - DNA, 24 bp, Artificial Sequence
  Synthetic
agatgttaccctacactttgagca

SEQ ID NO: 22014 - DNA, 22 bp, Artificial Sequence
  Synthetic
atttccacaaacacccattgct

SEQ ID NO: 22015 - DNA, 25 bp, Artificial Sequence
  Synthetic
atcctgattaccttaaaatggctgc

SEQ ID NO: 22016 - DNA, 23 bp, Artificial Sequence
  Synthetic
cccagggtcaaaacaatggtatt

SEQ ID NO: 22017 - DNA, 22 bp, Artificial Sequence
  Synthetic
ccccagctacaagtagtttgga

SEQ ID NO: 22018 - DNA, 20 bp, Artificial Sequence
  Synthetic
actacgtccgccgtctaggt

SEQ ID NO: 22019 - DNA, 19 bp, Artificial Sequence
  Synthetic
cgggattcgagcgcccctt

SEQ ID NO: 22020 - DNA, 19 bp, Artificial Sequence
  Synthetic
cgccgtcatcctccaccca

SEQ ID NO: 22021 - DNA, 22 bp, Artificial Sequence
  Synthetic
aagacctccaagacctcctgca

SEQ ID NO: 22022 - DNA, 22 bp, Artificial Sequence
  Synthetic
ccttcctgggcctctatcctcc

SEQ ID NO: 22023 - DNA, 20 bp, Artificial Sequence
  Synthetic
cttccggtgcgggaaagcag

SEQ ID NO: 22024 - DNA, 20 bp, Artificial Sequence
  Synthetic
tacaggcgccagctgtcctt

SEQ ID NO: 22025 - DNA, 20 bp, Artificial Sequence
  Synthetic
gacctgcgggccactaactc

SEQ ID NO: 22026 - DNA, 20 bp, Artificial Sequence
  Synthetic
ctggcccatatcctgcagcc

SEQ ID NO: 22027 - DNA, 22 bp, Artificial Sequence
  Synthetic
aggcatactgatccccgagacc

SEQ ID NO: 22028 - DNA, 20 bp, Artificial Sequence
  Synthetic
ggggcagctacttgcctcag

SEQ ID NO: 22029 - DNA, 21 bp, Artificial Sequence
  Synthetic
acctgatcccatctccaggct

SEQ ID NO: 22030 - DNA, 24 bp, Artificial Sequence
  Synthetic
gctattcgccatactacccatgtc

SEQ ID NO: 22031 - DNA, 21 bp, Artificial Sequence
  Synthetic
agttctgcccagtggatcccg

SEQ ID NO: 22032 - DNA, 21 bp, Artificial Sequence
  Synthetic
gttcatggaccctcgacctgc

SEQ ID NO: 22033 - DNA, 22 bp, Artificial Sequence
  Synthetic
cagcccctactggaaatttcag

SEQ ID NO: 22034 - DNA, 19 bp, Artificial Sequence
  Synthetic
gagcagtaccggtggcggt

SEQ ID NO: 22035 - DNA, 22 bp, Artificial Sequence
  Synthetic
atcctccttctcctgcagcaac

SEQ ID NO: 22036 - DNA, 22 bp, Artificial Sequence
  Synthetic
tcgcttcctcttctcctcagcc

SEQ ID NO: 22037 - DNA, 21 bp, Artificial Sequence
  Synthetic
tatcagcccacttcccagggt

SEQ ID NO: 22038 - DNA, 22 bp, Artificial Sequence
  Synthetic
acccttaaggtccttaccccgc

SEQ ID NO: 22039 - DNA, 20 bp, Artificial Sequence
  Synthetic
tcaaaccaaggcctaccacc

SEQ ID NO: 22040 - DNA, 22 bp, Artificial Sequence
  Synthetic
taagctcagacctccgggaagc

SEQ ID NO: 22041 - DNA, 18 bp, Artificial Sequence
  Synthetic
acgccggttgagtcgcgt

SEQ ID NO: 22042 - DNA, 23 bp, Artificial Sequence
  Synthetic
agaagtacacatcagggagacag

SEQ ID NO: 22043 - DNA, 25 bp, Artificial Sequence
  Synthetic
aagtcgaaaggttaaaacatggaac

SEQ ID NO: 22044 - DNA, 25 bp, Artificial Sequence
  Synthetic
tggttgcatacatgttagagagaga

SEQ ID NO: 22045 - DNA, 20 bp, Artificial Sequence
  Synthetic
attggagatgtgccacagca

SEQ ID NO: 22046 - DNA, 23 bp, Artificial Sequence
  Synthetic
ggaaaagggcaacagctatactc

SEQ ID NO: 22047 - DNA, 25 bp, Artificial Sequence
  Synthetic
aattggggaattgaacatatcgaca

SEQ ID NO: 22048 - DNA, 21 bp, Artificial Sequence
  Synthetic
acaggggacagagaaactgac

SEQ ID NO: 22049 - DNA, 24 bp, Artificial Sequence
  Synthetic
tgtacttgggacatttgataccac

SEQ ID NO: 22050 - DNA, 20 bp, Artificial Sequence
  Synthetic
gtggagtccgctgttctgag

SEQ ID NO: 22051 - DNA, 21 bp, Artificial Sequence
  Synthetic
tatcagaatggaccaggcgat

SEQ ID NO: 22052 - DNA, 23 bp, Artificial Sequence
  Synthetic
aacacagttcgagtctctgaaac

SEQ ID NO: 22053 - DNA, 22 bp, Artificial Sequence
  Synthetic
acaggaacaggatacaccatgg

SEQ ID NO: 22054 - DNA, 21 bp, Artificial Sequence
  Synthetic
ctaactcaaggtcgccagact

SEQ ID NO: 22055 - DNA, 25 bp, Artificial Sequence
  Synthetic
agagcactgacattaaatacgatga

SEQ ID NO: 22056 - DNA, 23 bp, Artificial Sequence
  Synthetic
ctttcacaatcactggggacaac

SEQ ID NO: 22057 - DNA, 21 bp, Artificial Sequence
  Synthetic
gctagcaagcattgacctgaa

SEQ ID NO: 22058 - DNA, 23 bp, Artificial Sequence
  Synthetic
ctcatagtgaatgcaccaaacca

SEQ ID NO: 22059 - DNA, 22 bp, Artificial Sequence
  Synthetic
cccagatggctcttcaattgtt

SEQ ID NO: 22060 - DNA, 19 bp, Artificial Sequence
  Synthetic
gacggcctcgctgactgga

SEQ ID NO: 22061 - DNA, 22 bp, Artificial Sequence
  Synthetic
tattgccacgcatccggatcac

SEQ ID NO: 22062 - DNA, 19 bp, Artificial Sequence
  Synthetic
acgccgtccaacttcacgc

SEQ ID NO: 22063 - DNA, 22 bp, Artificial Sequence
  Synthetic
tccaataaacccatcccctcgc

SEQ ID NO: 22064 - DNA, 22 bp, Artificial Sequence
  Synthetic
gggacggaggagagacgatgca

SEQ ID NO: 22065 - DNA, 25 bp, Artificial Sequence
  Synthetic
atacaccacatcgttggataatacg

SEQ ID NO: 22066 - DNA, 22 bp, Artificial Sequence
  Synthetic
cgttatcatctgctcccgctgc

SEQ ID NO: 22067 - DNA, 22 bp, Artificial Sequence
  Synthetic
cggattccaagtcagagcggcg

SEQ ID NO: 22068 - DNA, 19 bp, Artificial Sequence
  Synthetic
tcagccacgacgcgagtga

SEQ ID NO: 22069 - DNA, 21 bp, Artificial Sequence
  Synthetic
tctcatcaccgagaccgcggg

SEQ ID NO: 22070 - DNA, 19 bp, Artificial Sequence
  Synthetic
cgcccgatccctccaggtt

SEQ ID NO: 22071 - DNA, 20 bp, Artificial Sequence
  Synthetic
catcgggtagacggcgctag

SEQ ID NO: 22072 - DNA, 19 bp, Artificial Sequence
  Synthetic
ggaggaaactgccgcggga

SEQ ID NO: 22073 - DNA, 22 bp, Artificial Sequence
  Synthetic
gcacgctgcatggctaaatacc

SEQ ID NO: 22074 - DNA, 20 bp, Artificial Sequence
  Synthetic
gcatgaactgcccgtggtgg

SEQ ID NO: 22075 - DNA, 18 bp, Artificial Sequence
  Synthetic
tgaggttgcgggccaggt

SEQ ID NO: 22076 - DNA, 20 bp, Artificial Sequence
  Synthetic
tctgagcgagtcccttgcgc

SEQ ID NO: 22077 - DNA, 19 bp, Artificial Sequence
  Synthetic
cgcaagtaatgggtgcgcg

SEQ ID NO: 22078 - DNA, 22 bp, Artificial Sequence
  Synthetic
cgagagcccgtcgtgatagtcc

SEQ ID NO: 22079 - DNA, 19 bp, Artificial Sequence
  Synthetic
acatgcgccctgggtctga

SEQ ID NO: 22080 - DNA, 18 bp, Artificial Sequence
  Synthetic
cgtgcgccacgccaagat

SEQ ID NO: 22081 - DNA, 22 bp, Artificial Sequence
  Synthetic
caggcggtgcagatcggttttc

SEQ ID NO: 22082 - DNA, 22 bp, Artificial Sequence
  Synthetic
cgggtacgacctgcgatttagc

SEQ ID NO: 22083 - DNA, 20 bp, Artificial Sequence
  Synthetic
ccgctggtcggtttctgact

SEQ ID NO: 22084 - DNA, 19 bp, Artificial Sequence
  Synthetic
gcgctccacgatctcggca

SEQ ID NO: 22085 - DNA, 21 bp, Artificial Sequence
  Synthetic
accaggacaaggtggtgagct

SEQ ID NO: 22086 - DNA, 20 bp, Artificial Sequence
  Synthetic
ggccttggtggacttccagg

SEQ ID NO: 22087 - DNA, 22 bp, Artificial Sequence
  Synthetic
agagggctcatccgactctgcc

SEQ ID NO: 22088 - DNA, 20 bp, Artificial Sequence
  Synthetic
caggggcgagtccgtcgtca

SEQ ID NO: 22089 - DNA, 22 bp, Artificial Sequence
  Synthetic
tcgcgcatagtgtggaagtggt

SEQ ID NO: 22090 - DNA, 21 bp, Artificial Sequence
  Synthetic
cccctccgtattcttgtcgcg

SEQ ID NO: 22091 - DNA, 20 bp, Artificial Sequence
  Synthetic
tgctgggcgccaggaaaaac

SEQ ID NO: 22092 - DNA, 20 bp, Artificial Sequence
  Synthetic
acctgacggtgaaccaccca

SEQ ID NO: 22093 - DNA, 21 bp, Artificial Sequence
  Synthetic
cggcagcagtacacgtcgagc

SEQ ID NO: 22094 - DNA, 20 bp, Artificial Sequence
  Synthetic
cgtcgggcacagacccatgg

SEQ ID NO: 22095 - DNA, 19 bp, Artificial Sequence
  Synthetic
gcgtagttgcgcaggccct

SEQ ID NO: 22096 - DNA, 21 bp, Artificial Sequence
  Synthetic
cgtaattcaccacgggcacgc

SEQ ID NO: 22097 - DNA, 21 bp, Artificial Sequence
  Synthetic
actgacagttgcgcaatccga

SEQ ID NO: 22098 - DNA, 18 bp, Artificial Sequence
  Synthetic
gcgcgttgccccaaacca

SEQ ID NO: 22099 - DNA, 18 bp, Artificial Sequence
  Synthetic
acaagccccagcaaccgg

SEQ ID NO: 22100 - DNA, 18 bp, Artificial Sequence
  Synthetic
aagctacagcgctcgcgg

SEQ ID NO: 22101 - DNA, 19 bp, Artificial Sequence
  Synthetic
gggccacgctgacggcttt

SEQ ID NO: 22102 - DNA, 18 bp, Artificial Sequence
  Synthetic
cggcttgaacgagcgcct

SEQ ID NO: 22103 - DNA, 18 bp, Artificial Sequence
  Synthetic
gcgctacgaacccgcaca

SEQ ID NO: 22104 - DNA, 18 bp, Artificial Sequence
  Synthetic
tacgcgcacgccaaaccg

SEQ ID NO: 22105 - DNA, 19 bp, Artificial Sequence
  Synthetic
ggcttcggcgtgcagctgt

SEQ ID NO: 22106 - DNA, 20 bp, Artificial Sequence
  Synthetic
gttggacgacaacgccaagc

SEQ ID NO: 22107 - DNA, 19 bp, Artificial Sequence
  Synthetic
gtgcagcagcgcctacaga

SEQ ID NO: 22108 - DNA, 22 bp, Artificial Sequence
  Synthetic
tcaaccaggacttgctgtcggc

SEQ ID NO: 22109 - DNA, 19 bp, Artificial Sequence
  Synthetic
tgaccacccccgacgccaa

SEQ ID NO: 22110 - DNA, 21 bp, Artificial Sequence
  Synthetic
cggaagcaggacccactaccg

SEQ ID NO: 22111 - DNA, 22 bp, Artificial Sequence
  Synthetic
caaacagctgtcgcggtactcg

SEQ ID NO: 22112 - DNA, 19 bp, Artificial Sequence
  Synthetic
cgccacagcagagccagca

SEQ ID NO: 22113 - DNA, 22 bp, Artificial Sequence
  Synthetic
agctcgatgttgaacaccgacg

SEQ ID NO: 22114 - DNA, 22 bp, Artificial Sequence
  Synthetic
tcgttttcctcctctccgtcgt

SEQ ID NO: 22115 - DNA, 22 bp, Artificial Sequence
  Synthetic
accagtctcagtctcagcagca

SEQ ID NO: 22116 - DNA, 22 bp, Artificial Sequence
  Synthetic
ctgttgctctcctctaccccgc

SEQ ID NO: 22117 - DNA, 19 bp, Artificial Sequence
  Synthetic
ccactactgccggagccga

SEQ ID NO: 22118 - DNA, 21 bp, Artificial Sequence
  Synthetic
atagcggcgttaggtgacacg

SEQ ID NO: 22119 - DNA, 19 bp, Artificial Sequence
  Synthetic
gttgcgcacccgtaagccg

SEQ ID NO: 22120 - DNA, 22 bp, Artificial Sequence
  Synthetic
gctgctgttgctgctgttgttg

SEQ ID NO: 22121 - DNA, 20 bp, Artificial Sequence
  Synthetic
ggggatctcctcacgcacgc

SEQ ID NO: 22122 - DNA, 21 bp, Artificial Sequence
  Synthetic
gccacaaagtcgcttttgccg

SEQ ID NO: 22123 - DNA, 19 bp, Artificial Sequence
  Synthetic
cctcgcacagccgatgcac

SEQ ID NO: 22124 - DNA, 19 bp, Artificial Sequence
  Synthetic
gcgatcaccacgctcgagg

SEQ ID NO: 22125 - DNA, 19 bp, Artificial Sequence
  Synthetic
cagccagaccgctagccga

SEQ ID NO: 22126 - DNA, 19 bp, Artificial Sequence
  Synthetic
acccggcgtgtcgactcgt

SEQ ID NO: 22127 - DNA, 19 bp, Artificial Sequence
  Synthetic
gcggactgcaccgggatga

SEQ ID NO: 22128 - DNA, 19 bp, Artificial Sequence
  Synthetic
cgaccgcgcggctgatgat

SEQ ID NO: 22129 - DNA, 22 bp, Artificial Sequence
  Synthetic
tgaagaaatagaccgggtgccg

SEQ ID NO: 22130 - DNA, 19 bp, Artificial Sequence
  Synthetic
gaggccacggcgcagaaga

SEQ ID NO: 22131 - DNA, 19 bp, Artificial Sequence
  Synthetic
cgcgccggtactcgagcaa

SEQ ID NO: 22132 - DNA, 19 bp, Artificial Sequence
  Synthetic
agcggctgctggaagaggg

SEQ ID NO: 22133 - DNA, 22 bp, Artificial Sequence
  Synthetic
cacctggacatctaccgtcgcc

SEQ ID NO: 22134 - DNA, 19 bp, Artificial Sequence
  Synthetic
tgcctcagctgttaccgcg

SEQ ID NO: 22135 - DNA, 19 bp, Artificial Sequence
  Synthetic
gctggtgcggcttttccac

SEQ ID NO: 22136 - DNA, 19 bp, Artificial Sequence
  Synthetic
ctcggtgagcgggtagcga

SEQ ID NO: 22137 - DNA, 19 bp, Artificial Sequence
  Synthetic
cagggccagggacagcctt

SEQ ID NO: 22138 - DNA, 19 bp, Artificial Sequence
  Synthetic
cgcaccctctgagtgctgc

SEQ ID NO: 22139 - DNA, 19 bp, Artificial Sequence
  Synthetic
ccgtcttatcccgtgccgc

SEQ ID NO: 22140 - DNA, 19 bp, Artificial Sequence
  Synthetic
cgtaaggaaaccgcggcgg

SEQ ID NO: 22141 - DNA, 20 bp, Artificial Sequence
  Synthetic
acagtccggcttgggtgtcc

SEQ ID NO: 22142 - DNA, 19 bp, Artificial Sequence
  Synthetic
cgcggagggtgattcgcac

SEQ ID NO: 22143 - DNA, 22 bp, Artificial Sequence
  Synthetic
agttgttgaggtccaccagcag

SEQ ID NO: 22144 - DNA, 19 bp, Artificial Sequence
  Synthetic
agacgaccggcttccagcg

SEQ ID NO: 22145 - DNA, 18 bp, Artificial Sequence
  Synthetic
gcttgcccgacgcgtgaa

SEQ ID NO: 22146 - DNA, 21 bp, Artificial Sequence
  Synthetic
gcacgttgaccgacacgttct

SEQ ID NO: 22147 - DNA, 19 bp, Artificial Sequence
  Synthetic
gctgttgcgacggcgaatg

SEQ ID NO: 22148 - DNA, 19 bp, Artificial Sequence
  Synthetic
ccggagcgtggcggtacaa

SEQ ID NO: 22149 - DNA, 19 bp, Artificial Sequence
  Synthetic
cgtgtcgtacgcgcaccgt

SEQ ID NO: 22150 - DNA, 22 bp, Artificial Sequence
  Synthetic
tcagctccgaggctaggttagc

SEQ ID NO: 22151 - DNA, 22 bp, Artificial Sequence
  Synthetic
gaggcccatgatgagtagtcgc

SEQ ID NO: 22152 - DNA, 19 bp, Artificial Sequence
  Synthetic
gcggccggcatcaggagaa

SEQ ID NO: 22153 - DNA, 21 bp, Artificial Sequence
  Synthetic
ccgatagcggttcctcagcca

SEQ ID NO: 22154 - DNA, 19 bp, Artificial Sequence
  Synthetic
agggtggtccgcgttccgt

SEQ ID NO: 22155 - DNA, 20 bp, Artificial Sequence
  Synthetic
ccgaccagttctccatcgcg

SEQ ID NO: 22156 - DNA, 19 bp, Artificial Sequence
  Synthetic
cccgtggccgtaccctgtt

SEQ ID NO: 22157 - DNA, 21 bp, Artificial Sequence
  Synthetic
cacgcatgtgctacgcggatt

SEQ ID NO: 22158 - DNA, 19 bp, Artificial Sequence
  Synthetic
cgacgagcgcgggtcacaa

SEQ ID NO: 22159 - DNA, 19 bp, Artificial Sequence
  Synthetic
ctgacgccacgccgccatt

SEQ ID NO: 22160 - DNA, 19 bp, Artificial Sequence
  Synthetic
tgctgctctgcacgctctg

SEQ ID NO: 22161 - DNA, 19 bp, Artificial Sequence
  Synthetic
gcgtcgcccttctccgtga

SEQ ID NO: 22162 - DNA, 22 bp, Artificial Sequence
  Synthetic
cgtcgtggagacaagcaacacc

SEQ ID NO: 22163 - DNA, 20 bp, Artificial Sequence
  Synthetic
gtgctcagcggcgtgtacag

SEQ ID NO: 22164 - DNA, 18 bp, Artificial Sequence
  Synthetic
ggtagcgcttgcggcaca

SEQ ID NO: 22165 - DNA, 20 bp, Artificial Sequence
  Synthetic
gcagcggcgagaggagagga

SEQ ID NO: 22166 - DNA, 22 bp, Artificial Sequence
  Synthetic
tcctctcagtttccccgtctcc

SEQ ID NO: 22167 - DNA, 19 bp, Artificial Sequence
  Synthetic
gtggtgccgtccacgtcgt

SEQ ID NO: 22168 - DNA, 19 bp, Artificial Sequence
  Synthetic
gcacgcgcgtttccccgta

SEQ ID NO: 22169 - DNA, 19 bp, Artificial Sequence
  Synthetic
cggcaagctcacgcactgc

SEQ ID NO: 22170 - DNA, 19 bp, Artificial Sequence
  Synthetic
cggaacgtgacggttgccg

SEQ ID NO: 22171 - DNA, 20 bp, Artificial Sequence
  Synthetic
tgacgacggggaggatgacg

SEQ ID NO: 22172 - DNA, 22 bp, Artificial Sequence
  Synthetic
atcggctcgtatcccgaagtgc

SEQ ID NO: 22173 - DNA, 19 bp, Artificial Sequence
  Synthetic
ccgtcctggcacgcctctt

SEQ ID NO: 22174 - DNA, 19 bp, Artificial Sequence
  Synthetic
cccggcgtgctgttggtct

SEQ ID NO: 22175 - DNA, 20 bp, Artificial Sequence
  Synthetic
agagcctcacctgcgtgacg

SEQ ID NO: 22176 - DNA, 20 bp, Artificial Sequence
  Synthetic
gagcacttgcggctccatga

SEQ ID NO: 22177 - DNA, 19 bp, Artificial Sequence
  Synthetic
gcccgtcgtagcgcagaat

SEQ ID NO: 22178 - DNA, 20 bp, Artificial Sequence
  Synthetic
caacgccgcgtgtaacttcc

SEQ ID NO: 22179 - DNA, 20 bp, Artificial Sequence
  Synthetic
atatgtgggagcgcaaggcc

SEQ ID NO: 22180 - DNA, 20 bp, Artificial Sequence
  Synthetic
gcgactttaccgcgaacgcc

SEQ ID NO: 22181 - DNA, 21 bp, Artificial Sequence
  Synthetic
tgcctgtccaaccaccatgac

SEQ ID NO: 22182 - DNA, 20 bp, Artificial Sequence
  Synthetic
gctcatgcagcgtctcacgg

SEQ ID NO: 22183 - DNA, 20 bp, Artificial Sequence
  Synthetic
acaccagcgacaacgtgctc

SEQ ID NO: 22184 - DNA, 18 bp, Artificial Sequence
  Synthetic
cgtgtgcaccaccgtgga

SEQ ID NO: 22185 - DNA, 20 bp, Artificial Sequence
  Synthetic
cgtgcaccacggtgaacacg

SEQ ID NO: 22186 - DNA, 19 bp, Artificial Sequence
  Synthetic
ggcgctgtgtccgagctca

SEQ ID NO: 22187 - DNA, 22 bp, Artificial Sequence
  Synthetic
ccaggtgagaaagagaagccgc

SEQ ID NO: 22188 - DNA, 20 bp, Artificial Sequence
  Synthetic
cggcagcggtggtactggta

SEQ ID NO: 22189 - DNA, 19 bp, Artificial Sequence
  Synthetic
gtccagaacgcggttggga

SEQ ID NO: 22190 - DNA, 22 bp, Artificial Sequence
  Synthetic
catgttgccgtgtgacgagacg

SEQ ID NO: 22191 - DNA, 22 bp, Artificial Sequence
  Synthetic
tgggcgatgcacaactctttct

SEQ ID NO: 22192 - DNA, 19 bp, Artificial Sequence
  Synthetic
ggtggtggtgggcatcgtg

SEQ ID NO: 22193 - DNA, 22 bp, Artificial Sequence
  Synthetic
gtcgcctcggtagctcagtagt

SEQ ID NO: 22194 - DNA, 24 bp, Artificial Sequence
  Synthetic
cgataggcggctataagatagaga

SEQ ID NO: 22195 - DNA, 20 bp, Artificial Sequence
  Synthetic
tatggttcttaggcgcgcat

SEQ ID NO: 22196 - DNA, 18 bp, Artificial Sequence
  Synthetic
ccggcgtgcagcaaggtt

SEQ ID NO: 22197 - DNA, 19 bp, Artificial Sequence
  Synthetic
tccctcggcgaccaacacc

SEQ ID NO: 22198 - DNA, 21 bp, Artificial Sequence
  Synthetic
gtagcgggagatacggcgttc

SEQ ID NO: 22199 - DNA, 21 bp, Artificial Sequence
  Synthetic
gctatcgtcgccggtttcggg

SEQ ID NO: 22200 - DNA, 20 bp, Artificial Sequence
  Synthetic
tcggcgttttcgggaagggc

SEQ ID NO: 22201 - DNA, 20 bp, Artificial Sequence
  Synthetic
cgacgcgatcacggtaaccc

SEQ ID NO: 22202 - DNA, 22 bp, Artificial Sequence
  Synthetic
gcgttgtctcgcctatcagcgt

SEQ ID NO: 22203 - DNA, 20 bp, Artificial Sequence
  Synthetic
tacgagaccccgaggtacgc

SEQ ID NO: 22204 - DNA, 20 bp, Artificial Sequence
  Synthetic
cggaacggcgtttcactgcc

SEQ ID NO: 22205 - DNA, 19 bp, Artificial Sequence
  Synthetic
gcgtggcagggctggaaga

SEQ ID NO: 22206 - DNA, 19 bp, Artificial Sequence
  Synthetic
accggtgtggaagccgagg

SEQ ID NO: 22207 - DNA, 20 bp, Artificial Sequence
  Synthetic
acatgggccatgtgtggtgg

SEQ ID NO: 22208 - DNA, 22 bp, Artificial Sequence
  Synthetic
ctccgggttcctgccttttcca

SEQ ID NO: 22209 - DNA, 22 bp, Artificial Sequence
  Synthetic
aacaacgcagactgctgaaggc

SEQ ID NO: 22210 - DNA, 19 bp, Artificial Sequence
  Synthetic
agcttctccccgactccgc

SEQ ID NO: 22211 - DNA, 22 bp, Artificial Sequence
  Synthetic
cgataccaccacattcaggggc

SEQ ID NO: 22212 - DNA, 19 bp, Artificial Sequence
  Synthetic
gggactttccacacggcgg

SEQ ID NO: 22213 - DNA, 22 bp, Artificial Sequence
  Synthetic
tcgacgacaggtgcggattagt

SEQ ID NO: 22214 - DNA, 21 bp, Artificial Sequence
  Synthetic
caacaataccgccctacgttg

SEQ ID NO: 22215 - DNA, 22 bp, Artificial Sequence
  Synthetic
ggacgtaacattcggacacgga

SEQ ID NO: 22216 - DNA, 19 bp, Artificial Sequence
  Synthetic
ggcgacgacagttccgtgg

SEQ ID NO: 22217 - DNA, 19 bp, Artificial Sequence
  Synthetic
ccggcggtggtgaacgaga

SEQ ID NO: 22218 - DNA, 21 bp, Artificial Sequence
  Synthetic
gtaacccagccaaaccagcgc

SEQ ID NO: 22219 - DNA, 19 bp, Artificial Sequence
  Synthetic
ccgtgccatcggtgggtac

SEQ ID NO: 22220 - DNA, 22 bp, Artificial Sequence
  Synthetic
gcgagaaccggtcgctcatagc

SEQ ID NO: 22221 - DNA, 20 bp, Artificial Sequence
  Synthetic
ggaggctatatgaccgcgcg

SEQ ID NO: 22222 - DNA, 21 bp, Artificial Sequence
  Synthetic
ccttcatcgcgtttgccgtgc

SEQ ID NO: 22223 - DNA, 22 bp, Artificial Sequence
  Synthetic
aaacgggcgcggttttataggc

SEQ ID NO: 22224 - DNA, 22 bp, Artificial Sequence
  Synthetic
agctgatgcatttccagcgacg

SEQ ID NO: 22225 - DNA, 21 bp, Artificial Sequence
  Synthetic
ttctctgtggtcggcgagtct

SEQ ID NO: 22226 - DNA, 20 bp, Artificial Sequence
  Synthetic
gcagtgctacggtggttccc

SEQ ID NO: 22227 - DNA, 21 bp, Artificial Sequence
  Synthetic
tggtaaagtgaagacgcgccg

SEQ ID NO: 22228 - DNA, 19 bp, Artificial Sequence
  Synthetic
gtgacgcagcagcatcgct

SEQ ID NO: 22229 - DNA, 22 bp, Artificial Sequence
  Synthetic
acacctggtcgacgtggttacg

SEQ ID NO: 22230 - DNA, 20 bp, Artificial Sequence
  Synthetic
gtcagggccagaacccgcag

SEQ ID NO: 22231 - DNA, 21 bp, Artificial Sequence
  Synthetic
ccctgctgttggctacctctc

SEQ ID NO: 22232 - DNA, 20 bp, Artificial Sequence
  Synthetic
cgcatctgctcgccgtagat

SEQ ID NO: 22233 - DNA, 19 bp, Artificial Sequence
  Synthetic
acgagcacgcttccgaggg

SEQ ID NO: 22234 - DNA, 19 bp, Artificial Sequence
  Synthetic
gaccgagccagagggacct

SEQ ID NO: 22235 - DNA, 20 bp, Artificial Sequence
  Synthetic
cgtggaaaaccacccggcag

SEQ ID NO: 22236 - DNA, 21 bp, Artificial Sequence
  Synthetic
cgggggggtgaaatttggagt

SEQ ID NO: 22237 - DNA, 22 bp, Artificial Sequence
  Synthetic
aagttcgctgcaatatgcacac

SEQ ID NO: 22238 - DNA, 25 bp, Artificial Sequence
  Synthetic
aggaaaaccgattcactgaaattgg

SEQ ID NO: 22239 - DNA, 20 bp, Artificial Sequence
  Synthetic
aatcacagggaccatgcgta

SEQ ID NO: 22240 - DNA, 23 bp, Artificial Sequence
  Synthetic
ctgcaaagatattggcgatctga

SEQ ID NO: 22241 - DNA, 21 bp, Artificial Sequence
  Synthetic
cattgcagggccactgagtac

SEQ ID NO: 22242 - DNA, 21 bp, Artificial Sequence
  Synthetic
ttctcccttactgacccaagg

SEQ ID NO: 22243 - DNA, 21 bp, Artificial Sequence
  Synthetic
aaacagatcggagacatggcc

SEQ ID NO: 22244 - DNA, 21 bp, Artificial Sequence
  Synthetic
agaatggttagcggcattggg

SEQ ID NO: 22245 - DNA, 20 bp, Artificial Sequence
  Synthetic
gcgacaagcgaacaatggag

SEQ ID NO: 22246 - DNA, 25 bp, Artificial Sequence
  Synthetic
agaaggacaagaattgcatatgaga

SEQ ID NO: 22247 - DNA, 23 bp, Artificial Sequence
  Synthetic
atgagaacatggaagcaatggac

SEQ ID NO: 22248 - DNA, 22 bp, Artificial Sequence
  Synthetic
ggaagtgaaaattgatgacggc

SEQ ID NO: 22249 - DNA, 25 bp, Artificial Sequence
  Synthetic
tttggtggacaacttttttaacgag

SEQ ID NO: 22250 - DNA, 22 bp, Artificial Sequence
  Synthetic
aagacgagcaagacgagaacgg

SEQ ID NO: 22251 - DNA, 25 bp, Artificial Sequence
  Synthetic
agaggaagaaagagaacaaacagtg

SEQ ID NO: 22252 - DNA, 23 bp, Artificial Sequence
  Synthetic
aaacacttcaggtttttggaggt

SEQ ID NO: 22253 - DNA, 20 bp, Artificial Sequence
  Synthetic
ctgccgacgttgcaagagga

SEQ ID NO: 22254 - DNA, 25 bp, Artificial Sequence
  Synthetic
tataggtaacggggcaatagttgag

SEQ ID NO: 22255 - DNA, 25 bp, Artificial Sequence
  Synthetic
tgaagggaatggctattttaaagca

SEQ ID NO: 22256 - DNA, 22 bp, Artificial Sequence
  Synthetic
tgatgatactcgacatcgttgc

SEQ ID NO: 22257 - DNA, 21 bp, Artificial Sequence
  Synthetic
cgcttctacggctcgcagtat

SEQ ID NO: 22258 - DNA, 21 bp, Artificial Sequence
  Synthetic
gcattaggccatctttgggat

SEQ ID NO: 22259 - DNA, 21 bp, Artificial Sequence
  Synthetic
cgaaaacggtgtagccagtac

SEQ ID NO: 22260 - DNA, 20 bp, Artificial Sequence
  Synthetic
ttaacgaggtgcagctgccg

SEQ ID NO: 22261 - DNA, 20 bp, Artificial Sequence
  Synthetic
gggtttggctggctgttgct

SEQ ID NO: 22262 - DNA, 20 bp, Artificial Sequence
  Synthetic
ggcgtacagttttggagcca

SEQ ID NO: 22263 - DNA, 24 bp, Artificial Sequence
  Synthetic
ctctgacacaaaagctctagtcca

SEQ ID NO: 22264 - DNA, 25 bp, Artificial Sequence
  Synthetic
acgtgtcagtttctataaacgatga

SEQ ID NO: 22265 - DNA, 21 bp, Artificial Sequence
  Synthetic
tgcgctcgtcagatagcaagc

SEQ ID NO: 22266 - DNA, 21 bp, Artificial Sequence
  Synthetic
agtaggatagcacctgccgcc

SEQ ID NO: 22267 - DNA, 25 bp, Artificial Sequence
  Synthetic
agcatataaaactgatttaccgcct

SEQ ID NO: 22268 - DNA, 23 bp, Artificial Sequence
  Synthetic
aagcggttattgattacctgagc

SEQ ID NO: 22269 - DNA, 23 bp, Artificial Sequence
  Synthetic
agagtctttttcccattggtccc

SEQ ID NO: 22270 - DNA, 20 bp, Artificial Sequence
  Synthetic
gcatcgttgcacgggctgta

SEQ ID NO: 22271 - DNA, 21 bp, Artificial Sequence
  Synthetic
cggaaacgggaaatcagggcg

SEQ ID NO: 22272 - DNA, 19 bp, Artificial Sequence
  Synthetic
ggttcgggtcctgcgggaa

SEQ ID NO: 22273 - DNA, 23 bp, Artificial Sequence
  Synthetic
gctgcaaggtcattagatatccg

SEQ ID NO: 22274 - DNA, 21 bp, Artificial Sequence
  Synthetic
gctcgaccgttttcacgtggt

SEQ ID NO: 22275 - DNA, 24 bp, Artificial Sequence
  Synthetic
ttgaagtaagctgttttaagccca

SEQ ID NO: 22276 - DNA, 24 bp, Artificial Sequence
  Synthetic
taagctcctgcattaatggtgtag

SEQ ID NO: 22277 - DNA, 22 bp, Artificial Sequence
  Synthetic
tgttgctcgcataaattcgcgg

SEQ ID NO: 22278 - DNA, 22 bp, Artificial Sequence
  Synthetic
gctatgagcacaagtgaggcgc

SEQ ID NO: 22279 - DNA, 20 bp, Artificial Sequence
  Synthetic
gacaacagcggggaggaagc

SEQ ID NO: 22280 - DNA, 25 bp, Artificial Sequence
  Synthetic
tgtacataatccagcaagtaaaccc

SEQ ID NO: 22281 - DNA, 22 bp, Artificial Sequence
  Synthetic
tgctgacgtcactggcgatgac

SEQ ID NO: 22282 - DNA, 20 bp, Artificial Sequence
  Synthetic
catccgcaaagatgaggctg

SEQ ID NO: 22283 - DNA, 20 bp, Artificial Sequence
  Synthetic
caaacgtccaggcagggttt

SEQ ID NO: 22284 - DNA, 21 bp, Artificial Sequence
  Synthetic
ccccctcctggattttacact

SEQ ID NO: 22285 - DNA, 22 bp, Artificial Sequence
  Synthetic
cacatgcgggggatgaaggaag

SEQ ID NO: 22286 - DNA, 25 bp, Artificial Sequence
  Synthetic
gtttaccaccaaatttaaggccagg

SEQ ID NO: 22287 - DNA, 23 bp, Artificial Sequence
  Synthetic
aactccgggagtgtacactaatg

SEQ ID NO: 22288 - DNA, 21 bp, Artificial Sequence
  Synthetic
tatcgcagctggtatttggca

SEQ ID NO: 22289 - DNA, 21 bp, Artificial Sequence
  Synthetic
cgtacgcggacattaccgagc

SEQ ID NO: 22290 - DNA, 19 bp, Artificial Sequence
  Synthetic
gctgcggccgcaacagcta

SEQ ID NO: 22291 - DNA, 21 bp, Artificial Sequence
  Synthetic
cgcccagacgtagggtacagt

SEQ ID NO: 22292 - DNA, 22 bp, Artificial Sequence
  Synthetic
acgtactagagcacatgaaggt

SEQ ID NO: 22293 - DNA, 19 bp, Artificial Sequence
  Synthetic
cgccgtagacgtcgacgca

SEQ ID NO: 22294 - DNA, 22 bp, Artificial Sequence
  Synthetic
ccaaccaaaggagaaaagcggc

SEQ ID NO: 22295 - DNA, 20 bp, Artificial Sequence
  Synthetic
cactccctcgatgatgccgc

SEQ ID NO: 22296 - DNA, 22 bp, Artificial Sequence
  Synthetic
ttaagccctattccggaaccgc

SEQ ID NO: 22297 - DNA, 24 bp, Artificial Sequence
  Synthetic
ctgctcaagttgtgttctataccg

SEQ ID NO: 22298 - DNA, 23 bp, Artificial Sequence
  Synthetic
cgttcgcgttattgagaatcacg

SEQ ID NO: 22299 - DNA, 24 bp, Artificial Sequence
  Synthetic
aacaagaacacctacgagtacatg

SEQ ID NO: 22300 - DNA, 21 bp, Artificial Sequence
  Synthetic
gggaaatgatcttcgggtgga

SEQ ID NO: 22301 - DNA, 24 bp, Artificial Sequence
  Synthetic
gtgtcaatcatgtttgactcctcc

SEQ ID NO: 22302 - DNA, 20 bp, Artificial Sequence
  Synthetic
ggatacctgggccccactat

SEQ ID NO: 22303 - DNA, 22 bp, Artificial Sequence
  Synthetic
tttccgggttttgtgtctcgcg

SEQ ID NO: 22304 - DNA, 25 bp, Artificial Sequence
  Synthetic
atggataaaaatcccactatggacc

SEQ ID NO: 22305 - DNA, 20 bp, Artificial Sequence
  Synthetic
ccacagctggcgcacaagtt

SEQ ID NO: 22306 - DNA, 24 bp, Artificial Sequence
  Synthetic
gctatttgagccttcattccttca

SEQ ID NO: 22307 - DNA, 21 bp, Artificial Sequence
  Synthetic
accggtgggttcccaggaatt

SEQ ID NO: 22308 - DNA, 24 bp, Artificial Sequence
  Synthetic
acattcttttcattttcgtcgctg

SEQ ID NO: 22309 - DNA, 20 bp, Artificial Sequence
  Synthetic
aaaacgctgggctcgaggac

SEQ ID NO: 22310 - DNA, 20 bp, Artificial Sequence
  Synthetic
ttcttgctttaagggctggc

SEQ ID NO: 22311 - DNA, 22 bp, Artificial Sequence
  Synthetic
atggaaagccggttgtaagcga

SEQ ID NO: 22312 - DNA, 25 bp, Artificial Sequence
  Synthetic
aaccttcgagaactaaacaaactgt

SEQ ID NO: 22313 - DNA, 24 bp, Artificial Sequence
  Synthetic
ttcacgacgaacctaagacttacc

SEQ ID NO: 22314 - DNA, 22 bp, Artificial Sequence
  Synthetic
cgcagcaacgctcaaagaaaca

SEQ ID NO: 22315 - DNA, 22 bp, Artificial Sequence
  Synthetic
tgtagcctgctttcagcactgc

SEQ ID NO: 22316 - DNA, 20 bp, Artificial Sequence
  Synthetic
ccgcagctgtctctacctca

SEQ ID NO: 22317 - DNA, 22 bp, Artificial Sequence
  Synthetic
ttaaccctccctcttggccagc

SEQ ID NO: 22318 - DNA, 25 bp, Artificial Sequence
  Synthetic
tgaagatttctgctgtcatttgtgt

SEQ ID NO: 22319 - DNA, 24 bp, Artificial Sequence
  Synthetic
ttgttgctccagttattgacaaac

SEQ ID NO: 22320 - DNA, 22 bp, Artificial Sequence
  Synthetic
gtatgctcaaacagccgaaaga

SEQ ID NO: 22321 - DNA, 20 bp, Artificial Sequence
  Synthetic
atacggtaagggcagcccaa

SEQ ID NO: 22322 - DNA, 23 bp, Artificial Sequence
  Synthetic
ttctcatctttttatgcctgcca

SEQ ID NO: 22323 - DNA, 21 bp, Artificial Sequence
  Synthetic
cccccaggatgatttacccct

SEQ ID NO: 22324 - DNA, 20 bp, Artificial Sequence
  Synthetic
tcaactgtgctacacgctgc

SEQ ID NO: 22325 - DNA, 25 bp, Artificial Sequence
  Synthetic
aaatggaaggtcagattcttcttcc

SEQ ID NO: 22326 - DNA, 25 bp, Artificial Sequence
  Synthetic
tcacaaggtcttaaactttcttgga

SEQ ID NO: 22327 - DNA, 22 bp, Artificial Sequence
  Synthetic
aatggtgagctccgatgggttg

SEQ ID NO: 22328 - DNA, 22 bp, Artificial Sequence
  Synthetic
ctgtccttaagacggggattgg

SEQ ID NO: 22329 - DNA, 20 bp, Artificial Sequence
  Synthetic
ctggttccccaagcttcgtg

SEQ ID NO: 22330 - DNA, 24 bp, Artificial Sequence
  Synthetic
tacactatacgcgtggttaaactg

SEQ ID NO: 22331 - DNA, 20 bp, Artificial Sequence
  Synthetic
cgcccaaggattctctcgtt

SEQ ID NO: 22332 - DNA, 23 bp, Artificial Sequence
  Synthetic
ccagctgacatacactgtagtga

SEQ ID NO: 22333 - DNA, 20 bp, Artificial Sequence
  Synthetic
ttcctcacagggcggtagtt

SEQ ID NO: 22334 - DNA, 20 bp, Artificial Sequence
  Synthetic
ccgctgtgctggtgaaagat

SEQ ID NO: 22335 - DNA, 22 bp, Artificial Sequence
  Synthetic
gcaaagaaagttcacctccagg

SEQ ID NO: 22336 - DNA, 21 bp, Artificial Sequence
  Synthetic
ctggcaaacgggtggaaaaac

SEQ ID NO: 22337 - DNA, 20 bp, Artificial Sequence
  Synthetic
catagccccaggtcccgtaa

SEQ ID NO: 22338 - DNA, 20 bp, Artificial Sequence
  Synthetic
gcctatggctggtcgctcaa

SEQ ID NO: 22339 - DNA, 22 bp, Artificial Sequence
  Synthetic
gttgaggcttgtgggttttccg

SEQ ID NO: 22340 - DNA, 20 bp, Artificial Sequence
  Synthetic
gcctgagcaccagttggctt

SEQ ID NO: 22341 - DNA, 21 bp, Artificial Sequence
  Synthetic
gaatgcctagtggggctaacc

SEQ ID NO: 22342 - DNA, 23 bp, Artificial Sequence
  Synthetic
acagaaggtggctttatcacatt

SEQ ID NO: 22343 - DNA, 25 bp, Artificial Sequence
  Synthetic
tcaagagctggaaaataaacttcca

SEQ ID NO: 22344 - DNA, 25 bp, Artificial Sequence
  Synthetic
gtaccaattacaacaagcaaaagcc

SEQ ID NO: 22345 - DNA, 20 bp, Artificial Sequence
  Synthetic
gatggtgactgcaggtggag

SEQ ID NO: 22346 - DNA, 22 bp, Artificial Sequence
  Synthetic
atccaagttcattgactggctg

SEQ ID NO: 22347 - DNA, 23 bp, Artificial Sequence
  Synthetic
tttgtcagatggtttcaagcact

SEQ ID NO: 22348 - DNA, 25 bp, Artificial Sequence
  Synthetic
cattgtagatcttcttagtgcctcc

SEQ ID NO: 22349 - DNA, 25 bp, Artificial Sequence
  Synthetic
ataacgattttgtggctagatcgaa

SEQ ID NO: 22350 - DNA, 20 bp, Artificial Sequence
  Synthetic
cgctgtgttgacccagaaag

SEQ ID NO: 22351 - DNA, 24 bp, Artificial Sequence
  Synthetic
gtaatctctatgctggcttccatg

SEQ ID NO: 22352 - DNA, 23 bp, Artificial Sequence
  Synthetic
atggattgacaataacacctgct

SEQ ID NO: 22353 - DNA, 22 bp, Artificial Sequence
  Synthetic
ttctgcagacgattcgacattt

SEQ ID NO: 22354 - DNA, 25 bp, Artificial Sequence
  Synthetic
tcggtggttccatttagaatagaca

SEQ ID NO: 22355 - DNA, 25 bp, Artificial Sequence
  Synthetic
tgcactgacagtatagatacgttgg

SEQ ID NO: 22356 - DNA, 24 bp, Artificial Sequence
  Synthetic
tgaaagacacagcaaaaggagatt

SEQ ID NO: 22357 - DNA, 21 bp, Artificial Sequence
  Synthetic
ctgtttttggacaaacaccgg

SEQ ID NO: 22358 - DNA, 24 bp, Artificial Sequence
  Synthetic
ctcatattgagtcacaggagagca

SEQ ID NO: 22359 - DNA, 25 bp, Artificial Sequence
  Synthetic
ggactgtgcattttaaaacccaagt

SEQ ID NO: 22360 - DNA, 20 bp, Artificial Sequence
  Synthetic
gtcaggagaaaccccccgca

SEQ ID NO: 22361 - DNA, 21 bp, Artificial Sequence
  Synthetic
actgtttggaactgggttgga

SEQ ID NO: 22362 - DNA, 25 bp, Artificial Sequence
  Synthetic
gggaagtgtaatatacctaggaggc

SEQ ID NO: 22363 - DNA, 24 bp, Artificial Sequence
  Synthetic
ttctgttgtgccattagaggatct

SEQ ID NO: 22364 - DNA, 20 bp, Artificial Sequence
  Synthetic
gagcctcagcaactccacat

SEQ ID NO: 22365 - DNA, 21 bp, Artificial Sequence
  Synthetic
cccagctttactgacacagcc

SEQ ID NO: 22366 - DNA, 20 bp, Artificial Sequence
  Synthetic
aattgggcaggcggttcatt

SEQ ID NO: 22367 - DNA, 24 bp, Artificial Sequence
  Synthetic
atgattctgatcatgaacgcctag

SEQ ID NO: 22368 - DNA, 25 bp, Artificial Sequence
  Synthetic
agaagagaacaactatatgccagac

SEQ ID NO: 22369 - DNA, 23 bp, Artificial Sequence
  Synthetic
tagagctacaagatgccctacac

SEQ ID NO: 22370 - DNA, 24 bp, Artificial Sequence
  Synthetic
gtccgcaccccaataattatttgc

SEQ ID NO: 22371 - DNA, 21 bp, Artificial Sequence
  Synthetic
acagaccacgatccccacacc

SEQ ID NO: 22372 - DNA, 23 bp, Artificial Sequence
  Synthetic
gccttaaccacaaattctttggc

SEQ ID NO: 22373 - DNA, 22 bp, Artificial Sequence
  Synthetic
tgccagcctattcacatacctg

SEQ ID NO: 22374 - DNA, 20 bp, Artificial Sequence
  Synthetic
atcacatgagaacggcgcga

SEQ ID NO: 22375 - DNA, 24 bp, Artificial Sequence
  Synthetic
atgtcacatggatcatcaaccaaa

SEQ ID NO: 22376 - DNA, 23 bp, Artificial Sequence
  Synthetic
attgtgtaatggaggcagaaaca

SEQ ID NO: 22377 - DNA, 24 bp, Artificial Sequence
  Synthetic
caggatgaacagtgatcagtttgc

SEQ ID NO: 22378 - DNA, 23 bp, Artificial Sequence
  Synthetic
aacagcttatcaccttctactgc

SEQ ID NO: 22379 - DNA, 20 bp, Artificial Sequence
  Synthetic
aagcgtgtttgaatcagcgg

SEQ ID NO: 22380 - DNA, 20 bp, Artificial Sequence
  Synthetic
gaccagttgtgcaagacgtt

SEQ ID NO: 22381 - DNA, 25 bp, Artificial Sequence
  Synthetic
aacaagacatcttagacgtgctaat

SEQ ID NO: 22382 - DNA, 23 bp, Artificial Sequence
  Synthetic
cagaagatgaggtggacgaagtg

SEQ ID NO: 22383 - DNA, 24 bp, Artificial Sequence
  Synthetic
cccaacaggtacacaaatatcaga

SEQ ID NO: 22384 - DNA, 20 bp, Artificial Sequence
  Synthetic
tccacgattggacgccatta

SEQ ID NO: 22385 - DNA, 21 bp, Artificial Sequence
  Synthetic
caggcacagcaggaatattgg

SEQ ID NO: 22386 - DNA, 24 bp, Artificial Sequence
  Synthetic
gcatttgaatatgcacaaagggga

SEQ ID NO: 22387 - DNA, 21 bp, Artificial Sequence
  Synthetic
atggaagcaatagccaagcgt

SEQ ID NO: 22388 - DNA, 25 bp, Artificial Sequence
  Synthetic
aacaagttatgaaatgtggcaaaca

SEQ ID NO: 22389 - DNA, 20 bp, Artificial Sequence
  Synthetic
accagcaccaaagacggaac

SEQ ID NO: 22390 - DNA, 24 bp, Artificial Sequence
  Synthetic
ctgggatttatgtcactgcaccta

SEQ ID NO: 22391 - DNA, 25 bp, Artificial Sequence
  Synthetic
aactctacttgtgtgttactgtccc

SEQ ID NO: 22392 - DNA, 20 bp, Artificial Sequence
  Synthetic
ccaggtgcaggttacagacc

SEQ ID NO: 22393 - DNA, 21 bp, Artificial Sequence
  Synthetic
tactgcacctatgggaacacc

SEQ ID NO: 22394 - DNA, 23 bp, Artificial Sequence
  Synthetic
cagcagttctagacttcttgcag

SEQ ID NO: 22395 - DNA, 25 bp, Artificial Sequence
  Synthetic
tccagattatttacaaatggctgca

SEQ ID NO: 22396 - DNA, 25 bp, Artificial Sequence
  Synthetic
acaatggtatttgttggggtaatca

SEQ ID NO: 22397 - DNA, 24 bp, Artificial Sequence
  Synthetic
cttttatgcactgtagccaactct

SEQ ID NO: 22398 - DNA, 22 bp, Artificial Sequence
  Synthetic
tggattaacccgctcaatgccc

SEQ ID NO: 22399 - DNA, 19 bp, Artificial Sequence
  Synthetic
cccagattgggtgtgcgcg

SEQ ID NO: 22400 - DNA, 21 bp, Artificial Sequence
  Synthetic
ggctttggaggacgggatcaa

SEQ ID NO: 22401 - DNA, 19 bp, Artificial Sequence
  Synthetic
tcgcagcgccatacatcgg

SEQ ID NO: 22402 - DNA, 20 bp, Artificial Sequence
  Synthetic
cctcgtgggggtggcctatt

SEQ ID NO: 22403 - DNA, 20 bp, Artificial Sequence
  Synthetic
cccactcggggtcgctaaca

SEQ ID NO: 22404 - DNA, 21 bp, Artificial Sequence
  Synthetic
gttcaccaaaacctgtggcgc

SEQ ID NO: 22405 - DNA, 21 bp, Artificial Sequence
  Synthetic
ccactacagcgtggcagatcc

SEQ ID NO: 22406 - DNA, 22 bp, Artificial Sequence
  Synthetic
ttctgatgctgcctgagagggc

SEQ ID NO: 22407 - DNA, 22 bp, Artificial Sequence
  Synthetic
tcttgcagtcctggtctgtcca

SEQ ID NO: 22408 - DNA, 20 bp, Artificial Sequence
  Synthetic
cctgtttcggccaggttggg

SEQ ID NO: 22409 - DNA, 20 bp, Artificial Sequence
  Synthetic
taacggcgtgatgtggaccg

SEQ ID NO: 22410 - DNA, 22 bp, Artificial Sequence
  Synthetic
cactgacaactcaacaccccca

SEQ ID NO: 22411 - DNA, 21 bp, Artificial Sequence
  Synthetic
ggtgcgccaatcacgtactca

SEQ ID NO: 22412 - DNA, 22 bp, Artificial Sequence
  Synthetic
aaagtgcgatgaactggccaga

SEQ ID NO: 22413 - DNA, 21 bp, Artificial Sequence
  Synthetic
gggaggttgggcacataccgg

SEQ ID NO: 22414 - DNA, 21 bp, Artificial Sequence
  Synthetic
ccaagctgggacaccatgtgg

SEQ ID NO: 22415 - DNA, 22 bp, Artificial Sequence
  Synthetic
aacacctcccactagtcgagca

SEQ ID NO: 22416 - DNA, 22 bp, Artificial Sequence
  Synthetic
gattcgcgactccgatgcttct

SEQ ID NO: 22417 - DNA, 19 bp, Artificial Sequence
  Synthetic
gaaggggccgtgcagtgga

SEQ ID NO: 22418 - DNA, 22 bp, Artificial Sequence
  Synthetic
aggctataagggagagtggcgc

SEQ ID NO: 22419 - DNA, 21 bp, Artificial Sequence
  Synthetic
ccacgcccctaagtgcaaacc

SEQ ID NO: 22420 - DNA, 21 bp, Artificial Sequence
  Synthetic
gtaccgctccccatgactccc

SEQ ID NO: 22421 - DNA, 22 bp, Artificial Sequence
  Synthetic
tccctctcccaggaggaaacgg

SEQ ID NO: 22422 - DNA, 20 bp, Artificial Sequence
  Synthetic
gcttgtaacaccttgcgcgg

SEQ ID NO: 22423 - DNA, 22 bp, Artificial Sequence
  Synthetic
taaccacatcagctccgtgtgg

SEQ ID NO: 22424 - DNA, 22 bp, Artificial Sequence
  Synthetic
accgaaaaggacatcagggtcg

SEQ ID NO: 22425 - DNA, 19 bp, Artificial Sequence
  Synthetic
aggaggacaaccgagccct

SEQ ID NO: 22426 - DNA, 22 bp, Artificial Sequence
  Synthetic
atcgggttggtttacggtaggc

SEQ ID NO: 22427 - DNA, 24 bp, Artificial Sequence
  Synthetic
atacatatactgtgatcatgggcg

SEQ ID NO: 22428 - DNA, 23 bp, Artificial Sequence
  Synthetic
gagtacaacaaatcacactcggg

SEQ ID NO: 22429 - DNA, 20 bp, Artificial Sequence
  Synthetic
tatgggtgtgttcgggcaaa

SEQ ID NO: 22430 - DNA, 25 bp, Artificial Sequence
  Synthetic
gatggggtcttcaaaactactcttc

SEQ ID NO: 22431 - DNA, 24 bp, Artificial Sequence
  Synthetic
actgatccagatacatacaccagt

SEQ ID NO: 22432 - DNA, 23 bp, Artificial Sequence
  Synthetic
gttgagaaaacgaaacagacggt

SEQ ID NO: 22433 - DNA, 21 bp, Artificial Sequence
  Synthetic
aagtgcttcaaaccccagtgt

SEQ ID NO: 22434 - DNA, 21 bp, Artificial Sequence
  Synthetic
acatcaatagggcgcacaaat

SEQ ID NO: 22435 - DNA, 24 bp, Artificial Sequence
  Synthetic
attaccccataatttgcgaaaagc

SEQ ID NO: 22436 - DNA, 21 bp, Artificial Sequence
  Synthetic
gttggagtgtatcgcagagga

SEQ ID NO: 22437 - DNA, 25 bp, Artificial Sequence
  Synthetic
tgtacatttccaaacactttcaggt

SEQ ID NO: 22438 - DNA, 24 bp, Artificial Sequence
  Synthetic
tgcaattgcagaacacttcaattc

SEQ ID NO: 22439 - DNA, 21 bp, Artificial Sequence
  Synthetic
ctaagccccccaacaatcttg

SEQ ID NO: 22440 - DNA, 24 bp, Artificial Sequence
  Synthetic
atgattatgcaacaaaaactgggc

SEQ ID NO: 22441 - DNA, 24 bp, Artificial Sequence
  Synthetic
aacctgctgtattgagtgacaatg

SEQ ID NO: 22442 - DNA, 24 bp, Artificial Sequence
  Synthetic
acaaagcattccatcaaaatcccg

SEQ ID NO: 22443 - DNA, 25 bp, Artificial Sequence
  Synthetic
aagagatacttcaagcctgatcaac

SEQ ID NO: 22444 - DNA, 22 bp, Artificial Sequence
  Synthetic
tcattggtcgagagaaccacgc

SEQ ID NO: 22445 - DNA, 22 bp, Artificial Sequence
  Synthetic
ttgcagatgcagcaagtgtgga

SEQ ID NO: 22446 - DNA, 21 bp, Artificial Sequence
  Synthetic
agtggaacgtggacgacctca

SEQ ID NO: 22447 - DNA, 21 bp, Artificial Sequence
  Synthetic
ccggggttgagtgtgactgtt

SEQ ID NO: 22448 - DNA, 20 bp, Artificial Sequence
  Synthetic
aagtgaaaacaacgcggcgc

SEQ ID NO: 22449 - DNA, 25 bp, Artificial Sequence
  Synthetic
aagcaattgagtcttgtatggaagg

SEQ ID NO: 22450 - DNA, 22 bp, Artificial Sequence
  Synthetic
caggctttgtgtagttgcaaca

SEQ ID NO: 22451 - DNA, 24 bp, Artificial Sequence
  Synthetic
agaagatgaagctacaaatgctgc

SEQ ID NO: 22452 - DNA, 22 bp, Artificial Sequence
  Synthetic
catcagctagcttcacaggcag

SEQ ID NO: 22453 - DNA, 24 bp, Artificial Sequence
  Synthetic
agtaggatttttggatgatgccac

SEQ ID NO: 22454 - DNA, 20 bp, Artificial Sequence
  Synthetic
acctacaccaagaccccgca

SEQ ID NO: 22455 - DNA, 25 bp, Artificial Sequence
  Synthetic
tgaaagacttgaagaggaagctagg

SEQ ID NO: 22456 - DNA, 21 bp, Artificial Sequence
  Synthetic
tcgcagacgaataaaacgagc

SEQ ID NO: 22457 - DNA, 22 bp, Artificial Sequence
  Synthetic
taggccacgtcctaccataccc

SEQ ID NO: 22458 - DNA, 24 bp, Artificial Sequence
  Synthetic
gggacctttaagaagtacaccttt

SEQ ID NO: 22459 - DNA, 24 bp, Artificial Sequence
  Synthetic
tattgcatttacagaacagccacg

SEQ ID NO: 22460 - DNA, 25 bp, Artificial Sequence
  Synthetic
atcagatgttcattgttggttgtgc

SEQ ID NO: 22461 - DNA, 25 bp, Artificial Sequence
  Synthetic
agatgtttcttttatggcaagaggg

SEQ ID NO: 22462 - DNA, 23 bp, Artificial Sequence
  Synthetic
taataggccattttgggtgcaca

SEQ ID NO: 22463 - DNA, 23 bp, Artificial Sequence
  Synthetic
tgtaccaactaggaatgctcaca

SEQ ID NO: 22464 - DNA, 22 bp, Artificial Sequence
  Synthetic
cgaaatcggtcgcttgtatagc

SEQ ID NO: 22465 - DNA, 22 bp, Artificial Sequence
  Synthetic
aacctaatgcaacctcgccagc

SEQ ID NO: 22466 - DNA, 19 bp, Artificial Sequence
  Synthetic
gggccggctgctaattgcc

SEQ ID NO: 22467 - DNA, 19 bp, Artificial Sequence
  Synthetic
ccccctggcacataccgca

SEQ ID NO: 22468 - DNA, 22 bp, Artificial Sequence
  Synthetic
tgttccttacccccggtctacc

SEQ ID NO: 22469 - DNA, 22 bp, Artificial Sequence
  Synthetic
ttaccatctgccaccagcggta

SEQ ID NO: 22470 - DNA, 21 bp, Artificial Sequence
  Synthetic
ggactgcgattcgtaaggcgg

SEQ ID NO: 22471 - DNA, 21 bp, Artificial Sequence
  Synthetic
ctgccctccaaccgctttacc

SEQ ID NO: 22472 - DNA, 19 bp, Artificial Sequence
  Synthetic
ctgggctggaggtgcgcta

SEQ ID NO: 22473 - DNA, 19 bp, Artificial Sequence
  Synthetic
attcgccggctcgctgttt

SEQ ID NO: 22474 - DNA, 20 bp, Artificial Sequence
  Synthetic
gacttgctcccgcctcggta

SEQ ID NO: 22475 - DNA, 22 bp, Artificial Sequence
  Synthetic
cttgactcagccacagacgtcg

SEQ ID NO: 22476 - DNA, 20 bp, Artificial Sequence
  Synthetic
gatgaggccccgtcccttcc

SEQ ID NO: 22477 - DNA, 21 bp, Artificial Sequence
  Synthetic
ggtcgttgttctggggtgagc

SEQ ID NO: 22478 - DNA, 22 bp, Artificial Sequence
  Synthetic
tccttgctggtggcgaaattgg

SEQ ID NO: 22479 - DNA, 20 bp, Artificial Sequence
  Synthetic
gtaaccgcgacgtgtccagg

SEQ ID NO: 22480 - DNA, 19 bp, Artificial Sequence
  Synthetic
gaagcagctccgcctcgct

SEQ ID NO: 22481 - DNA, 19 bp, Artificial Sequence
  Synthetic
gccgctgcctcacgtcgta

SEQ ID NO: 22482 - DNA, 21 bp, Artificial Sequence
  Synthetic
ttactccagcactgcccgtca

SEQ ID NO: 22483 - DNA, 22 bp, Artificial Sequence
  Synthetic
ttggttaatgtagcgaccggcg

SEQ ID NO: 22484 - DNA, 20 bp, Artificial Sequence
  Synthetic
ggccccgtctctatttccgc

SEQ ID NO: 22485 - DNA, 20 bp, Artificial Sequence
  Synthetic
acttgacgttcgtaatgggc

SEQ ID NO: 22486 - DNA, 24 bp, Artificial Sequence
  Synthetic
tctcgtgtatgtctaacgatgttc

SEQ ID NO: 22487 - DNA, 23 bp, Artificial Sequence
  Synthetic
gtattaacgcattgcccagttga

SEQ ID NO: 22488 - DNA, 20 bp, Artificial Sequence
  Synthetic
acaaacaatggtagaccgcg

SEQ ID NO: 22489 - DNA, 25 bp, Artificial Sequence
  Synthetic
gttgcaaaaacaaagacagtttgaa

SEQ ID NO: 22490 - DNA, 20 bp, Artificial Sequence
  Synthetic
ccagctccggattatgtggt

SEQ ID NO: 22491 - DNA, 20 bp, Artificial Sequence
  Synthetic
cgatgaacaccgttttgcac

SEQ ID NO: 22492 - DNA, 20 bp, Artificial Sequence
  Synthetic
ggcaccactggattccgttt

SEQ ID NO: 22493 - DNA, 22 bp, Artificial Sequence
  Synthetic
ctagctcctgcaaactttctgg

SEQ ID NO: 22494 - DNA, 20 bp, Artificial Sequence
  Synthetic
gtgtgcacaccgttgcattt

SEQ ID NO: 22495 - DNA, 23 bp, Artificial Sequence
  Synthetic
ctgcttcttccggtgaatattca

SEQ ID NO: 22496 - DNA, 22 bp, Artificial Sequence
  Synthetic
caccgttgcctttactgtaagt

SEQ ID NO: 22497 - DNA, 21 bp, Artificial Sequence
  Synthetic
actctgggaatcggggggagg

SEQ ID NO: 22498 - DNA, 20 bp, Artificial Sequence
  Synthetic
ccggtattcacggggcgaca

SEQ ID NO: 22499 - DNA, 19 bp, Artificial Sequence
  Synthetic
cgatccgggccaagggctt

SEQ ID NO: 22500 - DNA, 20 bp, Artificial Sequence
  Synthetic
tgggcgggtatcatcggtct

SEQ ID NO: 22501 - DNA, 24 bp, Artificial Sequence
  Synthetic
agctagaacgattcgcagttaatc

SEQ ID NO: 22502 - DNA, 21 bp, Artificial Sequence
  Synthetic
agcaatcaggtcagccaaaat

SEQ ID NO: 22503 - DNA, 22 bp, Artificial Sequence
  Synthetic
gagagaaccaaggggaagtgac

SEQ ID NO: 22504 - DNA, 20 bp, Artificial Sequence
  Synthetic
ggaccagcggctacactaga

SEQ ID NO: 22505 - DNA, 25 bp, Artificial Sequence
  Synthetic
gtagcatgacaaaaatcttagagcc

SEQ ID NO: 22506 - DNA, 24 bp, Artificial Sequence
  Synthetic
gttagtggggaaattgaattgggc

SEQ ID NO: 22507 - DNA, 24 bp, Artificial Sequence
  Synthetic
aaactgcccatacaaaaggaaaca

SEQ ID NO: 22508 - DNA, 23 bp, Artificial Sequence
  Synthetic
ctagtgattttaacctgccacct

SEQ ID NO: 22509 - DNA, 25 bp, Artificial Sequence
  Synthetic
atacatactgacaatggcagcaatt

SEQ ID NO: 22510 - DNA, 25 bp, Artificial Sequence
  Synthetic
aggggatgctagattggtaataaca

SEQ ID NO: 22511 - DNA, 25 bp, Artificial Sequence
  Synthetic
aacaccaaaaaagataaagccacct

SEQ ID NO: 22512 - DNA, 25 bp, Artificial Sequence
  Synthetic
acaactgctgtttatccattttcag

SEQ ID NO: 22513 - DNA, 23 bp, Artificial Sequence
  Synthetic
acagaggtacataatgtttgggc

SEQ ID NO: 22514 - DNA, 23 bp, Artificial Sequence
  Synthetic
ctgctgttaaatggcagtctagc

SEQ ID NO: 22515 - DNA, 25 bp, Artificial Sequence
  Synthetic
tggtggtaatagcaacaatgagtcc

SEQ ID NO: 22516 - DNA, 22 bp, Artificial Sequence
  Synthetic
gttgcaactcacagtctggggc

SEQ ID NO: 22517 - DNA, 22 bp, Artificial Sequence
  Synthetic
agcagctaccaatgctgcttgt

SEQ ID NO: 22518 - DNA, 20 bp, Artificial Sequence
  Synthetic
agggactttccgctggggac

SEQ ID NO: 22519 - DNA, 20 bp, Artificial Sequence
  Synthetic
acgaccttcaccgcgactcc

SEQ ID NO: 22520 - DNA, 20 bp, Artificial Sequence
  Synthetic
gagcgcgtgatggtcatcgc

SEQ ID NO: 22521 - DNA, 20 bp, Artificial Sequence
  Synthetic
cgctctcaaacacctccccg

SEQ ID NO: 22522 - DNA, 22 bp, Artificial Sequence
  Synthetic
taacgtcaaggtcgtcgtcggg

SEQ ID NO: 22523 - DNA, 19 bp, Artificial Sequence
  Synthetic
ggtccgaaacgtcccgtcg

SEQ ID NO: 22524 - DNA, 22 bp, Artificial Sequence
  Synthetic
tccttgtgggacgagaacagcc

SEQ ID NO: 22525 - DNA, 19 bp, Artificial Sequence
  Synthetic
cgttgagggtctgcacgca

SEQ ID NO: 22526 - DNA, 22 bp, Artificial Sequence
  Synthetic
ggtgcgctgcttcaagattctg

SEQ ID NO: 22527 - DNA, 19 bp, Artificial Sequence
  Synthetic
ccacgccctcgctgttcgt

SEQ ID NO: 22528 - DNA, 22 bp, Artificial Sequence
  Synthetic
cactggtacatggcccactacc

SEQ ID NO: 22529 - DNA, 19 bp, Artificial Sequence
  Synthetic
gagcgcggccccagactta

SEQ ID NO: 22530 - DNA, 22 bp, Artificial Sequence
  Synthetic
ctgcatgtagcggtcgtagtgg

SEQ ID NO: 22531 - DNA, 19 bp, Artificial Sequence
  Synthetic
gctctccggcggcgttgat

SEQ ID NO: 22532 - DNA, 20 bp, Artificial Sequence
  Synthetic
gagagtccgtacccgcccca

SEQ ID NO: 22533 - DNA, 19 bp, Artificial Sequence
  Synthetic
ggggtgagcgagtggagca

SEQ ID NO: 22534 - DNA, 19 bp, Artificial Sequence
  Synthetic
cggagaacgcgaggcccat

SEQ ID NO: 22535 - DNA, 19 bp, Artificial Sequence
  Synthetic
cgtgcttcagggggcggtt

SEQ ID NO: 22536 - DNA, 19 bp, Artificial Sequence
  Synthetic
cgaagagcgcactccccca

SEQ ID NO: 22537 - DNA, 22 bp, Artificial Sequence
  Synthetic
aaaggcgccaacaaacctagga

SEQ ID NO: 22538 - DNA, 18 bp, Artificial Sequence
  Synthetic
gcgggacttcgcccagtt

SEQ ID NO: 22539 - DNA, 21 bp, Artificial Sequence
  Synthetic
gtttgcctccagccacaacac

SEQ ID NO: 22540 - DNA, 20 bp, Artificial Sequence
  Synthetic
ggacaaggccgggtcccgta

SEQ ID NO: 22541 - DNA, 22 bp, Artificial Sequence
  Synthetic
ctcccggaaggtattgctcgca

SEQ ID NO: 22542 - DNA, 20 bp, Artificial Sequence
  Synthetic
cggcgtagatgcgcttctcc

SEQ ID NO: 22543 - DNA, 19 bp, Artificial Sequence
  Synthetic
ccggcggacgcgactaaca

SEQ ID NO: 22544 - DNA, 20 bp, Artificial Sequence
  Synthetic
caagggggtgtgggtgacga

SEQ ID NO: 22545 - DNA, 19 bp, Artificial Sequence
  Synthetic
gtccgccgggatgtcggat

SEQ ID NO: 22546 - DNA, 21 bp, Artificial Sequence
  Synthetic
cgtactaccctttcgacgcgc

SEQ ID NO: 22547 - DNA, 19 bp, Artificial Sequence
  Synthetic
gtgcgccgtgctgtgtctg

SEQ ID NO: 22548 - DNA, 20 bp, Artificial Sequence
  Synthetic
gctgggcatgctgatcccgg

SEQ ID NO: 22549 - DNA, 19 bp, Artificial Sequence
  Synthetic
gtgacgtcggcgcgactca

SEQ ID NO: 22550 - DNA, 19 bp, Artificial Sequence
  Synthetic
aggagccccacgttctcga

SEQ ID NO: 22551 - DNA, 19 bp, Artificial Sequence
  Synthetic
gggcggtccagaaccactg

SEQ ID NO: 22552 - DNA, 19 bp, Artificial Sequence
  Synthetic
acaacccccacctcgctca

SEQ ID NO: 22553 - DNA, 22 bp, Artificial Sequence
  Synthetic
agcgacgtcgagtttaactgca

SEQ ID NO: 22554 - DNA, 20 bp, Artificial Sequence
  Synthetic
ggaacgcgtaatcggccacc

SEQ ID NO: 22555 - DNA, 21 bp, Artificial Sequence
  Synthetic
ttcggtgctgtttcaggggtt

SEQ ID NO: 22556 - DNA, 19 bp, Artificial Sequence
  Synthetic
gctttgtgcgcatgccccg

SEQ ID NO: 22557 - DNA, 20 bp, Artificial Sequence
  Synthetic
cttcgcccaccgattcctgt

SEQ ID NO: 22558 - DNA, 18 bp, Artificial Sequence
  Synthetic
gtatgcgacgcggctggt

SEQ ID NO: 22559 - DNA, 18 bp, Artificial Sequence
  Synthetic
tggtggcggcgcacaaca

SEQ ID NO: 22560 - DNA, 19 bp, Artificial Sequence
  Synthetic
cacacggcgtgcctgaaga

SEQ ID NO: 22561 - DNA, 20 bp, Artificial Sequence
  Synthetic
gcgagcaccgaccccctaga

SEQ ID NO: 22562 - DNA, 22 bp, Artificial Sequence
  Synthetic
aggacgtctccaagctctccga

SEQ ID NO: 22563 - DNA, 19 bp, Artificial Sequence
  Synthetic
gcgacgtccggcgacatag

SEQ ID NO: 22564 - DNA, 19 bp, Artificial Sequence
  Synthetic
cgctatcgtcggctgcggt

SEQ ID NO: 22565 - DNA, 20 bp, Artificial Sequence
  Synthetic
caggtcgaggatcgcgtcgc

SEQ ID NO: 22566 - DNA, 19 bp, Artificial Sequence
  Synthetic
gggggcggagtcgttcaac

SEQ ID NO: 22567 - DNA, 22 bp, Artificial Sequence
  Synthetic
tgcgttatcacctcctcgctcg

SEQ ID NO: 22568 - DNA, 19 bp, Artificial Sequence
  Synthetic
cggctccctgacgatgcgt

SEQ ID NO: 22569 - DNA, 22 bp, Artificial Sequence
  Synthetic
ttttcgagaagaaggcgtcgcg

SEQ ID NO: 22570 - DNA, 20 bp, Artificial Sequence
  Synthetic
cgcctatgcgcgtccctgtg

SEQ ID NO: 22571 - DNA, 20 bp, Artificial Sequence
  Synthetic
acgacgatgcatgttcggcg

SEQ ID NO: 22572 - DNA, 20 bp, Artificial Sequence
  Synthetic
gttcgaggcggatccggtca

SEQ ID NO: 22573 - DNA, 18 bp, Artificial Sequence
  Synthetic
tggcaggccgaaaacgcc

SEQ ID NO: 22574 - DNA, 20 bp, Artificial Sequence
  Synthetic
cggtcgtagtccaacgtgcc

SEQ ID NO: 22575 - DNA, 18 bp, Artificial Sequence
  Synthetic
gcatgccccgcaaaacgc

SEQ ID NO: 22576 - DNA, 20 bp, Artificial Sequence
  Synthetic
atgcagaaggggtgcaggca

SEQ ID NO: 22577 - DNA, 19 bp, Artificial Sequence
  Synthetic
ggggcggggtttgttgtga

SEQ ID NO: 22578 - DNA, 19 bp, Artificial Sequence
  Synthetic
ctccccagagcctgctggt

SEQ ID NO: 22579 - DNA, 22 bp, Artificial Sequence
  Synthetic
tttcgcgggaagaaccttccgg

SEQ ID NO: 22580 - DNA, 20 bp, Artificial Sequence
  Synthetic
ccatcggaggccccccagat

SEQ ID NO: 22581 - DNA, 19 bp, Artificial Sequence
  Synthetic
gggtggcgctctctgccaa

SEQ ID NO: 22582 - DNA, 20 bp, Artificial Sequence
  Synthetic
cgatcctgccgctcgttcga

SEQ ID NO: 22583 - DNA, 21 bp, Artificial Sequence
  Synthetic
acgaagtgtcttgtgcagcca

SEQ ID NO: 22584 - DNA, 24 bp, Artificial Sequence
  Synthetic
aatcgtgcgtaaattgctataccc

SEQ ID NO: 22585 - DNA, 22 bp, Artificial Sequence
  Synthetic
caggcactcctggtcaacagtc

SEQ ID NO: 22586 - DNA, 20 bp, Artificial Sequence
  Synthetic
tttgctgcgacaacaatgcc

SEQ ID NO: 22587 - DNA, 23 bp, Artificial Sequence
  Synthetic
gtggtgtctaatcagcagacaga

SEQ ID NO: 22588 - DNA, 20 bp, Artificial Sequence
  Synthetic
tggaccatggggaagctgat

SEQ ID NO: 22589 - DNA, 21 bp, Artificial Sequence
  Synthetic
gggcacggtgctgtctaatag

SEQ ID NO: 22590 - DNA, 25 bp, Artificial Sequence
  Synthetic
tgaatggtataaagctagaggtggc

SEQ ID NO: 22591 - DNA, 22 bp, Artificial Sequence
  Synthetic
aaggtactacgaccgcaggggt

SEQ ID NO: 22592 - DNA, 21 bp, Artificial Sequence
  Synthetic
aagggttaaacgcgctaatcc

SEQ ID NO: 22593 - DNA, 22 bp, Artificial Sequence
  Synthetic
ggtccccgggatattttgccaa

SEQ ID NO: 22594 - DNA, 20 bp, Artificial Sequence
  Synthetic
ggcgaggaggagactgcctt

SEQ ID NO: 22595 - DNA, 20 bp, Artificial Sequence
  Synthetic
gttagtcgcctggggcaacg

SEQ ID NO: 22596 - DNA, 24 bp, Artificial Sequence
  Synthetic
ttgagcaagacataggactaaccg

SEQ ID NO: 22597 - DNA, 21 bp, Artificial Sequence
  Synthetic
cactgaccgtttgcttactgt

SEQ ID NO: 22598 - DNA, 21 bp, Artificial Sequence
  Synthetic
actgaccaaggttcagactca

SEQ ID NO: 22599 - DNA, 22 bp, Artificial Sequence
  Synthetic
cataggcctgggaaacttgaat

SEQ ID NO: 22600 - DNA, 21 bp, Artificial Sequence
  Synthetic
gaggagtttcagcttgccttt

SEQ ID NO: 22601 - DNA, 24 bp, Artificial Sequence
  Synthetic
tgatctacgggatcgtatgacaga

SEQ ID NO: 22602 - DNA, 22 bp, Artificial Sequence
  Synthetic
actgaaacggtgtgtactgcca

SEQ ID NO: 22603 - DNA, 25 bp, Artificial Sequence
  Synthetic
agaatgcacctgttttaattgtggt

SEQ ID NO: 22604 - DNA, 24 bp, Artificial Sequence
  Synthetic
tcgaaaaaacatcaaaagacgctt

SEQ ID NO: 22605 - DNA, 25 bp, Artificial Sequence
  Synthetic
ttgctttctcaaattgaacattgga

SEQ ID NO: 22606 - DNA, 25 bp, Artificial Sequence
  Synthetic
acttgggaaatttgggtattggtac

SEQ ID NO: 22607 - DNA, 23 bp, Artificial Sequence
  Synthetic
tacacaaatcccgcctttgatcc

SEQ ID NO: 22608 - DNA, 23 bp, Artificial Sequence
  Synthetic
agaactacagcctttagggtctt

SEQ ID NO: 22609 - DNA, 25 bp, Artificial Sequence
  Synthetic
tgttggacatccatactttgaagtg

SEQ ID NO: 22610 - DNA, 25 bp, Artificial Sequence
  Synthetic
aatccaaatcagtatcctccagagg

SEQ ID NO: 22611 - DNA, 23 bp, Artificial Sequence
  Synthetic
ggtcttagcctggtttggagaag

SEQ ID NO: 22612 - DNA, 23 bp, Artificial Sequence
  Synthetic
ctggaaaggtttgtgtagacagt

SEQ ID NO: 22613 - DNA, 20 bp, Artificial Sequence
  Synthetic
tgctgtttgcagaacttggt

SEQ ID NO: 22614 - DNA, 21 bp, Artificial Sequence
  Synthetic
agctgattgatgatgccgatg

SEQ ID NO: 22615 - DNA, 23 bp, Artificial Sequence
  Synthetic
agaaacatctgtggtggaaaagc

SEQ ID NO: 22616 - DNA, 23 bp, Artificial Sequence
  Synthetic
acaatgggcatttgacaatgaca

SEQ ID NO: 22617 - DNA, 23 bp, Artificial Sequence
  Synthetic
agacttgagaaaagaggatggcg

SEQ ID NO: 22618 - DNA, 20 bp, Artificial Sequence
  Synthetic
cgcagagcctcagccctaga

SEQ ID NO: 22619 - DNA, 22 bp, Artificial Sequence
  Synthetic
cgcgacttcaacgacttcaagc

SEQ ID NO: 22620 - DNA, 21 bp, Artificial Sequence
  Synthetic
aaacgggacactgctgaaaat

SEQ ID NO: 22621 - DNA, 23 bp, Artificial Sequence
  Synthetic
gtggtacaacccactgttaaacc

SEQ ID NO: 22622 - DNA, 21 bp, Artificial Sequence
  Synthetic
aactctaggggctacaggagg

SEQ ID NO: 22623 - DNA, 23 bp, Artificial Sequence
  Synthetic
tctttgcaaagaactagcacacc

SEQ ID NO: 22624 - DNA, 20 bp, Artificial Sequence
  Synthetic
tgctccagatcccgccttta

SEQ ID NO: 22625 - DNA, 25 bp, Artificial Sequence
  Synthetic
ttgatgtttttggtgacttcagtga

SEQ ID NO: 22626 - DNA, 25 bp, Artificial Sequence
  Synthetic
aattaggtgacactgaaaatcctgc

SEQ ID NO: 22627 - DNA, 22 bp, Artificial Sequence
  Synthetic
ttggggctgcaaacttcaaaac

SEQ ID NO: 22628 - DNA, 25 bp, Artificial Sequence
  Synthetic
tgctttaattctactgactcatggg

SEQ ID NO: 22629 - DNA, 22 bp, Artificial Sequence
  Synthetic
agactgactcaaatctggcagc

SEQ ID NO: 22630 - DNA, 25 bp, Artificial Sequence
  Synthetic
aaatggactacatcaaggaaggaaa

SEQ ID NO: 22631 - DNA, 25 bp, Artificial Sequence
  Synthetic
tactggagtgagcaagaagaattct

SEQ ID NO: 22632 - DNA, 25 bp, Artificial Sequence
  Synthetic
ttcaggatgtaagctttcaacatcc

SEQ ID NO: 22633 - DNA, 25 bp, Artificial Sequence
  Synthetic
gaagggtttagtgtttgtgaaaacg

SEQ ID NO: 22634 - DNA, 24 bp, Artificial Sequence
  Synthetic
aagaatctagctgatgtggtatgc

SEQ ID NO: 22635 - DNA, 21 bp, Artificial Sequence
  Synthetic
atctgatgaggagacccagga

SEQ ID NO: 22636 - DNA, 23 bp, Artificial Sequence
  Synthetic
caaggcttcaagcagtttcaatt

SEQ ID NO: 22637 - DNA, 25 bp, Artificial Sequence
  Synthetic
aatacgtttttttgggggaaaagtt

SEQ ID NO: 22638 - DNA, 24 bp, Artificial Sequence
  Synthetic
attgggagctggttagaaaagagc

SEQ ID NO: 22639 - DNA, 22 bp, Artificial Sequence
  Synthetic
agaagaagaacagccaccgacg

SEQ ID NO: 22640 - DNA, 22 bp, Artificial Sequence
  Synthetic
attgctgcgcatttttggtagt

SEQ ID NO: 22641 - DNA, 24 bp, Artificial Sequence
  Synthetic
agagagctcactacctacagaatc

SEQ ID NO: 22642 - DNA, 25 bp, Artificial Sequence
  Synthetic
ctggtgatgtaagtcttgaatttgc

SEQ ID NO: 22643 - DNA, 25 bp, Artificial Sequence
  Synthetic
ctaatttaggggagtttagtgggga

SEQ ID NO: 22644 - DNA, 25 bp, Artificial Sequence
  Synthetic
ttggaactcagttacattttcatgc

SEQ ID NO: 22645 - DNA, 25 bp, Artificial Sequence
  Synthetic
aaggtattcaaattggtagaggtgg

SEQ ID NO: 22646 - DNA, 24 bp, Artificial Sequence
  Synthetic
taatgctgttattcaggacggaac

SEQ ID NO: 22647 - DNA, 23 bp, Artificial Sequence
  Synthetic
tatggctcgtgaaggtaaaatgg

SEQ ID NO: 22648 - DNA, 24 bp, Artificial Sequence
  Synthetic
ctactgaaaatcctgctccagaaa

SEQ ID NO: 22649 - DNA, 20 bp, Artificial Sequence
  Synthetic
tctctcgaacggaagcggta

SEQ ID NO: 22650 - DNA, 25 bp, Artificial Sequence
  Synthetic
gtgcagaaattgtaagtcatgaagg

SEQ ID NO: 22651 - DNA, 22 bp, Artificial Sequence
  Synthetic
aacttctgcttcaattcgcaca

SEQ ID NO: 22652 - DNA, 24 bp, Artificial Sequence
  Synthetic
ggaaattccctggcactatacaac

SEQ ID NO: 22653 - DNA, 21 bp, Artificial Sequence
  Synthetic
cccataacactgcgttgttgg

SEQ ID NO: 22654 - DNA, 23 bp, Artificial Sequence
  Synthetic
tcaagaggaagctagggatccac

SEQ ID NO: 22655 - DNA, 24 bp, Artificial Sequence
  Synthetic
gcaaaggtcctgaaataactgtga

SEQ ID NO: 22656 - DNA, 25 bp, Artificial Sequence
  Synthetic
aagaattatcaatcaagggcaacga

SEQ ID NO: 22657 - DNA, 25 bp, Artificial Sequence
  Synthetic
atagggttttcagatttcatttgcc

SEQ ID NO: 22658 - DNA, 24 bp, Artificial Sequence
  Synthetic
atggagcctaagcaaaatcaattg

SEQ ID NO: 22659 - DNA, 25 bp, Artificial Sequence
  Synthetic
tcagattggaatgttaaatgggagc

SEQ ID NO: 22660 - DNA, 25 bp, Artificial Sequence
  Synthetic
atttggccagtattaatacccacac

SEQ ID NO: 22661 - DNA, 22 bp, Artificial Sequence
  Synthetic
aaaacgtcaacaaaagccaggt

SEQ ID NO: 22662 - DNA, 25 bp, Artificial Sequence
  Synthetic
attcctaactttgatggaaacgtct

SEQ ID NO: 22663 - DNA, 24 bp, Artificial Sequence
  Synthetic
attcgttatggctaccgatgaaat

SEQ ID NO: 22664 - DNA, 20 bp, Artificial Sequence
  Synthetic
ggcggccaacccagcttatg

SEQ ID NO: 22665 - DNA, 23 bp, Artificial Sequence
  Synthetic
cgaatgttgaagcatgtggttac

SEQ ID NO: 22666 - DNA, 25 bp, Artificial Sequence
  Synthetic
ttaccattcacttggtagaacaggt

SEQ ID NO: 22667 - DNA, 20 bp, Artificial Sequence
  Synthetic
tggacggaactcttctaggc

SEQ ID NO: 22668 - DNA, 21 bp, Artificial Sequence
  Synthetic
ccacaagggttacccactact

SEQ ID NO: 22669 - DNA, 25 bp, Artificial Sequence
  Synthetic
ttgggtgaaatagctcagtactaca

SEQ ID NO: 22670 - DNA, 23 bp, Artificial Sequence
  Synthetic
cattccatggacatcaggtgtac

SEQ ID NO: 22671 - DNA, 22 bp, Artificial Sequence
  Synthetic
gctggcttggataatcacagga

SEQ ID NO: 22672 - DNA, 20 bp, Artificial Sequence
  Synthetic
tgcttctaaccccagtgtgt

SEQ ID NO: 22673 - DNA, 22 bp, Artificial Sequence
  Synthetic
tggattccaagagcacctagag

SEQ ID NO: 22674 - DNA, 25 bp, Artificial Sequence
  Synthetic
acaggaagttctatcccatcatttg

SEQ ID NO: 22675 - DNA, 25 bp, Artificial Sequence
  Synthetic
agacaattggatttcattgctgatg

SEQ ID NO: 22676 - DNA, 25 bp, Artificial Sequence
  Synthetic
aatcccactcaagagaaaagagagc

SEQ ID NO: 22677 - DNA, 20 bp, Artificial Sequence
  Synthetic
cgcgcattggcagaacattt

SEQ ID NO: 22678 - DNA, 22 bp, Artificial Sequence
  Synthetic
atcttgaacccagaagctctga

SEQ ID NO: 22679 - DNA, 22 bp, Artificial Sequence
  Synthetic
atgcccaaccaggtgataatgt

SEQ ID NO: 22680 - DNA, 23 bp, Artificial Sequence
  Synthetic
atacaccaacaaccaggatgatc

SEQ ID NO: 22681 - DNA, 25 bp, Artificial Sequence
  Synthetic
agtgtgttttacaatgtgttccctg

SEQ ID NO: 22682 - DNA, 25 bp, Artificial Sequence
  Synthetic
aaatcgaaacaaacaaatttgcagc

SEQ ID NO: 22683 - DNA, 20 bp, Artificial Sequence
  Synthetic
cctgttctcagcggtccaaa

SEQ ID NO: 22684 - DNA, 25 bp, Artificial Sequence
  Synthetic
aggaattatttcacatcagaggtgt

SEQ ID NO: 22685 - DNA, 24 bp, Artificial Sequence
  Synthetic
ccaagacttgaaccacacaaatgg

SEQ ID NO: 22686 - DNA, 25 bp, Artificial Sequence
  Synthetic
aagacatgaccaaagagttctttga

SEQ ID NO: 22687 - DNA, 22 bp, Artificial Sequence
  Synthetic
tgcccttaggatgaagtggatg

SEQ ID NO: 22688 - DNA, 20 bp, Artificial Sequence
  Synthetic
ggccccgttcacttcagaaa

SEQ ID NO: 22689 - DNA, 22 bp, Artificial Sequence
  Synthetic
acatgttggagagagaactggt

SEQ ID NO: 22690 - DNA, 20 bp, Artificial Sequence
  Synthetic
agtacacagattggcgggat

SEQ ID NO: 22691 - DNA, 22 bp, Artificial Sequence
  Synthetic
cgaagagcaacagccattctaa

SEQ ID NO: 22692 - DNA, 24 bp, Artificial Sequence
  Synthetic
gtttcaaaactggggaattgaacc

SEQ ID NO: 22693 - DNA, 22 bp, Artificial Sequence
  Synthetic
attcatcgtccatgatgtggga

SEQ ID NO: 22694 - DNA, 25 bp, Artificial Sequence
  Synthetic
ctcttctctaactgtgaatgtgagg

SEQ ID NO: 22695 - DNA, 22 bp, Artificial Sequence
  Synthetic
agtgagagggtattggagaggc

SEQ ID NO: 22696 - DNA, 25 bp, Artificial Sequence
  Synthetic
gacgatgagaattttcaagaacagg

SEQ ID NO: 22697 - DNA, 24 bp, Artificial Sequence
  Synthetic
tttctgaacaggtagaagtgcaaa

SEQ ID NO: 22698 - DNA, 20 bp, Artificial Sequence
  Synthetic
gggccctccagatccaccga

SEQ ID NO: 22699 - DNA, 20 bp, Artificial Sequence
  Synthetic
ggaggctcgggatccgtata

SEQ ID NO: 22700 - DNA, 22 bp, Artificial Sequence
  Synthetic
ggatacacaccttttggaggca

SEQ ID NO: 22701 - DNA, 22 bp, Artificial Sequence
  Synthetic
tggtgaacatccttccgttaca

SEQ ID NO: 22702 - DNA, 21 bp, Artificial Sequence
  Synthetic
aaacgcaaacactcctcctct

SEQ ID NO: 22703 - DNA, 25 bp, Artificial Sequence
  Synthetic
taaagcaatagaggttccaaaggtg

SEQ ID NO: 22704 - DNA, 23 bp, Artificial Sequence
  Synthetic
ctgcagaggtagatgacagtaga

SEQ ID NO: 22705 - DNA, 20 bp, Artificial Sequence
  Synthetic
cctcccgggagagccatagt

SEQ ID NO: 22706 - DNA, 20 bp, Artificial Sequence
  Synthetic
ggtgtgcgcgccacaagaaa

SEQ ID NO: 22707 - DNA, 22 bp, Artificial Sequence
  Synthetic
ttcacgctgctggcatcctgtt

SEQ ID NO: 22708 - DNA, 20 bp, Artificial Sequence
  Synthetic
cggtcactggggtgtcctga

SEQ ID NO: 22709 - DNA, 22 bp, Artificial Sequence
  Synthetic
tggggccctataacccacaagt

SEQ ID NO: 22710 - DNA, 21 bp, Artificial Sequence
  Synthetic
gcttcaccaagacctgcggag

SEQ ID NO: 22711 - DNA, 22 bp, Artificial Sequence
  Synthetic
cctctacggagtctcctcgagc

SEQ ID NO: 22712 - DNA, 22 bp, Artificial Sequence
  Synthetic
tggaccctcatcttcctgtgct

SEQ ID NO: 22713 - DNA, 22 bp, Artificial Sequence
  Synthetic
gtggcgacatcttgaggggtct

SEQ ID NO: 22714 - DNA, 21 bp, Artificial Sequence
  Synthetic
aagggcccgtatgccagatgt

SEQ ID NO: 22715 - DNA, 21 bp, Artificial Sequence
  Synthetic
ggccctggacttcatccctgt

SEQ ID NO: 22716 - DNA, 22 bp, Artificial Sequence
  Synthetic
cagacccaacgacggtgcttgg

SEQ ID NO: 22717 - DNA, 20 bp, Artificial Sequence
  Synthetic
gacggacgcccttatgaccg

SEQ ID NO: 22718 - DNA, 20 bp, Artificial Sequence
  Synthetic
cacggggtgcgcatggtatg

SEQ ID NO: 22719 - DNA, 22 bp, Artificial Sequence
  Synthetic
ctgggggctgtccaaaatgaga

SEQ ID NO: 22720 - DNA, 22 bp, Artificial Sequence
  Synthetic
tgcagaagaactgaaacccgct

SEQ ID NO: 22721 - DNA, 19 bp, Artificial Sequence
  Synthetic
tcgtcgtgagcggcttagc

SEQ ID NO: 22722 - DNA, 22 bp, Artificial Sequence
  Synthetic
gttacgcaggctacaccagtgg

SEQ ID NO: 22723 - DNA, 21 bp, Artificial Sequence
  Synthetic
tgtgcagcaacacttggcatg

SEQ ID NO: 22724 - DNA, 21 bp, Artificial Sequence
  Synthetic
tgttgtggggtctcagctccc

SEQ ID NO: 22725 - DNA, 20 bp, Artificial Sequence
  Synthetic
gttccctcctgctctcccga

SEQ ID NO: 22726 - DNA, 22 bp, Artificial Sequence
  Synthetic
catctcctgacccgacaacagc

SEQ ID NO: 22727 - DNA, 22 bp, Artificial Sequence
  Synthetic
tgcgagaagatggcactctacg

SEQ ID NO: 22728 - DNA, 22 bp, Artificial Sequence
  Synthetic
gtggggtgctcactaccagttt

SEQ ID NO: 22729 - DNA, 20 bp, Artificial Sequence
  Synthetic
gcgagctgcttgggagacag

SEQ ID NO: 22730 - DNA, 20 bp, Artificial Sequence
  Synthetic
ggcgccacccttaagagctt

SEQ ID NO: 22731 - DNA, 22 bp, Artificial Sequence
  Synthetic
gtaaggaagtgggccttaatgg

SEQ ID NO: 22732 - DNA, 22 bp, Artificial Sequence
  Synthetic
aagccgctcaagaattgttcaa

SEQ ID NO: 22733 - DNA, 24 bp, Artificial Sequence
  Synthetic
aattggagttcttatagctgacgc

SEQ ID NO: 22734 - DNA, 25 bp, Artificial Sequence
  Synthetic
aaagcctcagataaccaacaagatg

SEQ ID NO: 22735 - DNA, 24 bp, Artificial Sequence
  Synthetic
ccaccctcttaagttgagaaacag

SEQ ID NO: 22736 - DNA, 24 bp, Artificial Sequence
  Synthetic
tatcagcagattggaagaagaagg

SEQ ID NO: 22737 - DNA, 25 bp, Artificial Sequence
  Synthetic
tttggagagaaggaagatgttatgc

SEQ ID NO: 22738 - DNA, 24 bp, Artificial Sequence
  Synthetic
agagttacttctgatccacgaagg

SEQ ID NO: 22739 - DNA, 22 bp, Artificial Sequence
  Synthetic
ccatagcggttcagaaaatggc

SEQ ID NO: 22740 - DNA, 22 bp, Artificial Sequence
  Synthetic
ccagattgggttgctagacaaa

SEQ ID NO: 22741 - DNA, 25 bp, Artificial Sequence
  Synthetic
agggtagtatgctttaaattcccaa

SEQ ID NO: 22742 - DNA, 25 bp, Artificial Sequence
  Synthetic
aacaagcaatttccataagtctgac

SEQ ID NO: 22743 - DNA, 24 bp, Artificial Sequence
  Synthetic
aaaacctacactatctcccctccc

SEQ ID NO: 22744 - DNA, 23 bp, Artificial Sequence
  Synthetic
aaaacgcattccagcagtaaaca

SEQ ID NO: 22745 - DNA, 23 bp, Artificial Sequence
  Synthetic
taggcctactgttcctgtagagc

SEQ ID NO: 22746 - DNA, 24 bp, Artificial Sequence
  Synthetic
ttttacaacaaccaaccagaaacg

SEQ ID NO: 22747 - DNA, 25 bp, Artificial Sequence
  Synthetic
tggttttacgtactggtagtagaca

SEQ ID NO: 22748 - DNA, 24 bp, Artificial Sequence
  Synthetic
agtttcaggcaatcagtttagagt

SEQ ID NO: 22749 - DNA, 24 bp, Artificial Sequence
  Synthetic
atatgccagacatttttggacacg

SEQ ID NO: 22750 - DNA, 24 bp, Artificial Sequence
  Synthetic
atcaatgctatgaatccaggcatt

SEQ ID NO: 22751 - DNA, 23 bp, Artificial Sequence
  Synthetic
cacttgtccatttgtgtcattcg

SEQ ID NO: 22752 - DNA, 22 bp, Artificial Sequence
  Synthetic
tccatggggccaaagaaatagc

SEQ ID NO: 22753 - DNA, 22 bp, Artificial Sequence
  Synthetic
ctatcgactcttcaaacacggc

SEQ ID NO: 22754 - DNA, 25 bp, Artificial Sequence
  Synthetic
cgagaacgaaaatgacagtgataca

SEQ ID NO: 22755 - DNA, 20 bp, Artificial Sequence
  Synthetic
tacaggtagaagggcgccat

SEQ ID NO: 22756 - DNA, 24 bp, Artificial Sequence
  Synthetic
acagacctacgtgaccatatagac

SEQ ID NO: 22757 - DNA, 24 bp, Artificial Sequence
  Synthetic
tggagacatatgcaatacaatgca

SEQ ID NO: 22758 - DNA, 21 bp, Artificial Sequence
  Synthetic
aatcccactttcactgaccca

SEQ ID NO: 22759 - DNA, 21 bp, Artificial Sequence
  Synthetic
acggatgaatatgttgcacgc

SEQ ID NO: 22760 - DNA, 20 bp, Artificial Sequence
  Synthetic
gtgttgaggtaggtcgtggt

SEQ ID NO: 22761 - DNA, 23 bp, Artificial Sequence
  Synthetic
tatggttgatactggctttggtg

SEQ ID NO: 22762 - DNA, 25 bp, Artificial Sequence
  Synthetic
tttcctacacctagtggttctatgg

SEQ ID NO: 22763 - DNA, 25 bp, Artificial Sequence
  Synthetic
taggacgcaaatttttactacaagc

SEQ ID NO: 22764 - DNA, 20 bp, Artificial Sequence
  Synthetic
atgcgtgccaaatccctgtt

SEQ ID NO: 22765 - DNA, 22 bp, Artificial Sequence
  Synthetic
agaatgtgtgtactgcaagcaa

SEQ ID NO: 22766 - DNA, 24 bp, Artificial Sequence
  Synthetic
ttccataatataaggggtcggtgg

SEQ ID NO: 22767 - DNA, 25 bp, Artificial Sequence
  Synthetic
cggacagagcccattacaatattgt

SEQ ID NO: 22768 - DNA, 24 bp, Artificial Sequence
  Synthetic
atatgcacacacttagaagtctgc

SEQ ID NO: 22769 - DNA, 25 bp, Artificial Sequence
  Synthetic
aggaaaaccgtttcattgaaattgg

SEQ ID NO: 22770 - DNA, 22 bp, Artificial Sequence
  Synthetic
aacaagccaattaaagtgggca

SEQ ID NO: 22771 - DNA, 21 bp, Artificial Sequence
  Synthetic
ttttacagcagaggtgtccca

SEQ ID NO: 22772 - DNA, 25 bp, Artificial Sequence
  Synthetic
gttggaaccacataaatgggaaaag

SEQ ID NO: 22773 - DNA, 23 bp, Artificial Sequence
  Synthetic
aatcagaaacatggccaattgga

SEQ ID NO: 22774 - DNA, 25 bp, Artificial Sequence
  Synthetic
acaaagactgaacaaaaggagctac

SEQ ID NO: 22775 - DNA, 24 bp, Artificial Sequence
  Synthetic
aattggcaaatgttgtgaggaaga

SEQ ID NO: 22776 - DNA, 20 bp, Artificial Sequence
  Synthetic
agtaccagcggaaatgctcg

SEQ ID NO: 22777 - DNA, 21 bp, Artificial Sequence
  Synthetic
tgacttcgccctcatagtgaa

SEQ ID NO: 22778 - DNA, 20 bp, Artificial Sequence
  Synthetic
cccaaatggcccttcagcta

SEQ ID NO: 22779 - DNA, 22 bp, Artificial Sequence
  Synthetic
ggatgaagactaccaaggcagg

SEQ ID NO: 22780 - DNA, 25 bp, Artificial Sequence
  Synthetic
agatggacctgacatctgtacattc

SEQ ID NO: 22781 - DNA, 25 bp, Artificial Sequence
  Synthetic
attggtttaaggtgtgttacatgca

SEQ ID NO: 22782 - DNA, 25 bp, Artificial Sequence
  Synthetic
aggaggagtctgaatatccatatgc

SEQ ID NO: 22783 - DNA, 23 bp, Artificial Sequence
  Synthetic
cgggatgatgatgagagcgaatt

SEQ ID NO: 22784 - DNA, 20 bp, Artificial Sequence
  Synthetic
tgcaatagcctcagtcccag

SEQ ID NO: 22785 - DNA, 24 bp, Artificial Sequence
  Synthetic
cacagtaggtgtcagttttactga

SEQ ID NO: 22786 - DNA, 22 bp, Artificial Sequence
  Synthetic
aagtgaccaagaagacgaggag

SEQ ID NO: 22787 - DNA, 25 bp, Artificial Sequence
  Synthetic
gactcacaatatggttctgaacagt

SEQ ID NO: 22788 - DNA, 18 bp, Artificial Sequence
  Synthetic
ccggctgttcgcaagcga

SEQ ID NO: 22789 - DNA, 24 bp, Artificial Sequence
  Synthetic
agctgctccacaagatatttatcc

SEQ ID NO: 22790 - DNA, 25 bp, Artificial Sequence
  Synthetic
tcctttattcaggatcacagctagt

SEQ ID NO: 22791 - DNA, 24 bp, Artificial Sequence
  Synthetic
tagacgctattatgaacaagtgcc

SEQ ID NO: 22792 - DNA, 24 bp, Artificial Sequence
  Synthetic
ttgagttacaaacactgggtgaag

SEQ ID NO: 22793 - DNA, 20 bp, Artificial Sequence
  Synthetic
cagatggctgtttggcttcc

SEQ ID NO: 22794 - DNA, 22 bp, Artificial Sequence
  Synthetic
cctaaccgatttgcctttggag

SEQ ID NO: 22795 - DNA, 21 bp, Artificial Sequence
  Synthetic
tgtgcaggaacacagtttcag

SEQ ID NO: 22796 - DNA, 25 bp, Artificial Sequence
  Synthetic
tttcagaaaacgtagatcctccaat

SEQ ID NO: 22797 - DNA, 21 bp, Artificial Sequence
  Synthetic
tggcatgcaattggtatgtgg

SEQ ID NO: 22798 - DNA, 24 bp, Artificial Sequence
  Synthetic
tcggaagaatgattggtggaatcg

SEQ ID NO: 22799 - DNA, 22 bp, Artificial Sequence
  Synthetic
ggtgaaaatggacgaaggacaa

SEQ ID NO: 22800 - DNA, 22 bp, Artificial Sequence
  Synthetic
agggaagggtactcactggtcg

SEQ ID NO: 22801 - DNA, 25 bp, Artificial Sequence
  Synthetic
ttgcttcaaatgagaatgtggaaac

SEQ ID NO: 22802 - DNA, 24 bp, Artificial Sequence
  Synthetic
acttggaatgcaggaccttttttc

SEQ ID NO: 22803 - DNA, 24 bp, Artificial Sequence
  Synthetic
ttgaggacacaagagtctgaatgt

SEQ ID NO: 22804 - DNA, 22 bp, Artificial Sequence
  Synthetic
gacaattggcatggttcgaacc

SEQ ID NO: 22805 - DNA, 24 bp, Artificial Sequence
  Synthetic
aatggatggacagagactgatagt

SEQ ID NO: 22806 - DNA, 23 bp, Artificial Sequence
  Synthetic
gtgtcttgaaacgatggaagttg

SEQ ID NO: 22807 - DNA, 23 bp, Artificial Sequence
  Synthetic
aattggcaaatgtcgtgaggaag

SEQ ID NO: 22808 - DNA, 25 bp, Artificial Sequence
  Synthetic
atgttcgaaagtaagagcatgaagc

SEQ ID NO: 22809 - DNA, 23 bp, Artificial Sequence
  Synthetic
tccaatcctctgatgatttcgct

SEQ ID NO: 22810 - DNA, 21 bp, Artificial Sequence
  Synthetic
ggacaacgaccttggaccagc

SEQ ID NO: 22811 - DNA, 20 bp, Artificial Sequence
  Synthetic
caacacggcgaccctacaag

SEQ ID NO: 22812 - DNA, 25 bp, Artificial Sequence
  Synthetic
ttggaaaaactaactaacactgggt

SEQ ID NO: 22813 - DNA, 23 bp, Artificial Sequence
  Synthetic
aattccggttgaccttctatgtc

SEQ ID NO: 22814 - DNA, 20 bp, Artificial Sequence
  Synthetic
acgaaagtttgcaggaggca

SEQ ID NO: 22815 - DNA, 21 bp, Artificial Sequence
  Synthetic
ggcagtacggaggctatagac

SEQ ID NO: 22816 - DNA, 22 bp, Artificial Sequence
  Synthetic
agatgaagggggagattggaga

SEQ ID NO: 22817 - DNA, 23 bp, Artificial Sequence
  Synthetic
ggcatacagacattaaaccacca

SEQ ID NO: 22818 - DNA, 22 bp, Artificial Sequence
  Synthetic
gacaaaaccgctacctgtgtaa

SEQ ID NO: 22819 - DNA, 20 bp, Artificial Sequence
  Synthetic
gggcaccgcaaagacctacg

SEQ ID NO: 22820 - DNA, 20 bp, Artificial Sequence
  Synthetic
ttggacaggtgcaggcaatg

SEQ ID NO: 22821 - DNA, 23 bp, Artificial Sequence
  Synthetic
attgtggtaataacgtcccctgc

SEQ ID NO: 22822 - DNA, 21 bp, Artificial Sequence
  Synthetic
tatccgtctacataggcctgc

SEQ ID NO: 22823 - DNA, 20 bp, Artificial Sequence
  Synthetic
gcctgtaccatcgcgttcta

SEQ ID NO: 22824 - DNA, 20 bp, Artificial Sequence
  Synthetic
attggggaacactgggctaa

SEQ ID NO: 22825 - DNA, 22 bp, Artificial Sequence
  Synthetic
ggtactatgggtgacactgtgc

SEQ ID NO: 22826 - DNA, 22 bp, Artificial Sequence
  Synthetic
ctgtacctgggcaatatgatgc

SEQ ID NO: 22827 - DNA, 23 bp, Artificial Sequence
  Synthetic
tcctacaatcctccattttgctg

SEQ ID NO: 22828 - DNA, 21 bp, Artificial Sequence
  Synthetic
gagaccctccttacagccatg

SEQ ID NO: 22829 - DNA, 22 bp, Artificial Sequence
  Synthetic
tgaaacgatggaggttgttcag

SEQ ID NO: 22830 - DNA, 24 bp, Artificial Sequence
  Synthetic
gaaagcaaagttggcaaatgttgt

SEQ ID NO: 22831 - DNA, 24 bp, Artificial Sequence
  Synthetic
tcttcaatcctctgacgattttgc

SEQ ID NO: 22832 - DNA, 24 bp, Artificial Sequence
  Synthetic
cggacatgagtattggagttactg

SEQ ID NO: 22833 - DNA, 23 bp, Artificial Sequence
  Synthetic
acagaagaccagtcgggatatcc

SEQ ID NO: 22834 - DNA, 22 bp, Artificial Sequence
  Synthetic
ggtggtaaatcccagcacaggt

SEQ ID NO: 22835 - DNA, 22 bp, Artificial Sequence
  Synthetic
gagttcctctagggatggccga

SEQ ID NO: 22836 - DNA, 19 bp, Artificial Sequence
  Synthetic
ccggtggcctcagctgctt

SEQ ID NO: 22837 - DNA, 22 bp, Artificial Sequence
  Synthetic
agggtggcatcttcgacaactg

SEQ ID NO: 22838 - DNA, 19 bp, Artificial Sequence
  Synthetic
cagtggggctccgcgtact

SEQ ID NO: 22839 - DNA, 22 bp, Artificial Sequence
  Synthetic
taggaggttattggcacgccct

SEQ ID NO: 22840 - DNA, 21 bp, Artificial Sequence
  Synthetic
tcttcagtggtcagcgtcggt

SEQ ID NO: 22841 - DNA, 21 bp, Artificial Sequence
  Synthetic
tgcttcgctggttccgacttg

SEQ ID NO: 22842 - DNA, 18 bp, Artificial Sequence
  Synthetic
cgtgctggtggcgatgca

SEQ ID NO: 22843 - DNA, 20 bp, Artificial Sequence
  Synthetic
gccggcctttgtgcaaactg

SEQ ID NO: 22844 - DNA, 22 bp, Artificial Sequence
  Synthetic
aggactgtgccatagttcggga

SEQ ID NO: 22845 - DNA, 21 bp, Artificial Sequence
  Synthetic
ccattgccaatgggggctacc

SEQ ID NO: 22846 - DNA, 22 bp, Artificial Sequence
  Synthetic
ctccctagggaggctcagacca

SEQ ID NO: 22847 - DNA, 19 bp, Artificial Sequence
  Synthetic
gtgcccggttgctggcgaa

SEQ ID NO: 22848 - DNA, 20 bp, Artificial Sequence
  Synthetic
ctgggtgtgtcggcagtgac

SEQ ID NO: 22849 - DNA, 19 bp, Artificial Sequence
  Synthetic
ggcaggtaccgtgcgctct

SEQ ID NO: 22850 - DNA, 22 bp, Artificial Sequence
  Synthetic
ggaacatgtggccccccatcac

SEQ ID NO: 22851 - DNA, 20 bp, Artificial Sequence
  Synthetic
tgtgaagccggtggcggaag

SEQ ID NO: 22852 - DNA, 20 bp, Artificial Sequence
  Synthetic
cggcctctttcctgctggga

SEQ ID NO: 22853 - DNA, 21 bp, Artificial Sequence
  Synthetic
gcgctcggcgttctactctgg

SEQ ID NO: 22854 - DNA, 22 bp, Artificial Sequence
  Synthetic
gatggggtgcagcaaaggatgg

SEQ ID NO: 22855 - DNA, 21 bp, Artificial Sequence
  Synthetic
cgtctagcgcctacgacctga

SEQ ID NO: 22856 - DNA, 20 bp, Artificial Sequence
  Synthetic
ctgctgtgtccctactgccc

SEQ ID NO: 22857 - DNA, 22 bp, Artificial Sequence
  Synthetic
agctggtgtgcaggagagaaga

SEQ ID NO: 22858 - DNA, 22 bp, Artificial Sequence
  Synthetic
tcgacgaacatgacatgcaggt

SEQ ID NO: 22859 - DNA, 22 bp, Artificial Sequence
  Synthetic
cttggctgaatgtgttgctggg

SEQ ID NO: 22860 - DNA, 22 bp, Artificial Sequence
  Synthetic
gagttggtgatgtgccaggtcc

SEQ ID NO: 22861 - DNA, 24 bp, Artificial Sequence
  Synthetic
atttggaagcttgtgaattcgact

SEQ ID NO: 22862 - DNA, 25 bp, Artificial Sequence
  Synthetic
aggcagtgtaagcatttttatcatg

SEQ ID NO: 22863 - DNA, 23 bp, Artificial Sequence
  Synthetic
ggcaattccctggaactatttca

SEQ ID NO: 22864 - DNA, 22 bp, Artificial Sequence
  Synthetic
tgcgttctagcaacaaaaaagc

SEQ ID NO: 22865 - DNA, 22 bp, Artificial Sequence
  Synthetic
gtgggataggtgcaatgtcatt

SEQ ID NO: 22866 - DNA, 20 bp, Artificial Sequence
  Synthetic
caaggcttgctcccgaagac

SEQ ID NO: 22867 - DNA, 24 bp, Artificial Sequence
  Synthetic
ctaaaagtcagttttggctgcaac

SEQ ID NO: 22868 - DNA, 24 bp, Artificial Sequence
  Synthetic
tttggacacaattagacctgagtg

SEQ ID NO: 22869 - DNA, 20 bp, Artificial Sequence
  Synthetic
ccccaccacctccacaaccg

SEQ ID NO: 22870 - DNA, 19 bp, Artificial Sequence
  Synthetic
gtggaaggtcacccaggcg

SEQ ID NO: 22871 - DNA, 20 bp, Artificial Sequence
  Synthetic
gcgaccccccagtaatcatt

SEQ ID NO: 22872 - DNA, 25 bp, Artificial Sequence
  Synthetic
atgctgcttttgctactaacatact

SEQ ID NO: 22873 - DNA, 22 bp, Artificial Sequence
  Synthetic
ccactagcacaggttccagtgc

SEQ ID NO: 22874 - DNA, 25 bp, Artificial Sequence
  Synthetic
tccagacagagattttcttgatgtt

SEQ ID NO: 22875 - DNA, 25 bp, Artificial Sequence
  Synthetic
agtcattatacaccctcatgacagt

SEQ ID NO: 22876 - DNA, 25 bp, Artificial Sequence
  Synthetic
ccaaatgtttattgtaggatgcaca

SEQ ID NO: 22877 - DNA, 25 bp, Artificial Sequence
  Synthetic
atccagtgatgctcaattgtttaac

SEQ ID NO: 22878 - DNA, 25 bp, Artificial Sequence
  Synthetic
caaacgtaaaaattgaggtctgacc

SEQ ID NO: 22879 - DNA, 20 bp, Artificial Sequence
  Synthetic
tcgaacaatcaagcagtgcc

SEQ ID NO: 22880 - DNA, 22 bp, Artificial Sequence
  Synthetic
atcgtgcggtcttggtaaatgt

SEQ ID NO: 22881 - DNA, 25 bp, Artificial Sequence
  Synthetic
atgcgactgctagcatcatttatga

SEQ ID NO: 22882 - DNA, 24 bp, Artificial Sequence
  Synthetic
ccagaagttagatgtgtttgcaga

SEQ ID NO: 22883 - DNA, 24 bp, Artificial Sequence
  Synthetic
ctggttatgagactttcagggtcg

SEQ ID NO: 22884 - DNA, 21 bp, Artificial Sequence
  Synthetic
aagaactgactcccggaacca

SEQ ID NO: 22885 - DNA, 25 bp, Artificial Sequence
  Synthetic
ctaattcaaaatgcacaagctgtgg

SEQ ID NO: 22886 - DNA, 25 bp, Artificial Sequence
  Synthetic
tgagattccaattaagcagaccatc

SEQ ID NO: 22887 - DNA, 24 bp, Artificial Sequence
  Synthetic
tctctcctatcattgttggcaact

SEQ ID NO: 22888 - DNA, 25 bp, Artificial Sequence
  Synthetic
actttgtcgatttgaaaatgagagg

SEQ ID NO: 22889 - DNA, 20 bp, Artificial Sequence
  Synthetic
ccctccgtgctcgaagattt

SEQ ID NO: 22890 - DNA, 24 bp, Artificial Sequence
  Synthetic
tgaaacggaggatcataactctgc

SEQ ID NO: 22891 - DNA, 22 bp, Artificial Sequence
  Synthetic
agcattgcctacagatatgcca

SEQ ID NO: 22892 - DNA, 22 bp, Artificial Sequence
  Synthetic
cgaggcgcattagatggtaatg

SEQ ID NO: 22893 - DNA, 22 bp, Artificial Sequence
  Synthetic
agatgaatcaggccgatttgac

SEQ ID NO: 22894 - DNA, 21 bp, Artificial Sequence
  Synthetic
aaaaggcgaagagggaggagc

SEQ ID NO: 22895 - DNA, 24 bp, Artificial Sequence
  Synthetic
tctccagaaaatggggttgcaatt

SEQ ID NO: 22896 - DNA, 24 bp, Artificial Sequence
  Synthetic
cccctattgaacgtctacaatcct

SEQ ID NO: 22897 - DNA, 25 bp, Artificial Sequence
  Synthetic
tttcagatgtcttggacaaagtcag

SEQ ID NO: 22898 - DNA, 24 bp, Artificial Sequence
  Synthetic
aatttgctatcacagatgcatgtg

SEQ ID NO: 22899 - DNA, 23 bp, Artificial Sequence
  Synthetic
agacaggatatggcatttgaccc

SEQ ID NO: 22900 - DNA, 25 bp, Artificial Sequence
  Synthetic
aaatgggcaaggatatttatggtga

SEQ ID NO: 22901 - DNA, 25 bp, Artificial Sequence
  Synthetic
atggtgttttatggggtaatgactg

SEQ ID NO: 22902 - DNA, 22 bp, Artificial Sequence
  Synthetic
aacatgccctcaaactttggtt

SEQ ID NO: 22903 - DNA, 21 bp, Artificial Sequence
  Synthetic
ggagatcctccatacagccat

SEQ ID NO: 22904 - DNA, 24 bp, Artificial Sequence
  Synthetic
gaactcatgccttgaaacaatgga

SEQ ID NO: 22905 - DNA, 25 bp, Artificial Sequence
  Synthetic
aatggtcacacaaagaacaataggg

SEQ ID NO: 22906 - DNA, 22 bp, Artificial Sequence
  Synthetic
ccaaactggcaaatgttgtgag

SEQ ID NO: 22907 - DNA, 22 bp, Artificial Sequence
  Synthetic
tgaagctccgaacacaaatacc

SEQ ID NO: 22908 - DNA, 22 bp, Artificial Sequence
  Synthetic
tccaatcctccgacgattttgc

SEQ ID NO: 22909 - DNA, 21 bp, Artificial Sequence
  Synthetic
cccagatggctctccaattgt

SEQ ID NO: 22910 - DNA, 23 bp, Artificial Sequence
  Synthetic
tgaagtctgcttaaagtgggagc

SEQ ID NO: 22911 - DNA, 25 bp, Artificial Sequence
  Synthetic
ccctagtagttcatataggagaccg

SEQ ID NO: 22912 - DNA, 24 bp, Artificial Sequence
  Synthetic
tggagcctcagagagctaaaaatt

SEQ ID NO: 22913 - DNA, 25 bp, Artificial Sequence
  Synthetic
aaggtcaccattcaagattgattct

SEQ ID NO: 22914 - DNA, 25 bp, Artificial Sequence
  Synthetic
aacaccagaaagacaatccaaaagg

SEQ ID NO: 22915 - DNA, 20 bp, Artificial Sequence
  Synthetic
tcctcaaggagtgcgtttgg

SEQ ID NO: 22916 - DNA, 25 bp, Artificial Sequence
  Synthetic
gcttttaaaaatcctgaacaaaggc

SEQ ID NO: 22917 - DNA, 20 bp, Artificial Sequence
  Synthetic
caggaagaggaactgggggt

SEQ ID NO: 22918 - DNA, 22 bp, Artificial Sequence
  Synthetic
caacagatgttggtgctgttgg

SEQ ID NO: 22919 - DNA, 25 bp, Artificial Sequence
  Synthetic
tcaaacctttgacattttagagcca

SEQ ID NO: 22920 - DNA, 21 bp, Artificial Sequence
  Synthetic
cgccattgcaggaatttgctg

SEQ ID NO: 22921 - DNA, 24 bp, Artificial Sequence
  Synthetic
agtgagcgtttactaattgtggga

SEQ ID NO: 22922 - DNA, 25 bp, Artificial Sequence
  Synthetic
gttggagacacagaaaatcctagct

SEQ ID NO: 22923 - DNA, 22 bp, Artificial Sequence
  Synthetic
aactacaacaggacagagcagg

SEQ ID NO: 22924 - DNA, 21 bp, Artificial Sequence
  Synthetic
aggatttgtcacaagaggcgg

SEQ ID NO: 22925 - DNA, 24 bp, Artificial Sequence
  Synthetic
ggactaggaaatgaagctgaagat

SEQ ID NO: 22926 - DNA, 21 bp, Artificial Sequence
  Synthetic
cgtcgacgcctagaagacgac

SEQ ID NO: 22927 - DNA, 23 bp, Artificial Sequence
  Synthetic
gcaaactaaaatacaggggcatg

SEQ ID NO: 22928 - DNA, 21 bp, Artificial Sequence
  Synthetic
aattggtgccaatagacgccc

SEQ ID NO: 22929 - DNA, 20 bp, Artificial Sequence
  Synthetic
cctagacgggtagcgactag

SEQ ID NO: 22930 - DNA, 25 bp, Artificial Sequence
  Synthetic
tgtacaatagaagagtcagacaggt

SEQ ID NO: 22931 - DNA, 22 bp, Artificial Sequence
  Synthetic
tcgtccttaatactggctctcg

SEQ ID NO: 22932 - DNA, 24 bp, Artificial Sequence
  Synthetic
tgcttctggtaaggtgtatcttcc

SEQ ID NO: 22933 - DNA, 24 bp, Artificial Sequence
  Synthetic
acttctaagtcttccaaacgcaaa

SEQ ID NO: 22934 - DNA, 20 bp, Artificial Sequence
  Synthetic
gactcacagccaacctctct

SEQ ID NO: 22935 - DNA, 24 bp, Artificial Sequence
  Synthetic
ttcaggatcttgcatcgtttgaac

SEQ ID NO: 22936 - DNA, 25 bp, Artificial Sequence
  Synthetic
atcagattttatgtaagtgccagcg

SEQ ID NO: 22937 - DNA, 23 bp, Artificial Sequence
  Synthetic
cagtgcagaaaatgaagctgaag

SEQ ID NO: 22938 - DNA, 23 bp, Artificial Sequence
  Synthetic
gcataatgccagagtggataaca

SEQ ID NO: 22939 - DNA, 25 bp, Artificial Sequence
  Synthetic
tgatgttacatatgcatgttggagt

SEQ ID NO: 22940 - DNA, 25 bp, Artificial Sequence
  Synthetic
aaatgctgcaaaagacattgataca

SEQ ID NO: 22941 - DNA, 20 bp, Artificial Sequence
  Synthetic
ctctcccactgcctggaaac

SEQ ID NO: 22942 - DNA, 25 bp, Artificial Sequence
  Synthetic
gacactgtcacactaccaaaaggaa

SEQ ID NO: 22943 - DNA, 22 bp, Artificial Sequence
  Synthetic
ttttcctgatgtcaccgttgtt

SEQ ID NO: 22944 - DNA, 25 bp, Artificial Sequence
  Synthetic
tacactttttaaatcagccttcccg

SEQ ID NO: 22945 - DNA, 25 bp, Artificial Sequence
  Synthetic
cccacaaacaaatataattcctggc

SEQ ID NO: 22946 - DNA, 23 bp, Artificial Sequence
  Synthetic
aatccagaaactcaacggctagt

SEQ ID NO: 22947 - DNA, 22 bp, Artificial Sequence
  Synthetic
ctatggaaaacgagagcagctg

SEQ ID NO: 22948 - DNA, 23 bp, Artificial Sequence
  Synthetic
acaaccaacatccagtattgagg

SEQ ID NO: 22949 - DNA, 22 bp, Artificial Sequence
  Synthetic
tgtttgactcatggggtcagtc

SEQ ID NO: 22950 - DNA, 24 bp, Artificial Sequence
  Synthetic
ttcaggtacgtctttattgttgcc

SEQ ID NO: 22951 - DNA, 22 bp, Artificial Sequence
  Synthetic
gcccatcctggacatggagacg

SEQ ID NO: 22952 - DNA, 22 bp, Artificial Sequence
  Synthetic
ctcaagttttcgcacccgtcgc

SEQ ID NO: 22953 - DNA, 20 bp, Artificial Sequence
  Synthetic
gattccattcggggtgccgc

SEQ ID NO: 22954 - DNA, 19 bp, Artificial Sequence
  Synthetic
taaggccctgggagcgcgt

SEQ ID NO: 22955 - DNA, 21 bp, Artificial Sequence
  Synthetic
gcctcttccagtaactcggcc

SEQ ID NO: 22956 - DNA, 21 bp, Artificial Sequence
  Synthetic
gcgagtagttggtgatgcggc

SEQ ID NO: 22957 - DNA, 20 bp, Artificial Sequence
  Synthetic
gagcttggccatgtacgcgc

SEQ ID NO: 22958 - DNA, 19 bp, Artificial Sequence
  Synthetic
gtcggcgagcccacacaca

SEQ ID NO: 22959 - DNA, 19 bp, Artificial Sequence
  Synthetic
agaactgcccccgaagcca

SEQ ID NO: 22960 - DNA, 19 bp, Artificial Sequence
  Synthetic
gttcgtcctgccccactgg

SEQ ID NO: 22961 - DNA, 20 bp, Artificial Sequence
  Synthetic
gtggtccgtctcgctaacgg

SEQ ID NO: 22962 - DNA, 21 bp, Artificial Sequence
  Synthetic
ccgaaggtcctcccagatccc

SEQ ID NO: 22963 - DNA, 20 bp, Artificial Sequence
  Synthetic
gcagaaccgggccacgatct

SEQ ID NO: 22964 - DNA, 18 bp, Artificial Sequence
  Synthetic
attggcgcgcggaccaca

SEQ ID NO: 22965 - DNA, 21 bp, Artificial Sequence
  Synthetic
tgcactttgcgtgtctggtgt

SEQ ID NO: 22966 - DNA, 20 bp, Artificial Sequence
  Synthetic
cgtgtcgtcgaatgccaggc

SEQ ID NO: 22967 - DNA, 19 bp, Artificial Sequence
  Synthetic
ggtgcggtgcctgccgata

SEQ ID NO: 22968 - DNA, 21 bp, Artificial Sequence
  Synthetic
gaatgggagctcgggtccaca

SEQ ID NO: 22969 - DNA, 21 bp, Artificial Sequence
  Synthetic
atcgccttgtgtgtgtgctgg

SEQ ID NO: 22970 - DNA, 19 bp, Artificial Sequence
  Synthetic
ggcgaacacggggctgcat

SEQ ID NO: 22971 - DNA, 19 bp, Artificial Sequence
  Synthetic
cgccggatcgaggtaccgt

SEQ ID NO: 22972 - DNA, 20 bp, Artificial Sequence
  Synthetic
aggatcttgggtgctgacgc

SEQ ID NO: 22973 - DNA, 19 bp, Artificial Sequence
  Synthetic
tcagggggtgcgtcacgct

SEQ ID NO: 22974 - DNA, 19 bp, Artificial Sequence
  Synthetic
ggccacctgacacagaggc

SEQ ID NO: 22975 - DNA, 20 bp, Artificial Sequence
  Synthetic
tgtgggtgtgtaggcgatgc

SEQ ID NO: 22976 - DNA, 19 bp, Artificial Sequence
  Synthetic
aagtctgcgggggagcggt

SEQ ID NO: 22977 - DNA, 21 bp, Artificial Sequence
  Synthetic
atggtcgccgtcattatggcc

SEQ ID NO: 22978 - DNA, 21 bp, Artificial Sequence
  Synthetic
cgctctccatcctgcatcagg

SEQ ID NO: 22979 - DNA, 19 bp, Artificial Sequence
  Synthetic
caggggcgatggaagcgga

SEQ ID NO: 22980 - DNA, 20 bp, Artificial Sequence
  Synthetic
tccaggcagcgatgtttggc

SEQ ID NO: 22981 - DNA, 19 bp, Artificial Sequence
  Synthetic
gtcctgtcggacgacggtg

SEQ ID NO: 22982 - DNA, 19 bp, Artificial Sequence
  Synthetic
gccagggcgcagaagacgt

SEQ ID NO: 22983 - DNA, 19 bp, Artificial Sequence
  Synthetic
cgctcaaacgccccgagga

SEQ ID NO: 22984 - DNA, 22 bp, Artificial Sequence
  Synthetic
acagggtgttgcaatacgaccc

SEQ ID NO: 22985 - DNA, 18 bp, Artificial Sequence
  Synthetic
ggcggcgaacaaggcaca

SEQ ID NO: 22986 - DNA, 19 bp, Artificial Sequence
  Synthetic
gctacgccaccaccatgca

SEQ ID NO: 22987 - DNA, 19 bp, Artificial Sequence
  Synthetic
cttcgaccggggtctcgga

SEQ ID NO: 22988 - DNA, 19 bp, Artificial Sequence
  Synthetic
gccccgttaggcgccagaa

SEQ ID NO: 22989 - DNA, 22 bp, Artificial Sequence
  Synthetic
tgtgtctgtcctccggaagggc

SEQ ID NO: 22990 - DNA, 18 bp, Artificial Sequence
  Synthetic
cggcacgctgttgacgct

SEQ ID NO: 22991 - DNA, 19 bp, Artificial Sequence
  Synthetic
ccccgcgtcagacaaaccc

SEQ ID NO: 22992 - DNA, 21 bp, Artificial Sequence
  Synthetic
ccgggacttttggatgtcgcc

SEQ ID NO: 22993 - DNA, 22 bp, Artificial Sequence
  Synthetic
ccttcatgacggcgctggtact

SEQ ID NO: 22994 - DNA, 19 bp, Artificial Sequence
  Synthetic
gtcaaagtcgccgccctcc

SEQ ID NO: 22995 - DNA, 19 bp, Artificial Sequence
  Synthetic
cggctcagctggtgggagt

SEQ ID NO: 22996 - DNA, 18 bp, Artificial Sequence
  Synthetic
tcagcttgcgggcctcgt

SEQ ID NO: 22997 - DNA, 20 bp, Artificial Sequence
  Synthetic
tgtacctgcgggcgaagatg

SEQ ID NO: 22998 - DNA, 20 bp, Artificial Sequence
  Synthetic
tccacctcctgccacttggt

SEQ ID NO: 22999 - DNA, 19 bp, Artificial Sequence
  Synthetic
gatggccgcgtggaactgc

SEQ ID NO: 23000 - DNA, 18 bp, Artificial Sequence
  Synthetic
tgcgaaagttgcgcccct

SEQ ID NO: 23001 - DNA, 19 bp, Artificial Sequence
  Synthetic
gcagggtctcgagttcggc

SEQ ID NO: 23002 - DNA, 20 bp, Artificial Sequence
  Synthetic
ccgagcctcccaggtgcaga

SEQ ID NO: 23003 - DNA, 21 bp, Artificial Sequence
  Synthetic
gttgccgtcttgggctttgtc

SEQ ID NO: 23004 - DNA, 19 bp, Artificial Sequence
  Synthetic
cgtctacgtccgaagcggg

SEQ ID NO: 23005 - DNA, 20 bp, Artificial Sequence
  Synthetic
gattccccagagcagccccg

SEQ ID NO: 23006 - DNA, 18 bp, Artificial Sequence
  Synthetic
acatctcgcgcgcgctgt

SEQ ID NO: 23007 - DNA, 22 bp, Artificial Sequence
  Synthetic
ggtccgggtaaaacaacagccg

SEQ ID NO: 23008 - DNA, 21 bp, Artificial Sequence
  Synthetic
caggaggctgggatcgaaggc

SEQ ID NO: 23009 - DNA, 20 bp, Artificial Sequence
  Synthetic
ggatcagctgctttgtgcgc

SEQ ID NO: 23010 - DNA, 20 bp, Artificial Sequence
  Synthetic
cgtcaggacggagagccagg

SEQ ID NO: 23011 - DNA, 20 bp, Artificial Sequence
  Synthetic
gtgcggggcattgtgtctcc

SEQ ID NO: 23012 - DNA, 19 bp, Artificial Sequence
  Synthetic
gatcccccccgcgttccat

SEQ ID NO: 23013 - DNA, 19 bp, Artificial Sequence
  Synthetic
ggtaggccgcgctacacgt

SEQ ID NO: 23014 - DNA, 20 bp, Artificial Sequence
  Synthetic
gaggccctcttgcacgaacg

SEQ ID NO: 23015 - DNA, 19 bp, Artificial Sequence
  Synthetic
gggtggttccgccttgcgt

SEQ ID NO: 23016 - DNA, 18 bp, Artificial Sequence
  Synthetic
aaaagccagcgcgggtgg

SEQ ID NO: 23017 - DNA, 20 bp, Artificial Sequence
  Synthetic
tgcgtgcaggcgtttaacga

SEQ ID NO: 23018 - DNA, 21 bp, Artificial Sequence
  Synthetic
ctgcaccgagatcgtccatcc

SEQ ID NO: 23019 - DNA, 21 bp, Artificial Sequence
  Synthetic
atcaggggccgtgatatgccg

SEQ ID NO: 23020 - DNA, 20 bp, Artificial Sequence
  Synthetic
ctcctcgtccgtccggcact

SEQ ID NO: 23021 - DNA, 21 bp, Artificial Sequence
  Synthetic
ttcagtcggtatcgctggcgc

SEQ ID NO: 23022 - DNA, 19 bp, Artificial Sequence
  Synthetic
ccacgttcgagctcggggt

SEQ ID NO: 23023 - DNA, 20 bp, Artificial Sequence
  Synthetic
ggggacacgggctaccctca

SEQ ID NO: 23024 - DNA, 22 bp, Artificial Sequence
  Synthetic
tgtctggttcgaggacgaccac

SEQ ID NO: 23025 - DNA, 19 bp, Artificial Sequence
  Synthetic
ggccgtgaatcccccgtca

SEQ ID NO: 23026 - DNA, 20 bp, Artificial Sequence
  Synthetic
gtgtcccgcggggagaaagg

SEQ ID NO: 23027 - DNA, 18 bp, Artificial Sequence
  Synthetic
tggtcgccaccacgcatt

SEQ ID NO: 23028 - DNA, 18 bp, Artificial Sequence
  Synthetic
actcgttggcgcgctgaa

SEQ ID NO: 23029 - DNA, 20 bp, Artificial Sequence
  Synthetic
gcggcccgggagagaagaga

SEQ ID NO: 23030 - DNA, 20 bp, Artificial Sequence
  Synthetic
aggttcaccatgcaggcgtg

SEQ ID NO: 23031 - DNA, 19 bp, Artificial Sequence
  Synthetic
taacgatgcggggggtggc

SEQ ID NO: 23032 - DNA, 21 bp, Artificial Sequence
  Synthetic
cgcctgtgcgtgtccttgtgt

SEQ ID NO: 23033 - DNA, 19 bp, Artificial Sequence
  Synthetic
ccgtcttcggtgccagtcc

SEQ ID NO: 23034 - DNA, 20 bp, Artificial Sequence
  Synthetic
tgtttggcgtcgtgagtccc

SEQ ID NO: 23035 - DNA, 19 bp, Artificial Sequence
  Synthetic
ggacagcagcggggagtgt

SEQ ID NO: 23036 - DNA, 18 bp, Artificial Sequence
  Synthetic
cggccatgcacaccagca

SEQ ID NO: 23037 - DNA, 19 bp, Artificial Sequence
  Synthetic
acgaacggccacgacagtg

SEQ ID NO: 23038 - DNA, 21 bp, Artificial Sequence
  Synthetic
ataacgacaaacggcccctcg

SEQ ID NO: 23039 - DNA, 22 bp, Artificial Sequence
  Synthetic
tccaagccagccaagttaacgg

SEQ ID NO: 23040 - DNA, 22 bp, Artificial Sequence
  Synthetic
ccccggtgtcgttcaacaaaga

SEQ ID NO: 23041 - DNA, 22 bp, Artificial Sequence
  Synthetic
tctggacatgtcggcggaatcc

SEQ ID NO: 23042 - DNA, 19 bp, Artificial Sequence
  Synthetic
ttcttgcggaccacggccc

SEQ ID NO: 23043 - DNA, 19 bp, Artificial Sequence
  Synthetic
tcctccgcaaacaggcccg

SEQ ID NO: 23044 - DNA, 19 bp, Artificial Sequence
  Synthetic
gcaggaagctccacagggc

SEQ ID NO: 23045 - DNA, 20 bp, Artificial Sequence
  Synthetic
gtcgttcggggtgctcgttg

SEQ ID NO: 23046 - DNA, 20 bp, Artificial Sequence
  Synthetic
ccccggagacccccaaacct

SEQ ID NO: 23047 - DNA, 20 bp, Artificial Sequence
  Synthetic
ctggacgccatggacaggga

SEQ ID NO: 23048 - DNA, 21 bp, Artificial Sequence
  Synthetic
gtggtacacgagcacgagcca

SEQ ID NO: 23049 - DNA, 20 bp, Artificial Sequence
  Synthetic
ccgcagatcgcagcggtctc

SEQ ID NO: 23050 - DNA, 22 bp, Artificial Sequence
  Synthetic
tcagatcacccgcatcatccga

SEQ ID NO: 23051 - DNA, 19 bp, Artificial Sequence
  Synthetic
tcagccttaccacgcccga

SEQ ID NO: 23052 - DNA, 20 bp, Artificial Sequence
  Synthetic
acttccgggcctcagaaccc

SEQ ID NO: 23053 - DNA, 19 bp, Artificial Sequence
  Synthetic
gggacctgcggccaacaca

SEQ ID NO: 23054 - DNA, 22 bp, Artificial Sequence
  Synthetic
cgggctaaccaggaaatccgtg

SEQ ID NO: 23055 - DNA, 20 bp, Artificial Sequence
  Synthetic
cccgacggcgtagtggagga

SEQ ID NO: 23056 - DNA, 20 bp, Artificial Sequence
  Synthetic
cgccagcctgtttgtcctgg

SEQ ID NO: 23057 - DNA, 21 bp, Artificial Sequence
  Synthetic
gtataccctgtccgtgggcga

SEQ ID NO: 23058 - DNA, 22 bp, Artificial Sequence
  Synthetic
actcggaaagcgaagacgaggc

SEQ ID NO: 23059 - DNA, 22 bp, Artificial Sequence
  Synthetic
gctccgctaaaagaccgcatcg

SEQ ID NO: 23060 - DNA, 25 bp, Artificial Sequence
  Synthetic
ttcaattcagacagggaatcaacac

SEQ ID NO: 23061 - DNA, 20 bp, Artificial Sequence
  Synthetic
ggggctgtggctgtattgaa

SEQ ID NO: 23062 - DNA, 20 bp, Artificial Sequence
  Synthetic
gctggcgaaatcacatgtgt

SEQ ID NO: 23063 - DNA, 22 bp, Artificial Sequence
  Synthetic
agcggctttgaaatgatttggg

SEQ ID NO: 23064 - DNA, 22 bp, Artificial Sequence
  Synthetic
attcctatgggagtgggcctca

SEQ ID NO: 23065 - DNA, 21 bp, Artificial Sequence
  Synthetic
tccttgccacaagaacacatc

SEQ ID NO: 23066 - DNA, 22 bp, Artificial Sequence
  Synthetic
gaacgcccaccaaatattgccc

SEQ ID NO: 23067 - DNA, 24 bp, Artificial Sequence
  Synthetic
tttggaagatccagcgtctagaga

SEQ ID NO: 23068 - DNA, 22 bp, Artificial Sequence
  Synthetic
ctttcccgaccaccagttggat

SEQ ID NO: 23069 - DNA, 25 bp, Artificial Sequence
  Synthetic
gtggaccatatggccataattaaga

SEQ ID NO: 23070 - DNA, 24 bp, Artificial Sequence
  Synthetic
caagtacggtccattacccaaaag

SEQ ID NO: 23071 - DNA, 20 bp, Artificial Sequence
  Synthetic
attggagatgtgccacagca

SEQ ID NO: 23072 - DNA, 22 bp, Artificial Sequence
  Synthetic
atgaggagttcacaatggtggg

SEQ ID NO: 23073 - DNA, 22 bp, Artificial Sequence
  Synthetic
ttcagaaagatgcgaaagtgct

SEQ ID NO: 23074 - DNA, 22 bp, Artificial Sequence
  Synthetic
attcatcgtcgatgatgtggga

SEQ ID NO: 23075 - DNA, 20 bp, Artificial Sequence
  Synthetic
ggacatttgacaccacccag

SEQ ID NO: 23076 - DNA, 24 bp, Artificial Sequence
  Synthetic
aggtaaggaagacagaagatacgg

SEQ ID NO: 23077 - DNA, 25 bp, Artificial Sequence
  Synthetic
gaaagcgtctgagtttagtatggaa

SEQ ID NO: 23078 - DNA, 25 bp, Artificial Sequence
  Synthetic
tctggttctaaatttcaactggtgc

SEQ ID NO: 23079 - DNA, 24 bp, Artificial Sequence
  Synthetic
actgaaactggcattagagcattt

SEQ ID NO: 23080 - DNA, 21 bp, Artificial Sequence
  Synthetic
gtgatgaggtggatcagggga

SEQ ID NO: 23081 - DNA, 24 bp, Artificial Sequence
  Synthetic
gttagtacgcctgaagaaaatggc

SEQ ID NO: 23082 - DNA, 20 bp, Artificial Sequence
  Synthetic
ccgttacctgtagcagcagt

SEQ ID NO: 23083 - DNA, 22 bp, Artificial Sequence
  Synthetic
accgtatcccaatcggaaagcc

SEQ ID NO: 23084 - DNA, 20 bp, Artificial Sequence
  Synthetic
aaagggttcagggggtgcta

SEQ ID NO: 23085 - DNA, 25 bp, Artificial Sequence
  Synthetic
agatcctatatcagacgttacagca

SEQ ID NO: 23086 - DNA, 25 bp, Artificial Sequence
  Synthetic
ttgcagatgttatcacagtacacag

SEQ ID NO: 23087 - DNA, 23 bp, Artificial Sequence
  Synthetic
aactgcaattgtagatgcagtgg

SEQ ID NO: 23088 - DNA, 22 bp, Artificial Sequence
  Synthetic
aacgcttactacaagtaggcca

SEQ ID NO: 23089 - DNA, 22 bp, Artificial Sequence
  Synthetic
atcctctggctcaaacagatga

SEQ ID NO: 23090 - DNA, 25 bp, Artificial Sequence
  Synthetic
cttgcaatttcagaacatttcagca

SEQ ID NO: 23091 - DNA, 24 bp, Artificial Sequence
  Synthetic
atcaatttccactaggtagacggt

SEQ ID NO: 23092 - DNA, 25 bp, Artificial Sequence
  Synthetic
tttgtctgaataaattgctgatgcg

SEQ ID NO: 23093 - DNA, 25 bp, Artificial Sequence
  Synthetic
aacggtctcttagagtcaaacaagg

SEQ ID NO: 23094 - DNA, 23 bp, Artificial Sequence
  Synthetic
agtcattgtcaccagatgctact

SEQ ID NO: 23095 - DNA, 25 bp, Artificial Sequence
  Synthetic
tagtggagttgttgaagatgaagct

SEQ ID NO: 23096 - DNA, 22 bp, Artificial Sequence
  Synthetic
accaactccttcggaagtggga

SEQ ID NO: 23097 - DNA, 25 bp, Artificial Sequence
  Synthetic
ttggatatagaccattaggatccgc

SEQ ID NO: 23098 - DNA, 24 bp, Artificial Sequence
  Synthetic
aactgatgtaggtggtgttagtgg

SEQ ID NO: 23099 - DNA, 23 bp, Artificial Sequence
  Synthetic
ttaaatttcagttttccgcggga

SEQ ID NO: 23100 - DNA, 21 bp, Artificial Sequence
  Synthetic
ctgcgccaaatccagcttttg

SEQ ID NO: 23101 - DNA, 22 bp, Artificial Sequence
  Synthetic
aagtcagttttccttgggtcga

SEQ ID NO: 23102 - DNA, 22 bp, Artificial Sequence
  Synthetic
ggtcagtcatttggtcagcaga

SEQ ID NO: 23103 - DNA, 23 bp, Artificial Sequence
  Synthetic
gaattatactcatgggccaggag

SEQ ID NO: 23104 - DNA, 21 bp, Artificial Sequence
  Synthetic
ttcagtcgctctgcggagagg

SEQ ID NO: 23105 - DNA, 22 bp, Artificial Sequence
  Synthetic
aagaggactgagaagccctgga

SEQ ID NO: 23106 - DNA, 25 bp, Artificial Sequence
  Synthetic
acaggttaaaacatattgtgtgggc

SEQ ID NO: 23107 - DNA, 22 bp, Artificial Sequence
  Synthetic
tggcaactatgtccatgtgcca

SEQ ID NO: 23108 - DNA, 24 bp, Artificial Sequence
  Synthetic
cagaagatggatccaaatagggct

SEQ ID NO: 23109 - DNA, 22 bp, Artificial Sequence
  Synthetic
gtgccgagcacctagaagacag

SEQ ID NO: 23110 - DNA, 23 bp, Artificial Sequence
  Synthetic
ttaccagttgccaagatagagcc

SEQ ID NO: 23111 - DNA, 25 bp, Artificial Sequence
  Synthetic
agatgtaggggatgcctatttttcc

SEQ ID NO: 23112 - DNA, 24 bp, Artificial Sequence
  Synthetic
tctactccagatgagaagttccaa

SEQ ID NO: 23113 - DNA, 24 bp, Artificial Sequence
  Synthetic
tagaggcaacaatccaaaaaagcc

SEQ ID NO: 23114 - DNA, 23 bp, Artificial Sequence
  Synthetic
gcagagaccttctacacagatgg

SEQ ID NO: 23115 - DNA, 23 bp, Artificial Sequence
  Synthetic
attcctggaaaagatagagcccg

SEQ ID NO: 23116 - DNA, 20 bp, Artificial Sequence
  Synthetic
gcacacagacaatggcccca

SEQ ID NO: 23117 - DNA, 25 bp, Artificial Sequence
  Synthetic
tttccaggtctattacagagaaggc

SEQ ID NO: 23118 - DNA, 20 bp, Artificial Sequence
  Synthetic
ccagactgtgcagacatcct

SEQ ID NO: 23119 - DNA, 23 bp, Artificial Sequence
  Synthetic
ggcaaaggtcctggagatattgg

SEQ ID NO: 23120 - DNA, 20 bp, Artificial Sequence
  Synthetic
aggcgccagagagctcatta

SEQ ID NO: 23121 - DNA, 21 bp, Artificial Sequence
  Synthetic
atggagcctggtaggaatcag

SEQ ID NO: 23122 - DNA, 25 bp, Artificial Sequence
  Synthetic
acacctctatgtgtggcaatgaatt

SEQ ID NO: 23123 - DNA, 25 bp, Artificial Sequence
  Synthetic
gagtcatgtgataagcactattggg

SEQ ID NO: 23124 - DNA, 22 bp, Artificial Sequence
  Synthetic
agccaatcaacacaaggcctag

SEQ ID NO: 23125 - DNA, 20 bp, Artificial Sequence
  Synthetic
cctcctagggaaggggagtt

SEQ ID NO: 23126 - DNA, 24 bp, Artificial Sequence
  Synthetic
aatgactctttatcgcctgactgg

SEQ ID NO: 23127 - DNA, 21 bp, Artificial Sequence
  Synthetic
agacttaaggcggcccaactg

SEQ ID NO: 23128 - DNA, 25 bp, Artificial Sequence
  Synthetic
acctaataggagttcctgttacacc

SEQ ID NO: 23129 - DNA, 22 bp, Artificial Sequence
  Synthetic
gtttgggcacaagtcaggattg

SEQ ID NO: 23130 - DNA, 21 bp, Artificial Sequence
  Synthetic
cagtacttggccggtactggg

SEQ ID NO: 23131 - DNA, 23 bp, Artificial Sequence
  Synthetic
aacatcgtcaaactcacctcatg

SEQ ID NO: 23132 - DNA, 25 bp, Artificial Sequence
  Synthetic
acatctggatgctttcctataatgc

SEQ ID NO: 23133 - DNA, 24 bp, Artificial Sequence
  Synthetic
accatacatttgttcagaagggga

SEQ ID NO: 23134 - DNA, 25 bp, Artificial Sequence
  Synthetic
aggaacaattgtttatcaaagaggc

SEQ ID NO: 23135 - DNA, 23 bp, Artificial Sequence
  Synthetic
aagaggtttcttcggagctattg

SEQ ID NO: 23136 - DNA, 24 bp, Artificial Sequence
  Synthetic
taagctcacaaatagagcttgcag

SEQ ID NO: 23137 - DNA, 25 bp, Artificial Sequence
  Synthetic
tgctgcatctttaaatgatgatggc

SEQ ID NO: 23138 - DNA, 20 bp, Artificial Sequence
  Synthetic
aaggaggtcgcactcagcta

SEQ ID NO: 23139 - DNA, 20 bp, Artificial Sequence
  Synthetic
cggaagccatggaggttgct

SEQ ID NO: 23140 - DNA, 25 bp, Artificial Sequence
  Synthetic
tcttgatcgtcttttcttcaaatgc

SEQ ID NO: 23141 - DNA, 24 bp, Artificial Sequence
  Synthetic
aggccattttcatcatgggagatc

SEQ ID NO: 23142 - DNA, 25 bp, Artificial Sequence
  Synthetic
actgaggaatgtgatttagccttac

SEQ ID NO: 23143 - DNA, 20 bp, Artificial Sequence
  Synthetic
agaggaagcagatggagagc

SEQ ID NO: 23144 - DNA, 24 bp, Artificial Sequence
  Synthetic
accttttatgaggaggttacagga

SEQ ID NO: 23145 - DNA, 25 bp, Artificial Sequence
  Synthetic
aaaattgaaggagatacatgggcag

SEQ ID NO: 23146 - DNA, 24 bp, Artificial Sequence
  Synthetic
ggcagggccatctgttatagattt

SEQ ID NO: 23147 - DNA, 23 bp, Artificial Sequence
  Synthetic
tcttcaactacacatcctgaccc

SEQ ID NO: 23148 - DNA, 23 bp, Artificial Sequence
  Synthetic
ctgtttgaacaggttcctacacg

SEQ ID NO: 23149 - DNA, 25 bp, Artificial Sequence
  Synthetic
ctcgtgcatctataactaccagaag

SEQ ID NO: 23150 - DNA, 23 bp, Artificial Sequence
  Synthetic
ttttgcagatgactgtctggatg

SEQ ID NO: 23151 - DNA, 24 bp, Artificial Sequence
  Synthetic
agagacagagaacgcttagtatgg

SEQ ID NO: 23152 - DNA, 22 bp, Artificial Sequence
  Synthetic
tcctccatggggtgaatattgg

SEQ ID NO: 23153 - DNA, 20 bp, Artificial Sequence
  Synthetic
ttttgggcgtaaggagcagc

SEQ ID NO: 23154 - DNA, 22 bp, Artificial Sequence
  Synthetic
tttagcatttgtacccccacca

SEQ ID NO: 23155 - DNA, 25 bp, Artificial Sequence
  Synthetic
aagcgcaaaaggtctaagtaatttc

SEQ ID NO: 23156 - DNA, 25 bp, Artificial Sequence
  Synthetic
ttaacggcgaaatatgaatcagaga

SEQ ID NO: 23157 - DNA, 24 bp, Artificial Sequence
  Synthetic
ccttaccaggttgacactatttgt

SEQ ID NO: 23158 - DNA, 25 bp, Artificial Sequence
  Synthetic
agactttatcagatgaaactgtggc

SEQ ID NO: 23159 - DNA, 20 bp, Artificial Sequence
  Synthetic
aagtcaaatggtgcagtggg

SEQ ID NO: 23160 - DNA, 23 bp, Artificial Sequence
  Synthetic
aattgggacccaccgatttatcc

SEQ ID NO: 23161 - DNA, 20 bp, Artificial Sequence
  Synthetic
acaaccgcagacgacaagcc

SEQ ID NO: 23162 - DNA, 22 bp, Artificial Sequence
  Synthetic
aagttgaaggaacaacatgggc

SEQ ID NO: 23163 - DNA, 25 bp, Artificial Sequence
  Synthetic
agaagaaggaattccagatgttggg

SEQ ID NO: 23164 - DNA, 21 bp, Artificial Sequence
  Synthetic
actcgttctgctgaccttttc

SEQ ID NO: 23165 - DNA, 24 bp, Artificial Sequence
  Synthetic
agtgataaataacaccggcctacc

SEQ ID NO: 23166 - DNA, 25 bp, Artificial Sequence
  Synthetic
tcctgaaagagaacgtttagtttgg

SEQ ID NO: 23167 - DNA, 25 bp, Artificial Sequence
  Synthetic
atgccagacatttcttttgtaagga

SEQ ID NO: 23168 - DNA, 24 bp, Artificial Sequence
  Synthetic
tcctcctcaaggattggaggatac

SEQ ID NO: 23169 - DNA, 20 bp, Artificial Sequence
  Synthetic
aacaaccggttctggtcgtt

SEQ ID NO: 23170 - DNA, 24 bp, Artificial Sequence
  Synthetic
agaagaatcccgctcttagaatga

SEQ ID NO: 23171 - DNA, 25 bp, Artificial Sequence
  Synthetic
agtacagtccattatccaaaggtgt

SEQ ID NO: 23172 - DNA, 24 bp, Artificial Sequence
  Synthetic
aatattgctcctttaatggtggca

SEQ ID NO: 23173 - DNA, 22 bp, Artificial Sequence
  Synthetic
agagcaacagtatcagcagacc

SEQ ID NO: 23174 - DNA, 23 bp, Artificial Sequence
  Synthetic
gaagagcaacagccattctaaga

SEQ ID NO: 23175 - DNA, 23 bp, Artificial Sequence
  Synthetic
tgagacactttcaaaaggatgca

SEQ ID NO: 23176 - DNA, 23 bp, Artificial Sequence
  Synthetic
cagggaatggaaaagttgacgat

SEQ ID NO: 23177 - DNA, 25 bp, Artificial Sequence
  Synthetic
acgttcgacactgttcaaataatca

SEQ ID NO: 23178 - DNA, 23 bp, Artificial Sequence
  Synthetic
agagtctgcagtattgagaggat

SEQ ID NO: 23179 - DNA, 25 bp, Artificial Sequence
  Synthetic
aacacattaactgaaagaggagtgg

SEQ ID NO: 23180 - DNA, 25 bp, Artificial Sequence
  Synthetic
tgaggcaaattctcagagaatcagg

SEQ ID NO: 23181 - DNA, 25 bp, Artificial Sequence
  Synthetic
atcaacaatcttttgtaccgagtcc

SEQ ID NO: 23182 - DNA, 25 bp, Artificial Sequence
  Synthetic
cttgccatttcagaacatagatagc

SEQ ID NO: 23183 - DNA, 20 bp, Artificial Sequence
  Synthetic
caccagaatgcacagggaga

SEQ ID NO: 23184 - DNA, 24 bp, Artificial Sequence
  Synthetic
aactgtacgaacgagtgaaaagac

SEQ ID NO: 23185 - DNA, 20 bp, Artificial Sequence
  Synthetic
acttctgcctcatcacagcc

SEQ ID NO: 23186 - DNA, 24 bp, Artificial Sequence
  Synthetic
tatcgccaagtgagaaagatcatc

SEQ ID NO: 23187 - DNA, 22 bp, Artificial Sequence
  Synthetic
gtgtggttgtacacagtgtgga

SEQ ID NO: 23188 - DNA, 23 bp, Artificial Sequence
  Synthetic
agggtggtggaattgcttaagtg

SEQ ID NO: 23189 - DNA, 23 bp, Artificial Sequence
  Synthetic
accacagtgtctaaaggaatgtg

SEQ ID NO: 23190 - DNA, 22 bp, Artificial Sequence
  Synthetic
acacagatagtaatgcagctgc

SEQ ID NO: 23191 - DNA, 21 bp, Artificial Sequence
  Synthetic
aacatgtgcagcactggaagt

SEQ ID NO: 23192 - DNA, 23 bp, Artificial Sequence
  Synthetic
actgtggaggttgtattcgatgg

SEQ ID NO: 23193 - DNA, 20 bp, Artificial Sequence
  Synthetic
ccccgccgcgaaaacgatac

SEQ ID NO: 23194 - DNA, 23 bp, Artificial Sequence
  Synthetic
tgtgttgtgtgtgtggattagtt

SEQ ID NO: 23195 - DNA, 25 bp, Artificial Sequence
  Synthetic
ttaaactactgcagacatacgtgtg

SEQ ID NO: 23196 - DNA, 23 bp, Artificial Sequence
  Synthetic
ggacatttctcctcccaccaata

SEQ ID NO: 23197 - DNA, 25 bp, Artificial Sequence
  Synthetic
aggctatagaattgcaacctttagg

SEQ ID NO: 23198 - DNA, 21 bp, Artificial Sequence
  Synthetic
ctcctgtttccaaggtggtca

SEQ ID NO: 23199 - DNA, 23 bp, Artificial Sequence
  Synthetic
tatggcagatgtagggtttggag

SEQ ID NO: 23200 - DNA, 23 bp, Artificial Sequence
  Synthetic
attggaatgttggtgtagctcca

SEQ ID NO: 23201 - DNA, 25 bp, Artificial Sequence
  Synthetic
tgtactgccaaatggtattgctaag

SEQ ID NO: 23202 - DNA, 22 bp, Artificial Sequence
  Synthetic
aaatggttcaatgggcgtatga

SEQ ID NO: 23203 - DNA, 24 bp, Artificial Sequence
  Synthetic
aaatgttgtagggaatgtgatggt

SEQ ID NO: 23204 - DNA, 22 bp, Artificial Sequence
  Synthetic
gattcctcaagaagcggcagga

SEQ ID NO: 23205 - DNA, 24 bp, Artificial Sequence
  Synthetic
caagagttgagcgacttaaagcag

SEQ ID NO: 23206 - DNA, 21 bp, Artificial Sequence
  Synthetic
tgtaggtgagcatcccaatgt

SEQ ID NO: 23207 - DNA, 25 bp, Artificial Sequence
  Synthetic
tggggacagattgtttttttatggt

SEQ ID NO: 23208 - DNA, 23 bp, Artificial Sequence
  Synthetic
tcgttagttagcagcgaatctca

SEQ ID NO: 23209 - DNA, 22 bp, Artificial Sequence
  Synthetic
attaatgcaatggactctcgca

SEQ ID NO: 23210 - DNA, 23 bp, Artificial Sequence
  Synthetic
aagcgaccacggaatatctatga

SEQ ID NO: 23211 - DNA, 25 bp, Artificial Sequence
  Synthetic
ttaccctcctattatttgcccacaa

SEQ ID NO: 23212 - DNA, 20 bp, Artificial Sequence
  Synthetic
aagctggcaagaacaacacc

SEQ ID NO: 23213 - DNA, 22 bp, Artificial Sequence
  Synthetic
atggctggatcaagtgagcagg

SEQ ID NO: 23214 - DNA, 24 bp, Artificial Sequence
  Synthetic
tcttcaaatgcatttatcgtcgct

SEQ ID NO: 23215 - DNA, 25 bp, Artificial Sequence
  Synthetic
acctaacaacaaatggaagtaatgc

SEQ ID NO: 23216 - DNA, 25 bp, Artificial Sequence
  Synthetic
aagctatcactagtatctcagggtt

SEQ ID NO: 23217 - DNA, 23 bp, Artificial Sequence
  Synthetic
atatgttccagctaggacaagca

SEQ ID NO: 23218 - DNA, 23 bp, Artificial Sequence
  Synthetic
atcaactaatatctcctcggccc

SEQ ID NO: 23219 - DNA, 22 bp, Artificial Sequence
  Synthetic
gaggaatctccagaagcatcac

SEQ ID NO: 23220 - DNA, 24 bp, Artificial Sequence
  Synthetic
aatcctcatcatggaatctcacca

SEQ ID NO: 23221 - DNA, 25 bp, Artificial Sequence
  Synthetic
atacactagagaacgatgtgcaagt

SEQ ID NO: 23222 - DNA, 23 bp, Artificial Sequence
  Synthetic
gaacagagaaaagcagtacccca

SEQ ID NO: 23223 - DNA, 21 bp, Artificial Sequence
  Synthetic
acaaagttgctcttgctcctc

SEQ ID NO: 23224 - DNA, 24 bp, Artificial Sequence
  Synthetic
aatctctacttcaatctggacgca

SEQ ID NO: 23225 - DNA, 25 bp, Artificial Sequence
  Synthetic
tgtgatagtaaccaatcaggaatcc

SEQ ID NO: 23226 - DNA, 25 bp, Artificial Sequence
  Synthetic
agaatggtatattcctcttcccagc

SEQ ID NO: 23227 - DNA, 25 bp, Artificial Sequence
  Synthetic
agtacaataggtatcaacggaatgc

SEQ ID NO: 23228 - DNA, 22 bp, Artificial Sequence
  Synthetic
aagcataccaatcacggaaagg

SEQ ID NO: 23229 - DNA, 25 bp, Artificial Sequence
  Synthetic
acccaaaaataaggttaatgccagg

SEQ ID NO: 23230 - DNA, 25 bp, Artificial Sequence
  Synthetic
atgagaatgtaatctgcaacacaac

SEQ ID NO: 23231 - DNA, 24 bp, Artificial Sequence
  Synthetic
acttactcaacagcaactgaaaga

SEQ ID NO: 23232 - DNA, 25 bp, Artificial Sequence
  Synthetic
aaacgctgttgattattaccagagc

SEQ ID NO: 23233 - DNA, 25 bp, Artificial Sequence
  Synthetic
tagacgaaacaagatcagcatcttc

SEQ ID NO: 23234 - DNA, 23 bp, Artificial Sequence
  Synthetic
cagtgttgggggattcaattaca

SEQ ID NO: 23235 - DNA, 23 bp, Artificial Sequence
  Synthetic
aagtggacttgaaacacctgacc

SEQ ID NO: 23236 - DNA, 25 bp, Artificial Sequence
  Synthetic
gtctcaaaattttaacaccggtagc

SEQ ID NO: 23237 - DNA, 22 bp, Artificial Sequence
  Synthetic
atttgggttgcaacagtttgga

SEQ ID NO: 23238 - DNA, 21 bp, Artificial Sequence
  Synthetic
tagggcatgccgatttgtttc

SEQ ID NO: 23239 - DNA, 25 bp, Artificial Sequence
  Synthetic
cgtaagcccttagattacaaacgtc

SEQ ID NO: 23240 - DNA, 21 bp, Artificial Sequence
  Synthetic
ccaagtcttggtctgttggtg

SEQ ID NO: 23241 - DNA, 25 bp, Artificial Sequence
  Synthetic
ggatacattctgcttcaatgtacgc

SEQ ID NO: 23242 - DNA, 24 bp, Artificial Sequence
  Synthetic
tgaaacttgtactattgccggtaa

SEQ ID NO: 23243 - DNA, 25 bp, Artificial Sequence
  Synthetic
acttacaatcgccaacaattattcc

SEQ ID NO: 23244 - DNA, 25 bp, Artificial Sequence
  Synthetic
tgattacagggcttttatcagtgtt

SEQ ID NO: 23245 - DNA, 25 bp, Artificial Sequence
  Synthetic
ggtttctactgttaaaattggtggc

SEQ ID NO: 23246 - DNA, 23 bp, Artificial Sequence
  Synthetic
agatgcagagtttgtagaaccag

SEQ ID NO: 23247 - DNA, 25 bp, Artificial Sequence
  Synthetic
ttcaatcagcactttctgttgtttc

SEQ ID NO: 23248 - DNA, 25 bp, Artificial Sequence
  Synthetic
tatgcagttttttaaaatgggccga

SEQ ID NO: 23249 - DNA, 22 bp, Artificial Sequence
  Synthetic
aggcgtttccttatggtacttg

SEQ ID NO: 23250 - DNA, 24 bp, Artificial Sequence
  Synthetic
cttcctcgttcatgacaatgtagc

SEQ ID NO: 23251 - DNA, 25 bp, Artificial Sequence
  Synthetic
aaccagtgtccgtaattaaagttgc

SEQ ID NO: 23252 - DNA, 23 bp, Artificial Sequence
  Synthetic
ataccagctgactacatcttgcc

SEQ ID NO: 23253 - DNA, 24 bp, Artificial Sequence
  Synthetic
agatgctgttacttttgcaacagt

SEQ ID NO: 23254 - DNA, 25 bp, Artificial Sequence
  Synthetic
gctattatagtcagtgtcgaacagc

SEQ ID NO: 23255 - DNA, 25 bp, Artificial Sequence
  Synthetic
gttcttaaatctaagtggtggctgc

SEQ ID NO: 23256 - DNA, 21 bp, Artificial Sequence
  Synthetic
tttggatgttgtgtggaagca

SEQ ID NO: 23257 - DNA, 24 bp, Artificial Sequence
  Synthetic
acacaattgtcaatggtgtgcaac

SEQ ID NO: 23258 - DNA, 24 bp, Artificial Sequence
  Synthetic
aacaactttgtcagttcgtatgct

SEQ ID NO: 23259 - DNA, 20 bp, Artificial Sequence
  Synthetic
ctggtgatgctggccattca

SEQ ID NO: 23260 - DNA, 25 bp, Artificial Sequence
  Synthetic
ttttacactacaagctgcttttggt

SEQ ID NO: 23261 - DNA, 22 bp, Artificial Sequence
  Synthetic
gtgttgaatccaatgcaggtgt

SEQ ID NO: 23262 - DNA, 21 bp, Artificial Sequence
  Synthetic
ttttgctccatggtggttgtg

SEQ ID NO: 23263 - DNA, 20 bp, Artificial Sequence
  Synthetic
tttgcgcaaaatggcacaac

SEQ ID NO: 23264 - DNA, 25 bp, Artificial Sequence
  Synthetic
ctggtgaaggttttaacatcttagc

SEQ ID NO: 23265 - DNA, 25 bp, Artificial Sequence
  Synthetic
ttatgctgctatattgaatggttgc

SEQ ID NO: 23266 - DNA, 23 bp, Artificial Sequence
  Synthetic
taaccctggttttcttactccgt

SEQ ID NO: 23267 - DNA, 25 bp, Artificial Sequence
  Synthetic
gcacttatttgttctcactcattgc

SEQ ID NO: 23268 - DNA, 25 bp, Artificial Sequence
  Synthetic
tatggttgctaatggtttgaatgca

SEQ ID NO: 23269 - DNA, 21 bp, Artificial Sequence
  Synthetic
aacttgtgtgacgaccctgaa

SEQ ID NO: 23270 - DNA, 23 bp, Artificial Sequence
  Synthetic
tgctgcagctatgtacaaagaag

SEQ ID NO: 23271 - DNA, 25 bp, Artificial Sequence
  Synthetic
agatgttacaaaggaaaaccaggaa

SEQ ID NO: 23272 - DNA, 24 bp, Artificial Sequence
  Synthetic
tacagttgaattggaaccaccttg

SEQ ID NO: 23273 - DNA, 22 bp, Artificial Sequence
  Synthetic
gactaatggttctggtagcggt

SEQ ID NO: 23274 - DNA, 20 bp, Artificial Sequence
  Synthetic
ctagtgccgctcgactagag

SEQ ID NO: 23275 - DNA, 25 bp, Artificial Sequence
  Synthetic
ggagatattggttcttactggttgt

SEQ ID NO: 23276 - DNA, 23 bp, Artificial Sequence
  Synthetic
tgatgcctgttatgggtatgact

SEQ ID NO: 23277 - DNA, 21 bp, Artificial Sequence
  Synthetic
agttgctactgctggttacca

SEQ ID NO: 23278 - DNA, 25 bp, Artificial Sequence
  Synthetic
tttcgatgagggttcagaattaaca

SEQ ID NO: 23279 - DNA, 25 bp, Artificial Sequence
  Synthetic
tgtctgaaatccatagtagctacca

SEQ ID NO: 23280 - DNA, 25 bp, Artificial Sequence
  Synthetic
agccactttgtattatcagaatggt

SEQ ID NO: 23281 - DNA, 25 bp, Artificial Sequence
  Synthetic
ttgtctaagcatcctaaacctgagt

SEQ ID NO: 23282 - DNA, 23 bp, Artificial Sequence
  Synthetic
tttgggttccatggacattgatg

SEQ ID NO: 23283 - DNA, 25 bp, Artificial Sequence
  Synthetic
atacggttacttacaaatccactgc

SEQ ID NO: 23284 - DNA, 20 bp, Artificial Sequence
  Synthetic
cgctctgtgcaaaagctgtc

SEQ ID NO: 23285 - DNA, 21 bp, Artificial Sequence
  Synthetic
gcttccagctcctagagttct

SEQ ID NO: 23286 - DNA, 25 bp, Artificial Sequence
  Synthetic
tttaggcttacaaactcagacagtg

SEQ ID NO: 23287 - DNA, 21 bp, Artificial Sequence
  Synthetic
aagactagtggtgacttggct

SEQ ID NO: 23288 - DNA, 25 bp, Artificial Sequence
  Synthetic
tgtacctctacaagttggtttttcc

SEQ ID NO: 23289 - DNA, 23 bp, Artificial Sequence
  Synthetic
acattgccaatgtggtactgttg

SEQ ID NO: 23290 - DNA, 20 bp, Artificial Sequence
  Synthetic
gtcgcactgtgcagagtcat

SEQ ID NO: 23291 - DNA, 21 bp, Artificial Sequence
  Synthetic
tcatgcatttcacactcctgc

SEQ ID NO: 23292 - DNA, 25 bp, Artificial Sequence
  Synthetic
agagaacattgcttttaacgttgtt

SEQ ID NO: 23293 - DNA, 25 bp, Artificial Sequence
  Synthetic
ctgtttgtggttatacagactttgc

SEQ ID NO: 23294 - DNA, 20 bp, Artificial Sequence
  Synthetic
acaagactttttgcctcgca

SEQ ID NO: 23295 - DNA, 25 bp, Artificial Sequence
  Synthetic
ccaaggttcatgaggtcataattga

SEQ ID NO: 23296 - DNA, 22 bp, Artificial Sequence
  Synthetic
tggctctgattatggtgttgca

SEQ ID NO: 23297 - DNA, 25 bp, Artificial Sequence
  Synthetic
aactccactgttatgagtttgtcct

SEQ ID NO: 23298 - DNA, 25 bp, Artificial Sequence
  Synthetic
aaatgtatttgctgttgagagtggt

SEQ ID NO: 23299 - DNA, 20 bp, Artificial Sequence
  Synthetic
ctgcttttgtgggtgcacta

SEQ ID NO: 23300 - DNA, 24 bp, Artificial Sequence
  Synthetic
acgtttattgtgttgtacgttgac

SEQ ID NO: 23301 - DNA, 23 bp, Artificial Sequence
  Synthetic
ggcaccatctactctatcactcc

SEQ ID NO: 23302 - DNA, 23 bp, Artificial Sequence
  Synthetic
agtgtttcagctatcgtcacagc

SEQ ID NO: 23303 - DNA, 20 bp, Artificial Sequence
  Synthetic
agcgtcatacctagcttgcc

SEQ ID NO: 23304 - DNA, 22 bp, Artificial Sequence
  Synthetic
atgttgcattgcagactgatgt

SEQ ID NO: 23305 - DNA, 25 bp, Artificial Sequence
  Synthetic
ctgctttgaatgtattcgtttctca

SEQ ID NO: 23306 - DNA, 25 bp, Artificial Sequence
  Synthetic
tcacatctcgcataatgtttgaacc

SEQ ID NO: 23307 - DNA, 25 bp, Artificial Sequence
  Synthetic
acactgttcaaaaattgcaaactct

SEQ ID NO: 23308 - DNA, 25 bp, Artificial Sequence
  Synthetic
tacagtaatggctctaggtttgttc

SEQ ID NO: 23309 - DNA, 22 bp, Artificial Sequence
  Synthetic
ttttccatacagcttggcactg

SEQ ID NO: 23310 - DNA, 25 bp, Artificial Sequence
  Synthetic
aagctttgtttcacttgccatatgt

SEQ ID NO: 23311 - DNA, 23 bp, Artificial Sequence
  Synthetic
aattgggattctaattgggcctt

SEQ ID NO: 23312 - DNA, 25 bp, Artificial Sequence
  Synthetic
acgagtaaaacacggtgatttttct

SEQ ID NO: 23313 - DNA, 20 bp, Artificial Sequence
  Synthetic
gaaagggcaaacgggtggat

SEQ ID NO: 23314 - DNA, 23 bp, Artificial Sequence
  Synthetic
tttgacaagcctcaggaaaaaga

SEQ ID NO: 23315 - DNA, 21 bp, Artificial Sequence
  Synthetic
ccagagaccttgaccacaact

SEQ ID NO: 23316 - DNA, 21 bp, Artificial Sequence
  Synthetic
aacttcacctgcaactgctga

SEQ ID NO: 23317 - DNA, 22 bp, Artificial Sequence
  Synthetic
actgaacctaggtgaacgctag

SEQ ID NO: 23318 - DNA, 25 bp, Artificial Sequence
  Synthetic
cttttagtatttggcttccgtcctt

SEQ ID NO: 23319 - DNA, 20 bp, Artificial Sequence
  Synthetic
ggaaatccccatgcactgtt

SEQ ID NO: 23320 - DNA, 21 bp, Artificial Sequence
  Synthetic
aatggggaacaggagcagcag

SEQ ID NO: 23321 - DNA, 25 bp, Artificial Sequence
  Synthetic
agaagcaaactatgttaaaccacca

SEQ ID NO: 23322 - DNA, 25 bp, Artificial Sequence
  Synthetic
aggacaatggataaaaaagtgtggg

SEQ ID NO: 23323 - DNA, 25 bp, Artificial Sequence
  Synthetic
agtgctatatgacaacgaggaaaat

SEQ ID NO: 23324 - DNA, 21 bp, Artificial Sequence
  Synthetic
cactatccgtcgagacttgca

SEQ ID NO: 23325 - DNA, 22 bp, Artificial Sequence
  Synthetic
aaatggattgccagtgtggtgt

SEQ ID NO: 23326 - DNA, 22 bp, Artificial Sequence
  Synthetic
gcttccattgttcccctggagg

SEQ ID NO: 23327 - DNA, 22 bp, Artificial Sequence
  Synthetic
cagccgcagaggttattattgg

SEQ ID NO: 23328 - DNA, 22 bp, Artificial Sequence
  Synthetic
cgcctttgaggaggaggtaacc

SEQ ID NO: 23329 - DNA, 21 bp, Artificial Sequence
  Synthetic
atctcctgccttggaaactgt

SEQ ID NO: 23330 - DNA, 25 bp, Artificial Sequence
  Synthetic
tccggtaaattatatttgccaccct

SEQ ID NO: 23331 - DNA, 22 bp, Artificial Sequence
  Synthetic
aatcctgagtctgaacgtttgg

SEQ ID NO: 23332 - DNA, 25 bp, Artificial Sequence
  Synthetic
tggtgacaagattccagaacaaaat

SEQ ID NO: 23333 - DNA, 22 bp, Artificial Sequence
  Synthetic
ccatctattggggatgcgtaca

SEQ ID NO: 23334 - DNA, 21 bp, Artificial Sequence
  Synthetic
ggcagtttggcttcgaggtgc

SEQ ID NO: 23335 - DNA, 19 bp, Artificial Sequence
  Synthetic
tcctgtcacaccccaccgt

SEQ ID NO: 23336 - DNA, 21 bp, Artificial Sequence
  Synthetic
agcatgtgccccaatcttgga

SEQ ID NO: 23337 - DNA, 21 bp, Artificial Sequence
  Synthetic
tccgactacctcccggagatg

SEQ ID NO: 23338 - DNA, 19 bp, Artificial Sequence
  Synthetic
ccagagacggtgttgcgcc

SEQ ID NO: 23339 - DNA, 18 bp, Artificial Sequence
  Synthetic
tgggtgcaaggctcgtgc

SEQ ID NO: 23340 - DNA, 20 bp, Artificial Sequence
  Synthetic
acacccagttatgcagtgcc

SEQ ID NO: 23341 - DNA, 21 bp, Artificial Sequence
  Synthetic
gtaggtgcctccagagcccct

SEQ ID NO: 23342 - DNA, 19 bp, Artificial Sequence
  Synthetic
ccggtatcgggccagaggt

SEQ ID NO: 23343 - DNA, 21 bp, Artificial Sequence
  Synthetic
tccgtagaagggtcctcgtcc

SEQ ID NO: 23344 - DNA, 19 bp, Artificial Sequence
  Synthetic
tgggccctcaagtccagcc

SEQ ID NO: 23345 - DNA, 20 bp, Artificial Sequence
  Synthetic
gggccaagaacccagacgag

SEQ ID NO: 23346 - DNA, 22 bp, Artificial Sequence
  Synthetic
aagccagacagcagccaattgt

SEQ ID NO: 23347 - DNA, 19 bp, Artificial Sequence
  Synthetic
accggtcgcccagtcctac

SEQ ID NO: 23348 - DNA, 20 bp, Artificial Sequence
  Synthetic
cccgtcttactgcccagcct

SEQ ID NO: 23349 - DNA, 21 bp, Artificial Sequence
  Synthetic
cgagttacgctccttggaggg

SEQ ID NO: 23350 - DNA, 19 bp, Artificial Sequence
  Synthetic
tgaccctcgcgccccatct

SEQ ID NO: 23351 - DNA, 22 bp, Artificial Sequence
  Synthetic
cacaaagctgtgtgacggtccc

SEQ ID NO: 23352 - DNA, 19 bp, Artificial Sequence
  Synthetic
cggaagccctcgtttcggc

SEQ ID NO: 23353 - DNA, 20 bp, Artificial Sequence
  Synthetic
gtggattcgggggaagctgg

SEQ ID NO: 23354 - DNA, 18 bp, Artificial Sequence
  Synthetic
tcttgagctggcgcgggt

SEQ ID NO: 23355 - DNA, 20 bp, Artificial Sequence
  Synthetic
gccagagccaacctcagctc

SEQ ID NO: 23356 - DNA, 19 bp, Artificial Sequence
  Synthetic
gcaccaccatcgtccacga

SEQ ID NO: 23357 - DNA, 20 bp, Artificial Sequence
  Synthetic
gaccggacggccacgttgtg

SEQ ID NO: 23358 - DNA, 21 bp, Artificial Sequence
  Synthetic
cgtcgtccaggaccaagggga

SEQ ID NO: 23359 - DNA, 20 bp, Artificial Sequence
  Synthetic
ccgaagggaggtgatgggga

SEQ ID NO: 23360 - DNA, 22 bp, Artificial Sequence
  Synthetic
gagggggaatcgtcggttaggg

SEQ ID NO: 23361 - DNA, 22 bp, Artificial Sequence
  Synthetic
aacgctcttttccttcaccgct

SEQ ID NO: 23362 - DNA, 19 bp, Artificial Sequence
  Synthetic
gtggccaggcccaacgact

SEQ ID NO: 23363 - DNA, 22 bp, Artificial Sequence
  Synthetic
agaaggggctgtggacataggc

SEQ ID NO: 23364 - DNA, 19 bp, Artificial Sequence
  Synthetic
gacacgccctggtcggact

SEQ ID NO: 23365 - DNA, 19 bp, Artificial Sequence
  Synthetic
ccggcagccccttcatcct

SEQ ID NO: 23366 - DNA, 19 bp, Artificial Sequence
  Synthetic
cgctgcctggtgaatgcgc

SEQ ID NO: 23367 - DNA, 19 bp, Artificial Sequence
  Synthetic
gctcggtagcagcggactc

SEQ ID NO: 23368 - DNA, 21 bp, Artificial Sequence
  Synthetic
cctgccattcccagccactcc

SEQ ID NO: 23369 - DNA, 20 bp, Artificial Sequence
  Synthetic
gagggccagatgcaggagct

SEQ ID NO: 23370 - DNA, 19 bp, Artificial Sequence
  Synthetic
ttcagctgctggacacgca

SEQ ID NO: 23371 - DNA, 19 bp, Artificial Sequence
  Synthetic
ggcgaggcgttgtggcaca

SEQ ID NO: 23372 - DNA, 22 bp, Artificial Sequence
  Synthetic
gccaggtggattttgagctccg

SEQ ID NO: 23373 - DNA, 22 bp, Artificial Sequence
  Synthetic
ggcatagaggcctaggtccaca

SEQ ID NO: 23374 - DNA, 22 bp, Artificial Sequence
  Synthetic
agcccaggaccagttctactcc

SEQ ID NO: 23375 - DNA, 24 bp, Artificial Sequence
  Synthetic
agatggggatatttaaaaggggca

SEQ ID NO: 23376 - DNA, 19 bp, Artificial Sequence
  Synthetic
acctacgcccttgccccct

SEQ ID NO: 23377 - DNA, 21 bp, Artificial Sequence
  Synthetic
ctcccagtcagatgtccgtgc

SEQ ID NO: 23378 - DNA, 19 bp, Artificial Sequence
  Synthetic
gccaggatgccaccgaggt

SEQ ID NO: 23379 - DNA, 20 bp, Artificial Sequence
  Synthetic
acccggtccttgtgactgct

SEQ ID NO: 23380 - DNA, 22 bp, Artificial Sequence
  Synthetic
atgacccaacgaaacagtcccg

SEQ ID NO: 23381 - DNA, 19 bp, Artificial Sequence
  Synthetic
catggtcgggctcgggaga

SEQ ID NO: 23382 - DNA, 24 bp, Artificial Sequence
  Synthetic
ggggcattaactaagcttatgagc

SEQ ID NO: 23383 - DNA, 22 bp, Artificial Sequence
  Synthetic
ccagtttgccccatcgtttccc

SEQ ID NO: 23384 - DNA, 20 bp, Artificial Sequence
  Synthetic
cgaggatgaagcaacccccg

SEQ ID NO: 23385 - DNA, 20 bp, Artificial Sequence
  Synthetic
gctccgccacgtattccccg

SEQ ID NO: 23386 - DNA, 22 bp, Artificial Sequence
  Synthetic
tctctcaggacctcaaaggcgg

SEQ ID NO: 23387 - DNA, 20 bp, Artificial Sequence
  Synthetic
atgtggcggctcttgaaccc

SEQ ID NO: 23388 - DNA, 19 bp, Artificial Sequence
  Synthetic
cccggccatctttgccgga

SEQ ID NO: 23389 - DNA, 20 bp, Artificial Sequence
  Synthetic
ggggacacggagcctgacca

SEQ ID NO: 23390 - DNA, 22 bp, Artificial Sequence
  Synthetic
gatctcgtcccagttttgcggc

SEQ ID NO: 23391 - DNA, 19 bp, Artificial Sequence
  Synthetic
gcccccggccatactccaa

SEQ ID NO: 23392 - DNA, 19 bp, Artificial Sequence
  Synthetic
gcccatcatcccccgagca

SEQ ID NO: 23393 - DNA, 22 bp, Artificial Sequence
  Synthetic
catcgcaatcatgaagtcctcc

SEQ ID NO: 23394 - DNA, 20 bp, Artificial Sequence
  Synthetic
ggaccacgggtgtcaccagc

SEQ ID NO: 23395 - DNA, 22 bp, Artificial Sequence
  Synthetic
aatcccatgtcagggttggggt

SEQ ID NO: 23396 - DNA, 18 bp, Artificial Sequence
  Synthetic
cccgtgccgcagcgtaaa

SEQ ID NO: 23397 - DNA, 22 bp, Artificial Sequence
  Synthetic
gtgacgatgccatcaaccagct

SEQ ID NO: 23398 - DNA, 19 bp, Artificial Sequence
  Synthetic
aaacaccccccccactggc

SEQ ID NO: 23399 - DNA, 21 bp, Artificial Sequence
  Synthetic
ggggcacctaaagacccccct

SEQ ID NO: 23400 - DNA, 22 bp, Artificial Sequence
  Synthetic
tgtcttccacaccatccacagc

SEQ ID NO: 23401 - DNA, 19 bp, Artificial Sequence
  Synthetic
cggagccccaagccacctt

SEQ ID NO: 23402 - DNA, 20 bp, Artificial Sequence
  Synthetic
tcttcatacaggcccgcaat

SEQ ID NO: 23403 - DNA, 20 bp, Artificial Sequence
  Synthetic
cctggtccagcgttgcctcc

SEQ ID NO: 23404 - DNA, 22 bp, Artificial Sequence
  Synthetic
ttggtatagggcaaggttgggc

SEQ ID NO: 23405 - DNA, 19 bp, Artificial Sequence
  Synthetic
ccttggggtagccgacggt

SEQ ID NO: 23406 - DNA, 22 bp, Artificial Sequence
  Synthetic
tgggcagcatgcttggataact

SEQ ID NO: 23407 - DNA, 19 bp, Artificial Sequence
  Synthetic
ccgaaagggccaggtcgga

SEQ ID NO: 23408 - DNA, 21 bp, Artificial Sequence
  Synthetic
atttccgtcagccagggtgac

SEQ ID NO: 23409 - DNA, 20 bp, Artificial Sequence
  Synthetic
tcacctggatcccctcaccg

SEQ ID NO: 23410 - DNA, 22 bp, Artificial Sequence
  Synthetic
ggatcgattggaaaagggccca

SEQ ID NO: 23411 - DNA, 19 bp, Artificial Sequence
  Synthetic
gccagcaggtaaggcaggc

SEQ ID NO: 23412 - DNA, 22 bp, Artificial Sequence
  Synthetic
ctagattcagcgatcccccggt

SEQ ID NO: 23413 - DNA, 19 bp, Artificial Sequence
  Synthetic
gagcttgcggctgagctcc

SEQ ID NO: 23414 - DNA, 20 bp, Artificial Sequence
  Synthetic
ctccagggagatgggggcca

SEQ ID NO: 23415 - DNA, 22 bp, Artificial Sequence
  Synthetic
cagctgctgcttgtcgaggatg

SEQ ID NO: 23416 - DNA, 22 bp, Artificial Sequence
  Synthetic
acacggcgtacatgtcgatggg

SEQ ID NO: 23417 - DNA, 20 bp, Artificial Sequence
  Synthetic
cccctgtcgaccagaggacg

SEQ ID NO: 23418 - DNA, 19 bp, Artificial Sequence
  Synthetic
gcaggcacagggtctcggt

SEQ ID NO: 23419 - DNA, 20 bp, Artificial Sequence
  Synthetic
ccagcagggcacagaggtga

SEQ ID NO: 23420 - DNA, 22 bp, Artificial Sequence
  Synthetic
ttccttcagcgtctatgcccag

SEQ ID NO: 23421 - DNA, 20 bp, Artificial Sequence
  Synthetic
cgggcctctggaccctcaca

SEQ ID NO: 23422 - DNA, 20 bp, Artificial Sequence
  Synthetic
agatgtagccgcacggaccc

SEQ ID NO: 23423 - DNA, 19 bp, Artificial Sequence
  Synthetic
tgagccggcagaggaccag

SEQ ID NO: 23424 - DNA, 20 bp, Artificial Sequence
  Synthetic
cgggtgaggcggctaagagg

SEQ ID NO: 23425 - DNA, 25 bp, Artificial Sequence
  Synthetic
ttcgagtatccttctttgatgttcg

SEQ ID NO: 23426 - DNA, 24 bp, Artificial Sequence
  Synthetic
cttagtgaagagtctttgtcacca

SEQ ID NO: 23427 - DNA, 20 bp, Artificial Sequence
  Synthetic
cccgcgattggaagctgtat

SEQ ID NO: 23428 - DNA, 25 bp, Artificial Sequence
  Synthetic
ttcctttaagttcggtgattatcca

SEQ ID NO: 23429 - DNA, 21 bp, Artificial Sequence
  Synthetic
tgtcccccaaggaagagctac

SEQ ID NO: 23430 - DNA, 25 bp, Artificial Sequence
  Synthetic
ttccacttctcttagttctcaaagg

SEQ ID NO: 23431 - DNA, 20 bp, Artificial Sequence
  Synthetic
tgcaagcaggcccatagatg

SEQ ID NO: 23432 - DNA, 25 bp, Artificial Sequence
  Synthetic
acacctttagacagagttcagagag

SEQ ID NO: 23433 - DNA, 22 bp, Artificial Sequence
  Synthetic
cagaacggttgcttatggttgg

SEQ ID NO: 23434 - DNA, 25 bp, Artificial Sequence
  Synthetic
tgagtcttttcaacaagacagagct

SEQ ID NO: 23435 - DNA, 24 bp, Artificial Sequence
  Synthetic
gatgttattccagcagaaaagcct

SEQ ID NO: 23436 - DNA, 25 bp, Artificial Sequence
  Synthetic
ctgaagccatttgcacttatcttct

SEQ ID NO: 23437 - DNA, 21 bp, Artificial Sequence
  Synthetic
ttcaaccgacactgttgacac

SEQ ID NO: 23438 - DNA, 20 bp, Artificial Sequence
  Synthetic
gctgagggagcaattgagct

SEQ ID NO: 23439 - DNA, 23 bp, Artificial Sequence
  Synthetic
ccttgtactgtggggtattcatc

SEQ ID NO: 23440 - DNA, 20 bp, Artificial Sequence
  Synthetic
ttcgcactgagtagaggctt

SEQ ID NO: 23441 - DNA, 20 bp, Artificial Sequence
  Synthetic
ttgaagggggatggactgga

SEQ ID NO: 23442 - DNA, 25 bp, Artificial Sequence
  Synthetic
ctatcagattctggcgatctactca

SEQ ID NO: 23443 - DNA, 23 bp, Artificial Sequence
  Synthetic
aggtggttatttgatcgttggga

SEQ ID NO: 23444 - DNA, 22 bp, Artificial Sequence
  Synthetic
atggactctgtagtagctgtgc

SEQ ID NO: 23445 - DNA, 20 bp, Artificial Sequence
  Synthetic
attgtgcagacactgtgggt

SEQ ID NO: 23446 - DNA, 20 bp, Artificial Sequence
  Synthetic
gaggcagacttcgccatgag

SEQ ID NO: 23447 - DNA, 21 bp, Artificial Sequence
  Synthetic
aaactcccgcgaactgttttg

SEQ ID NO: 23448 - DNA, 21 bp, Artificial Sequence
  Synthetic
ctcagggaactaagggcttgg

SEQ ID NO: 23449 - DNA, 24 bp, Artificial Sequence
  Synthetic
aacgtaggcaaaagtagagaaact

SEQ ID NO: 23450 - DNA, 25 bp, Artificial Sequence
  Synthetic
ttgatgaagctaccattgcatatca

SEQ ID NO: 23451 - DNA, 23 bp, Artificial Sequence
  Synthetic
aaaaggctttggacacagttaga

SEQ ID NO: 23452 - DNA, 21 bp, Artificial Sequence
  Synthetic
taccaacctgtacctccgttg

SEQ ID NO: 23453 - DNA, 20 bp, Artificial Sequence
  Synthetic
cgccaacaacatcgcgactc

SEQ ID NO: 23454 - DNA, 21 bp, Artificial Sequence
  Synthetic
gacaggcgaaggggaagggga

SEQ ID NO: 23455 - DNA, 22 bp, Artificial Sequence
  Synthetic
agtactacgtggtcatgggtag

SEQ ID NO: 23456 - DNA, 23 bp, Artificial Sequence
  Synthetic
cgtactaaacgtgcctctgttac

SEQ ID NO: 23457 - DNA, 21 bp, Artificial Sequence
  Synthetic
agttcgccctggggtgatacc

SEQ ID NO: 23458 - DNA, 22 bp, Artificial Sequence
  Synthetic
ggctcgtctgccattttagagg

SEQ ID NO: 23459 - DNA, 23 bp, Artificial Sequence
  Synthetic
acagaaacacctcagggatatgt

SEQ ID NO: 23460 - DNA, 20 bp, Artificial Sequence
  Synthetic
acctgatggtttggaggtgg

SEQ ID NO: 23461 - DNA, 25 bp, Artificial Sequence
  Synthetic
gtgggtcatccatattatgatgtcc

SEQ ID NO: 23462 - DNA, 25 bp, Artificial Sequence
  Synthetic
ggttagagacacagaaaactctagc

SEQ ID NO: 23463 - DNA, 25 bp, Artificial Sequence
  Synthetic
gtgatcaacaacaacgaacaatagc

SEQ ID NO: 23464 - DNA, 21 bp, Artificial Sequence
  Synthetic
cttctgtatgcctcttgggga

SEQ ID NO: 23465 - DNA, 20 bp, Artificial Sequence
  Synthetic
cctgagctcacctatgtccg

SEQ ID NO: 23466 - DNA, 24 bp, Artificial Sequence
  Synthetic
ggagatcccaaaagattttcaacg

SEQ ID NO: 23467 - DNA, 21 bp, Artificial Sequence
  Synthetic
agtctgctcctaagcctgaaa

SEQ ID NO: 23468 - DNA, 24 bp, Artificial Sequence
  Synthetic
cttccctgaaggttgagacaattt

SEQ ID NO: 23469 - DNA, 23 bp, Artificial Sequence
  Synthetic
aaatccatctacgtgcatttcct

SEQ ID NO: 23470 - DNA, 24 bp, Artificial Sequence
  Synthetic
aacggtttcaataaaaagctgtgc

SEQ ID NO: 23471 - DNA, 20 bp, Artificial Sequence
  Synthetic
gtacagctcacagttggcgt

SEQ ID NO: 23472 - DNA, 23 bp, Artificial Sequence
  Synthetic
caaggcagcgtggaattatacaa

SEQ ID NO: 23473 - DNA, 22 bp, Artificial Sequence
  Synthetic
gatctttatgctctgggggttg

SEQ ID NO: 23474 - DNA, 25 bp, Artificial Sequence
  Synthetic
tctgtttctgtctataaccgaagtc

SEQ ID NO: 23475 - DNA, 20 bp, Artificial Sequence
  Synthetic
gctgttgccgagggaagaaa

SEQ ID NO: 23476 - DNA, 21 bp, Artificial Sequence
  Synthetic
ttgcctgaatgagagtggact

SEQ ID NO: 23477 - DNA, 23 bp, Artificial Sequence
  Synthetic
tcaaacagcatgatgtccgatag

SEQ ID NO: 23478 - DNA, 24 bp, Artificial Sequence
  Synthetic
ataccctgtcagaaatacacgagc

SEQ ID NO: 23479 - DNA, 20 bp, Artificial Sequence
  Synthetic
gcagactttctgggggagga

SEQ ID NO: 23480 - DNA, 23 bp, Artificial Sequence
  Synthetic
tgatgagttgcgtaattggatgc

SEQ ID NO: 23481 - DNA, 20 bp, Artificial Sequence
  Synthetic
tgcttgcgaaaggtgtgtac

SEQ ID NO: 23482 - DNA, 20 bp, Artificial Sequence
  Synthetic
aaaggagaacctcgagcctt

SEQ ID NO: 23483 - DNA, 21 bp, Artificial Sequence
  Synthetic
ttagctcccaggttacgtcat

SEQ ID NO: 23484 - DNA, 25 bp, Artificial Sequence
  Synthetic
tatcgatgtttctcgcttaacagaa

SEQ ID NO: 23485 - DNA, 22 bp, Artificial Sequence
  Synthetic
ccgctttcctgtgtgtaatcat

SEQ ID NO: 23486 - DNA, 25 bp, Artificial Sequence
  Synthetic
gatcttcagttacaacttgacagct

SEQ ID NO: 23487 - DNA, 22 bp, Artificial Sequence
  Synthetic
aacgacctcggtacaaaaaccc

SEQ ID NO: 23488 - DNA, 21 bp, Artificial Sequence
  Synthetic
gcaaaacatctccttcctgca

SEQ ID NO: 23489 - DNA, 20 bp, Artificial Sequence
  Synthetic
gaagctgacttcgccgatct

SEQ ID NO: 23490 - DNA, 21 bp, Artificial Sequence
  Synthetic
cgtatccttgccggtattcac

SEQ ID NO: 23491 - DNA, 22 bp, Artificial Sequence
  Synthetic
tgcacaagctttactgaacact

SEQ ID NO: 23492 - DNA, 21 bp, Artificial Sequence
  Synthetic
cactgttcgcggttacaaacc

SEQ ID NO: 23493 - DNA, 20 bp, Artificial Sequence
  Synthetic
tctagggatttggcctccac

SEQ ID NO: 23494 - DNA, 21 bp, Artificial Sequence
  Synthetic
aggtttagggcttcttcctgc

SEQ ID NO: 23495 - DNA, 23 bp, Artificial Sequence
  Synthetic
caagtagcgaaaaatccaacagc

SEQ ID NO: 23496 - DNA, 20 bp, Artificial Sequence
  Synthetic
ctgctcagctcttgcggtta

SEQ ID NO: 23497 - DNA, 24 bp, Artificial Sequence
  Synthetic
tttgtcacgaatatagccactgat

SEQ ID NO: 23498 - DNA, 24 bp, Artificial Sequence
  Synthetic
agatcctctaaatttgaacctccg

SEQ ID NO: 23499 - DNA, 23 bp, Artificial Sequence
  Synthetic
tccagacatagcaacaatgacag

SEQ ID NO: 23500 - DNA, 25 bp, Artificial Sequence
  Synthetic
tgatggttacttcctcaaaacaaga

SEQ ID NO: 23501 - DNA, 20 bp, Artificial Sequence
  Synthetic
tcagaaccctgacggattgt

SEQ ID NO: 23502 - DNA, 20 bp, Artificial Sequence
  Synthetic
ggctgcatcgtctcgagaac

SEQ ID NO: 23503 - DNA, 25 bp, Artificial Sequence
  Synthetic
tctccagcagcaaaaactaaaattc

SEQ ID NO: 23504 - DNA, 24 bp, Artificial Sequence
  Synthetic
tgtacggaagaagaattgaggtct

SEQ ID NO: 23505 - DNA, 20 bp, Artificial Sequence
  Synthetic
caacgttctctcctgcacga

SEQ ID NO: 23506 - DNA, 23 bp, Artificial Sequence
  Synthetic
caagtagtcattgctatgctcga

SEQ ID NO: 23507 - DNA, 20 bp, Artificial Sequence
  Synthetic
agccgataatgctcgctcac

SEQ ID NO: 23508 - DNA, 23 bp, Artificial Sequence
  Synthetic
gtccttcctgtttagggaaacga

SEQ ID NO: 23509 - DNA, 23 bp, Artificial Sequence
  Synthetic
cattctgtggcttctgcattaga

SEQ ID NO: 23510 - DNA, 24 bp, Artificial Sequence
  Synthetic
tacgatccaaattgagaaccttgc

SEQ ID NO: 23511 - DNA, 24 bp, Artificial Sequence
  Synthetic
tcttactagctccttgtcgagaac

SEQ ID NO: 23512 - DNA, 20 bp, Artificial Sequence
  Synthetic
aatgccgctcgagtcaatgt

SEQ ID NO: 23513 - DNA, 20 bp, Artificial Sequence
  Synthetic
cgacaacccacgatcttgct

SEQ ID NO: 23514 - DNA, 20 bp, Artificial Sequence
  Synthetic
tcgctcccactaatgcaact

SEQ ID NO: 23515 - DNA, 24 bp, Artificial Sequence
  Synthetic
aaacagtgaggacgacaaagtaaa

SEQ ID NO: 23516 - DNA, 24 bp, Artificial Sequence
  Synthetic
gcaatcgctaaaacaatcgattgc

SEQ ID NO: 23517 - DNA, 25 bp, Artificial Sequence
  Synthetic
gtaggtaaaacctcgtttggtcaac

SEQ ID NO: 23518 - DNA, 20 bp, Artificial Sequence
  Synthetic
caggctgcacaccatcacta

SEQ ID NO: 23519 - DNA, 23 bp, Artificial Sequence
  Synthetic
ggaactgaccctataaggaatgc

SEQ ID NO: 23520 - DNA, 23 bp, Artificial Sequence
  Synthetic
gacaaccatttttgctttgctgt

SEQ ID NO: 23521 - DNA, 24 bp, Artificial Sequence
  Synthetic
cgatcaaatcgcaaacaaacactt

SEQ ID NO: 23522 - DNA, 22 bp, Artificial Sequence
  Synthetic
gcgaacgtttacaaatggctcc

SEQ ID NO: 23523 - DNA, 25 bp, Artificial Sequence
  Synthetic
atctgtgcagcttaaaacctaatgt

SEQ ID NO: 23524 - DNA, 20 bp, Artificial Sequence
  Synthetic
ggcttctgtcaccttgctca

SEQ ID NO: 23525 - DNA, 20 bp, Artificial Sequence
  Synthetic
ccgcacaagaaagccctctt

SEQ ID NO: 23526 - DNA, 25 bp, Artificial Sequence
  Synthetic
ctgtcaattctacattatgtgcagc

SEQ ID NO: 23527 - DNA, 24 bp, Artificial Sequence
  Synthetic
gaagctggttctacaacagaaact

SEQ ID NO: 23528 - DNA, 22 bp, Artificial Sequence
  Synthetic
gctcaaagtccaaaaaaacgca

SEQ ID NO: 23529 - DNA, 20 bp, Artificial Sequence
  Synthetic
gcctgaccccagaaaccatt

SEQ ID NO: 23530 - DNA, 23 bp, Artificial Sequence
  Synthetic
tcgtttccttttccaggttcatt

SEQ ID NO: 23531 - DNA, 25 bp, Artificial Sequence
  Synthetic
ttaggtcctgtagctttagactcat

SEQ ID NO: 23532 - DNA, 20 bp, Artificial Sequence
  Synthetic
aaggcactattcgttgcacc

SEQ ID NO: 23533 - DNA, 21 bp, Artificial Sequence
  Synthetic
aatcacaatgcgctcccattt

SEQ ID NO: 23534 - DNA, 24 bp, Artificial Sequence
  Synthetic
agaagcaaggatgaggttttctgt

SEQ ID NO: 23535 - DNA, 20 bp, Artificial Sequence
  Synthetic
gcccctaaaacccgacaaag

SEQ ID NO: 23536 - DNA, 22 bp, Artificial Sequence
  Synthetic
aaaagcatctaggagctcccca

SEQ ID NO: 23537 - DNA, 20 bp, Artificial Sequence
  Synthetic
cacaggagcaaccacgaaga

SEQ ID NO: 23538 - DNA, 25 bp, Artificial Sequence
  Synthetic
acctctctgtaagcaaatactgaca

SEQ ID NO: 23539 - DNA, 20 bp, Artificial Sequence
  Synthetic
cgaagcggtgaatgcatgaa

SEQ ID NO: 23540 - DNA, 25 bp, Artificial Sequence
  Synthetic
actggaaaagctacaatggattgta

SEQ ID NO: 23541 - DNA, 21 bp, Artificial Sequence
  Synthetic
tctgccatcaaagcatttcga

SEQ ID NO: 23542 - DNA, 20 bp, Artificial Sequence
  Synthetic
aatttggcggctggtaatcc

SEQ ID NO: 23543 - DNA, 20 bp, Artificial Sequence
  Synthetic
ttccgaccgagcaatctcag

SEQ ID NO: 23544 - DNA, 25 bp, Artificial Sequence
  Synthetic
caacacttttttaaggcatcttcca

SEQ ID NO: 23545 - DNA, 22 bp, Artificial Sequence
  Synthetic
ccaaagcgttcatatctcggac

SEQ ID NO: 23546 - DNA, 20 bp, Artificial Sequence
  Synthetic
aagcaaccttgacgggcatt

SEQ ID NO: 23547 - DNA, 21 bp, Artificial Sequence
  Synthetic
aaaccggcgtatttcttcctg

SEQ ID NO: 23548 - DNA, 21 bp, Artificial Sequence
  Synthetic
agaccctcttacgctggttaa

SEQ ID NO: 23549 - DNA, 23 bp, Artificial Sequence
  Synthetic
tctttgtcatcgatttggtcacg

SEQ ID NO: 23550 - DNA, 22 bp, Artificial Sequence
  Synthetic
cgtccactaccaagacctagat

SEQ ID NO: 23551 - DNA, 23 bp, Artificial Sequence
  Synthetic
tagctctgcagattttgtagcac

SEQ ID NO: 23552 - DNA, 22 bp, Artificial Sequence
  Synthetic
agctaaaccaacccgaagaatc

SEQ ID NO: 23553 - DNA, 25 bp, Artificial Sequence
  Synthetic
tctcaaaatccctttaaagcagagc

SEQ ID NO: 23554 - DNA, 25 bp, Artificial Sequence
  Synthetic
atctggaaattcaagaaagtcgtgg

SEQ ID NO: 23555 - DNA, 21 bp, Artificial Sequence
  Synthetic
ctgaaggaatcgctcaaggac

SEQ ID NO: 23556 - DNA, 20 bp, Artificial Sequence
  Synthetic
tggaggggccattccgtaat

SEQ ID NO: 23557 - DNA, 20 bp, Artificial Sequence
  Synthetic
aacctgggagacaagatgca

SEQ ID NO: 23558 - DNA, 22 bp, Artificial Sequence
  Synthetic
caccctaatatagttccgctgc

SEQ ID NO: 23559 - DNA, 23 bp, Artificial Sequence
  Synthetic
cagatgcttttacgacttgcaac

SEQ ID NO: 23560 - DNA, 20 bp, Artificial Sequence
  Synthetic
aagttcccatgatcgcctca

SEQ ID NO: 23561 - DNA, 20 bp, Artificial Sequence
  Synthetic
gagcttgtcccaattgctcc

SEQ ID NO: 23562 - DNA, 24 bp, Artificial Sequence
  Synthetic
tatcagcgatgcagtttctacagc

SEQ ID NO: 23563 - DNA, 20 bp, Artificial Sequence
  Synthetic
tgttccccgtacaagcaagt

SEQ ID NO: 23564 - DNA, 24 bp, Artificial Sequence
  Synthetic
ctgctcagctgttaaaaagtcaaa

SEQ ID NO: 23565 - DNA, 20 bp, Artificial Sequence
  Synthetic
ccccaggcaaagcaaaaagc

SEQ ID NO: 23566 - DNA, 22 bp, Artificial Sequence
  Synthetic
ggtaactgttgtattcgcacgg

SEQ ID NO: 23567 - DNA, 23 bp, Artificial Sequence
  Synthetic
gatcctaacgtgtctcctattgc

SEQ ID NO: 23568 - DNA, 24 bp, Artificial Sequence
  Synthetic
ttttcctgtgttttttcgatcagc

SEQ ID NO: 23569 - DNA, 22 bp, Artificial Sequence
  Synthetic
gggagttggagaaatcatggga

SEQ ID NO: 23570 - DNA, 22 bp, Artificial Sequence
  Synthetic
ttcgagcccttttgaagagtga

SEQ ID NO: 23571 - DNA, 22 bp, Artificial Sequence
  Synthetic
tcagagcctgtggatagtcttg

SEQ ID NO: 23572 - DNA, 21 bp, Artificial Sequence
  Synthetic
agggaaatcagaaaatcccgc

SEQ ID NO: 23573 - DNA, 25 bp, Artificial Sequence
  Synthetic
agcgtacatccatgatttattgtgt

SEQ ID NO: 23574 - DNA, 20 bp, Artificial Sequence
  Synthetic
cgcgctccgttaagatgatt

SEQ ID NO: 23575 - DNA, 22 bp, Artificial Sequence
  Synthetic
ccttcggcaacaaaaatcgttg

SEQ ID NO: 23576 - DNA, 21 bp, Artificial Sequence
  Synthetic
ttaacttcaacaagcgctgca

SEQ ID NO: 23577 - DNA, 23 bp, Artificial Sequence
  Synthetic
caggacgcaccggagataaaatt

SEQ ID NO: 23578 - DNA, 20 bp, Artificial Sequence
  Synthetic
gtagtgccagctcgggataa

SEQ ID NO: 23579 - DNA, 20 bp, Artificial Sequence
  Synthetic
tcctgcagccagaccatgta

SEQ ID NO: 23580 - DNA, 23 bp, Artificial Sequence
  Synthetic
cttaatctttctgaatggggcgt

SEQ ID NO: 23581 - DNA, 22 bp, Artificial Sequence
  Synthetic
ttacgaaggccatacggtatct

SEQ ID NO: 23582 - DNA, 20 bp, Artificial Sequence
  Synthetic
gtgcggggagaactcttgtt

SEQ ID NO: 23583 - DNA, 23 bp, Artificial Sequence
  Synthetic
caacgaaatacgcttgataccca

SEQ ID NO: 23584 - DNA, 24 bp, Artificial Sequence
  Synthetic
aatgtcgaggctttaaacgttttc

SEQ ID NO: 23585 - DNA, 21 bp, Artificial Sequence
  Synthetic
cgtctgcgtaagatgcatctt

SEQ ID NO: 23586 - DNA, 20 bp, Artificial Sequence
  Synthetic
gcgtaatggtgtgatgcctg

SEQ ID NO: 23587 - DNA, 25 bp, Artificial Sequence
  Synthetic
tccgtaacttctgattcagaattga

SEQ ID NO: 23588 - DNA, 20 bp, Artificial Sequence
  Synthetic
catggcaaaggttcgcctca

SEQ ID NO: 23589 - DNA, 21 bp, Artificial Sequence
  Synthetic
aggcgattctggaccaaaatc

SEQ ID NO: 23590 - DNA, 23 bp, Artificial Sequence
  Synthetic
ttgccttaggagaaaagggaagg

SEQ ID NO: 23591 - DNA, 20 bp, Artificial Sequence
  Synthetic
agcttcggaaggagacaagt

SEQ ID NO: 23592 - DNA, 23 bp, Artificial Sequence
  Synthetic
agcaattacgggatgaacatctg

SEQ ID NO: 23593 - DNA, 25 bp, Artificial Sequence
  Synthetic
gttcacctctttcaacggtatatga

SEQ ID NO: 23594 - DNA, 20 bp, Artificial Sequence
  Synthetic
ctccacaaatcagccgatcc

SEQ ID NO: 23595 - DNA, 20 bp, Artificial Sequence
  Synthetic
tgctcgctgcaaattccgaa

SEQ ID NO: 23596 - DNA, 23 bp, Artificial Sequence
  Synthetic
aacagctcaccaatcgagaatca

SEQ ID NO: 23597 - DNA, 20 bp, Artificial Sequence
  Synthetic
catgtgcggcaagccttttg

SEQ ID NO: 23598 - DNA, 22 bp, Artificial Sequence
  Synthetic
caagagcacaatggtatccgag

SEQ ID NO: 23599 - DNA, 25 bp, Artificial Sequence
  Synthetic
tggaagaggttcttttatgaatcgt

SEQ ID NO: 23600 - DNA, 22 bp, Artificial Sequence
  Synthetic
tatagggagcgaatgttgctgt

SEQ ID NO: 23601 - DNA, 20 bp, Artificial Sequence
  Synthetic
ttggcgagatagcgttgttc

SEQ ID NO: 23602 - DNA, 20 bp, Artificial Sequence
  Synthetic
ggtgctttgtgccaactctt

SEQ ID NO: 23603 - DNA, 25 bp, Artificial Sequence
  Synthetic
ctaagggaacagaaggcttgataat

SEQ ID NO: 23604 - DNA, 20 bp, Artificial Sequence
  Synthetic
tgctaaaaggtcgcgctaga

SEQ ID NO: 23605 - DNA, 20 bp, Artificial Sequence
  Synthetic
gtggaaattcgggggagtct

SEQ ID NO: 23606 - DNA, 25 bp, Artificial Sequence
  Synthetic
aaggacaatatagccttggagaaac

SEQ ID NO: 23607 - DNA, 25 bp, Artificial Sequence
  Synthetic
tcctggttttcctctcttaatagct

SEQ ID NO: 23608 - DNA, 22 bp, Artificial Sequence
  Synthetic
ccggaagacttattagcagcag

SEQ ID NO: 23609 - DNA, 22 bp, Artificial Sequence
  Synthetic
actagctaagcagttaggcctt

SEQ ID NO: 23610 - DNA, 22 bp, Artificial Sequence
  Synthetic
ttcacactacacaatgtgtcgc

SEQ ID NO: 23611 - DNA, 24 bp, Artificial Sequence
  Synthetic
tgacggatgttgttaaaggttctc

SEQ ID NO: 23612 - DNA, 23 bp, Artificial Sequence
  Synthetic
ttctcagaagaggatgtgcatga

SEQ ID NO: 23613 - DNA, 24 bp, Artificial Sequence
  Synthetic
tcgcagaattgatgatcatatgcc

SEQ ID NO: 23614 - DNA, 25 bp, Artificial Sequence
  Synthetic
atatgctgaggatttagaacaagca

SEQ ID NO: 23615 - DNA, 20 bp, Artificial Sequence
  Synthetic
gtcgcatcgagcaaagcatc

SEQ ID NO: 23616 - DNA, 21 bp, Artificial Sequence
  Synthetic
tagcagggatagaggaagcca

SEQ ID NO: 23617 - DNA, 24 bp, Artificial Sequence
  Synthetic
ctccttctttgacaaagtcagaga

SEQ ID NO: 23618 - DNA, 25 bp, Artificial Sequence
  Synthetic
ggagcatatttagaaacagttccct

SEQ ID NO: 23619 - DNA, 23 bp, Artificial Sequence
  Synthetic
gcgattcagttagcacgtattcc

SEQ ID NO: 23620 - DNA, 20 bp, Artificial Sequence
  Synthetic
tccgaagaaagcttgggtgc

SEQ ID NO: 23621 - DNA, 20 bp, Artificial Sequence
  Synthetic
cgttgcgtgatctcaaggct

SEQ ID NO: 23622 - DNA, 25 bp, Artificial Sequence
  Synthetic
ggaaattttctttccggagaacgag

SEQ ID NO: 23623 - DNA, 23 bp, Artificial Sequence
  Synthetic
gatcccagccatcaatgtgatag

SEQ ID NO: 23624 - DNA, 21 bp, Artificial Sequence
  Synthetic
ctagtcagcgagtgggatgac

SEQ ID NO: 23625 - DNA, 23 bp, Artificial Sequence
  Synthetic
tatgccgcatattttaacgcgta

SEQ ID NO: 23626 - DNA, 24 bp, Artificial Sequence
  Synthetic
tccacagttacagaaatcgatgag

SEQ ID NO: 23627 - DNA, 20 bp, Artificial Sequence
  Synthetic
gcgctatgatggttacagcg

SEQ ID NO: 23628 - DNA, 25 bp, Artificial Sequence
  Synthetic
accagtattttgggtcatatcttgt

SEQ ID NO: 23629 - DNA, 22 bp, Artificial Sequence
  Synthetic
gaaagggggagctatttatgcc

SEQ ID NO: 23630 - DNA, 22 bp, Artificial Sequence
  Synthetic
gcaattcaagcaagtgtggatg

SEQ ID NO: 23631 - DNA, 22 bp, Artificial Sequence
  Synthetic
atacacatttgcagaggagagc

SEQ ID NO: 23632 - DNA, 21 bp, Artificial Sequence
  Synthetic
gcatcgacaccatcaccatct

SEQ ID NO: 23633 - DNA, 24 bp, Artificial Sequence
  Synthetic
tttacgcagttgctgtactactca

SEQ ID NO: 23634 - DNA, 22 bp, Artificial Sequence
  Synthetic
ttgctctgaaacacttctgtcg

SEQ ID NO: 23635 - DNA, 25 bp, Artificial Sequence
  Synthetic
ttgatggaattggacgattctacat

SEQ ID NO: 23636 - DNA, 23 bp, Artificial Sequence
  Synthetic
gccaagccaataatggtgatgat

SEQ ID NO: 23637 - DNA, 22 bp, Artificial Sequence
  Synthetic
ggtgagaatggacggaaaacaa

SEQ ID NO: 23638 - DNA, 21 bp, Artificial Sequence
  Synthetic
aaggaccagaagtggaggaaa

SEQ ID NO: 23639 - DNA, 24 bp, Artificial Sequence
  Synthetic
gggatgtgtttgtcataagggaac

SEQ ID NO: 23640 - DNA, 25 bp, Artificial Sequence
  Synthetic
aacagacactatcaagagttggaga

SEQ ID NO: 23641 - DNA, 22 bp, Artificial Sequence
  Synthetic
cacatgtgtgtgcagggataac

SEQ ID NO: 23642 - DNA, 23 bp, Artificial Sequence
  Synthetic
tgagatgatttgggatccgaacg

SEQ ID NO: 23643 - DNA, 22 bp, Artificial Sequence
  Synthetic
tctacggaaggagtacctgagt

SEQ ID NO: 23644 - DNA, 23 bp, Artificial Sequence
  Synthetic
tggcttcggaggaaatttgtatg

SEQ ID NO: 23645 - DNA, 23 bp, Artificial Sequence
  Synthetic
tgaaggagttaactggagtccac

SEQ ID NO: 23646 - DNA, 24 bp, Artificial Sequence
  Synthetic
aaatccagcattgtacacacaaga

SEQ ID NO: 23647 - DNA, 24 bp, Artificial Sequence
  Synthetic
atcaccttacacagggaattctgg

SEQ ID NO: 23648 - DNA, 23 bp, Artificial Sequence
  Synthetic
actggactatgaagctagatgca

SEQ ID NO: 23649 - DNA, 25 bp, Artificial Sequence
  Synthetic
agagcagaatttttggaatcgatga

SEQ ID NO: 23650 - DNA, 25 bp, Artificial Sequence
  Synthetic
aggagaattgggaataataagagcc

SEQ ID NO: 23651 - DNA, 24 bp, Artificial Sequence
  Synthetic
caatcagatcctttttactgggga

SEQ ID NO: 23652 - DNA, 20 bp, Artificial Sequence
  Synthetic
ccagttgcatgggcctcata

SEQ ID NO: 23653 - DNA, 22 bp, Artificial Sequence
  Synthetic
tcatcctagctccagtgctggt

SEQ ID NO: 23654 - DNA, 22 bp, Artificial Sequence
  Synthetic
catcacaatggcaaaacctcct

SEQ ID NO: 23655 - DNA, 21 bp, Artificial Sequence
  Synthetic
cctgcattgtgacgaagactt

SEQ ID NO: 23656 - DNA, 24 bp, Artificial Sequence
  Synthetic
tttgacaaagacacagactcagat

SEQ ID NO: 23657 - DNA, 20 bp, Artificial Sequence
  Synthetic
aagaggcgactgttcgagga

SEQ ID NO: 23658 - DNA, 23 bp, Artificial Sequence
  Synthetic
atacccatggagaatacccagag

SEQ ID NO: 23659 - DNA, 25 bp, Artificial Sequence
  Synthetic
cactgcaagacaagttaatgacaat

SEQ ID NO: 23660 - DNA, 23 bp, Artificial Sequence
  Synthetic
agtgaaactggagaatgggaagt

SEQ ID NO: 23661 - DNA, 20 bp, Artificial Sequence
  Synthetic
gacgaccgaaagcgtcaccg

SEQ ID NO: 23662 - DNA, 20 bp, Artificial Sequence
  Synthetic
cctccagaggccgtagaggg

SEQ ID NO: 23663 - DNA, 23 bp, Artificial Sequence
  Synthetic
gcaggtagcaacgatagaatagg

SEQ ID NO: 23664 - DNA, 23 bp, Artificial Sequence
  Synthetic
tgaggctataggaccaagtgaac

SEQ ID NO: 23665 - DNA, 24 bp, Artificial Sequence
  Synthetic
caaacgagctactataaggaccag

SEQ ID NO: 23666 - DNA, 23 bp, Artificial Sequence
  Synthetic
ttttgcagatgtcctattggctt

SEQ ID NO: 23667 - DNA, 25 bp, Artificial Sequence
  Synthetic
atcagtttagagcttttcgactgaa

SEQ ID NO: 23668 - DNA, 22 bp, Artificial Sequence
  Synthetic
taggtgaacattgggacacagc

SEQ ID NO: 23669 - DNA, 25 bp, Artificial Sequence
  Synthetic
acgacgagaacaatgttatgttagg

SEQ ID NO: 23670 - DNA, 23 bp, Artificial Sequence
  Synthetic
attggttacaaagagcacaaggc

SEQ ID NO: 23671 - DNA, 21 bp, Artificial Sequence
  Synthetic
gttaacagctttcagccaggg

SEQ ID NO: 23672 - DNA, 25 bp, Artificial Sequence
  Synthetic
tgaatgcaagtccatatgatttgga

SEQ ID NO: 23673 - DNA, 24 bp, Artificial Sequence
  Synthetic
ttgttccatgggttatgtacttgc

SEQ ID NO: 23674 - DNA, 24 bp, Artificial Sequence
  Synthetic
gagtgctgctactatacgtagtgt

SEQ ID NO: 23675 - DNA, 25 bp, Artificial Sequence
  Synthetic
tggtaacatgatagatggttttgct

SEQ ID NO: 23676 - DNA, 20 bp, Artificial Sequence
  Synthetic
acgggagttgctaggtgttt

SEQ ID NO: 23677 - DNA, 25 bp, Artificial Sequence
  Synthetic
acgtagaagaatttgtctttcaggc

SEQ ID NO: 23678 - DNA, 24 bp, Artificial Sequence
  Synthetic
tgacaaatattaccctgttgtggt

SEQ ID NO: 23679 - DNA, 23 bp, Artificial Sequence
  Synthetic
ttaactgtcacaagtgctggaca

SEQ ID NO: 23680 - DNA, 25 bp, Artificial Sequence
  Synthetic
acctgctaatattgtacttccacaa

SEQ ID NO: 23681 - DNA, 24 bp, Artificial Sequence
  Synthetic
aaactgtgcttaatgttgttggac

SEQ ID NO: 23682 - DNA, 24 bp, Artificial Sequence
  Synthetic
atcaatgacgttgcatttgtttcg

SEQ ID NO: 23683 - DNA, 24 bp, Artificial Sequence
  Synthetic
aggaaatgtgttttgtgatggagt

SEQ ID NO: 23684 - DNA, 23 bp, Artificial Sequence
  Synthetic
aaaattgttcaatggcaagaggc

SEQ ID NO: 23685 - DNA, 25 bp, Artificial Sequence
  Synthetic
ttgagtcgtgaagatcttgagattg

SEQ ID NO: 23686 - DNA, 25 bp, Artificial Sequence
  Synthetic
ttaaattgataggacacaccgtctg

SEQ ID NO: 23687 - DNA, 20 bp, Artificial Sequence
  Synthetic
ggtgacagctcagagagtgg

SEQ ID NO: 23688 - DNA, 25 bp, Artificial Sequence
  Synthetic
tggctttagctaatatgttaccagc

SEQ ID NO: 23689 - DNA, 23 bp, Artificial Sequence
  Synthetic
ctaaggaattgaaacggcccatt

SEQ ID NO: 23690 - DNA, 25 bp, Artificial Sequence
  Synthetic
aactggtttgaaactgaagcttact

SEQ ID NO: 23691 - DNA, 25 bp, Artificial Sequence
  Synthetic
tgtgttgcactttattacacatgca

SEQ ID NO: 23692 - DNA, 23 bp, Artificial Sequence
  Synthetic
actcgttctatgtcgtattgcag

SEQ ID NO: 23693 - DNA, 22 bp, Artificial Sequence
  Synthetic
aagcttaaacgtgcttttggtg

SEQ ID NO: 23694 - DNA, 20 bp, Artificial Sequence
  Synthetic
gcctactgcttccgtctcaa

SEQ ID NO: 23695 - DNA, 25 bp, Artificial Sequence
  Synthetic
gatcttgtggatctgttggttatgt

SEQ ID NO: 23696 - DNA, 25 bp, Artificial Sequence
  Synthetic
agatgctttagcttctatgactggt

SEQ ID NO: 23697 - DNA, 25 bp, Artificial Sequence
  Synthetic
tgtgtacaagcatacatttagaggc

SEQ ID NO: 23698 - DNA, 23 bp, Artificial Sequence
  Synthetic
gcaaaggttattgctaagtgggt

SEQ ID NO: 23699 - DNA, 25 bp, Artificial Sequence
  Synthetic
tgactgatgtcaaatgtgctaatgt

SEQ ID NO: 23700 - DNA, 25 bp, Artificial Sequence
  Synthetic
tgctaagaaaaatcttgatgaggcg

SEQ ID NO: 23701 - DNA, 25 bp, Artificial Sequence
  Synthetic
gtatggcagattcaaactatccagg

SEQ ID NO: 23702 - DNA, 24 bp, Artificial Sequence
  Synthetic
gaactgctactgaatatgcttcca

SEQ ID NO: 23703 - DNA, 21 bp, Artificial Sequence
  Synthetic
cggcaagtttgtacaagtgcc

SEQ ID NO: 23704 - DNA, 25 bp, Artificial Sequence
  Synthetic
tcagttctttgttgttaagaggaca

SEQ ID NO: 23705 - DNA, 25 bp, Artificial Sequence
  Synthetic
ttttggtgactatgttattgcagcc

SEQ ID NO: 23706 - DNA, 22 bp, Artificial Sequence
  Synthetic
atccagctttgcatgtagcttc

SEQ ID NO: 23707 - DNA, 25 bp, Artificial Sequence
  Synthetic
ttggaaaagccaggctctattatga

SEQ ID NO: 23708 - DNA, 21 bp, Artificial Sequence
  Synthetic
ctgggatgatatgttacgccg

SEQ ID NO: 23709 - DNA, 25 bp, Artificial Sequence
  Synthetic
gttgattcaacctttgtcacagaat

SEQ ID NO: 23710 - DNA, 21 bp, Artificial Sequence
  Synthetic
agatggatggtgacgatgtct

SEQ ID NO: 23711 - DNA, 22 bp, Artificial Sequence
  Synthetic
ttatgcagagtgttggagcttg

SEQ ID NO: 23712 - DNA, 24 bp, Artificial Sequence
  Synthetic
cttgaaattgtttgctgcagaaac

SEQ ID NO: 23713 - DNA, 25 bp, Artificial Sequence
  Synthetic
acacattggtatgaaacgttactgc

SEQ ID NO: 23714 - DNA, 25 bp, Artificial Sequence
  Synthetic
accataaatgcattacctgagatgg

SEQ ID NO: 23715 - DNA, 21 bp, Artificial Sequence
  Synthetic
caaaccgtggattctgctcaa

SEQ ID NO: 23716 - DNA, 20 bp, Artificial Sequence
  Synthetic
atcacccagctcatgctcct

SEQ ID NO: 23717 - DNA, 21 bp, Artificial Sequence
  Synthetic
gaagccactggtttgtttgct

SEQ ID NO: 23718 - DNA, 25 bp, Artificial Sequence
  Synthetic
taaacgtgccacagtttacaattct

SEQ ID NO: 23719 - DNA, 25 bp, Artificial Sequence
  Synthetic
tttgaggcacataaggactctttta

SEQ ID NO: 23720 - DNA, 21 bp, Artificial Sequence
  Synthetic
gcatggatgctaagcaggttg

SEQ ID NO: 23721 - DNA, 24 bp, Artificial Sequence
  Synthetic
acaacataccctactaatgtggcc

SEQ ID NO: 23722 - DNA, 25 bp, Artificial Sequence
  Synthetic
agagtctttcgatgataagaggtcc

SEQ ID NO: 23723 - DNA, 25 bp, Artificial Sequence
  Synthetic
tgcatttgttaataggcttgtaccg

SEQ ID NO: 23724 - DNA, 25 bp, Artificial Sequence
  Synthetic
ttctccaatggaaagagttagtctc

SEQ ID NO: 23725 - DNA, 24 bp, Artificial Sequence
  Synthetic
aatggggtattttgcattttggac

SEQ ID NO: 23726 - DNA, 22 bp, Artificial Sequence
  Synthetic
ctggacatacagcctgaagact

SEQ ID NO: 23727 - DNA, 25 bp, Artificial Sequence
  Synthetic
ccggctagacttgaaatagttaagc

SEQ ID NO: 23728 - DNA, 22 bp, Artificial Sequence
  Synthetic
tcatgcctttaaatgcaaccgt

SEQ ID NO: 23729 - DNA, 24 bp, Artificial Sequence
  Synthetic
gtaaggattttacgcctgtacagg

SEQ ID NO: 23730 - DNA, 24 bp, Artificial Sequence
  Synthetic
acaaggtcttttagaggtctctgt

SEQ ID NO: 23731 - DNA, 25 bp, Artificial Sequence
  Synthetic
attgggttacacctctcacttctag

SEQ ID NO: 23732 - DNA, 25 bp, Artificial Sequence
  Synthetic
tgagcagcctgatgtcttttattca

SEQ ID NO: 23733 - DNA, 24 bp, Artificial Sequence
  Synthetic
cctgcaggtgttcttactaatcat

SEQ ID NO: 23734 - DNA, 25 bp, Artificial Sequence
  Synthetic
aagtgattattgtggaggcaattct

SEQ ID NO: 23735 - DNA, 22 bp, Artificial Sequence
  Synthetic
ccgaaccagcattgctatttcg

SEQ ID NO: 23736 - DNA, 23 bp, Artificial Sequence
  Synthetic
tgtggtgattatgcagcatgtaa

SEQ ID NO: 23737 - DNA, 20 bp, Artificial Sequence
  Synthetic
gcatcaaagtgttgcctcca

SEQ ID NO: 23738 - DNA, 25 bp, Artificial Sequence
  Synthetic
tgcttatgtttctcaacagcttagt

SEQ ID NO: 23739 - DNA, 25 bp, Artificial Sequence
  Synthetic
gtagtggttactactaccctgaacc

SEQ ID NO: 23740 - DNA, 25 bp, Artificial Sequence
  Synthetic
gtaaaatggccttggtatgtatggc

SEQ ID NO: 23741 - DNA, 22 bp, Artificial Sequence
  Synthetic
agagttcctagtcatgcttggt

SEQ ID NO: 23742 - DNA, 24 bp, Artificial Sequence
  Synthetic
ttgaggactatcatactctgacgg

SEQ ID NO: 23743 - DNA, 22 bp, Artificial Sequence
  Synthetic
aatccagtagtagagcgtcctc

SEQ ID NO: 23744 - DNA, 22 bp, Artificial Sequence
  Synthetic
ccaggctgatgtcaataccccg

SEQ ID NO: 23745 - DNA, 24 bp, Artificial Sequence
  Synthetic
ttgctagtcttgttctggcaaaac

SEQ ID NO: 23746 - DNA, 25 bp, Artificial Sequence
  Synthetic
tgacagtacactttcaggttttgag

SEQ ID NO: 23747 - DNA, 23 bp, Artificial Sequence
  Synthetic
gcagaaaagtcgagataaggcac

SEQ ID NO: 23748 - DNA, 22 bp, Artificial Sequence
  Synthetic
ggaaggacctctttgcatcaga

SEQ ID NO: 23749 - DNA, 24 bp, Artificial Sequence
  Synthetic
ctacagagattcgcttggagaagc

SEQ ID NO: 23750 - DNA, 21 bp, Artificial Sequence
  Synthetic
ggcttcgccgagatcagaagt

SEQ ID NO: 23751 - DNA, 20 bp, Artificial Sequence
  Synthetic
gaaagtgacagggccccttt

SEQ ID NO: 23752 - DNA, 23 bp, Artificial Sequence
  Synthetic
aacacagttcgagtctctgaaac

SEQ ID NO: 23753 - DNA, 22 bp, Artificial Sequence
  Synthetic
ccctcccgggagagccatagtg

SEQ ID NO: 23754 - DNA, 21 bp, Artificial Sequence
  Synthetic
tggagtatacgtgttgccgcg

SEQ ID NO: 23755 - DNA, 19 bp, Artificial Sequence
  Synthetic
gctcgtcggcgctcctgta

SEQ ID NO: 23756 - DNA, 22 bp, Artificial Sequence
  Synthetic
acacctacagtggcagtcaggt

SEQ ID NO: 23757 - DNA, 21 bp, Artificial Sequence
  Synthetic
gcatgtcctgcgtttacccca

SEQ ID NO: 23758 - DNA, 20 bp, Artificial Sequence
  Synthetic
tactgctggcactacgcacc

SEQ ID NO: 23759 - DNA, 21 bp, Artificial Sequence
  Synthetic
ctcccagtggtcggtggtttg

SEQ ID NO: 23760 - DNA, 21 bp, Artificial Sequence
  Synthetic
tgaccgcagtgagcaacatcc

SEQ ID NO: 23761 - DNA, 20 bp, Artificial Sequence
  Synthetic
cgctgctgctgggacacatg

SEQ ID NO: 23762 - DNA, 20 bp, Artificial Sequence
  Synthetic
aggtcatcacctggggtgcg

SEQ ID NO: 23763 - DNA, 22 bp, Artificial Sequence
  Synthetic
atggagcaggttcgagaacgct

SEQ ID NO: 23764 - DNA, 22 bp, Artificial Sequence
  Synthetic
tgttgcggggatctttagggct

SEQ ID NO: 23765 - DNA, 21 bp, Artificial Sequence
  Synthetic
gggaaccgcaccgttacaact

SEQ ID NO: 23766 - DNA, 22 bp, Artificial Sequence
  Synthetic
acgtaccgatatgtcgcctccg

SEQ ID NO: 23767 - DNA, 20 bp, Artificial Sequence
  Synthetic
gcaggctcctcccccaagtt

SEQ ID NO: 23768 - DNA, 22 bp, Artificial Sequence
  Synthetic
atggaggagtgctcacaagctg

SEQ ID NO: 23769 - DNA, 19 bp, Artificial Sequence
  Synthetic
tactcggggggtgggttgc

SEQ ID NO: 23770 - DNA, 20 bp, Artificial Sequence
  Synthetic
cgtaggacctggggagggag

SEQ ID NO: 23771 - DNA, 22 bp, Artificial Sequence
  Synthetic
aaagggatacaagggcgtgtgg

SEQ ID NO: 23772 - DNA, 20 bp, Artificial Sequence
  Synthetic
tgccggctgctgagttcttt

SEQ ID NO: 23773 - DNA, 21 bp, Artificial Sequence
  Synthetic
cagacgctgagctagtggacg

SEQ ID NO: 23774 - DNA, 22 bp, Artificial Sequence
  Synthetic
tcagctggacggctctaatgtg

SEQ ID NO: 23775 - DNA, 22 bp, Artificial Sequence
  Synthetic
aagagaaactgcccatcagccc

SEQ ID NO: 23776 - DNA, 22 bp, Artificial Sequence
  Synthetic
ttccaaccaccatcatggcgaa

SEQ ID NO: 23777 - DNA, 21 bp, Artificial Sequence
  Synthetic
ctccctcacggagcggcttta

SEQ ID NO: 23778 - DNA, 21 bp, Artificial Sequence
  Synthetic
tagagcagccctgagagcctt

SEQ ID NO: 23779 - DNA, 25 bp, Artificial Sequence
  Synthetic
tcaagaagtacacatcaggaagaca

SEQ ID NO: 23780 - DNA, 23 bp, Artificial Sequence
  Synthetic
agtcgaaaggctaaagcatggaa

SEQ ID NO: 23781 - DNA, 25 bp, Artificial Sequence
  Synthetic
agagaagaaagaagaactccaggat

SEQ ID NO: 23782 - DNA, 25 bp, Artificial Sequence
  Synthetic
tagcatctttattggagatgtgcca

SEQ ID NO: 23783 - DNA, 23 bp, Artificial Sequence
  Synthetic
tgaagagttcacaatggttggga

SEQ ID NO: 23784 - DNA, 24 bp, Artificial Sequence
  Synthetic
aaagtgctttttcaaaattgggga

SEQ ID NO: 23785 - DNA, 22 bp, Artificial Sequence
  Synthetic
acacagggaacagagaaactga

SEQ ID NO: 23786 - DNA, 24 bp, Artificial Sequence
  Synthetic
gatgtgcttgggacatttgatacc

SEQ ID NO: 23787 - DNA, 22 bp, Artificial Sequence
  Synthetic
agacaggagatatgggccagca

SEQ ID NO: 23788 - DNA, 20 bp, Artificial Sequence
  Synthetic
ctgccgacgccttaccgatt

SEQ ID NO: 23789 - DNA, 20 bp, Artificial Sequence
  Synthetic
gcccccttgtgtcatcggag

SEQ ID NO: 23790 - DNA, 20 bp, Artificial Sequence
  Synthetic
gcccattgctgctgtccacc

SEQ ID NO: 23791 - DNA, 22 bp, Artificial Sequence
  Synthetic
atctgaagggtaggtgggtgcc

SEQ ID NO: 23792 - DNA, 21 bp, Artificial Sequence
  Synthetic
aaagtcccctacttcgtgcgc

SEQ ID NO: 23793 - DNA, 18 bp, Artificial Sequence
  Synthetic
ccgcgtgcggtgacatca

SEQ ID NO: 23794 - DNA, 19 bp, Artificial Sequence
  Synthetic
agaccttgtgggctggccc

SEQ ID NO: 23795 - DNA, 22 bp, Artificial Sequence
  Synthetic
tcacggacaactcctctccacc

SEQ ID NO: 23796 - DNA, 22 bp, Artificial Sequence
  Synthetic
tttgtgacgagtgccactccac

SEQ ID NO: 23797 - DNA, 20 bp, Artificial Sequence
  Synthetic
accgcggtcttgacgtgtct

SEQ ID NO: 23798 - DNA, 20 bp, Artificial Sequence
  Synthetic
gagtgctatgacgcgggctg

SEQ ID NO: 23799 - DNA, 20 bp, Artificial Sequence
  Synthetic
acctggaggtcgtcacgagc

SEQ ID NO: 23800 - DNA, 22 bp, Artificial Sequence
  Synthetic
accaactggcagaaactcgagg

SEQ ID NO: 23801 - DNA, 22 bp, Artificial Sequence
  Synthetic
agatcatgagcggtgaggtccc

SEQ ID NO: 23802 - DNA, 22 bp, Artificial Sequence
  Synthetic
ctcagcagcctcactgtaaccc

SEQ ID NO: 23803 - DNA, 21 bp, Artificial Sequence
  Synthetic
gggacgttccccattaacgcc

SEQ ID NO: 23804 - DNA, 19 bp, Artificial Sequence
  Synthetic
cgagcccgaaccggacgta

SEQ ID NO: 23805 - DNA, 20 bp, Artificial Sequence
  Synthetic
ccggactacaaccccccgct

SEQ ID NO: 23806 - DNA, 19 bp, Artificial Sequence
  Synthetic
tcttccatgccccccctgg

SEQ ID NO: 23807 - DNA, 20 bp, Artificial Sequence
  Synthetic
ctgacgcccccacattcagc

SEQ ID NO: 23808 - DNA, 22 bp, Artificial Sequence
  Synthetic
acgacgtggttagcaagctccc

SEQ ID NO: 23809 - DNA, 22 bp, Artificial Sequence
  Synthetic
tcacttgctacatcaaggcccg

SEQ ID NO: 23810 - DNA, 22 bp, Artificial Sequence
  Synthetic
ccagtcaattcctggctaggca

SEQ ID NO: 23811 - DNA, 20 bp, Artificial Sequence
  Synthetic
gtccgcgctaggcttctgtc

SEQ ID NO: 23812 - DNA, 25 bp, Artificial Sequence
  Synthetic
acccagaaacatattgcttttgtgt

SEQ ID NO: 23813 - DNA, 20 bp, Artificial Sequence
  Synthetic
tgtgtcacaaaccgctggta

SEQ ID NO: 23814 - DNA, 21 bp, Artificial Sequence
  Synthetic
gcacaacaagcgtatagggtg

SEQ ID NO: 23815 - DNA, 22 bp, Artificial Sequence
  Synthetic
gacagtcagcaaaggccaaacg

SEQ ID NO: 23816 - DNA, 22 bp, Artificial Sequence
  Synthetic
gggaatgacagtgcttatgctg

SEQ ID NO: 23817 - DNA, 20 bp, Artificial Sequence
  Synthetic
tggggggggctgttatatcc

SEQ ID NO: 23818 - DNA, 23 bp, Artificial Sequence
  Synthetic
tatgggcacgtttaagccttacc

SEQ ID NO: 23819 - DNA, 23 bp, Artificial Sequence
  Synthetic
atgtgaatttcaaggatgacgct

SEQ ID NO: 23820 - DNA, 19 bp, Artificial Sequence
  Synthetic
ttccacccagaaggccgcg

SEQ ID NO: 23821 - DNA, 20 bp, Artificial Sequence
  Synthetic
gctgacgtgctatctggcat

SEQ ID NO: 23822 - DNA, 22 bp, Artificial Sequence
  Synthetic
tggcagatcgcattttgcagtg

SEQ ID NO: 23823 - DNA, 20 bp, Artificial Sequence
  Synthetic
ccccagctgtgttggacatc

SEQ ID NO: 23824 - DNA, 20 bp, Artificial Sequence
  Synthetic
tacttgctccagctgcctct

SEQ ID NO: 23825 - DNA, 20 bp, Artificial Sequence
  Synthetic
cgactatgtgacacgcacca

SEQ ID NO: 23826 - DNA, 23 bp, Artificial Sequence
  Synthetic
atccagattatttgggaatggcc

SEQ ID NO: 23827 - DNA, 23 bp, Artificial Sequence
  Synthetic
attggaggattggaactttgggt

SEQ ID NO: 23828 - DNA, 24 bp, Artificial Sequence
  Synthetic
gtaaggttgttctaggtcaggaga

SEQ ID NO: 23829 - DNA, 21 bp, Artificial Sequence
  Synthetic
tgtgcgacacaagctgcaata

SEQ ID NO: 23830 - DNA, 21 bp, Artificial Sequence
  Synthetic
gaatcggagcagggaaattcc

SEQ ID NO: 23831 - DNA, 25 bp, Artificial Sequence
  Synthetic
tatcaggattcacatgaacagtggc

SEQ ID NO: 23832 - DNA, 20 bp, Artificial Sequence
  Synthetic
accgcaaatcgcagctggag

SEQ ID NO: 23833 - DNA, 22 bp, Artificial Sequence
  Synthetic
agacttcaagaggaggctcggg

SEQ ID NO: 23834 - DNA, 23 bp, Artificial Sequence
  Synthetic
ctccatctattacacgccctttg

SEQ ID NO: 23835 - DNA, 21 bp, Artificial Sequence
  Synthetic
acatcattaggtggtggggag

SEQ ID NO: 23836 - DNA, 22 bp, Artificial Sequence
  Synthetic
catcagtttgcagtttcagcag

SEQ ID NO: 23837 - DNA, 24 bp, Artificial Sequence
  Synthetic
atcacctacttacccttacacacc

SEQ ID NO: 23838 - DNA, 23 bp, Artificial Sequence
  Synthetic
ttatgctggatctgaaaggcttc

SEQ ID NO: 23839 - DNA, 25 bp, Artificial Sequence
  Synthetic
acagaaaatcctaacacgtatcctg

SEQ ID NO: 23840 - DNA, 22 bp, Artificial Sequence
  Synthetic
gtgatgtaggatttggagctgc

SEQ ID NO: 23841 - DNA, 25 bp, Artificial Sequence
  Synthetic
acaaacctcaaaacaatttaggacc

SEQ ID NO: 23842 - DNA, 23 bp, Artificial Sequence
  Synthetic
gaggcaaacttagaaaccgtttc

SEQ ID NO: 23843 - DNA, 21 bp, Artificial Sequence
  Synthetic
aagaatgaagtgggccatgtg

SEQ ID NO: 23844 - DNA, 25 bp, Artificial Sequence
  Synthetic
tcagaaagatgagacttgacaatgc

SEQ ID NO: 23845 - DNA, 23 bp, Artificial Sequence
  Synthetic
aactcccattgtactggcataca

SEQ ID NO: 23846 - DNA, 25 bp, Artificial Sequence
  Synthetic
agctgtagagattgcaaataagact

SEQ ID NO: 23847 - DNA, 22 bp, Artificial Sequence
  Synthetic
ttcagccaaaaaggaggacatg

SEQ ID NO: 23848 - DNA, 25 bp, Artificial Sequence
  Synthetic
tgaggaatcacctaaagcaagtgag

SEQ ID NO: 23849 - DNA, 22 bp, Artificial Sequence
  Synthetic
ccaagatgtgggaaatgggaac

SEQ ID NO: 23850 - DNA, 24 bp, Artificial Sequence
  Synthetic
aattgttgcctttctgtttttcgc

SEQ ID NO: 23851 - DNA, 25 bp, Artificial Sequence
  Synthetic
tgaggaacttgaaagactaaaaccg

SEQ ID NO: 23852 - DNA, 25 bp, Artificial Sequence
  Synthetic
actttccacacttttcatctctctg

SEQ ID NO: 23853 - DNA, 22 bp, Artificial Sequence
  Synthetic
tcttggacaagaatggcatgtg

SEQ ID NO: 23854 - DNA, 25 bp, Artificial Sequence
  Synthetic
ctagcgaagttaaagcccaatcatc

SEQ ID NO: 23855 - DNA, 23 bp, Artificial Sequence
  Synthetic
attgacttgtttgttaagcgtcg

SEQ ID NO: 23856 - DNA, 24 bp, Artificial Sequence
  Synthetic
tttgtcttttagatcaggcttggc

SEQ ID NO: 23857 - DNA, 24 bp, Artificial Sequence
  Synthetic
ttaatcctgctaatgggcatatgc

SEQ ID NO: 23858 - DNA, 20 bp, Artificial Sequence
  Synthetic
cagtggcaggaagcatggta

SEQ ID NO: 23859 - DNA, 25 bp, Artificial Sequence
  Synthetic
ctcctctgagtaaggatttacctga

SEQ ID NO: 23860 - DNA, 25 bp, Artificial Sequence
  Synthetic
tgttgagtacaaagtaacagtctgg

SEQ ID NO: 23861 - DNA, 25 bp, Artificial Sequence
  Synthetic
acgaaattgtagtgttcgtgttaag

SEQ ID NO: 23862 - DNA, 21 bp, Artificial Sequence
  Synthetic
cagtagctgctggtttggaat

SEQ ID NO: 23863 - DNA, 25 bp, Artificial Sequence
  Synthetic
atacatctttggttccacatacacg

SEQ ID NO: 23864 - DNA, 25 bp, Artificial Sequence
  Synthetic
tggtaatgttaaacctggtgaaact

SEQ ID NO: 23865 - DNA, 25 bp, Artificial Sequence
  Synthetic
attgtgcttggtttgtacaaaatga

SEQ ID NO: 23866 - DNA, 25 bp, Artificial Sequence
  Synthetic
agaggctcggattaatgataagaag

SEQ ID NO: 23867 - DNA, 24 bp, Artificial Sequence
  Synthetic
ctcagtttgtatttattgccgtgc

SEQ ID NO: 23868 - DNA, 25 bp, Artificial Sequence
  Synthetic
tttggtgattttatacaaacagccc

SEQ ID NO: 23869 - DNA, 21 bp, Artificial Sequence
  Synthetic
cagatcctgctatgcacgttg

SEQ ID NO: 23870 - DNA, 25 bp, Artificial Sequence
  Synthetic
tgctatcagtgctaagaatagagct

SEQ ID NO: 23871 - DNA, 25 bp, Artificial Sequence
  Synthetic
acatgaattttgttgttcacatggt

SEQ ID NO: 23872 - DNA, 25 bp, Artificial Sequence
  Synthetic
aagtctagctatagatgcttaccct

SEQ ID NO: 23873 - DNA, 25 bp, Artificial Sequence
  Synthetic
tgaacgtttaaagttatttgctgca

SEQ ID NO: 23874 - DNA, 25 bp, Artificial Sequence
  Synthetic
atgttgctaattatcagcacattgg

SEQ ID NO: 23875 - DNA, 25 bp, Artificial Sequence
  Synthetic
ctttccactgcaaataggtttttca

SEQ ID NO: 23876 - DNA, 22 bp, Artificial Sequence
  Synthetic
tgatgcttttcctgtagccaag

SEQ ID NO: 23877 - DNA, 23 bp, Artificial Sequence
  Synthetic
atcacacggtgtaatctaggtgg

SEQ ID NO: 23878 - DNA, 23 bp, Artificial Sequence
  Synthetic
ctcaaagttgagttttggttcgc

SEQ ID NO: 23879 - DNA, 24 bp, Artificial Sequence
  Synthetic
ttttacatttaggtgcagggtctg

SEQ ID NO: 23880 - DNA, 25 bp, Artificial Sequence
  Synthetic
atcgttcttgtgagagtactactgt

SEQ ID NO: 23881 - DNA, 25 bp, Artificial Sequence
  Synthetic
tcgtaaacgtagaagtatttctgct

SEQ ID NO: 23882 - DNA, 24 bp, Artificial Sequence
  Synthetic
aaatgcttatgtctctcaacagct

SEQ ID NO: 23883 - DNA, 21 bp, Artificial Sequence
  Synthetic
tacagggtgtcaaacttggca

SEQ ID NO: 23884 - DNA, 23 bp, Artificial Sequence
  Synthetic
atctgagcgaaattaccaaacct

SEQ ID NO: 23885 - DNA, 25 bp, Artificial Sequence
  Synthetic
tcaacagtgttttggtaaaagagga

SEQ ID NO: 23886 - DNA, 24 bp, Artificial Sequence
  Synthetic
ctggtactcagcacatttcaaatg

SEQ ID NO: 23887 - DNA, 20 bp, Artificial Sequence
  Synthetic
tgcagcaatatgcacccact

SEQ ID NO: 23888 - DNA, 24 bp, Artificial Sequence
  Synthetic
cgaaagaggcgaagaaacaattga

SEQ ID NO: 23889 - DNA, 24 bp, Artificial Sequence
  Synthetic
cctaatggacctccttgttatcag

SEQ ID NO: 23890 - DNA, 23 bp, Artificial Sequence
  Synthetic
aaaacgagtcaactaaagtgggc

SEQ ID NO: 23891 - DNA, 25 bp, Artificial Sequence
  Synthetic
gaattatttcacagcagaggtgtcc

SEQ ID NO: 23892 - DNA, 25 bp, Artificial Sequence
  Synthetic
aaatgggagaaatactgtgtccttg

SEQ ID NO: 23893 - DNA, 20 bp, Artificial Sequence
  Synthetic
ccccaagggagtggaagaag

SEQ ID NO: 23894 - DNA, 25 bp, Artificial Sequence
  Synthetic
aattgggaggttttacgtacagatg

SEQ ID NO: 23895 - DNA, 21 bp, Artificial Sequence
  Synthetic
ggcgataatggacgaagaaca

SEQ ID NO: 23896 - DNA, 21 bp, Artificial Sequence
  Synthetic
tcctgagaggatccgtagccc

SEQ ID NO: 23897 - DNA, 25 bp, Artificial Sequence
  Synthetic
aagaggacaactatccactagagga

SEQ ID NO: 23898 - DNA, 25 bp, Artificial Sequence
  Synthetic
aagctttcagcatctattactgaca

SEQ ID NO: 23899 - DNA, 22 bp, Artificial Sequence
  Synthetic
aagagacggagagagaccgagg

SEQ ID NO: 23900 - DNA, 24 bp, Artificial Sequence
  Synthetic
aaatgttggaggtggagatgtaaa

SEQ ID NO: 23901 - DNA, 23 bp, Artificial Sequence
  Synthetic
cggaggacttatatagggcttgt

SEQ ID NO: 23902 - DNA, 25 bp, Artificial Sequence
  Synthetic
acacctgttaaaccaaatacagctg

SEQ ID NO: 23903 - DNA, 21 bp, Artificial Sequence
  Synthetic
tgcagcctatacctgaaaggc

SEQ ID NO: 23904 - DNA, 23 bp, Artificial Sequence
  Synthetic
cactttagttagagccagggaac

SEQ ID NO: 23905 - DNA, 20 bp, Artificial Sequence
  Synthetic
ggtggttcgagtgagcagat

SEQ ID NO: 23906 - DNA, 25 bp, Artificial Sequence
  Synthetic
tacaggtgaatattgggatgtagca

SEQ ID NO: 23907 - DNA, 21 bp, Artificial Sequence
  Synthetic
ctttcatggaagacgggagca

SEQ ID NO: 23908 - DNA, 20 bp, Artificial Sequence
  Synthetic
gtacctccccctcagactgc

SEQ ID NO: 23909 - DNA, 21 bp, Artificial Sequence
  Synthetic
tcgcactgtttatgcagagca

SEQ ID NO: 23910 - DNA, 23 bp, Artificial Sequence
  Synthetic
ttttggtaagtgacaaatgcccg

SEQ ID NO: 23911 - DNA, 24 bp, Artificial Sequence
  Synthetic
attcggatttccatttcatcgacg

SEQ ID NO: 23912 - DNA, 24 bp, Artificial Sequence
  Synthetic
tcattgaaattggagtaacacgga

SEQ ID NO: 23913 - DNA, 23 bp, Artificial Sequence
  Synthetic
aagaggcgaagagacaattgaag

SEQ ID NO: 23914 - DNA, 25 bp, Artificial Sequence
  Synthetic
agactttgatgactgcaaagatgtt

SEQ ID NO: 23915 - DNA, 25 bp, Artificial Sequence
  Synthetic
gggctactgaatacataatgaaggg

SEQ ID NO: 23916 - DNA, 25 bp, Artificial Sequence
  Synthetic
tgtgttcttgaaataggagacatgc

SEQ ID NO: 23917 - DNA, 20 bp, Artificial Sequence
  Synthetic
gggagtggaggaaggctcta

SEQ ID NO: 23918 - DNA, 21 bp, Artificial Sequence
  Synthetic
gtgatgccccctttgatgaca

SEQ ID NO: 23919 - DNA, 25 bp, Artificial Sequence
  Synthetic
cagaaaataactggaggccttatgg

SEQ ID NO: 23920 - DNA, 20 bp, Artificial Sequence
  Synthetic
acagagattcgcttggggaa

SEQ ID NO: 23921 - DNA, 23 bp, Artificial Sequence
  Synthetic
agggacaacatgaccaagaaaat

SEQ ID NO: 23922 - DNA, 21 bp, Artificial Sequence
  Synthetic
ccgttggagggaatgagaaga

SEQ ID NO: 23923 - DNA, 23 bp, Artificial Sequence
  Synthetic
tccaatcctctgatgatttcgct

SEQ ID NO: 23924 - DNA, 20 bp, Artificial Sequence
  Synthetic
aacaacgaccttggaccagc

SEQ ID NO: 23925 - DNA, 23 bp, Artificial Sequence
  Synthetic
tcttccctagcagttcatatcgg

SEQ ID NO: 23926 - DNA, 20 bp, Artificial Sequence
  Synthetic
ccagctacccgaccctacaa

SEQ ID NO: 23927 - DNA, 25 bp, Artificial Sequence
  Synthetic
tggaaccatataatgaagtgcaaga

SEQ ID NO: 23928 - DNA, 25 bp, Artificial Sequence
  Synthetic
acatgccttaaaacgaaagtatgga

SEQ ID NO: 23929 - DNA, 24 bp, Artificial Sequence
  Synthetic
tgacagtgtatttgacctgtcaga

SEQ ID NO: 23930 - DNA, 23 bp, Artificial Sequence
  Synthetic
gacgtggtccagattagatttgc

SEQ ID NO: 23931 - DNA, 23 bp, Artificial Sequence
  Synthetic
aaaagcaaagcacatgaagcaat

SEQ ID NO: 23932 - DNA, 22 bp, Artificial Sequence
  Synthetic
agagaattacaacaccccacca

SEQ ID NO: 23933 - DNA, 25 bp, Artificial Sequence
  Synthetic
ggccttcagatccatctattgttac

SEQ ID NO: 23934 - DNA, 23 bp, Artificial Sequence
  Synthetic
cacatggatacgaggaaattcca

SEQ ID NO: 23935 - DNA, 21 bp, Artificial Sequence
  Synthetic
tgccttaacatccagacgtgg

SEQ ID NO: 23936 - DNA, 25 bp, Artificial Sequence
  Synthetic
tcctgaaacacaacgtttagtatgg

SEQ ID NO: 23937 - DNA, 23 bp, Artificial Sequence
  Synthetic
attggttgtgttcctgctattgg

SEQ ID NO: 23938 - DNA, 24 bp, Artificial Sequence
  Synthetic
tttacgacgcgaacagttatttgc

SEQ ID NO: 23939 - DNA, 22 bp, Artificial Sequence
  Synthetic
gaaccctatgtttcatgcgacc

SEQ ID NO: 23940 - DNA, 24 bp, Artificial Sequence
  Synthetic
tctgcagtagtatggtacaacaga

SEQ ID NO: 23941 - DNA, 23 bp, Artificial Sequence
  Synthetic
ggctcaaatagaccagtgattca

SEQ ID NO: 23942 - DNA, 22 bp, Artificial Sequence
  Synthetic
ctcgaggtctggatacgagatg

SEQ ID NO: 23943 - DNA, 23 bp, Artificial Sequence
  Synthetic
aaaagtacacatcaggaaggcaa

SEQ ID NO: 23944 - DNA, 24 bp, Artificial Sequence
  Synthetic
aaaaggtcgaaaggttgaaacatg

SEQ ID NO: 23945 - DNA, 24 bp, Artificial Sequence
  Synthetic
atgctagaaagagaattggtccgt

SEQ ID NO: 23946 - DNA, 22 bp, Artificial Sequence
  Synthetic
tctctcttggaaatgtgccaca

SEQ ID NO: 23947 - DNA, 25 bp, Artificial Sequence
  Synthetic
gaagagcaacagctattctcagaaa

SEQ ID NO: 23948 - DNA, 20 bp, Artificial Sequence
  Synthetic
agatcaatggccctgagtca

SEQ ID NO: 23949 - DNA, 20 bp, Artificial Sequence
  Synthetic
tgccccaccagaacagagta

SEQ ID NO: 23950 - DNA, 24 bp, Artificial Sequence
  Synthetic
aagagatatggcccagcattaagc

SEQ ID NO: 23951 - DNA, 25 bp, Artificial Sequence
  Synthetic
tggaggagtattgcaaacattatgg

SEQ ID NO: 23952 - DNA, 25 bp, Artificial Sequence
  Synthetic
ggttagattaagggtttgtgtacgt

SEQ ID NO: 23953 - DNA, 25 bp, Artificial Sequence
  Synthetic
aaaaggagattgtttttggacagtg

SEQ ID NO: 23954 - DNA, 23 bp, Artificial Sequence
  Synthetic
gggaagtggatctagaacggttc

SEQ ID NO: 23955 - DNA, 22 bp, Artificial Sequence
  Synthetic
gtggatcacgttctggtagacc

SEQ ID NO: 23956 - DNA, 20 bp, Artificial Sequence
  Synthetic
actggcggtgtcactcaatc

SEQ ID NO: 23957 - DNA, 21 bp, Artificial Sequence
  Synthetic
agcagcaccagacaatgcatt

SEQ ID NO: 23958 - DNA, 25 bp, Artificial Sequence
  Synthetic
agaccctataaatgcaacagatgtt

SEQ ID NO: 23959 - DNA, 23 bp, Artificial Sequence
  Synthetic
taggtgatacagagaatccagca

SEQ ID NO: 23960 - DNA, 25 bp, Artificial Sequence
  Synthetic
gtgtgccattagaattagtggacac

SEQ ID NO: 23961 - DNA, 21 bp, Artificial Sequence
  Synthetic
ctagtggacagcagtgacctt

SEQ ID NO: 23962 - DNA, 25 bp, Artificial Sequence
  Synthetic
ctgtgtggaaacctggatattgtgt

SEQ ID NO: 23963 - DNA, 24 bp, Artificial Sequence
  Synthetic
gtgcctggatattttacacagcag

SEQ ID NO: 23964 - DNA, 24 bp, Artificial Sequence
  Synthetic
agaagtgtaccagtagcattgttt

SEQ ID NO: 23965 - DNA, 21 bp, Artificial Sequence
  Synthetic
agatggaaacgaggtgtctgt

SEQ ID NO: 23966 - DNA, 21 bp, Artificial Sequence
  Synthetic
cattggcagcatctgaaagca

SEQ ID NO: 23967 - DNA, 23 bp, Artificial Sequence
  Synthetic
atgtgcattttaccaaggaagca

SEQ ID NO: 23968 - DNA, 20 bp, Artificial Sequence
  Synthetic
ttttacatgggtggcggatg

SEQ ID NO: 23969 - DNA, 20 bp, Artificial Sequence
  Synthetic
caggtgggggtcgggtaaca

SEQ ID NO: 23970 - DNA, 23 bp, Artificial Sequence
  Synthetic
acagaccctgttacacaatctgc

SEQ ID NO: 23971 - DNA, 24 bp, Artificial Sequence
  Synthetic
gtatccaccctgactcatttgaat

SEQ ID NO: 23972 - DNA, 25 bp, Artificial Sequence
  Synthetic
ccacagtccggtaaactttatctac

SEQ ID NO: 23973 - DNA, 20 bp, Artificial Sequence
  Synthetic
cattgggatgctgcaaagcc

SEQ ID NO: 23974 - DNA, 25 bp, Artificial Sequence
  Synthetic
tgccaccagctataaacattatctg

SEQ ID NO: 23975 - DNA, 23 bp, Artificial Sequence
  Synthetic
tctacctcctctagaaagcggtc

SEQ ID NO: 23976 - DNA, 25 bp, Artificial Sequence
  Synthetic
cttgatcctatgattgttgttggca

SEQ ID NO: 23977 - DNA, 25 bp, Artificial Sequence
  Synthetic
gcactatccctatacaatagacacc

SEQ ID NO: 23978 - DNA, 23 bp, Artificial Sequence
  Synthetic
tagcgaatggtatgttgtgacag

SEQ ID NO: 23979 - DNA, 25 bp, Artificial Sequence
  Synthetic
tttcacctcagagacaaagcaaaag

SEQ ID NO: 23980 - DNA, 21 bp, Artificial Sequence
  Synthetic
gtgccgctgcagaagaagtaa

SEQ ID NO: 23981 - DNA, 25 bp, Artificial Sequence
  Synthetic
ccaaattatttctgctcctgttacc

SEQ ID NO: 23982 - DNA, 20 bp, Artificial Sequence
  Synthetic
ctccagagagtcgccccgta

SEQ ID NO: 23983 - DNA, 25 bp, Artificial Sequence
  Synthetic
agaccctataagttcaggttctgaa

SEQ ID NO: 23984 - DNA, 22 bp, Artificial Sequence
  Synthetic
ggggagggatttcaacgtgtta

SEQ ID NO: 23985 - DNA, 25 bp, Artificial Sequence
  Synthetic
gaacaatacgagtcagcagattagg

SEQ ID NO: 23986 - DNA, 25 bp, Artificial Sequence
  Synthetic
tgaaggagaatctatgatcatgccc

SEQ ID NO: 23987 - DNA, 25 bp, Artificial Sequence
  Synthetic
aatgttttacagatggctctttggt

SEQ ID NO: 23988 - DNA, 25 bp, Artificial Sequence
  Synthetic
tgtctttaacccagaaagagagaga

SEQ ID NO: 23989 - DNA, 20 bp, Artificial Sequence
  Synthetic
ccagccactggtgaacactg

SEQ ID NO: 23990 - DNA, 23 bp, Artificial Sequence
  Synthetic
ctcggatttaacaagcattgctg

SEQ ID NO: 23991 - DNA, 20 bp, Artificial Sequence
  Synthetic
gcagtttggcttcgaggtgc

SEQ ID NO: 23992 - DNA, 19 bp, Artificial Sequence
  Synthetic
ccagagacggtgttgcgcc

SEQ ID NO: 23993 - DNA, 22 bp, Artificial Sequence
  Synthetic
gtagacacccagttatgcagtg

SEQ ID NO: 23994 - DNA, 20 bp, Artificial Sequence
  Synthetic
agtaggtgcctccagagccc

SEQ ID NO: 23995 - DNA, 19 bp, Artificial Sequence
  Synthetic
ccggtatcgggccagaggt

SEQ ID NO: 23996 - DNA, 20 bp, Artificial Sequence
  Synthetic
cctggggccaccttcatcac

SEQ ID NO: 23997 - DNA, 20 bp, Artificial Sequence
  Synthetic
gtggctgcctttgggatgca

SEQ ID NO: 23998 - DNA, 21 bp, Artificial Sequence
  Synthetic
agttgatgatctgtaggcgca

SEQ ID NO: 23999 - DNA, 19 bp, Artificial Sequence
  Synthetic
atgcgggatctgccggtcg

SEQ ID NO: 24000 - DNA, 20 bp, Artificial Sequence
  Synthetic
actcgtgaggcaccccatcc

SEQ ID NO: 24001 - DNA, 20 bp, Artificial Sequence
  Synthetic
tccccgggagattcgcgaca

SEQ ID NO: 24002 - DNA, 21 bp, Artificial Sequence
  Synthetic
gtttcagatcccacgcctcca

SEQ ID NO: 24003 - DNA, 21 bp, Artificial Sequence
  Synthetic
agctatgcctcccgtcgactg

SEQ ID NO: 24004 - DNA, 20 bp, Artificial Sequence
  Synthetic
cggccaatcccggggtaact

SEQ ID NO: 24005 - DNA, 21 bp, Artificial Sequence
  Synthetic
cctgcgtagaacgatggggcg

SEQ ID NO: 24006 - DNA, 22 bp, Artificial Sequence
  Synthetic
gactctgtttccagccagaggg

SEQ ID NO: 24007 - DNA, 19 bp, Artificial Sequence
  Synthetic
ccgccatctcgtgggcctt

SEQ ID NO: 24008 - DNA, 19 bp, Artificial Sequence
  Synthetic
ggcctcattcgcctctcgc

SEQ ID NO: 24009 - DNA, 19 bp, Artificial Sequence
  Synthetic
gcaggcaggcctccagctt

SEQ ID NO: 24010 - DNA, 19 bp, Artificial Sequence
  Synthetic
gccgtgcctaggatgcgga

SEQ ID NO: 24011 - DNA, 18 bp, Artificial Sequence
  Synthetic
tgcgagcaaaggcggcga

SEQ ID NO: 24012 - DNA, 20 bp, Artificial Sequence
  Synthetic
tcgccagagggatctgcacc

SEQ ID NO: 24013 - DNA, 20 bp, Artificial Sequence
  Synthetic
cgacctcagctccgagtggg

SEQ ID NO: 24014 - DNA, 19 bp, Artificial Sequence
  Synthetic
cccacttttggcgcgacct

SEQ ID NO: 24015 - DNA, 19 bp, Artificial Sequence
  Synthetic
actcctgctggccctccct

SEQ ID NO: 24016 - DNA, 19 bp, Artificial Sequence
  Synthetic
catgagcaagggcccaggg

SEQ ID NO: 24017 - DNA, 18 bp, Artificial Sequence
  Synthetic
ttccggccgttagcgtgc

SEQ ID NO: 24018 - DNA, 20 bp, Artificial Sequence
  Synthetic
gcctctggctgttcagctcg

SEQ ID NO: 24019 - DNA, 18 bp, Artificial Sequence
  Synthetic
aggggtcagcggctgtca

SEQ ID NO: 24020 - DNA, 19 bp, Artificial Sequence
  Synthetic
cggccaggctctgaccaga

SEQ ID NO: 24021 - DNA, 19 bp, Artificial Sequence
  Synthetic
agatgcggcgcagacagcc

SEQ ID NO: 24022 - DNA, 20 bp, Artificial Sequence
  Synthetic
ctcgtcaggccgcgagagga

SEQ ID NO: 24023 - DNA, 19 bp, Artificial Sequence
  Synthetic
cctttgagcccgaggtgcc

SEQ ID NO: 24024 - DNA, 20 bp, Artificial Sequence
  Synthetic
gtagcgccgctgattctgga

SEQ ID NO: 24025 - DNA, 22 bp, Artificial Sequence
  Synthetic
tctgttccttctgctccagtgc

SEQ ID NO: 24026 - DNA, 19 bp, Artificial Sequence
  Synthetic
gatgcgcctgacgttgtgc

SEQ ID NO: 24027 - DNA, 25 bp, Artificial Sequence
  Synthetic
tcgaagagtttatatggatgtgcat

SEQ ID NO: 24028 - DNA, 22 bp, Artificial Sequence
  Synthetic
ttggcttctgacatctcccagc

SEQ ID NO: 24029 - DNA, 18 bp, Artificial Sequence
  Synthetic
agtagcgggcctcggtgt

SEQ ID NO: 24030 - DNA, 21 bp, Artificial Sequence
  Synthetic
gcagtggctatgcctccatgc

SEQ ID NO: 24031 - DNA, 22 bp, Artificial Sequence
  Synthetic
gagatggtgtccggagacccca

SEQ ID NO: 24032 - DNA, 21 bp, Artificial Sequence
  Synthetic
aagagccagggggggaagtcg

SEQ ID NO: 24033 - DNA, 21 bp, Artificial Sequence
  Synthetic
aagcctgcctcatccttgacc

SEQ ID NO: 24034 - DNA, 19 bp, Artificial Sequence
  Synthetic
ccctgggcttggttcgcct

SEQ ID NO: 24035 - DNA, 20 bp, Artificial Sequence
  Synthetic
tgggcagtaggctcggagtg

SEQ ID NO: 24036 - DNA, 19 bp, Artificial Sequence
  Synthetic
cccgcctggtgctggaagt

SEQ ID NO: 24037 - DNA, 22 bp, Artificial Sequence
  Synthetic
agatggccatcagtaggcaccc

SEQ ID NO: 24038 - DNA, 20 bp, Artificial Sequence
  Synthetic
cagtcctaggtcagcggccg

SEQ ID NO: 24039 - DNA, 22 bp, Artificial Sequence
  Synthetic
tgtgctggaaagagaggctgga

SEQ ID NO: 24040 - DNA, 19 bp, Artificial Sequence
  Synthetic
tgggacctggggccgtaga

SEQ ID NO: 24041 - DNA, 19 bp, Artificial Sequence
  Synthetic
tgctgtatgcctcgcagcg

SEQ ID NO: 24042 - DNA, 20 bp, Artificial Sequence
  Synthetic
ggggggcctggagtcgatca

SEQ ID NO: 24043 - DNA, 18 bp, Artificial Sequence
  Synthetic
tggcacgcgattggggca

SEQ ID NO: 24044 - DNA, 18 bp, Artificial Sequence
  Synthetic
aagggcgcacaccactcc

SEQ ID NO: 24045 - DNA, 19 bp, Artificial Sequence
  Synthetic
acaccctcaacccccgagt

SEQ ID NO: 24046 - DNA, 19 bp, Artificial Sequence
  Synthetic
gccctccagatcgccacct

SEQ ID NO: 24047 - DNA, 22 bp, Artificial Sequence
  Synthetic
tgacggatgtctttaacggcgc

SEQ ID NO: 24048 - DNA, 22 bp, Artificial Sequence
  Synthetic
gcgtaacgtcattgtccaccga

SEQ ID NO: 24049 - DNA, 20 bp, Artificial Sequence
  Synthetic
actgacccccttgagcacgc

SEQ ID NO: 24050 - DNA, 21 bp, Artificial Sequence
  Synthetic
gtgtcctggtttaaggccgca

SEQ ID NO: 24051 - DNA, 19 bp, Artificial Sequence
  Synthetic
tgtacccatcccggccctc

SEQ ID NO: 24052 - DNA, 21 bp, Artificial Sequence
  Synthetic
tcgatgagggagcaaacaccc

SEQ ID NO: 24053 - DNA, 21 bp, Artificial Sequence
  Synthetic
gtggtcagcagcagatagtga

SEQ ID NO: 24054 - DNA, 19 bp, Artificial Sequence
  Synthetic
cgtagcaccacgtggctgc

SEQ ID NO: 24055 - DNA, 19 bp, Artificial Sequence
  Synthetic
cgctctccgggcacgtctt

SEQ ID NO: 24056 - DNA, 21 bp, Artificial Sequence
  Synthetic
cccgtgcctccttactacgga

SEQ ID NO: 24057 - DNA, 19 bp, Artificial Sequence
  Synthetic
aggcctctgcgtccggagt

SEQ ID NO: 24058 - DNA, 21 bp, Artificial Sequence
  Synthetic
ctggatgagggagcgccaatt

SEQ ID NO: 24059 - DNA, 19 bp, Artificial Sequence
  Synthetic
ccagggtccccacagtgga

SEQ ID NO: 24060 - DNA, 19 bp, Artificial Sequence
  Synthetic
gggcagttcctcgttgcgc

SEQ ID NO: 24061 - DNA, 19 bp, Artificial Sequence
  Synthetic
cagacgcccccagccctaa

SEQ ID NO: 24062 - DNA, 20 bp, Artificial Sequence
  Synthetic
ccaccaccgtcagggagtct

SEQ ID NO: 24063 - DNA, 19 bp, Artificial Sequence
  Synthetic
cacgttgctgggtggggga

SEQ ID NO: 24064 - DNA, 20 bp, Artificial Sequence
  Synthetic
ctgtcctcccagggacccga

SEQ ID NO: 24065 - DNA, 22 bp, Artificial Sequence
  Synthetic
ggtggttacaggagacgtgggt

SEQ ID NO: 24066 - DNA, 19 bp, Artificial Sequence
  Synthetic
cgtagctcaccgccagctc

SEQ ID NO: 24067 - DNA, 22 bp, Artificial Sequence
  Synthetic
aacgatggaatggccaccaggt

SEQ ID NO: 24068 - DNA, 19 bp, Artificial Sequence
  Synthetic
gcaccgtcaggcacctgtg

SEQ ID NO: 24069 - DNA, 22 bp, Artificial Sequence
  Synthetic
gagtctgcgatagagggccagg

SEQ ID NO: 24070 - DNA, 21 bp, Artificial Sequence
  Synthetic
cgtacgtgcgtgtctttgccc

SEQ ID NO: 24071 - DNA, 21 bp, Artificial Sequence
  Synthetic
tggactcagccaccttgtcgt

SEQ ID NO: 24072 - DNA, 19 bp, Artificial Sequence
  Synthetic
gccgctgggtgacacagac

SEQ ID NO: 24073 - DNA, 22 bp, Artificial Sequence
  Synthetic
tttcaggctttgcaaacacagt

SEQ ID NO: 24074 - DNA, 22 bp, Artificial Sequence
  Synthetic
atagggtggacggtgagcaacc

SEQ ID NO: 24075 - DNA, 23 bp, Artificial Sequence
  Synthetic
aacaacatgtttggactgggtag

SEQ ID NO: 24076 - DNA, 20 bp, Artificial Sequence
  Synthetic
agaagtacgcctgctgcatt

SEQ ID NO: 24077 - DNA, 25 bp, Artificial Sequence
  Synthetic
gtagacattataaacgagcagagca

SEQ ID NO: 24078 - DNA, 21 bp, Artificial Sequence
  Synthetic
tttgggtggggttgtcatttc

SEQ ID NO: 24079 - DNA, 25 bp, Artificial Sequence
  Synthetic
atgtgttgttatttaaggcaaggga

SEQ ID NO: 24080 - DNA, 24 bp, Artificial Sequence
  Synthetic
gctggaaaaaaaaaggctacactg

SEQ ID NO: 24081 - DNA, 22 bp, Artificial Sequence
  Synthetic
aaacctactgaccacggacccg

SEQ ID NO: 24082 - DNA, 25 bp, Artificial Sequence
  Synthetic
accaggatatatgtcattgtttgca

SEQ ID NO: 24083 - DNA, 25 bp, Artificial Sequence
  Synthetic
tactgctactacgtgtacataacct

SEQ ID NO: 24084 - DNA, 20 bp, Artificial Sequence
  Synthetic
ctcctactcctgtagtgccg

SEQ ID NO: 24085 - DNA, 25 bp, Artificial Sequence
  Synthetic
aaatcgtatagttgtccccaaagtg

SEQ ID NO: 24086 - DNA, 24 bp, Artificial Sequence
  Synthetic
gctgtttgatgttaatcctggtga

SEQ ID NO: 24087 - DNA, 25 bp, Artificial Sequence
  Synthetic
tatcagattatttcgaatggctgca

SEQ ID NO: 24088 - DNA, 20 bp, Artificial Sequence
  Synthetic
actggctacaacgtgcacag

SEQ ID NO: 24089 - DNA, 23 bp, Artificial Sequence
  Synthetic
ggtgatacctaccgctttttaca

SEQ ID NO: 24090 - DNA, 20 bp, Artificial Sequence
  Synthetic
cagtgaccatgccctgcctt

SEQ ID NO: 24091 - DNA, 24 bp, Artificial Sequence
  Synthetic
ccattgtttggggcatatagttgt

SEQ ID NO: 24092 - DNA, 22 bp, Artificial Sequence
  Synthetic
ataccacttctgtcactggctg

SEQ ID NO: 24093 - DNA, 20 bp, Artificial Sequence
  Synthetic
tcctgaagaggaggagcgac

SEQ ID NO: 24094 - DNA, 24 bp, Artificial Sequence
  Synthetic
aaaacgaaagtatctgacaagccc

SEQ ID NO: 24095 - DNA, 21 bp, Artificial Sequence
  Synthetic
tgaagttatgtgccagcctcc

SEQ ID NO: 24096 - DNA, 25 bp, Artificial Sequence
  Synthetic
ggcagcatggataaataaatgttgc

SEQ ID NO: 24097 - DNA, 23 bp, Artificial Sequence
  Synthetic
aaaagctggctattccgttgatg

SEQ ID NO: 24098 - DNA, 22 bp, Artificial Sequence
  Synthetic
agaagaaccaggtcccctcagc

SEQ ID NO: 24099 - DNA, 24 bp, Artificial Sequence
  Synthetic
attcctttggaaactttacctcca

SEQ ID NO: 24100 - DNA, 20 bp, Artificial Sequence
  Synthetic
ctgacccgattcctcccaga

SEQ ID NO: 24101 - DNA, 24 bp, Artificial Sequence
  Synthetic
agcccaatttcgactattgttgaa

SEQ ID NO: 24102 - DNA, 23 bp, Artificial Sequence
  Synthetic
aattgcctttcagatgacactgt

SEQ ID NO: 24103 - DNA, 21 bp, Artificial Sequence
  Synthetic
ggttgtgaaccagcgttaggt

SEQ ID NO: 24104 - DNA, 22 bp, Artificial Sequence
  Synthetic
tttcagctgaattgtcccagtt

SEQ ID NO: 24105 - DNA, 21 bp, Artificial Sequence
  Synthetic
ttgcggaacagcattaacaga

SEQ ID NO: 24106 - DNA, 22 bp, Artificial Sequence
  Synthetic
gcttgcctgcagtgttggaaac

SEQ ID NO: 24107 - DNA, 21 bp, Artificial Sequence
  Synthetic
ctccaggagcttctgttgggc

SEQ ID NO: 24108 - DNA, 21 bp, Artificial Sequence
  Synthetic
acagacagcaggaggcacaag

SEQ ID NO: 24109 - DNA, 20 bp, Artificial Sequence
  Synthetic
gcacagggggggtacaggaa

SEQ ID NO: 24110 - DNA, 23 bp, Artificial Sequence
  Synthetic
cagcaacactgtcaatatgcaca

SEQ ID NO: 24111 - DNA, 25 bp, Artificial Sequence
  Synthetic
agaaacaccagaatggattgtaaga

SEQ ID NO: 24112 - DNA, 24 bp, Artificial Sequence
  Synthetic
ggcacaaatgacaatgtcagaatg

SEQ ID NO: 24113 - DNA, 21 bp, Artificial Sequence
  Synthetic
gctgcagccattatgtgatgc

SEQ ID NO: 24114 - DNA, 23 bp, Artificial Sequence
  Synthetic
tgatgcaaactggaaatgcttct

SEQ ID NO: 24115 - DNA, 20 bp, Artificial Sequence
  Synthetic
acatggaccaaggtgtctgg

SEQ ID NO: 24116 - DNA, 22 bp, Artificial Sequence
  Synthetic
acagaagacaggatccagcggc

SEQ ID NO: 24117 - DNA, 21 bp, Artificial Sequence
  Synthetic
gatggtcaacgtgcagtaaca

SEQ ID NO: 24118 - DNA, 24 bp, Artificial Sequence
  Synthetic
tggcgttactgcttttcttattgt

SEQ ID NO: 24119 - DNA, 23 bp, Artificial Sequence
  Synthetic
atcctgtagtactgtggacacct

SEQ ID NO: 24120 - DNA, 19 bp, Artificial Sequence
  Synthetic
attgggacccgacccccca

SEQ ID NO: 24121 - DNA, 25 bp, Artificial Sequence
  Synthetic
acagaggaaaccatactatttgagc

SEQ ID NO: 24122 - DNA, 23 bp, Artificial Sequence
  Synthetic
gttcccaaggtgtctggatatca

SEQ ID NO: 24123 - DNA, 25 bp, Artificial Sequence
  Synthetic
acccagctatttattatagggtgca

SEQ ID NO: 24124 - DNA, 24 bp, Artificial Sequence
  Synthetic
tctgtttacgtagggaacagatgt

SEQ ID NO: 24125 - DNA, 24 bp, Artificial Sequence
  Synthetic
actacacgtagcaccaatatgact

SEQ ID NO: 24126 - DNA, 24 bp, Artificial Sequence
  Synthetic
gtactgttgtgtatgtatgggtgg

SEQ ID NO: 24127 - DNA, 20 bp, Artificial Sequence
  Synthetic
ccggtttcggtcgtgcacaa

SEQ ID NO: 24128 - DNA, 22 bp, Artificial Sequence
  Synthetic
tgagtgtcgtacagcctccagg

SEQ ID NO: 24129 - DNA, 20 bp, Artificial Sequence
  Synthetic
gcgcgcgacaaggaagactt

SEQ ID NO: 24130 - DNA, 19 bp, Artificial Sequence
  Synthetic
cgccagagctctcgcgcat

SEQ ID NO: 24131 - DNA, 21 bp, Artificial Sequence
  Synthetic
tctcaccgaatgtggccgtgc

SEQ ID NO: 24132 - DNA, 20 bp, Artificial Sequence
  Synthetic
cgtcatgttcggcttggcct

SEQ ID NO: 24133 - DNA, 20 bp, Artificial Sequence
  Synthetic
ggatggggcgccttgcaata

SEQ ID NO: 24134 - DNA, 20 bp, Artificial Sequence
  Synthetic
tgacttcaacgccagcacgg

SEQ ID NO: 24135 - DNA, 22 bp, Artificial Sequence
  Synthetic
ccttgctcttactcggacctgc

SEQ ID NO: 24136 - DNA, 21 bp, Artificial Sequence
  Synthetic
attccctcactggcctgtggt

SEQ ID NO: 24137 - DNA, 22 bp, Artificial Sequence
  Synthetic
ctaaaaggtgctttgacgcgcg

SEQ ID NO: 24138 - DNA, 22 bp, Artificial Sequence
  Synthetic
tggcccagctgatggctatacc

SEQ ID NO: 24139 - DNA, 22 bp, Artificial Sequence
  Synthetic
tcacgcagatgtactccagtgc

SEQ ID NO: 24140 - DNA, 21 bp, Artificial Sequence
  Synthetic
caggtcgggtacttgcatgcc

SEQ ID NO: 24141 - DNA, 22 bp, Artificial Sequence
  Synthetic
ctaccaccatccttggcatcgg

SEQ ID NO: 24142 - DNA, 20 bp, Artificial Sequence
  Synthetic
caccgacgccctcatgacag

SEQ ID NO: 24143 - DNA, 20 bp, Artificial Sequence
  Synthetic
ccgtcaggctcagggcgtat

SEQ ID NO: 24144 - DNA, 22 bp, Artificial Sequence
  Synthetic
atacatcgccacctgcatgcaa

SEQ ID NO: 24145 - DNA, 22 bp, Artificial Sequence
  Synthetic
ttctgggccaaacacatgtgga

SEQ ID NO: 24146 - DNA, 22 bp, Artificial Sequence
  Synthetic
tgtcgtcaacttgctgcctgga

SEQ ID NO: 24147 - DNA, 20 bp, Artificial Sequence
  Synthetic
cgaaacccgcgccaaacttt

SEQ ID NO: 24148 - DNA, 18 bp, Artificial Sequence
  Synthetic
cgtttagcgcgggggtca

SEQ ID NO: 24149 - DNA, 20 bp, Artificial Sequence
  Synthetic
cctgggcacggcctgattac

SEQ ID NO: 24150 - DNA, 22 bp, Artificial Sequence
  Synthetic
acctggagcctgagcaggtaga

SEQ ID NO: 24151 - DNA, 20 bp, Artificial Sequence
  Synthetic
cgcaaggctcctcaccatgg

SEQ ID NO: 24152 - DNA, 22 bp, Artificial Sequence
  Synthetic
tggattccagtattcccccgct

SEQ ID NO: 24153 - DNA, 20 bp, Artificial Sequence
  Synthetic
aatcgcgcccacaatgctgg

SEQ ID NO: 24154 - DNA, 20 bp, Artificial Sequence
  Synthetic
gggctgcctgggaaacagtt

SEQ ID NO: 24155 - DNA, 19 bp, Artificial Sequence
  Synthetic
ccacccctcagagcgtgga

SEQ ID NO: 24156 - DNA, 21 bp, Artificial Sequence
  Synthetic
cgcgattgatgcggatttgcc

SEQ ID NO: 24157 - DNA, 20 bp, Artificial Sequence
  Synthetic
cgaggtgggcgtaacgcttg

SEQ ID NO: 24158 - DNA, 21 bp, Artificial Sequence
  Synthetic
tcatgcccgggaagagtttgc

SEQ ID NO: 24159 - DNA, 19 bp, Artificial Sequence
  Synthetic
gggcggacaatgccgtctg

SEQ ID NO: 24160 - DNA, 20 bp, Artificial Sequence
  Synthetic
cagcgtcagtccgaacgtcc

SEQ ID NO: 24161 - DNA, 22 bp, Artificial Sequence
  Synthetic
gcgaaccgaaaacccaataccg

SEQ ID NO: 24162 - DNA, 22 bp, Artificial Sequence
  Synthetic
gaccaatacatcggcggcatcg

SEQ ID NO: 24163 - DNA, 20 bp, Artificial Sequence
  Synthetic
gcaaaatcaccgtcgccgcc

SEQ ID NO: 24164 - DNA, 20 bp, Artificial Sequence
  Synthetic
gctcccaagccgaaacgtga

SEQ ID NO: 24165 - DNA, 19 bp, Artificial Sequence
  Synthetic
gtgatgcggccgccgactt

SEQ ID NO: 24166 - DNA, 21 bp, Artificial Sequence
  Synthetic
aaccgggaatcaggtcggtgg

SEQ ID NO: 24167 - DNA, 19 bp, Artificial Sequence
  Synthetic
ggggtgtgcgtgccggaaa

SEQ ID NO: 24168 - DNA, 20 bp, Artificial Sequence
  Synthetic
ccgcccgcgacaatgtagtt

SEQ ID NO: 24169 - DNA, 20 bp, Artificial Sequence
  Synthetic
gcgcttttgggcgaacagcg

SEQ ID NO: 24170 - DNA, 19 bp, Artificial Sequence
  Synthetic
ggcagggaataccgcccgt

SEQ ID NO: 24171 - DNA, 19 bp, Artificial Sequence
  Synthetic
ccgccctgcaagccgatgt

SEQ ID NO: 24172 - DNA, 22 bp, Artificial Sequence
  Synthetic
gcttcctgccatttgctgtcgg

SEQ ID NO: 24173 - DNA, 20 bp, Artificial Sequence
  Synthetic
agtttcaccgccaccaacgc

SEQ ID NO: 24174 - DNA, 19 bp, Artificial Sequence
  Synthetic
ttcgtcccaagccggacac

SEQ ID NO: 24175 - DNA, 19 bp, Artificial Sequence
  Synthetic
ccgcgtttcgggcaactcg

SEQ ID NO: 24176 - DNA, 18 bp, Artificial Sequence
  Synthetic
ggtacgcgccgtggatga

SEQ ID NO: 24177 - DNA, 20 bp, Artificial Sequence
  Synthetic
ccgctttgccgtggaacagt

SEQ ID NO: 24178 - DNA, 19 bp, Artificial Sequence
  Synthetic
tgcaggtggaggtagcgcg

SEQ ID NO: 24179 - DNA, 20 bp, Artificial Sequence
  Synthetic
tagagcagttcggcgtgtgc

SEQ ID NO: 24180 - DNA, 22 bp, Artificial Sequence
  Synthetic
gccgccctaccgacttgataat

SEQ ID NO: 24181 - DNA, 20 bp, Artificial Sequence
  Synthetic
cgcgtgtcgcccaaaatgac

SEQ ID NO: 24182 - DNA, 22 bp, Artificial Sequence
  Synthetic
ccaaaaacgcctcgaatcgtgg

SEQ ID NO: 24183 - DNA, 21 bp, Artificial Sequence
  Synthetic
ttatgccgtctgtcgaacggc

SEQ ID NO: 24184 - DNA, 19 bp, Artificial Sequence
  Synthetic
ggcggagagtgcaccgtgt

SEQ ID NO: 24185 - DNA, 22 bp, Artificial Sequence
  Synthetic
ttcgggccgatgaaggtaaagc

SEQ ID NO: 24186 - DNA, 22 bp, Artificial Sequence
  Synthetic
gattcgtcggcgagtttgacgt

SEQ ID NO: 24187 - DNA, 18 bp, Artificial Sequence
  Synthetic
cgccggtggctttggaga

SEQ ID NO: 24188 - DNA, 21 bp, Artificial Sequence
  Synthetic
acgtcttccaatgtcagcggc

SEQ ID NO: 24189 - DNA, 19 bp, Artificial Sequence
  Synthetic
cgggtgtcgatgtcggcga

SEQ ID NO: 24190 - DNA, 18 bp, Artificial Sequence
  Synthetic
cgatgtgcgcgacaggga

SEQ ID NO: 24191 - DNA, 19 bp, Artificial Sequence
  Synthetic
ggcgttgcccagttgcagg

SEQ ID NO: 24192 - DNA, 20 bp, Artificial Sequence
  Synthetic
cctgcgaaatgctggtcgga

SEQ ID NO: 24193 - DNA, 20 bp, Artificial Sequence
  Synthetic
cgctcccttgcctacgatgc

SEQ ID NO: 24194 - DNA, 20 bp, Artificial Sequence
  Synthetic
gaccccagcttcaaagccgc

SEQ ID NO: 24195 - DNA, 20 bp, Artificial Sequence
  Synthetic
gttccgaccagtggggcaac

SEQ ID NO: 24196 - DNA, 21 bp, Artificial Sequence
  Synthetic
atcagccccctgcgtaccaaa

SEQ ID NO: 24197 - DNA, 22 bp, Artificial Sequence
  Synthetic
tcagtggtttgtcggcatggac

SEQ ID NO: 24198 - DNA, 19 bp, Artificial Sequence
  Synthetic
ccgccgccatcgagccttt

SEQ ID NO: 24199 - DNA, 19 bp, Artificial Sequence
  Synthetic
catggcagggcaggccgaa

SEQ ID NO: 24200 - DNA, 22 bp, Artificial Sequence
  Synthetic
tcttcgaggctgacgaaggcga

SEQ ID NO: 24201 - DNA, 20 bp, Artificial Sequence
  Synthetic
tcgatgctgtcgaacgcgcc

SEQ ID NO: 24202 - DNA, 22 bp, Artificial Sequence
  Synthetic
gattcgtccgcctgatacacgg

SEQ ID NO: 24203 - DNA, 18 bp, Artificial Sequence
  Synthetic
tgcggcgaggcgtgcatt

SEQ ID NO: 24204 - DNA, 21 bp, Artificial Sequence
  Synthetic
cgtccaaacgcgccatttcgc

SEQ ID NO: 24205 - DNA, 18 bp, Artificial Sequence
  Synthetic
tcgtgccacggcagcatg

SEQ ID NO: 24206 - DNA, 19 bp, Artificial Sequence
  Synthetic
cgccacggcgtgttgtcga

SEQ ID NO: 24207 - DNA, 21 bp, Artificial Sequence
  Synthetic
tgtttggtccgtcgggttcgg

SEQ ID NO: 24208 - DNA, 21 bp, Artificial Sequence
  Synthetic
aacaaccagaatgaggcggca

SEQ ID NO: 24209 - DNA, 21 bp, Artificial Sequence
  Synthetic
gcggcaacatgcacgatacga

SEQ ID NO: 24210 - DNA, 18 bp, Artificial Sequence
  Synthetic
ccgtcagcggcaacagca

SEQ ID NO: 24211 - DNA, 19 bp, Artificial Sequence
  Synthetic
gccgccgtctgcatcagca

SEQ ID NO: 24212 - DNA, 20 bp, Artificial Sequence
  Synthetic
cggcacgcaaaacctgtacg

SEQ ID NO: 24213 - DNA, 22 bp, Artificial Sequence
  Synthetic
cgttgtgcattgaagggcgaac

SEQ ID NO: 24214 - DNA, 19 bp, Artificial Sequence
  Synthetic
cggcgacgggggaatttgc

SEQ ID NO: 24215 - DNA, 22 bp, Artificial Sequence
  Synthetic
cgccgtaacccatttccgcttc

SEQ ID NO: 24216 - DNA, 22 bp, Artificial Sequence
  Synthetic
caacacgctgttgggtatggga

SEQ ID NO: 24217 - DNA, 19 bp, Artificial Sequence
  Synthetic
tttgccgtatccgggcggt

SEQ ID NO: 24218 - DNA, 20 bp, Artificial Sequence
  Synthetic
ggtggaacggaagctgctgg

SEQ ID NO: 24219 - DNA, 22 bp, Artificial Sequence
  Synthetic
ccgctgtcggcttcaaaatggt

SEQ ID NO: 24220 - DNA, 19 bp, Artificial Sequence
  Synthetic
gtttgcgcgtcagctcgac

SEQ ID NO: 24221 - DNA, 21 bp, Artificial Sequence
  Synthetic
ttttccggcaggagcttgtcg

SEQ ID NO: 24222 - DNA, 21 bp, Artificial Sequence
  Synthetic
gcgtgccgcagattttcatcg

SEQ ID NO: 24223 - DNA, 22 bp, Artificial Sequence
  Synthetic
aagcctgcgccttttgcattcg

SEQ ID NO: 24224 - DNA, 21 bp, Artificial Sequence
  Synthetic
aagtcggcgtagatgtgccca

SEQ ID NO: 24225 - DNA, 22 bp, Artificial Sequence
  Synthetic
aaccctgaaatcgtcgaagcgc

SEQ ID NO: 24226 - DNA, 19 bp, Artificial Sequence
  Synthetic
gaaccggcgggcaggatgt

SEQ ID NO: 24227 - DNA, 19 bp, Artificial Sequence
  Synthetic
ccggcgatggtctgcctga

SEQ ID NO: 24228 - DNA, 20 bp, Artificial Sequence
  Synthetic
aaaggtcgatgacgcgcacg

SEQ ID NO: 24229 - DNA, 20 bp, Artificial Sequence
  Synthetic
aatcggcaactgcggttccc

SEQ ID NO: 24230 - DNA, 20 bp, Artificial Sequence
  Synthetic
gctttcagacgacgtcaggt

SEQ ID NO: 24231 - DNA, 20 bp, Artificial Sequence
  Synthetic
gcaaggtcggcggcgcttta

SEQ ID NO: 24232 - DNA, 21 bp, Artificial Sequence
  Synthetic
catgttgcgcgggatttctgg

SEQ ID NO: 24233 - DNA, 19 bp, Artificial Sequence
  Synthetic
gggcatgaccgccgccata

SEQ ID NO: 24234 - DNA, 22 bp, Artificial Sequence
  Synthetic
aacgtggtcgatgtggttgcag

SEQ ID NO: 24235 - DNA, 19 bp, Artificial Sequence
  Synthetic
atgccgaacgtcccccagc

SEQ ID NO: 24236 - DNA, 21 bp, Artificial Sequence
  Synthetic
aggcagtggagtcgaggatgt

SEQ ID NO: 24237 - DNA, 18 bp, Artificial Sequence
  Synthetic
gggttgccgccgaccaaa

SEQ ID NO: 24238 - DNA, 20 bp, Artificial Sequence
  Synthetic
ttgatgccgacgacctgtcc

SEQ ID NO: 24239 - DNA, 21 bp, Artificial Sequence
  Synthetic
gcttcgccgtcgccttgttta

SEQ ID NO: 24240 - DNA, 22 bp, Artificial Sequence
  Synthetic
ttcgcgcccaaccgttatttgg

SEQ ID NO: 24241 - DNA, 21 bp, Artificial Sequence
  Synthetic
aaaaccctgcaccgcagtgat

SEQ ID NO: 24242 - DNA, 19 bp, Artificial Sequence
  Synthetic
gtagcgcgctgatgcagga

SEQ ID NO: 24243 - DNA, 19 bp, Artificial Sequence
  Synthetic
cgcaaggcaggccgtggtt

SEQ ID NO: 24244 - DNA, 20 bp, Artificial Sequence
  Synthetic
gggttcggacggcatctgtc

SEQ ID NO: 24245 - DNA, 22 bp, Artificial Sequence
  Synthetic
agccataagctgcccgtttcgg

SEQ ID NO: 24246 - DNA, 20 bp, Artificial Sequence
  Synthetic
gggtatggacggcagcaagg

SEQ ID NO: 24247 - DNA, 19 bp, Artificial Sequence
  Synthetic
tgctcctgctcgcccacga

SEQ ID NO: 24248 - DNA, 18 bp, Artificial Sequence
  Synthetic
agacggatgcgagggcgt

SEQ ID NO: 24249 - DNA, 21 bp, Artificial Sequence
  Synthetic
gggtaccttccacgacgcgta

SEQ ID NO: 24250 - DNA, 19 bp, Artificial Sequence
  Synthetic
ctgcgggcagttcgttggt

SEQ ID NO: 24251 - DNA, 21 bp, Artificial Sequence
  Synthetic
tttgggcgtgtcgtgtgttcc

SEQ ID NO: 24252 - DNA, 19 bp, Artificial Sequence
  Synthetic
gcaaggtggcggctgtcga

SEQ ID NO: 24253 - DNA, 21 bp, Artificial Sequence
  Synthetic
gccgctgcaagggcttttttg

SEQ ID NO: 24254 - DNA, 20 bp, Artificial Sequence
  Synthetic
tccgttgcggatgtggtggg

SEQ ID NO: 24255 - DNA, 22 bp, Artificial Sequence
  Synthetic
atgaggaagttgcagtgtcggg

SEQ ID NO: 24256 - DNA, 21 bp, Artificial Sequence
  Synthetic
tgtgcaggctgtgtccgaagc

SEQ ID NO: 24257 - DNA, 20 bp, Artificial Sequence
  Synthetic
ggtgcgttgttctgttcgcc

SEQ ID NO: 24258 - DNA, 20 bp, Artificial Sequence
  Synthetic
ggaggcggtcagtatgccga

SEQ ID NO: 24259 - DNA, 22 bp, Artificial Sequence
  Synthetic
tttccgcaggttcggctgtact

SEQ ID NO: 24260 - DNA, 20 bp, Artificial Sequence
  Synthetic
aggctgtgttcgagttcggg

SEQ ID NO: 24261 - DNA, 20 bp, Artificial Sequence
  Synthetic
gggaagcggccgatgtgttt

SEQ ID NO: 24262 - DNA, 20 bp, Artificial Sequence
  Synthetic
gcttttcgcgtgatgccccg

SEQ ID NO: 24263 - DNA, 19 bp, Artificial Sequence
  Synthetic
ggtgcaggcggggtggaaa

SEQ ID NO: 24264 - DNA, 24 bp, Artificial Sequence
  Synthetic
ttgatggctttaggttttgtcgtt

SEQ ID NO: 24265 - DNA, 19 bp, Artificial Sequence
  Synthetic
caggttgcggctgccttct

SEQ ID NO: 24266 - DNA, 19 bp, Artificial Sequence
  Synthetic
caggtgtcgccgctgacga

SEQ ID NO: 24267 - DNA, 21 bp, Artificial Sequence
  Synthetic
agcgtgtgttttcggggttga

SEQ ID NO: 24268 - DNA, 19 bp, Artificial Sequence
  Synthetic
ccgacggtcagcgggatga

SEQ ID NO: 24269 - DNA, 20 bp, Artificial Sequence
  Synthetic
acgccatgtttttcggcggc

SEQ ID NO: 24270 - DNA, 18 bp, Artificial Sequence
  Synthetic
tggcactgcgttggacgg

SEQ ID NO: 24271 - DNA, 18 bp, Artificial Sequence
  Synthetic
agcgcgtcggcatcggta

SEQ ID NO: 24272 - DNA, 21 bp, Artificial Sequence
  Synthetic
aaccagtcgtcgcttttgcct

SEQ ID NO: 24273 - DNA, 19 bp, Artificial Sequence
  Synthetic
ctcttgcgccgtcctgcct

SEQ ID NO: 24274 - DNA, 18 bp, Artificial Sequence
  Synthetic
agcagggtggcggtcaac

SEQ ID NO: 24275 - DNA, 18 bp, Artificial Sequence
  Synthetic
cgcctttgccgcgtgttt

SEQ ID NO: 24276 - DNA, 20 bp, Artificial Sequence
  Synthetic
gtttgcgacagtcggccatg

SEQ ID NO: 24277 - DNA, 22 bp, Artificial Sequence
  Synthetic
ttcgacaatgccggtaatgcgt

SEQ ID NO: 24278 - DNA, 21 bp, Artificial Sequence
  Synthetic
gacgtgttcctcgggttgcag

SEQ ID NO: 24279 - DNA, 19 bp, Artificial Sequence
  Synthetic
agccttcaacggcactgca

SEQ ID NO: 24280 - DNA, 20 bp, Artificial Sequence
  Synthetic
ccggcaaaatgcaggcaggc

SEQ ID NO: 24281 - DNA, 19 bp, Artificial Sequence
  Synthetic
acgatgatgcccatcccgc

SEQ ID NO: 24282 - DNA, 20 bp, Artificial Sequence
  Synthetic
ggagagggcggcgggtatca

SEQ ID NO: 24283 - DNA, 22 bp, Artificial Sequence
  Synthetic
tcgaaacagccttggatgtcgc

SEQ ID NO: 24284 - DNA, 19 bp, Artificial Sequence
  Synthetic
ttttggacacgctgccgga

SEQ ID NO: 24285 - DNA, 22 bp, Artificial Sequence
  Synthetic
gaacggattcggtttgcttggc

SEQ ID NO: 24286 - DNA, 19 bp, Artificial Sequence
  Synthetic
ggtatgctgggcgcgtcga

SEQ ID NO: 24287 - DNA, 22 bp, Artificial Sequence
  Synthetic
aagccacttcgataaaggcggc

SEQ ID NO: 24288 - DNA, 22 bp, Artificial Sequence
  Synthetic
tcggcaatctggaaatggtcgt

SEQ ID NO: 24289 - DNA, 19 bp, Artificial Sequence
  Synthetic
cacttctcccgcccccgaa

SEQ ID NO: 24290 - DNA, 20 bp, Artificial Sequence
  Synthetic
accgcatccgtgccgtattc

SEQ ID NO: 24291 - DNA, 19 bp, Artificial Sequence
  Synthetic
acaggcgcgcgagaaagac

SEQ ID NO: 24292 - DNA, 18 bp, Artificial Sequence
  Synthetic
aaacaggtgcgccgacgg

SEQ ID NO: 24293 - DNA, 19 bp, Artificial Sequence
  Synthetic
tcctgtggcacggctaccc

SEQ ID NO: 24294 - DNA, 19 bp, Artificial Sequence
  Synthetic
cgccgtgcggttgccgata

SEQ ID NO: 24295 - DNA, 18 bp, Artificial Sequence
  Synthetic
cccgaaggcagcgcgttt

SEQ ID NO: 24296 - DNA, 19 bp, Artificial Sequence
  Synthetic
agccgcccgcctcgttttg

SEQ ID NO: 24297 - DNA, 22 bp, Artificial Sequence
  Synthetic
aggcgcacaaattcttcctcgg

SEQ ID NO: 24298 - DNA, 18 bp, Artificial Sequence
  Synthetic
gcgatgtttgccgccgtc

SEQ ID NO: 24299 - DNA, 21 bp, Artificial Sequence
  Synthetic
ggtggttttcgtcgtggaggc

SEQ ID NO: 24300 - DNA, 19 bp, Artificial Sequence
  Synthetic
ccggtgatgcggacggctt

SEQ ID NO: 24301 - DNA, 20 bp, Artificial Sequence
  Synthetic
tcgctgtcggtttgcgaacc

SEQ ID NO: 24302 - DNA, 20 bp, Artificial Sequence
  Synthetic
cgttttcggcggcggatttc

SEQ ID NO: 24303 - DNA, 21 bp, Artificial Sequence
  Synthetic
gtctgtcgtcgaggcattcca

SEQ ID NO: 24304 - DNA, 22 bp, Artificial Sequence
  Synthetic
acgaaaacggccaagtcttggg

SEQ ID NO: 24305 - DNA, 24 bp, Artificial Sequence
  Synthetic
cctgttaacaagaaacggttttgc

SEQ ID NO: 24306 - DNA, 20 bp, Artificial Sequence
  Synthetic
cgactaccgttgctatgcgt

SEQ ID NO: 24307 - DNA, 18 bp, Artificial Sequence
  Synthetic
aattccgcgcgcgggcat

SEQ ID NO: 24308 - DNA, 19 bp, Artificial Sequence
  Synthetic
gccaaccatccgcttgccg

SEQ ID NO: 24309 - DNA, 19 bp, Artificial Sequence
  Synthetic
gcactgtttgccgagcgcg

SEQ ID NO: 24310 - DNA, 19 bp, Artificial Sequence
  Synthetic
tgaagggcgatgtcccgcg

SEQ ID NO: 24311 - DNA, 22 bp, Artificial Sequence
  Synthetic
ggctttggggcgacaaacagac

SEQ ID NO: 24312 - DNA, 20 bp, Artificial Sequence
  Synthetic
gccagcggctttccacaatg

SEQ ID NO: 24313 - DNA, 19 bp, Artificial Sequence
  Synthetic
aacgacgacgcgcaggtgg

SEQ ID NO: 24314 - DNA, 19 bp, Artificial Sequence
  Synthetic
gtttgcccgaacgtgcggt

SEQ ID NO: 24315 - DNA, 21 bp, Artificial Sequence
  Synthetic
gcagggcagtgtgtatccagt

SEQ ID NO: 24316 - DNA, 21 bp, Artificial Sequence
  Synthetic
aaacagtcatgccgatgccga

SEQ ID NO: 24317 - DNA, 22 bp, Artificial Sequence
  Synthetic
acgcatgatatttggctggcgg

SEQ ID NO: 24318 - DNA, 21 bp, Artificial Sequence
  Synthetic
cgccgtacacgaggtcttccg

SEQ ID NO: 24319 - DNA, 22 bp, Artificial Sequence
  Synthetic
aaccgtttacaccggaagatgt

SEQ ID NO: 24320 - DNA, 20 bp, Artificial Sequence
  Synthetic
atggtgatgatgattgcgcc

SEQ ID NO: 24321 - DNA, 22 bp, Artificial Sequence
  Synthetic
agaagtaacaggccgtctgaaa

SEQ ID NO: 24322 - DNA, 21 bp, Artificial Sequence
  Synthetic
tcatcgtcgaagaaagcggct

SEQ ID NO: 24323 - DNA, 19 bp, Artificial Sequence
  Synthetic
gtagggcggcgaggttggt

SEQ ID NO: 24324 - DNA, 22 bp, Artificial Sequence
  Synthetic
tccgagtccgaagcatcttgtg

SEQ ID NO: 24325 - DNA, 22 bp, Artificial Sequence
  Synthetic
tcgctgctcatcaggctaaggt

SEQ ID NO: 24326 - DNA, 22 bp, Artificial Sequence
  Synthetic
gttctttacgtttttgtggggc

SEQ ID NO: 24327 - DNA, 22 bp, Artificial Sequence
  Synthetic
aggcgtggatttccgttaccgt

SEQ ID NO: 24328 - DNA, 24 bp, Artificial Sequence
  Synthetic
gcatttttcggtatcggtgtaacg

SEQ ID NO: 24329 - DNA, 19 bp, Artificial Sequence
  Synthetic
ggcgtggcgatgattgccg

SEQ ID NO: 24330 - DNA, 21 bp, Artificial Sequence
  Synthetic
taagccaagccgttgcaaccg

SEQ ID NO: 24331 - DNA, 21 bp, Artificial Sequence
  Synthetic
acgtctggctttccattcggg

SEQ ID NO: 24332 - DNA, 21 bp, Artificial Sequence
  Synthetic
cctaccgtttttctgcttgcg

SEQ ID NO: 24333 - DNA, 20 bp, Artificial Sequence
  Synthetic
gcgtattgtctgtgcgcgga

SEQ ID NO: 24334 - DNA, 22 bp, Artificial Sequence
  Synthetic
cgaaaacacagcttccgaaccg

SEQ ID NO: 24335 - DNA, 21 bp, Artificial Sequence
  Synthetic
gcggcgaagatgaatgccaac

SEQ ID NO: 24336 - DNA, 22 bp, Artificial Sequence
  Synthetic
tgcactgaagccgagtattccg

SEQ ID NO: 24337 - DNA, 22 bp, Artificial Sequence
  Synthetic
gaccccgaacacgccaaaatct

SEQ ID NO: 24338 - DNA, 21 bp, Artificial Sequence
  Synthetic
aagcccaatgggagaaatcgt

SEQ ID NO: 24339 - DNA, 21 bp, Artificial Sequence
  Synthetic
acgcttcgaccgtccaatccc

SEQ ID NO: 24340 - DNA, 22 bp, Artificial Sequence
  Synthetic
ggcaacggcgtaaatcagtgcc

SEQ ID NO: 24341 - DNA, 19 bp, Artificial Sequence
  Synthetic
gacggtttcgcggctgtct

SEQ ID NO: 24342 - DNA, 21 bp, Artificial Sequence
  Synthetic
ccagcccgcgatcctgataca

SEQ ID NO: 24343 - DNA, 22 bp, Artificial Sequence
  Synthetic
aggagtggtaaccatgccgaca

SEQ ID NO: 24344 - DNA, 20 bp, Artificial Sequence
  Synthetic
gacttgttcgggcagcccca

SEQ ID NO: 24345 - DNA, 22 bp, Artificial Sequence
  Synthetic
ggcggttttgattttggagccg

SEQ ID NO: 24346 - DNA, 20 bp, Artificial Sequence
  Synthetic
acggtttatctgcccgccga

SEQ ID NO: 24347 - DNA, 19 bp, Artificial Sequence
  Synthetic
gaacgcaggctgccgagca

SEQ ID NO: 24348 - DNA, 20 bp, Artificial Sequence
  Synthetic
ggtgttgttcggcggcaagg

SEQ ID NO: 24349 - DNA, 18 bp, Artificial Sequence
  Synthetic
cggctgccgtgtcggtaa

SEQ ID NO: 24350 - DNA, 20 bp, Artificial Sequence
  Synthetic
agagcggcatatcgggatgc

SEQ ID NO: 24351 - DNA, 20 bp, Artificial Sequence
  Synthetic
tcgtcggcgtgtttaagcgc

SEQ ID NO: 24352 - DNA, 18 bp, Artificial Sequence
  Synthetic
tttgcccgccgtcgaacg

SEQ ID NO: 24353 - DNA, 21 bp, Artificial Sequence
  Synthetic
gttgtcgtttcccccgaagcc

SEQ ID NO: 24354 - DNA, 19 bp, Artificial Sequence
  Synthetic
gcatcggccctgcctacga

SEQ ID NO: 24355 - DNA, 20 bp, Artificial Sequence
  Synthetic
cgcgcgtcatatggtcgagc

SEQ ID NO: 24356 - DNA, 19 bp, Artificial Sequence
  Synthetic
atctggtgatgggccgccc

SEQ ID NO: 24357 - DNA, 20 bp, Artificial Sequence
  Synthetic
gcgcgaactcgaaaaaccgc

SEQ ID NO: 24358 - DNA, 22 bp, Artificial Sequence
  Synthetic
tggtggaaggcttcgaacatcg

SEQ ID NO: 24359 - DNA, 19 bp, Artificial Sequence
  Synthetic
ggccgggtttcgaccgtgt

SEQ ID NO: 24360 - DNA, 21 bp, Artificial Sequence
  Synthetic
gcccaattggaaaagggcagc

SEQ ID NO: 24361 - DNA, 19 bp, Artificial Sequence
  Synthetic
ccggcatccgcgccttgtt

SEQ ID NO: 24362 - DNA, 22 bp, Artificial Sequence
  Synthetic
accgtccgaccatcgtgtttgc

SEQ ID NO: 24363 - DNA, 21 bp, Artificial Sequence
  Synthetic
gacgagttccacgtcgttcgc

SEQ ID NO: 24364 - DNA, 19 bp, Artificial Sequence
  Synthetic
ggatgttgggcgcgggcat

SEQ ID NO: 24365 - DNA, 19 bp, Artificial Sequence
  Synthetic
gcgtgtcgggcaggtaggt

SEQ ID NO: 24366 - DNA, 22 bp, Artificial Sequence
  Synthetic
gtctgtgcccacatcggtctga

SEQ ID NO: 24367 - DNA, 20 bp, Artificial Sequence
  Synthetic
cgggaacggctctggcaacc

SEQ ID NO: 24368 - DNA, 19 bp, Artificial Sequence
  Synthetic
gacaaaggcgtgctggcgg

SEQ ID NO: 24369 - DNA, 22 bp, Artificial Sequence
  Synthetic
atacgcttagggtgtctgatcg

SEQ ID NO: 24370 - DNA, 22 bp, Artificial Sequence
  Synthetic
aagggttcgtccaaaagcagga

SEQ ID NO: 24371 - DNA, 22 bp, Artificial Sequence
  Synthetic
aacgttgtgaaacggtttgcgc

SEQ ID NO: 24372 - DNA, 20 bp, Artificial Sequence
  Synthetic
ggagttgccgcgttggaagt

SEQ ID NO: 24373 - DNA, 21 bp, Artificial Sequence
  Synthetic
ttctgcggatgtttttctccg

SEQ ID NO: 24374 - DNA, 19 bp, Artificial Sequence
  Synthetic
ggacagccggttccggtca

SEQ ID NO: 24375 - DNA, 22 bp, Artificial Sequence
  Synthetic
tcatcttgttgctgatggcgga

SEQ ID NO: 24376 - DNA, 21 bp, Artificial Sequence
  Synthetic
cggcaaccggcttcttcttcc

SEQ ID NO: 24377 - DNA, 19 bp, Artificial Sequence
  Synthetic
ctgacggcgcggcattcct

SEQ ID NO: 24378 - DNA, 19 bp, Artificial Sequence
  Synthetic
tgcgagatgctgggaacgg

SEQ ID NO: 24379 - DNA, 22 bp, Artificial Sequence
  Synthetic
gcgtgaaaccaagacattcggc

SEQ ID NO: 24380 - DNA, 22 bp, Artificial Sequence
  Synthetic
accgttattggcggatttggcg

SEQ ID NO: 24381 - DNA, 22 bp, Artificial Sequence
  Synthetic
ttggacaacgccctgaaggttg

SEQ ID NO: 24382 - DNA, 19 bp, Artificial Sequence
  Synthetic
ggctgaaatcaggcggcgc

SEQ ID NO: 24383 - DNA, 19 bp, Artificial Sequence
  Synthetic
tcgccgtcgccgtcagcta

SEQ ID NO: 24384 - DNA, 20 bp, Artificial Sequence
  Synthetic
agggcaattcgacgatgttg

SEQ ID NO: 24385 - DNA, 19 bp, Artificial Sequence
  Synthetic
gaagcgaggtcaggcggca

SEQ ID NO: 24386 - DNA, 22 bp, Artificial Sequence
  Synthetic
agccgataatcaggcgtgttgc

SEQ ID NO: 24387 - DNA, 19 bp, Artificial Sequence
  Synthetic
ggcgatggcggacggtatg

SEQ ID NO: 24388 - DNA, 20 bp, Artificial Sequence
  Synthetic
gcacatttttcggggcgcat

SEQ ID NO: 24389 - DNA, 20 bp, Artificial Sequence
  Synthetic
gtgattccggctgttcgcgg

SEQ ID NO: 24390 - DNA, 19 bp, Artificial Sequence
  Synthetic
tgccgaagcagaagccgaa

SEQ ID NO: 24391 - DNA, 19 bp, Artificial Sequence
  Synthetic
gcctcctggccgccgatta

SEQ ID NO: 24392 - DNA, 19 bp, Artificial Sequence
  Synthetic
taaggcttcgctgcgccag

SEQ ID NO: 24393 - DNA, 19 bp, Artificial Sequence
  Synthetic
agcaggaagccgcacaagc

SEQ ID NO: 24394 - DNA, 18 bp, Artificial Sequence
  Synthetic
cggcgcgcgggtcaaaat

SEQ ID NO: 24395 - DNA, 22 bp, Artificial Sequence
  Synthetic
gctgcatgaggacgctctatga

SEQ ID NO: 24396 - DNA, 20 bp, Artificial Sequence
  Synthetic
gcaggacggtcaaggcacac

SEQ ID NO: 24397 - DNA, 22 bp, Artificial Sequence
  Synthetic
tgctgacattgtgctacgtcga

SEQ ID NO: 24398 - DNA, 21 bp, Artificial Sequence
  Synthetic
aagcatcaacggcttggaggc

SEQ ID NO: 24399 - DNA, 22 bp, Artificial Sequence
  Synthetic
tggtggacacgcagaaaaaccg

SEQ ID NO: 24400 - DNA, 19 bp, Artificial Sequence
  Synthetic
cgccgccctgccttgtgaa

SEQ ID NO: 24401 - DNA, 22 bp, Artificial Sequence
  Synthetic
acatcgggcatttcttcccagc

SEQ ID NO: 24402 - DNA, 19 bp, Artificial Sequence
  Synthetic
atacggctgcatcgcggtc

SEQ ID NO: 24403 - DNA, 19 bp, Artificial Sequence
  Synthetic
cggaacgcctcaaagccgc

SEQ ID NO: 24404 - DNA, 22 bp, Artificial Sequence
  Synthetic
gtcaaatcgtggtttgacgggc

SEQ ID NO: 24405 - DNA, 20 bp, Artificial Sequence
  Synthetic
aaaagccgggcgcaaatcag

SEQ ID NO: 24406 - DNA, 21 bp, Artificial Sequence
  Synthetic
ccaaatgggcgaattggggcg

SEQ ID NO: 24407 - DNA, 18 bp, Artificial Sequence
  Synthetic
gcggcggcggttctcaaa

SEQ ID NO: 24408 - DNA, 18 bp, Artificial Sequence
  Synthetic
gcgcggcacttcgaccaa

SEQ ID NO: 24409 - DNA, 19 bp, Artificial Sequence
  Synthetic
atgcgcgcggatgtttggc

SEQ ID NO: 24410 - DNA, 20 bp, Artificial Sequence
  Synthetic
attgtccgaccatacgcccg

SEQ ID NO: 24411 - DNA, 23 bp, Artificial Sequence
  Synthetic
gagttcctgttgtcgctatttgc

SEQ ID NO: 24412 - DNA, 21 bp, Artificial Sequence
  Synthetic
gcgaagagcggaaaatcaaac

SEQ ID NO: 24413 - DNA, 22 bp, Artificial Sequence
  Synthetic
tcccgggtagcagccttttttg

SEQ ID NO: 24414 - DNA, 20 bp, Artificial Sequence
  Synthetic
aaatgccccgatggtgcagg

SEQ ID NO: 24415 - DNA, 21 bp, Artificial Sequence
  Synthetic
ctgttcggcagccgtttcacc

SEQ ID NO: 24416 - DNA, 18 bp, Artificial Sequence
  Synthetic
gcgcgatgtccatccgca

SEQ ID NO: 24417 - DNA, 19 bp, Artificial Sequence
  Synthetic
cccgccccgatcccttcta

SEQ ID NO: 24418 - DNA, 19 bp, Artificial Sequence
  Synthetic
atttggccgatgcgctgca

SEQ ID NO: 24419 - DNA, 22 bp, Artificial Sequence
  Synthetic
gttggcgatgacttcgttggtg

SEQ ID NO: 24420 - DNA, 22 bp, Artificial Sequence
  Synthetic
cgcattaatgccgtttatgcca

SEQ ID NO: 24421 - DNA, 21 bp, Artificial Sequence
  Synthetic
tggttttgccgatgtctgccg

SEQ ID NO: 24422 - DNA, 19 bp, Artificial Sequence
  Synthetic
gcagtaccgcccagcagga

SEQ ID NO: 24423 - DNA, 19 bp, Artificial Sequence
  Synthetic
ggtggtgcagcctgccgaa

SEQ ID NO: 24424 - DNA, 20 bp, Artificial Sequence
  Synthetic
tgtggacgacgtaaccgcgc

SEQ ID NO: 24425 - DNA, 22 bp, Artificial Sequence
  Synthetic
tccgccaccaaaaacctgatga

SEQ ID NO: 24426 - DNA, 22 bp, Artificial Sequence
  Synthetic
atttggacttcaaacgcggcag

SEQ ID NO: 24427 - DNA, 19 bp, Artificial Sequence
  Synthetic
tcaaaccataggccgcgcc

SEQ ID NO: 24428 - DNA, 19 bp, Artificial Sequence
  Synthetic
cgaagctgacgttggcggc

SEQ ID NO: 24429 - DNA, 22 bp, Artificial Sequence
  Synthetic
ttgcccatgccgaccataatcg

SEQ ID NO: 24430 - DNA, 22 bp, Artificial Sequence
  Synthetic
tcttcgggattggattcgccgg

SEQ ID NO: 24431 - DNA, 20 bp, Artificial Sequence
  Synthetic
aatcgttgctgccggcatcg

SEQ ID NO: 24432 - DNA, 22 bp, Artificial Sequence
  Synthetic
agccgcagtggattaagaaggg

SEQ ID NO: 24433 - DNA, 18 bp, Artificial Sequence
  Synthetic
tgctccccgaacgcgctt

SEQ ID NO: 24434 - DNA, 21 bp, Artificial Sequence
  Synthetic
acataaagccggcggcaaaca

SEQ ID NO: 24435 - DNA, 20 bp, Artificial Sequence
  Synthetic
gagcaggcggtatggtcggc

SEQ ID NO: 24436 - DNA, 23 bp, Artificial Sequence
  Synthetic
tccagcatcacatactcgaaagt

SEQ ID NO: 24437 - DNA, 21 bp, Artificial Sequence
  Synthetic
acgaagttttggtcgattgcc

SEQ ID NO: 24438 - DNA, 19 bp, Artificial Sequence
  Synthetic
gcaagggcgggttcggtaa

SEQ ID NO: 24439 - DNA, 20 bp, Artificial Sequence
  Synthetic
ggttttggcggcaggcgtat

SEQ ID NO: 24440 - DNA, 22 bp, Artificial Sequence
  Synthetic
tttggcggctttggatatcgga

SEQ ID NO: 24441 - DNA, 20 bp, Artificial Sequence
  Synthetic
aatcctgcatggcgagggtg

SEQ ID NO: 24442 - DNA, 19 bp, Artificial Sequence
  Synthetic
ggcgagtacggcgacctgt

SEQ ID NO: 24443 - DNA, 20 bp, Artificial Sequence
  Synthetic
cgctttcatgcgcctgaccg

SEQ ID NO: 24444 - DNA, 18 bp, Artificial Sequence
  Synthetic
tccgccgcgccgctttta

SEQ ID NO: 24445 - DNA, 19 bp, Artificial Sequence
  Synthetic
ggcccggggcgcatgattt

SEQ ID NO: 24446 - DNA, 17 bp, Artificial Sequence
  Synthetic
ttgttcgaccgccgcgt

SEQ ID NO: 24447 - DNA, 21 bp, Artificial Sequence
  Synthetic
ggttcgatggcttcggatgcc

SEQ ID NO: 24448 - DNA, 19 bp, Artificial Sequence
  Synthetic
ggacgagccgttgacgagc

SEQ ID NO: 24449 - DNA, 19 bp, Artificial Sequence
  Synthetic
caagcgcgcgcaggacgta

SEQ ID NO: 24450 - DNA, 20 bp, Artificial Sequence
  Synthetic
gcttcgccgaagcagacggg

SEQ ID NO: 24451 - DNA, 25 bp, Artificial Sequence
  Synthetic
aatttgcaggttatcactatgtgca

SEQ ID NO: 24452 - DNA, 19 bp, Artificial Sequence
  Synthetic
ggcgaaaaaggcgctggcg

SEQ ID NO: 24453 - DNA, 21 bp, Artificial Sequence
  Synthetic
gacgttgtgcaaggtttccgg

SEQ ID NO: 24454 - DNA, 18 bp, Artificial Sequence
  Synthetic
cagtccgcacgccccaat

SEQ ID NO: 24455 - DNA, 21 bp, Artificial Sequence
  Synthetic
actttggtggcgacgacttcg

SEQ ID NO: 24456 - DNA, 19 bp, Artificial Sequence
  Synthetic
gcgcccgaaatccccgtca

SEQ ID NO: 24457 - DNA, 19 bp, Artificial Sequence
  Synthetic
cgccatcgaagcctgcacg

SEQ ID NO: 24458 - DNA, 22 bp, Artificial Sequence
  Synthetic
acctgaaagacctgttcggcac

SEQ ID NO: 24459 - DNA, 20 bp, Artificial Sequence
  Synthetic
gcattggccgtcataccgct

SEQ ID NO: 24460 - DNA, 21 bp, Artificial Sequence
  Synthetic
aaaaccgtgttggagctcggc

SEQ ID NO: 24461 - DNA, 22 bp, Artificial Sequence
  Synthetic
ccctgcgacggttttagacagg

SEQ ID NO: 24462 - DNA, 22 bp, Artificial Sequence
  Synthetic
cgatacgttcggggtggatgtt

SEQ ID NO: 24463 - DNA, 20 bp, Artificial Sequence
  Synthetic
ttgcgacgtatgcaccagct

SEQ ID NO: 24464 - DNA, 19 bp, Artificial Sequence
  Synthetic
gcgcaggcgatggtggtgt

SEQ ID NO: 24465 - DNA, 22 bp, Artificial Sequence
  Synthetic
ttgctggaatctaaatcggctg

SEQ ID NO: 24466 - DNA, 20 bp, Artificial Sequence
  Synthetic
tgtgaatgtttcgccgcccg

SEQ ID NO: 24467 - DNA, 20 bp, Artificial Sequence
  Synthetic
gggcgataatggcgcggaag

SEQ ID NO: 24468 - DNA, 20 bp, Artificial Sequence
  Synthetic
gcactttgccgccgatgttt

SEQ ID NO: 24469 - DNA, 18 bp, Artificial Sequence
  Synthetic
gcgaatcgccgcagacga

SEQ ID NO: 24470 - DNA, 22 bp, Artificial Sequence
  Synthetic
tattgcaggagttcggcagctt

SEQ ID NO: 24471 - DNA, 19 bp, Artificial Sequence
  Synthetic
tccgcaccgcaaatcaggg

SEQ ID NO: 24472 - DNA, 21 bp, Artificial Sequence
  Synthetic
acgaagcagtgctgatgctca

SEQ ID NO: 24473 - DNA, 19 bp, Artificial Sequence
  Synthetic
acagcctcgccaccaacgc

SEQ ID NO: 24474 - DNA, 20 bp, Artificial Sequence
  Synthetic
cgttggcgcggattttggcg

SEQ ID NO: 24475 - DNA, 20 bp, Artificial Sequence
  Synthetic
gccgtttcgacaaaggcggc

SEQ ID NO: 24476 - DNA, 20 bp, Artificial Sequence
  Synthetic
aaacgccagcgacgaagtgc

SEQ ID NO: 24477 - DNA, 19 bp, Artificial Sequence
  Synthetic
gcagcgaccaggaatggcg

SEQ ID NO: 24478 - DNA, 19 bp, Artificial Sequence
  Synthetic
agcccgttcatttgcgcca

SEQ ID NO: 24479 - DNA, 22 bp, Artificial Sequence
  Synthetic
gcctgaacaatcaaaatggcga

SEQ ID NO: 24480 - DNA, 22 bp, Artificial Sequence
  Synthetic
tatcggcttcactattggcagc

SEQ ID NO: 24481 - DNA, 20 bp, Artificial Sequence
  Synthetic
tgtacggcaaaggagacggc

SEQ ID NO: 24482 - DNA, 18 bp, Artificial Sequence
  Synthetic
cggcggcaagcgtctgaa

SEQ ID NO: 24483 - DNA, 22 bp, Artificial Sequence
  Synthetic
accgtattcattgcaggtgccg

SEQ ID NO: 24484 - DNA, 21 bp, Artificial Sequence
  Synthetic
aaagccagttggacttcgccc

SEQ ID NO: 24485 - DNA, 22 bp, Artificial Sequence
  Synthetic
acttctcggacgttccattcgg

SEQ ID NO: 24486 - DNA, 19 bp, Artificial Sequence
  Synthetic
gtcggtcagcagcgccact

SEQ ID NO: 24487 - DNA, 20 bp, Artificial Sequence
  Synthetic
acacgatggcgggtgcttcg

SEQ ID NO: 24488 - DNA, 22 bp, Artificial Sequence
  Synthetic
acagtaatgcgcttcagacggc

SEQ ID NO: 24489 - DNA, 21 bp, Artificial Sequence
  Synthetic
gcaactgcgcgacgtattgtc

SEQ ID NO: 24490 - DNA, 21 bp, Artificial Sequence
  Synthetic
cctgcttgccaacgtctttgc

SEQ ID NO: 24491 - DNA, 18 bp, Artificial Sequence
  Synthetic
gcaggattggcggggcat

SEQ ID NO: 24492 - DNA, 22 bp, Artificial Sequence
  Synthetic
ttcgccgtgggactttatccgg

SEQ ID NO: 24493 - DNA, 22 bp, Artificial Sequence
  Synthetic
tttctgcgtcggtcattggggt

SEQ ID NO: 24494 - DNA, 22 bp, Artificial Sequence
  Synthetic
ccccaaagccgaaatcgaaggc

SEQ ID NO: 24495 - DNA, 19 bp, Artificial Sequence
  Synthetic
ttcgcgggaatgacggtcg

SEQ ID NO: 24496 - DNA, 18 bp, Artificial Sequence
  Synthetic
ggtgcagcctgccttcgt

SEQ ID NO: 24497 - DNA, 21 bp, Artificial Sequence
  Synthetic
acgagttggtgtacttgccgg

SEQ ID NO: 24498 - DNA, 21 bp, Artificial Sequence
  Synthetic
tgtcgcggacaaaacgatggt

SEQ ID NO: 24499 - DNA, 20 bp, Artificial Sequence
  Synthetic
acgatttgcagttggcggcg

SEQ ID NO: 24500 - DNA, 18 bp, Artificial Sequence
  Synthetic
cggctgcgtttggcgact

SEQ ID NO: 24501 - DNA, 20 bp, Artificial Sequence
  Synthetic
ttttccccgagcgcggcatt

SEQ ID NO: 24502 - DNA, 22 bp, Artificial Sequence
  Synthetic
tcttcggcgatttcaaagccgt

SEQ ID NO: 24503 - DNA, 22 bp, Artificial Sequence
  Synthetic
gggcattgtttgaccggtttcc

SEQ ID NO: 24504 - DNA, 21 bp, Artificial Sequence
  Synthetic
gcttaagcccgcaacaaaaag

SEQ ID NO: 24505 - DNA, 20 bp, Artificial Sequence
  Synthetic
gaagtcggcggcgaattgct

SEQ ID NO: 24506 - DNA, 20 bp, Artificial Sequence
  Synthetic
ccaaatgcggatggtgcgga

SEQ ID NO: 24507 - DNA, 21 bp, Artificial Sequence
  Synthetic
agtgactgggttatcttcggc

SEQ ID NO: 24508 - DNA, 20 bp, Artificial Sequence
  Synthetic
gttgagaagcgttgacggct

SEQ ID NO: 24509 - DNA, 22 bp, Artificial Sequence
  Synthetic
tgaaagaatgtccaggcgattt

SEQ ID NO: 24510 - DNA, 21 bp, Artificial Sequence
  Synthetic
cccgatgttcgtgattacgga

SEQ ID NO: 24511 - DNA, 25 bp, Artificial Sequence
  Synthetic
aatatttcacgggcaataacttccc

SEQ ID NO: 24512 - DNA, 25 bp, Artificial Sequence
  Synthetic
cgattgaggcttcatcgtttttagg

SEQ ID NO: 24513 - DNA, 25 bp, Artificial Sequence
  Synthetic
tggaattctaggcagaatctcttgc

SEQ ID NO: 24514 - DNA, 22 bp, Artificial Sequence
  Synthetic
tggcacaaattccatatccgaa

SEQ ID NO: 24515 - DNA, 19 bp, Artificial Sequence
  Synthetic
ctgcgcgacatccacaccc

SEQ ID NO: 24516 - DNA, 19 bp, Artificial Sequence
  Synthetic
acatcgccaaaggacgcgg

SEQ ID NO: 24517 - DNA, 21 bp, Artificial Sequence
  Synthetic
ccgctttggatttggttgccg

SEQ ID NO: 24518 - DNA, 19 bp, Artificial Sequence
  Synthetic
gcatccgcttctccggcga

SEQ ID NO: 24519 - DNA, 21 bp, Artificial Sequence
  Synthetic
gttctgccgaccgctacttcc

SEQ ID NO: 24520 - DNA, 19 bp, Artificial Sequence
  Synthetic
gttcggtcaccgtcgggca

SEQ ID NO: 24521 - DNA, 18 bp, Artificial Sequence
  Synthetic
gttggatgcgcccgtcga

SEQ ID NO: 24522 - DNA, 21 bp, Artificial Sequence
  Synthetic
cgtggcaaacatccaacccga

SEQ ID NO: 24523 - DNA, 19 bp, Artificial Sequence
  Synthetic
gtctgtccctgcccggcaa

SEQ ID NO: 24524 - DNA, 22 bp, Artificial Sequence
  Synthetic
agcatcctcaaattcaccggcc

SEQ ID NO: 24525 - DNA, 18 bp, Artificial Sequence
  Synthetic
gccgacacgttggcgcaa

SEQ ID NO: 24526 - DNA, 19 bp, Artificial Sequence
  Synthetic
tccaagacccaggcgagca

SEQ ID NO: 24527 - DNA, 22 bp, Artificial Sequence
  Synthetic
atcgccaactcctgcgtcttcc

SEQ ID NO: 24528 - DNA, 19 bp, Artificial Sequence
  Synthetic
cccctgcccaaaacgaccg

SEQ ID NO: 24529 - DNA, 22 bp, Artificial Sequence
  Synthetic
gatcgccgaaatcgattcccca

SEQ ID NO: 24530 - DNA, 20 bp, Artificial Sequence
  Synthetic
cgcgtgccgccatatcttcg

SEQ ID NO: 24531 - DNA, 22 bp, Artificial Sequence
  Synthetic
gcgggatgattttttccgccaa

SEQ ID NO: 24532 - DNA, 21 bp, Artificial Sequence
  Synthetic
tcgttgagcaggcgcaatacg

SEQ ID NO: 24533 - DNA, 22 bp, Artificial Sequence
  Synthetic
aagcccaaaaagtcggactggt

SEQ ID NO: 24534 - DNA, 18 bp, Artificial Sequence
  Synthetic
tacttgccaccgcgccct

SEQ ID NO: 24535 - DNA, 22 bp, Artificial Sequence
  Synthetic
ctcgaggttgcaaaagtcgcct

SEQ ID NO: 24536 - DNA, 22 bp, Artificial Sequence
  Synthetic
ttgatgaccgcctgccagtagc

SEQ ID NO: 24537 - DNA, 21 bp, Artificial Sequence
  Synthetic
gatggatgcccgattcgtgcg

SEQ ID NO: 24538 - DNA, 22 bp, Artificial Sequence
  Synthetic
ttttcgcaatcgcattgaccgc

SEQ ID NO: 24539 - DNA, 19 bp, Artificial Sequence
  Synthetic
gccatcgttgccgccctga

SEQ ID NO: 24540 - DNA, 21 bp, Artificial Sequence
  Synthetic
gcaccggtctcttccgattgg

SEQ ID NO: 24541 - DNA, 22 bp, Artificial Sequence
  Synthetic
tgctttccaacatcctccccct

SEQ ID NO: 24542 - DNA, 20 bp, Artificial Sequence
  Synthetic
cgcacacgctgccatatcct

SEQ ID NO: 24543 - DNA, 20 bp, Artificial Sequence
  Synthetic
tgcccttcattgccgttggg

SEQ ID NO: 24544 - DNA, 22 bp, Artificial Sequence
  Synthetic
gcagaaagtcggcgaataccgg

SEQ ID NO: 24545 - DNA, 22 bp, Artificial Sequence
  Synthetic
tccgcctgtaccgaaatcaacg

SEQ ID NO: 24546 - DNA, 20 bp, Artificial Sequence
  Synthetic
cgaaaccgacgctcgcgtat

SEQ ID NO: 24547 - DNA, 24 bp, Artificial Sequence
  Synthetic
ttttccagacggcattttttgttt

SEQ ID NO: 24548 - DNA, 19 bp, Artificial Sequence
  Synthetic
catccgcacccagttgcgc

SEQ ID NO: 24549 - DNA, 22 bp, Artificial Sequence
  Synthetic
gtcagacatcgggaaatgcttt

SEQ ID NO: 24550 - DNA, 20 bp, Artificial Sequence
  Synthetic
tgcaaaccgcgccgtatcag

SEQ ID NO: 24551 - DNA, 19 bp, Artificial Sequence
  Synthetic
gcgaaccggcgcaagaact

SEQ ID NO: 24552 - DNA, 22 bp, Artificial Sequence
  Synthetic
gttgccaagcctaagccgttgc

SEQ ID NO: 24553 - DNA, 20 bp, Artificial Sequence
  Synthetic
tggcggcttcgactgtttcg

SEQ ID NO: 24554 - DNA, 22 bp, Artificial Sequence
  Synthetic
agcatccccatcatccacaacc

SEQ ID NO: 24555 - DNA, 21 bp, Artificial Sequence
  Synthetic
tcgcttcgatcacttcgggac

SEQ ID NO: 24556 - DNA, 19 bp, Artificial Sequence
  Synthetic
ggattgccggcgccgatgt

SEQ ID NO: 24557 - DNA, 18 bp, Artificial Sequence
  Synthetic
cgcgccgtccaagccttt

SEQ ID NO: 24558 - DNA, 21 bp, Artificial Sequence
  Synthetic
ggcttggatttgccggactgt

SEQ ID NO: 24559 - DNA, 19 bp, Artificial Sequence
  Synthetic
cgagggtgcgctccatctg

SEQ ID NO: 24560 - DNA, 20 bp, Artificial Sequence
  Synthetic
gtagcggtcgaagtcgtgcg

SEQ ID NO: 24561 - DNA, 21 bp, Artificial Sequence
  Synthetic
cgggggaagtcggtcaggtag

SEQ ID NO: 24562 - DNA, 22 bp, Artificial Sequence
  Synthetic
tttgaccagcagcgaagacagg

SEQ ID NO: 24563 - DNA, 20 bp, Artificial Sequence
  Synthetic
cacggtccgcgtgatttggt

SEQ ID NO: 24564 - DNA, 25 bp, Artificial Sequence
  Synthetic
acaggctggttactttgtttttttg

SEQ ID NO: 24565 - DNA, 21 bp, Artificial Sequence
  Synthetic
ggtcggtatgcaatgcgtggt

SEQ ID NO: 24566 - DNA, 21 bp, Artificial Sequence
  Synthetic
ccccgatagccgaaaagcagc

SEQ ID NO: 24567 - DNA, 19 bp, Artificial Sequence
  Synthetic
ggacagcccgaacacaccc

SEQ ID NO: 24568 - DNA, 19 bp, Artificial Sequence
  Synthetic
ttgccggaacatggctgct

SEQ ID NO: 24569 - DNA, 18 bp, Artificial Sequence
  Synthetic
tgggcaacgaaggcgacg

SEQ ID NO: 24570 - DNA, 21 bp, Artificial Sequence
  Synthetic
ctacaccctctccgtcgtccc

SEQ ID NO: 24571 - DNA, 19 bp, Artificial Sequence
  Synthetic
atatgtgccgtgccgcgct

SEQ ID NO: 24572 - DNA, 21 bp, Artificial Sequence
  Synthetic
aaaggggcgaagtttacaggc

SEQ ID NO: 24573 - DNA, 20 bp, Artificial Sequence
  Synthetic
ttggtttcgccgctcatggc

SEQ ID NO: 24574 - DNA, 18 bp, Artificial Sequence
  Synthetic
cgctcggcggcatccaaa

SEQ ID NO: 24575 - DNA, 19 bp, Artificial Sequence
  Synthetic
tcacaggcacacgtctgcg

SEQ ID NO: 24576 - DNA, 19 bp, Artificial Sequence
  Synthetic
cgtgggcttacctgccgct

SEQ ID NO: 24577 - DNA, 22 bp, Artificial Sequence
  Synthetic
ttcagacggcattttcggcaca

SEQ ID NO: 24578 - DNA, 22 bp, Artificial Sequence
  Synthetic
tacctcgccaaaaaactcggca

SEQ ID NO: 24579 - DNA, 22 bp, Artificial Sequence
  Synthetic
ggtcggtatggatgccttcctg

SEQ ID NO: 24580 - DNA, 22 bp, Artificial Sequence
  Synthetic
accaacaacagcaccttcctcg

SEQ ID NO: 24581 - DNA, 22 bp, Artificial Sequence
  Synthetic
atctggcgaaggaaatgcacgt

SEQ ID NO: 24582 - DNA, 22 bp, Artificial Sequence
  Synthetic
gcttgcccgattttgaaagccg

SEQ ID NO: 24583 - DNA, 19 bp, Artificial Sequence
  Synthetic
ccgcccgcccgattgtcaa

SEQ ID NO: 24584 - DNA, 22 bp, Artificial Sequence
  Synthetic
tcgagtacgccggtgattttgt

SEQ ID NO: 24585 - DNA, 21 bp, Artificial Sequence
  Synthetic
aattcgactgctttttcggcg

SEQ ID NO: 24586 - DNA, 22 bp, Artificial Sequence
  Synthetic
tccaacagttttgccacaccgt

SEQ ID NO: 24587 - DNA, 22 bp, Artificial Sequence
  Synthetic
agcccagtatgacaatttgctg

SEQ ID NO: 24588 - DNA, 20 bp, Artificial Sequence
  Synthetic
tgcccaagcacccaaatcat

SEQ ID NO: 24589 - DNA, 20 bp, Artificial Sequence
  Synthetic
cacgccaatgacgcgcaatc

SEQ ID NO: 24590 - DNA, 21 bp, Artificial Sequence
  Synthetic
gcaaaattccgcgcattaagc

SEQ ID NO: 24591 - DNA, 22 bp, Artificial Sequence
  Synthetic
gcctataccgaaaaatggcgcg

SEQ ID NO: 24592 - DNA, 20 bp, Artificial Sequence
  Synthetic
gtttgatgccgttttgtgcg

SEQ ID NO: 24593 - DNA, 20 bp, Artificial Sequence
  Synthetic
gcaaacaacaacactcgggc

SEQ ID NO: 24594 - DNA, 25 bp, Artificial Sequence
  Synthetic
cgaaatttttcatggtaaacgagcg

SEQ ID NO: 24595 - DNA, 21 bp, Artificial Sequence
  Synthetic
gtccgaagacggcggcttcac

SEQ ID NO: 24596 - DNA, 21 bp, Artificial Sequence
  Synthetic
ggtacgcaaccgaacagctct

SEQ ID NO: 24597 - DNA, 25 bp, Artificial Sequence
  Synthetic
accgttcaaataaatcgctctacat

SEQ ID NO: 24598 - DNA, 21 bp, Artificial Sequence
  Synthetic
ctgggcaaactggaaaaacgg

SEQ ID NO: 24599 - DNA, 18 bp, Artificial Sequence
  Synthetic
cggcaaaggcgtgcacgt

SEQ ID NO: 24600 - DNA, 19 bp, Artificial Sequence
  Synthetic
cgcctgcgcgttgtgaatc

SEQ ID NO: 24601 - DNA, 23 bp, Artificial Sequence
  Synthetic
aaacggtttttctttggcttcgg

SEQ ID NO: 24602 - DNA, 22 bp, Artificial Sequence
  Synthetic
gcggctgccgtacaatcaaaat

SEQ ID NO: 24603 - DNA, 19 bp, Artificial Sequence
  Synthetic
gcatcagccttgccacgct

SEQ ID NO: 24604 - DNA, 22 bp, Artificial Sequence
  Synthetic
caggcagtgtcggtcatcctca

SEQ ID NO: 24605 - DNA, 19 bp, Artificial Sequence
  Synthetic
tccaggcgtccccagttgt

SEQ ID NO: 24606 - DNA, 18 bp, Artificial Sequence
  Synthetic
acgttcgacggcggcttg

SEQ ID NO: 24607 - DNA, 21 bp, Artificial Sequence
  Synthetic
ttcagcttcggatggaaaagg

SEQ ID NO: 24608 - DNA, 20 bp, Artificial Sequence
  Synthetic
catacggcgcatcgttggcg

SEQ ID NO: 24609 - DNA, 20 bp, Artificial Sequence
  Synthetic
cccgcctttccgacaacgag

SEQ ID NO: 24610 - DNA, 21 bp, Artificial Sequence
  Synthetic
tgtggcgaaaagctccatcgg

SEQ ID NO: 24611 - DNA, 19 bp, Artificial Sequence
  Synthetic
gggctgctggatgcgggta

SEQ ID NO: 24612 - DNA, 19 bp, Artificial Sequence
  Synthetic
cgcccgccggtctgaaaca

SEQ ID NO: 24613 - DNA, 21 bp, Artificial Sequence
  Synthetic
acggtggaacgtgggaacagg

SEQ ID NO: 24614 - DNA, 19 bp, Artificial Sequence
  Synthetic
aagcaacagcatccgccgc

SEQ ID NO: 24615 - DNA, 20 bp, Artificial Sequence
  Synthetic
tccccgataccgatgccgtc

SEQ ID NO: 24616 - DNA, 20 bp, Artificial Sequence
  Synthetic
aaacggttgcccaaaccccg

SEQ ID NO: 24617 - DNA, 22 bp, Artificial Sequence
  Synthetic
tctgctcgccaaagtcaaagcc

SEQ ID NO: 24618 - DNA, 22 bp, Artificial Sequence
  Synthetic
aacatctggcgcaaaaaaccgg

SEQ ID NO: 24619 - DNA, 20 bp, Artificial Sequence
  Synthetic
cgaagtgttggacgcaccgc

SEQ ID NO: 24620 - DNA, 20 bp, Artificial Sequence
  Synthetic
ttttccacgcgtttgcccgg

SEQ ID NO: 24621 - DNA, 20 bp, Artificial Sequence
  Synthetic
cgacatccacggcaaagcgc

SEQ ID NO: 24622 - DNA, 20 bp, Artificial Sequence
  Synthetic
attcacacgcaaacccgcct

SEQ ID NO: 24623 - DNA, 22 bp, Artificial Sequence
  Synthetic
agtgtccgccaacatattgcgc

SEQ ID NO: 24624 - DNA, 19 bp, Artificial Sequence
  Synthetic
ccccgcccgtttcgccaaa

SEQ ID NO: 24625 - DNA, 19 bp, Artificial Sequence
  Synthetic
accattgccgtctgcgaca

SEQ ID NO: 24626 - DNA, 21 bp, Artificial Sequence
  Synthetic
cgaaaccttaaaccccggccc

SEQ ID NO: 24627 - DNA, 22 bp, Artificial Sequence
  Synthetic
tgtcaaaacgctccttcaggcg

SEQ ID NO: 24628 - DNA, 18 bp, Artificial Sequence
  Synthetic
gcatccgcgccgaagagt

SEQ ID NO: 24629 - DNA, 19 bp, Artificial Sequence
  Synthetic
catctgcgccttgtccggc

SEQ ID NO: 24630 - DNA, 21 bp, Artificial Sequence
  Synthetic
cctgcggattcaataccggca

SEQ ID NO: 24631 - DNA, 19 bp, Artificial Sequence
  Synthetic
cggccgattccgccaaacc

SEQ ID NO: 24632 - DNA, 20 bp, Artificial Sequence
  Synthetic
cccattccccgtttgccagc

SEQ ID NO: 24633 - DNA, 21 bp, Artificial Sequence
  Synthetic
gctgggcacgtcttccaaagc

SEQ ID NO: 24634 - DNA, 18 bp, Artificial Sequence
  Synthetic
gccagttcgcgcgtggtt

SEQ ID NO: 24635 - DNA, 18 bp, Artificial Sequence
  Synthetic
gcctttggcggctttgcg

SEQ ID NO: 24636 - DNA, 18 bp, Artificial Sequence
  Synthetic
gtgtgcggcgcggatgta

SEQ ID NO: 24637 - DNA, 19 bp, Artificial Sequence
  Synthetic
gcgtttttccagcgcgtcg

SEQ ID NO: 24638 - DNA, 21 bp, Artificial Sequence
  Synthetic
gatcctacacgccgcgaacct

SEQ ID NO: 24639 - DNA, 22 bp, Artificial Sequence
  Synthetic
gactcggaagacgtcatccggc

SEQ ID NO: 24640 - DNA, 22 bp, Artificial Sequence
  Synthetic
aacttgaagcggcaatgagggc

SEQ ID NO: 24641 - DNA, 19 bp, Artificial Sequence
  Synthetic
cggctgtgcgtgaggtgct

SEQ ID NO: 24642 - DNA, 20 bp, Artificial Sequence
  Synthetic
tcaacgcctttcaccagctc

SEQ ID NO: 24643 - DNA, 19 bp, Artificial Sequence
  Synthetic
gtccaccaccaagagcgcg

SEQ ID NO: 24644 - DNA, 20 bp, Artificial Sequence
  Synthetic
ggcgagcgtttgcggatgaa

SEQ ID NO: 24645 - DNA, 21 bp, Artificial Sequence
  Synthetic
atgtgtgccgaaaacaaccgc

SEQ ID NO: 24646 - DNA, 19 bp, Artificial Sequence
  Synthetic
cttccgtcctcgccgatcc

SEQ ID NO: 24647 - DNA, 19 bp, Artificial Sequence
  Synthetic
cgaagccctgcgcctcgaa

SEQ ID NO: 24648 - DNA, 19 bp, Artificial Sequence
  Synthetic
tttgcagacgaccgcgtgc

SEQ ID NO: 24649 - DNA, 20 bp, Artificial Sequence
  Synthetic
aaatcctgtttgccgccgcc

SEQ ID NO: 24650 - DNA, 18 bp, Artificial Sequence
  Synthetic
tttggccttggctgccga

SEQ ID NO: 24651 - DNA, 19 bp, Artificial Sequence
  Synthetic
cgctacggcagccgcgaaa

SEQ ID NO: 24652 - DNA, 21 bp, Artificial Sequence
  Synthetic
tgccggtatggtttcaagacg

SEQ ID NO: 24653 - DNA, 22 bp, Artificial Sequence
  Synthetic
cctctcgtactaggagcagccc

SEQ ID NO: 24654 - DNA, 19 bp, Artificial Sequence
  Synthetic
gcggggccctcgaaaacct

SEQ ID NO: 24655 - DNA, 22 bp, Artificial Sequence
  Synthetic
agcacaaaaatcttgccgtcgc

SEQ ID NO: 24656 - DNA, 19 bp, Artificial Sequence
  Synthetic
gacgggcaaaggttcgcgt

SEQ ID NO: 24657 - DNA, 21 bp, Artificial Sequence
  Synthetic
atctccatccacgacgtgggc

SEQ ID NO: 24658 - DNA, 21 bp, Artificial Sequence
  Synthetic
cggcaaataccaaacccccgt

SEQ ID NO: 24659 - DNA, 19 bp, Artificial Sequence
  Synthetic
aatggccgccgccttcacc

SEQ ID NO: 24660 - DNA, 19 bp, Artificial Sequence
  Synthetic
ccctgccttgcgcgaccaa

SEQ ID NO: 24661 - DNA, 21 bp, Artificial Sequence
  Synthetic
tctcgctcgcgtccaaatctg

SEQ ID NO: 24662 - DNA, 20 bp, Artificial Sequence
  Synthetic
ccgtgggtatgtcgctcggc

SEQ ID NO: 24663 - DNA, 20 bp, Artificial Sequence
  Synthetic
caccgtcggtgcagtcttca

SEQ ID NO: 24664 - DNA, 19 bp, Artificial Sequence
  Synthetic
ctacgaagcccccgtcgga

SEQ ID NO: 24665 - DNA, 19 bp, Artificial Sequence
  Synthetic
cgttcaggctgcccgaaca

SEQ ID NO: 24666 - DNA, 22 bp, Artificial Sequence
  Synthetic
agaacaaatcaaacgcgcccgc

SEQ ID NO: 24667 - DNA, 19 bp, Artificial Sequence
  Synthetic
cgcaccccgtgggcacaat

SEQ ID NO: 24668 - DNA, 24 bp, Artificial Sequence
  Synthetic
catgcagatatgcagattctgaca

SEQ ID NO: 24669 - DNA, 21 bp, Artificial Sequence
  Synthetic
tatcgagttgcgccaccaacc

SEQ ID NO: 24670 - DNA, 22 bp, Artificial Sequence
  Synthetic
tcaaccaatccgtttacgccca

SEQ ID NO: 24671 - DNA, 22 bp, Artificial Sequence
  Synthetic
ttttggacgaaccctccatcgg

SEQ ID NO: 24672 - DNA, 22 bp, Artificial Sequence
  Synthetic
gcgacggcgtgattaaagtcga

SEQ ID NO: 24673 - DNA, 19 bp, Artificial Sequence
  Synthetic
acgccgtacgccgaaacag

SEQ ID NO: 24674 - DNA, 18 bp, Artificial Sequence
  Synthetic
aacgcatcgtgccgccca

SEQ ID NO: 24675 - DNA, 22 bp, Artificial Sequence
  Synthetic
agctgcaactgctcggtaatga

SEQ ID NO: 24676 - DNA, 19 bp, Artificial Sequence
  Synthetic
ccgccagattgccgcgtgt

SEQ ID NO: 24677 - DNA, 21 bp, Artificial Sequence
  Synthetic
tggggtctttttcggtcaggc

SEQ ID NO: 24678 - DNA, 22 bp, Artificial Sequence
  Synthetic
tgtccgtcgggattttggtgtc

SEQ ID NO: 24679 - DNA, 20 bp, Artificial Sequence
  Synthetic
atgaccccgcttttgctggt

SEQ ID NO: 24680 - DNA, 20 bp, Artificial Sequence
  Synthetic
cttggtcgagctgcttgccc

SEQ ID NO: 24681 - DNA, 20 bp, Artificial Sequence
  Synthetic
caggttcaggcttggtcgct

SEQ ID NO: 24682 - DNA, 22 bp, Artificial Sequence
  Synthetic
cgcgaaagagttgtccgacgaa

SEQ ID NO: 24683 - DNA, 21 bp, Artificial Sequence
  Synthetic
ctgcggaaaatgcggcaaagc

SEQ ID NO: 24684 - DNA, 19 bp, Artificial Sequence
  Synthetic
ggcacgacacccgccgatt

SEQ ID NO: 24685 - DNA, 22 bp, Artificial Sequence
  Synthetic
ctcgatgcgatggaaagccccg

SEQ ID NO: 24686 - DNA, 20 bp, Artificial Sequence
  Synthetic
ccgtcctcgaagccgtcagg

SEQ ID NO: 24687 - DNA, 22 bp, Artificial Sequence
  Synthetic
cactcggcgacaaaaaaggcat

SEQ ID NO: 24688 - DNA, 20 bp, Artificial Sequence
  Synthetic
gcgtatacaaccgctcgccc

SEQ ID NO: 24689 - DNA, 20 bp, Artificial Sequence
  Synthetic
tcggttttctctgtgcggac

SEQ ID NO: 24690 - DNA, 18 bp, Artificial Sequence
  Synthetic
caaccggcgtggcgatgt

SEQ ID NO: 24691 - DNA, 18 bp, Artificial Sequence
  Synthetic
cgcggccaaactcgttgc

SEQ ID NO: 24692 - DNA, 21 bp, Artificial Sequence
  Synthetic
atgagcgtggtcaaaggtcgc

SEQ ID NO: 24693 - DNA, 21 bp, Artificial Sequence
  Synthetic
tggcaatggcaggctttgaga

SEQ ID NO: 24694 - DNA, 22 bp, Artificial Sequence
  Synthetic
cttgcccatgaaaaccacgtcg

SEQ ID NO: 24695 - DNA, 19 bp, Artificial Sequence
  Synthetic
gacaagcccccgcctacca

SEQ ID NO: 24696 - DNA, 21 bp, Artificial Sequence
  Synthetic
aaccgtctgcaccgtaaatgt

SEQ ID NO: 24697 - DNA, 20 bp, Artificial Sequence
  Synthetic
tttccagtgcggcgagatac

SEQ ID NO: 24698 - DNA, 19 bp, Artificial Sequence
  Synthetic
acatccgccgtggtgttgc

SEQ ID NO: 24699 - DNA, 20 bp, Artificial Sequence
  Synthetic
ttcatgcagtggcgttagct

SEQ ID NO: 24700 - DNA, 20 bp, Artificial Sequence
  Synthetic
gtgcctctccaaacgccacg

SEQ ID NO: 24701 - DNA, 20 bp, Artificial Sequence
  Synthetic
gtttgtcgtcaaaccgcgcg

SEQ ID NO: 24702 - DNA, 20 bp, Artificial Sequence
  Synthetic
gaggcggaggtagagccgga

SEQ ID NO: 24703 - DNA, 18 bp, Artificial Sequence
  Synthetic
ttgccgccagttgcagcg

SEQ ID NO: 24704 - DNA, 22 bp, Artificial Sequence
  Synthetic
cgcatcgacgttgtcctttggt

SEQ ID NO: 24705 - DNA, 16 bp, Artificial Sequence
  Synthetic
tgccgcacgcgcagaa

SEQ ID NO: 24706 - DNA, 22 bp, Artificial Sequence
  Synthetic
caagccgaaacacgagcgaaac

SEQ ID NO: 24707 - DNA, 18 bp, Artificial Sequence
  Synthetic
cgtgtccgcgcgtttgca

SEQ ID NO: 24708 - DNA, 21 bp, Artificial Sequence
  Synthetic
acggtgcgtttctgacttcgc

SEQ ID NO: 24709 - DNA, 20 bp, Artificial Sequence
  Synthetic
ccgtcctgccactcggtctc

SEQ ID NO: 24710 - DNA, 19 bp, Artificial Sequence
  Synthetic
ctggtccgcatacagccgc

SEQ ID NO: 24711 - DNA, 20 bp, Artificial Sequence
  Synthetic
cgcgggcttggcgttatacg

SEQ ID NO: 24712 - DNA, 22 bp, Artificial Sequence
  Synthetic
accgcaaaagacgacaaggtgt

SEQ ID NO: 24713 - DNA, 16 bp, Artificial Sequence
  Synthetic
aaggcagccgcgcgat

SEQ ID NO: 24714 - DNA, 20 bp, Artificial Sequence
  Synthetic
cgggcctataccgttgccgc

SEQ ID NO: 24715 - DNA, 21 bp, Artificial Sequence
  Synthetic
gcccactgcagatagggacca

SEQ ID NO: 24716 - DNA, 21 bp, Artificial Sequence
  Synthetic
aaaccataaaacgggttgcct

SEQ ID NO: 24717 - DNA, 21 bp, Artificial Sequence
  Synthetic
cagatcgaccgcttcctcgtg

SEQ ID NO: 24718 - DNA, 22 bp, Artificial Sequence
  Synthetic
acaggcgaacaccaccaactac

SEQ ID NO: 24719 - DNA, 21 bp, Artificial Sequence
  Synthetic
cggtagattgcccggaatgcg

SEQ ID NO: 24720 - DNA, 19 bp, Artificial Sequence
  Synthetic
ccgccgacggccgaaaagt

SEQ ID NO: 24721 - DNA, 20 bp, Artificial Sequence
  Synthetic
cgtatcgaccaaagcggcgt

SEQ ID NO: 24722 - DNA, 22 bp, Artificial Sequence
  Synthetic
gcattcaaccgtttggacagca

SEQ ID NO: 24723 - DNA, 22 bp, Artificial Sequence
  Synthetic
cgactttgtcggcaacaccttg

SEQ ID NO: 24724 - DNA, 19 bp, Artificial Sequence
  Synthetic
gccgaagcgatggcgatgg

SEQ ID NO: 24725 - DNA, 20 bp, Artificial Sequence
  Synthetic
caagtgccgggcaaacctcc

SEQ ID NO: 24726 - DNA, 22 bp, Artificial Sequence
  Synthetic
cgaaagcaaagccgaactcgac

SEQ ID NO: 24727 - DNA, 20 bp, Artificial Sequence
  Synthetic
agaagccgtcttcccgctgc

SEQ ID NO: 24728 - DNA, 19 bp, Artificial Sequence
  Synthetic
tctgccttcgcttctgccg

SEQ ID NO: 24729 - DNA, 18 bp, Artificial Sequence
  Synthetic
gagcgcggggttgccttt

SEQ ID NO: 24730 - DNA, 20 bp, Artificial Sequence
  Synthetic
ctttgtcgcgggcgagtttg

SEQ ID NO: 24731 - DNA, 20 bp, Artificial Sequence
  Synthetic
tcgtcttcgcctttgaccgg

SEQ ID NO: 24732 - DNA, 22 bp, Artificial Sequence
  Synthetic
cttggcagatatgtgtcgggct

SEQ ID NO: 24733 - DNA, 22 bp, Artificial Sequence
  Synthetic
tcttcagccgccttcaaatcca

SEQ ID NO: 24734 - DNA, 19 bp, Artificial Sequence
  Synthetic
ggaggtgtggatgcggcct

SEQ ID NO: 24735 - DNA, 19 bp, Artificial Sequence
  Synthetic
ggaagctgtccgagcccgt

SEQ ID NO: 24736 - DNA, 19 bp, Artificial Sequence
  Synthetic
ggcaagtgcgccgaaatgg

SEQ ID NO: 24737 - DNA, 21 bp, Artificial Sequence
  Synthetic
gtcgccttcacatcgtgcacg

SEQ ID NO: 24738 - DNA, 19 bp, Artificial Sequence
  Synthetic
ggcaacgcggctgtcttcc

SEQ ID NO: 24739 - DNA, 20 bp, Artificial Sequence
  Synthetic
tttcaggcaggtcgggctgt

SEQ ID NO: 24740 - DNA, 21 bp, Artificial Sequence
  Synthetic
cgattgcgatatacccggcgg

SEQ ID NO: 24741 - DNA, 19 bp, Artificial Sequence
  Synthetic
cgtcgcataccaaacgcgc

SEQ ID NO: 24742 - DNA, 20 bp, Artificial Sequence
  Synthetic
gaagcctgccgcgagattct

SEQ ID NO: 24743 - DNA, 22 bp, Artificial Sequence
  Synthetic
acgcaccacaacgacagtatgg

SEQ ID NO: 24744 - DNA, 20 bp, Artificial Sequence
  Synthetic
ttgggacgggcagaacgacc

SEQ ID NO: 24745 - DNA, 21 bp, Artificial Sequence
  Synthetic
ccgaaatgcctgcccataccg

SEQ ID NO: 24746 - DNA, 20 bp, Artificial Sequence
  Synthetic
gtttgcctgtttgagcgcgt

SEQ ID NO: 24747 - DNA, 20 bp, Artificial Sequence
  Synthetic
gacattgccgccgctcaagc

SEQ ID NO: 24748 - DNA, 21 bp, Artificial Sequence
  Synthetic
gtaaccgccgcccaattcgtc

SEQ ID NO: 24749 - DNA, 21 bp, Artificial Sequence
  Synthetic
gcaaacgaaatgccttgcgcc

SEQ ID NO: 24750 - DNA, 20 bp, Artificial Sequence
  Synthetic
ggcaggaacgaagtcggcag

SEQ ID NO: 24751 - DNA, 20 bp, Artificial Sequence
  Synthetic
cgatttgctccgcgtgttgc

SEQ ID NO: 24752 - DNA, 21 bp, Artificial Sequence
  Synthetic
caaccaggtcgaatacggcgg

SEQ ID NO: 24753 - DNA, 19 bp, Artificial Sequence
  Synthetic
cggatgtggcggatgacgg

SEQ ID NO: 24754 - DNA, 19 bp, Artificial Sequence
  Synthetic
ctgccgccatatccgggca

SEQ ID NO: 24755 - DNA, 20 bp, Artificial Sequence
  Synthetic
aaacagctgatccgtgccgc

SEQ ID NO: 24756 - DNA, 22 bp, Artificial Sequence
  Synthetic
caatgcatcccgctcggattga

SEQ ID NO: 24757 - DNA, 21 bp, Artificial Sequence
  Synthetic
tacctgcccaagcaatacccg

SEQ ID NO: 24758 - DNA, 20 bp, Artificial Sequence
  Synthetic
cgcccacacgtgccaaatca

SEQ ID NO: 24759 - DNA, 20 bp, Artificial Sequence
  Synthetic
tcgccccttatgacctcgac

SEQ ID NO: 24760 - DNA, 20 bp, Artificial Sequence
  Synthetic
gacaccgtgcgcgaagaagg

SEQ ID NO: 24761 - DNA, 19 bp, Artificial Sequence
  Synthetic
cgctcgcccgccacaaact

SEQ ID NO: 24762 - DNA, 20 bp, Artificial Sequence
  Synthetic
ggtacgacttcgatgccgcg

SEQ ID NO: 24763 - DNA, 22 bp, Artificial Sequence
  Synthetic
aaccttggtcgcccataacgga

SEQ ID NO: 24764 - DNA, 20 bp, Artificial Sequence
  Synthetic
ggccgaccgacagtttccag

SEQ ID NO: 24765 - DNA, 21 bp, Artificial Sequence
  Synthetic
ggcaagggcgaggatgatgag

SEQ ID NO: 24766 - DNA, 19 bp, Artificial Sequence
  Synthetic
ctctgcctgccctgctgct

SEQ ID NO: 24767 - DNA, 22 bp, Artificial Sequence
  Synthetic
cgttaacaccgagcttgtcgca

SEQ ID NO: 24768 - DNA, 20 bp, Artificial Sequence
  Synthetic
cgaggttcgcaccgacttcg

SEQ ID NO: 24769 - DNA, 20 bp, Artificial Sequence
  Synthetic
aagccgcacaagcctttccc

SEQ ID NO: 24770 - DNA, 21 bp, Artificial Sequence
  Synthetic
tgccgcgttgtcgtgaaaagc

SEQ ID NO: 24771 - DNA, 22 bp, Artificial Sequence
  Synthetic
tcgtctttcaactgcgcttcca

SEQ ID NO: 24772 - DNA, 21 bp, Artificial Sequence
  Synthetic
gcgtcgtggtttcagacgtgc

SEQ ID NO: 24773 - DNA, 19 bp, Artificial Sequence
  Synthetic
ggacaggcgcggcgaaact

SEQ ID NO: 24774 - DNA, 19 bp, Artificial Sequence
  Synthetic
gcaccatcagcatcggggc

SEQ ID NO: 24775 - DNA, 19 bp, Artificial Sequence
  Synthetic
cggcacgtcggcaaaacgg

SEQ ID NO: 24776 - DNA, 19 bp, Artificial Sequence
  Synthetic
gctgtccgcccgagagttc

SEQ ID NO: 24777 - DNA, 20 bp, Artificial Sequence
  Synthetic
cgcgacacgcctttttcctg

SEQ ID NO: 24778 - DNA, 19 bp, Artificial Sequence
  Synthetic
ggcggggttgaggctgaac

SEQ ID NO: 24779 - DNA, 20 bp, Artificial Sequence
  Synthetic
cctcctgctgctgcaacagg

SEQ ID NO: 24780 - DNA, 19 bp, Artificial Sequence
  Synthetic
actgtgccagttcgcgctc

SEQ ID NO: 24781 - DNA, 19 bp, Artificial Sequence
  Synthetic
ggcaaaggtgcgggcggta

SEQ ID NO: 24782 - DNA, 22 bp, Artificial Sequence
  Synthetic
tgcgacaggatttgcgacaacg

SEQ ID NO: 24783 - DNA, 20 bp, Artificial Sequence
  Synthetic
tcctgctgggtttggaaggc

SEQ ID NO: 24784 - DNA, 19 bp, Artificial Sequence
  Synthetic
ctttcggcgcgggggtttc

SEQ ID NO: 24785 - DNA, 21 bp, Artificial Sequence
  Synthetic
ataccggcctgtccgtgaccc

SEQ ID NO: 24786 - DNA, 22 bp, Artificial Sequence
  Synthetic
ggcttcgtacagcttatcgcct

SEQ ID NO: 24787 - DNA, 20 bp, Artificial Sequence
  Synthetic
ccgacaatggcaagggcgtt

SEQ ID NO: 24788 - DNA, 21 bp, Artificial Sequence
  Synthetic
ccgccgtacaacgaatggctc

SEQ ID NO: 24789 - DNA, 19 bp, Artificial Sequence
  Synthetic
ccctcgccgctgattgacg

SEQ ID NO: 24790 - DNA, 22 bp, Artificial Sequence
  Synthetic
acggcgaaatcgaatgggtcaa

SEQ ID NO: 24791 - DNA, 18 bp, Artificial Sequence
  Synthetic
gcggcggatgctgttgct

SEQ ID NO: 24792 - DNA, 19 bp, Artificial Sequence
  Synthetic
cgccgtcgcggaatgggaa

SEQ ID NO: 24793 - DNA, 20 bp, Artificial Sequence
  Synthetic
agcggcacttccaatacgcg

SEQ ID NO: 24794 - DNA, 20 bp, Artificial Sequence
  Synthetic
aggcgagtttgtaggcggtc

SEQ ID NO: 24795 - DNA, 18 bp, Artificial Sequence
  Synthetic
aacgcaccatggtcgggc

SEQ ID NO: 24796 - DNA, 18 bp, Artificial Sequence
  Synthetic
agaaacaccgccgctccg

SEQ ID NO: 24797 - DNA, 20 bp, Artificial Sequence
  Synthetic
cgtccacacgcccaacatcg

SEQ ID NO: 24798 - DNA, 19 bp, Artificial Sequence
  Synthetic
gcgcggtaagccacgccta

SEQ ID NO: 24799 - DNA, 21 bp, Artificial Sequence
  Synthetic
tgttgtcggtttagcagcaag

SEQ ID NO: 24800 - DNA, 21 bp, Artificial Sequence
  Synthetic
gtttgaacacgattgaccgct

SEQ ID NO: 24801 - DNA, 22 bp, Artificial Sequence
  Synthetic
ccacctacttacattttgcggt

SEQ ID NO: 24802 - DNA, 20 bp, Artificial Sequence
  Synthetic
ggtcgcgccattcagaaaac

SEQ ID NO: 24803 - DNA, 20 bp, Artificial Sequence
  Synthetic
aaacagcccgaatcacaacc

SEQ ID NO: 24804 - DNA, 20 bp, Artificial Sequence
  Synthetic
acacaaagcgagatgcccga

SEQ ID NO: 24805 - DNA, 24 bp, Artificial Sequence
  Synthetic
acgtgatgatgctaaatttttgca

SEQ ID NO: 24806 - DNA, 24 bp, Artificial Sequence
  Synthetic
ggtcgtcatgaagttttaatgcgg

SEQ ID NO: 24807 - DNA, 20 bp, Artificial Sequence
  Synthetic
cggaagcgatgcacaatctg

SEQ ID NO: 24808 - DNA, 24 bp, Artificial Sequence
  Synthetic
tctgaaagatgatgatgagccaag

SEQ ID NO: 24809 - DNA, 22 bp, Artificial Sequence
  Synthetic
tgcaactgacctgcaaattttc

SEQ ID NO: 24810 - DNA, 24 bp, Artificial Sequence
  Synthetic
gtgcctgtcataatcgcttaatgc

SEQ ID NO: 24811 - DNA, 20 bp, Artificial Sequence
  Synthetic
cgttggaaacgttgtgcgac

SEQ ID NO: 24812 - DNA, 21 bp, Artificial Sequence
  Synthetic
catagccagcagcgtccaagc

SEQ ID NO: 24813 - DNA, 19 bp, Artificial Sequence
  Synthetic
cggttggtcaggcgcacgt

SEQ ID NO: 24814 - DNA, 20 bp, Artificial Sequence
  Synthetic
tcgcccaggtaagtctttgg

SEQ ID NO: 24815 - DNA, 19 bp, Artificial Sequence
  Synthetic
acattgacacacggcggcg

SEQ ID NO: 24816 - DNA, 18 bp, Artificial Sequence
  Synthetic
ccgcagtttaccgccgca

SEQ ID NO: 24817 - DNA, 19 bp, Artificial Sequence
  Synthetic
tttcaccagcccctccgcg

SEQ ID NO: 24818 - DNA, 20 bp, Artificial Sequence
  Synthetic
gctgggcagcgaatccttcc

SEQ ID NO: 24819 - DNA, 18 bp, Artificial Sequence
  Synthetic
gccgccggcaaattccca

SEQ ID NO: 24820 - DNA, 19 bp, Artificial Sequence
  Synthetic
gcccgatgccgatgttgcg

SEQ ID NO: 24821 - DNA, 18 bp, Artificial Sequence
  Synthetic
ggctgtgtgcgtcggcat

SEQ ID NO: 24822 - DNA, 19 bp, Artificial Sequence
  Synthetic
ggcgcggtgcagggttttg

SEQ ID NO: 24823 - DNA, 22 bp, Artificial Sequence
  Synthetic
ctgttgggtaaacgtgccctgc

SEQ ID NO: 24824 - DNA, 20 bp, Artificial Sequence
  Synthetic
acccgaaaaacagcacggcg

SEQ ID NO: 24825 - DNA, 20 bp, Artificial Sequence
  Synthetic
gcaatcagcctttgcgtcgg

SEQ ID NO: 24826 - DNA, 18 bp, Artificial Sequence
  Synthetic
aagcgacagcatccgccg

SEQ ID NO: 24827 - DNA, 21 bp, Artificial Sequence
  Synthetic
acaccgatgccgtctgaacct

SEQ ID NO: 24828 - DNA, 22 bp, Artificial Sequence
  Synthetic
ccacttccgtgggaatgacggt

SEQ ID NO: 24829 - DNA, 22 bp, Artificial Sequence
  Synthetic
cggcggataaatcgaattgccc

SEQ ID NO: 24830 - DNA, 22 bp, Artificial Sequence
  Synthetic
tccaaacgctcgcggatttcat

SEQ ID NO: 24831 - DNA, 19 bp, Artificial Sequence
  Synthetic
gttcctgcgcggcgaggat

SEQ ID NO: 24832 - DNA, 18 bp, Artificial Sequence
  Synthetic
tttacgcgttccgccgcc

SEQ ID NO: 24833 - DNA, 18 bp, Artificial Sequence
  Synthetic
cgcgacgaaggcgggttt

SEQ ID NO: 24834 - DNA, 21 bp, Artificial Sequence
  Synthetic
tgtacgttcccctgccagtgc

SEQ ID NO: 24835 - DNA, 22 bp, Artificial Sequence
  Synthetic
aggctcttcgtaaggcttcgcc

SEQ ID NO: 24836 - DNA, 19 bp, Artificial Sequence
  Synthetic
ccccgaccacgcgctcttt

SEQ ID NO: 24837 - DNA, 20 bp, Artificial Sequence
  Synthetic
ccacgccacggaaatcacgc

SEQ ID NO: 24838 - DNA, 17 bp, Artificial Sequence
  Synthetic
aaaacggcggcgcacca

SEQ ID NO: 24839 - DNA, 21 bp, Artificial Sequence
  Synthetic
cgtatttttggaagcggcggc

SEQ ID NO: 24840 - DNA, 22 bp, Artificial Sequence
  Synthetic
agagtgggtaagctggtagccg

SEQ ID NO: 24841 - DNA, 20 bp, Artificial Sequence
  Synthetic
gacgccgatcaggaacacgc

SEQ ID NO: 24842 - DNA, 22 bp, Artificial Sequence
  Synthetic
gcttgaacgcctcgatatccgg

SEQ ID NO: 24843 - DNA, 18 bp, Artificial Sequence
  Synthetic
gcactgcctgcccgcatt

SEQ ID NO: 24844 - DNA, 18 bp, Artificial Sequence
  Synthetic
aaccggcagccaaagcca

SEQ ID NO: 24845 - DNA, 18 bp, Artificial Sequence
  Synthetic
gctgccgcgcccatcaat

SEQ ID NO: 24846 - DNA, 22 bp, Artificial Sequence
  Synthetic
aacggtagagcagggtttggac

SEQ ID NO: 24847 - DNA, 19 bp, Artificial Sequence
  Synthetic
cggccgggtctgttgggat

SEQ ID NO: 24848 - DNA, 20 bp, Artificial Sequence
  Synthetic
caggttgcccatcgggtaat

SEQ ID NO: 24849 - DNA, 21 bp, Artificial Sequence
  Synthetic
cgccgaacatgacatgtccca

SEQ ID NO: 24850 - DNA, 20 bp, Artificial Sequence
  Synthetic
acctcgtcggctttgtcggc

SEQ ID NO: 24851 - DNA, 20 bp, Artificial Sequence
  Synthetic
cgtttgcttacgggcggata

SEQ ID NO: 24852 - DNA, 18 bp, Artificial Sequence
  Synthetic
acgcactgctttcgcccg

SEQ ID NO: 24853 - DNA, 22 bp, Artificial Sequence
  Synthetic
caaactctccgccatccatccg

SEQ ID NO: 24854 - DNA, 20 bp, Artificial Sequence
  Synthetic
agccgtcgatttctgccgct

SEQ ID NO: 24855 - DNA, 21 bp, Artificial Sequence
  Synthetic
agcctgattgccggttatgcc

SEQ ID NO: 24856 - DNA, 19 bp, Artificial Sequence
  Synthetic
aaagcccttgccaaacgcg

SEQ ID NO: 24857 - DNA, 21 bp, Artificial Sequence
  Synthetic
ccgacttggacggtttgctgc

SEQ ID NO: 24858 - DNA, 21 bp, Artificial Sequence
  Synthetic
cgcttggaaaacacccgcttc

SEQ ID NO: 24859 - DNA, 19 bp, Artificial Sequence
  Synthetic
aaggcgcacgcaattccgc

SEQ ID NO: 24860 - DNA, 18 bp, Artificial Sequence
  Synthetic
tgggcggcagtgcgcaat

SEQ ID NO: 24861 - DNA, 19 bp, Artificial Sequence
  Synthetic
cgcgccaagtccataccgg

SEQ ID NO: 24862 - DNA, 20 bp, Artificial Sequence
  Synthetic
gtccgcaccatcctgtcgca

SEQ ID NO: 24863 - DNA, 21 bp, Artificial Sequence
  Synthetic
tttcccgtccatccatcggca

SEQ ID NO: 24864 - DNA, 19 bp, Artificial Sequence
  Synthetic
ctgcgcctgcggcaatttg

SEQ ID NO: 24865 - DNA, 21 bp, Artificial Sequence
  Synthetic
gtgttgctgctggacgaaccg

SEQ ID NO: 24866 - DNA, 21 bp, Artificial Sequence
  Synthetic
gcatggcgacaatctcgtccc

SEQ ID NO: 24867 - DNA, 22 bp, Artificial Sequence
  Synthetic
attcggcgaacacatcatccgg

SEQ ID NO: 24868 - DNA, 24 bp, Artificial Sequence
  Synthetic
atcttgatgtgtttgtgttcgacg

SEQ ID NO: 24869 - DNA, 20 bp, Artificial Sequence
  Synthetic
ctgcaccgcagcaggatgtt

SEQ ID NO: 24870 - DNA, 22 bp, Artificial Sequence
  Synthetic
aacatcagcgtactcccccccg

SEQ ID NO: 24871 - DNA, 22 bp, Artificial Sequence
  Synthetic
gcgtaaccacttccacatcggt

SEQ ID NO: 24872 - DNA, 21 bp, Artificial Sequence
  Synthetic
gatgacggtccgttgcagtcg

SEQ ID NO: 24873 - DNA, 21 bp, Artificial Sequence
  Synthetic
ctggtgtggttggaagacggc

SEQ ID NO: 24874 - DNA, 18 bp, Artificial Sequence
  Synthetic
gcgggcgcgttcgtgtat

SEQ ID NO: 24875 - DNA, 22 bp, Artificial Sequence
  Synthetic
cgccattttgcgcccgatatgt

SEQ ID NO: 24876 - DNA, 19 bp, Artificial Sequence
  Synthetic
accgacgcaggcatcgatg

SEQ ID NO: 24877 - DNA, 21 bp, Artificial Sequence
  Synthetic
agcttcttcatctcgcgcgtg

SEQ ID NO: 24878 - DNA, 20 bp, Artificial Sequence
  Synthetic
atgggcatctaccggcgtga

SEQ ID NO: 24879 - DNA, 22 bp, Artificial Sequence
  Synthetic
cgacatcggcgatttcgtcctg

SEQ ID NO: 24880 - DNA, 21 bp, Artificial Sequence
  Synthetic
ttccgacaccgcaatatgccc

SEQ ID NO: 24881 - DNA, 21 bp, Artificial Sequence
  Synthetic
atcggcgtattcgatcggggc

SEQ ID NO: 24882 - DNA, 19 bp, Artificial Sequence
  Synthetic
tcttcggcggctttggcgg

SEQ ID NO: 24883 - DNA, 19 bp, Artificial Sequence
  Synthetic
cgcacgggattcagcggct

SEQ ID NO: 24884 - DNA, 20 bp, Artificial Sequence
  Synthetic
atgcgggcggaggattatgc

SEQ ID NO: 24885 - DNA, 19 bp, Artificial Sequence
  Synthetic
agtgctgaacgacacgcgc

SEQ ID NO: 24886 - DNA, 21 bp, Artificial Sequence
  Synthetic
cgcgattgagcaagacgcaaa

SEQ ID NO: 24887 - DNA, 20 bp, Artificial Sequence
  Synthetic
ggaggcggcggcgtataagg

SEQ ID NO: 24888 - DNA, 18 bp, Artificial Sequence
  Synthetic
atccgccgtggtgttgcc

SEQ ID NO: 24889 - DNA, 19 bp, Artificial Sequence
  Synthetic
acactgcctgggcaaagcg

SEQ ID NO: 24890 - DNA, 19 bp, Artificial Sequence
  Synthetic
gcccgaaactgccgcacct

SEQ ID NO: 24891 - DNA, 23 bp, Artificial Sequence
  Synthetic
aactgacgggcattttgaatttg

SEQ ID NO: 24892 - DNA, 20 bp, Artificial Sequence
  Synthetic
ccagtccgacccactgcatc

SEQ ID NO: 24893 - DNA, 21 bp, Artificial Sequence
  Synthetic
gggcggactgaatatccggtc

SEQ ID NO: 24894 - DNA, 20 bp, Artificial Sequence
  Synthetic
gcacaggcagtccgcgatcc

SEQ ID NO: 24895 - DNA, 22 bp, Artificial Sequence
  Synthetic
ttcaaccgcgatgtgtccgtag

SEQ ID NO: 24896 - DNA, 20 bp, Artificial Sequence
  Synthetic
cggtacatcacgctgcgctg

SEQ ID NO: 24897 - DNA, 20 bp, Artificial Sequence
  Synthetic
cggtacgcggccttggtaga

SEQ ID NO: 24898 - DNA, 20 bp, Artificial Sequence
  Synthetic
ctgcaggggctcgagtacgc

SEQ ID NO: 24899 - DNA, 22 bp, Artificial Sequence
  Synthetic
cagtcgtacatcgcaaacacgc

SEQ ID NO: 24900 - DNA, 19 bp, Artificial Sequence
  Synthetic
cccctcgctgccgttgact

SEQ ID NO: 24901 - DNA, 18 bp, Artificial Sequence
  Synthetic
cagcggcaaatcggcagc

SEQ ID NO: 24902 - DNA, 20 bp, Artificial Sequence
  Synthetic
cgtaaaaaccggcggcaaac

SEQ ID NO: 24903 - DNA, 22 bp, Artificial Sequence
  Synthetic
tttccagcgcggatattctggc

SEQ ID NO: 24904 - DNA, 22 bp, Artificial Sequence
  Synthetic
aggatggggtgcatacggtagc

SEQ ID NO: 24905 - DNA, 22 bp, Artificial Sequence
  Synthetic
ccgatacggtttggagccgttt

SEQ ID NO: 24906 - DNA, 21 bp, Artificial Sequence
  Synthetic
tggttcgcaccgctttacgaa

SEQ ID NO: 24907 - DNA, 20 bp, Artificial Sequence
  Synthetic
gcgaccataccaaacaccca

SEQ ID NO: 24908 - DNA, 20 bp, Artificial Sequence
  Synthetic
ggcaaagcaaaaacccccgg

SEQ ID NO: 24909 - DNA, 20 bp, Artificial Sequence
  Synthetic
tttgcctgacccactgcctg

SEQ ID NO: 24910 - DNA, 22 bp, Artificial Sequence
  Synthetic
cgaaatgattaaggcgggcgcg

SEQ ID NO: 24911 - DNA, 21 bp, Artificial Sequence
  Synthetic
acgttttaaacctcccccgcc

SEQ ID NO: 24912 - DNA, 19 bp, Artificial Sequence
  Synthetic
gccaccctgcaatcgctcg

SEQ ID NO: 24913 - DNA, 20 bp, Artificial Sequence
  Synthetic
tgcccaagctgatttcgccc

SEQ ID NO: 24914 - DNA, 22 bp, Artificial Sequence
  Synthetic
tcatcgaaatcaccgtccccga

SEQ ID NO: 24915 - DNA, 22 bp, Artificial Sequence
  Synthetic
tcgaaataccccaatcggaacc

SEQ ID NO: 24916 - DNA, 19 bp, Artificial Sequence
  Synthetic
gcggcagggttgggttcga

SEQ ID NO: 24917 - DNA, 19 bp, Artificial Sequence
  Synthetic
gtttcgcgcgcctcttgca

SEQ ID NO: 24918 - DNA, 20 bp, Artificial Sequence
  Synthetic
aaccgacttcccggcaaacg

SEQ ID NO: 24919 - DNA, 22 bp, Artificial Sequence
  Synthetic
gcgtggacggcttcttcaaagg

SEQ ID NO: 24920 - DNA, 18 bp, Artificial Sequence
  Synthetic
acggcggcgtttttgctg

SEQ ID NO: 24921 - DNA, 20 bp, Artificial Sequence
  Synthetic
atgttgtcggcaagctcgcg

SEQ ID NO: 24922 - DNA, 18 bp, Artificial Sequence
  Synthetic
ctttggcgggcgcggttt

SEQ ID NO: 24923 - DNA, 21 bp, Artificial Sequence
  Synthetic
ttccatacggacgttgtgcgc

SEQ ID NO: 24924 - DNA, 22 bp, Artificial Sequence
  Synthetic
atcggaagcttgtgcggattcg

SEQ ID NO: 24925 - DNA, 21 bp, Artificial Sequence
  Synthetic
acactgggcgagtttgacgac

SEQ ID NO: 24926 - DNA, 19 bp, Artificial Sequence
  Synthetic
aaacctgcccgccgtcatt

SEQ ID NO: 24927 - DNA, 20 bp, Artificial Sequence
  Synthetic
cttgccgatatgcttgccgc

SEQ ID NO: 24928 - DNA, 18 bp, Artificial Sequence
  Synthetic
gctgctgcaacgcgggtt

SEQ ID NO: 24929 - DNA, 19 bp, Artificial Sequence
  Synthetic
ggctgcctgccgacatcct

SEQ ID NO: 24930 - DNA, 21 bp, Artificial Sequence
  Synthetic
aaaaccctgcccatccccagc

SEQ ID NO: 24931 - DNA, 22 bp, Artificial Sequence
  Synthetic
atgtcaaacgcctctcctccgc

SEQ ID NO: 24932 - DNA, 21 bp, Artificial Sequence
  Synthetic
cggcgatgatggtgttttcgg

SEQ ID NO: 24933 - DNA, 19 bp, Artificial Sequence
  Synthetic
ggctggcgactctgctgca

SEQ ID NO: 24934 - DNA, 20 bp, Artificial Sequence
  Synthetic
cacgactgaaccgatgccgt

SEQ ID NO: 24935 - DNA, 19 bp, Artificial Sequence
  Synthetic
cgtcgatttcgcctgcggc

SEQ ID NO: 24936 - DNA, 22 bp, Artificial Sequence
  Synthetic
ggtggtgtccgaaatgtttgcg

SEQ ID NO: 24937 - DNA, 21 bp, Artificial Sequence
  Synthetic
taatagaggcccgccgcaaag

SEQ ID NO: 24938 - DNA, 22 bp, Artificial Sequence
  Synthetic
acggcatttgtcatcactggcc

SEQ ID NO: 24939 - DNA, 22 bp, Artificial Sequence
  Synthetic
ttacccatcgcaccgacaaaca

SEQ ID NO: 24940 - DNA, 22 bp, Artificial Sequence
  Synthetic
ttgaggccgtctgaaacttcgc

SEQ ID NO: 24941 - DNA, 20 bp, Artificial Sequence
  Synthetic
cacgcagaaggtcagcacca

SEQ ID NO: 24942 - DNA, 19 bp, Artificial Sequence
  Synthetic
gcccatgtgctgcggttgt

SEQ ID NO: 24943 - DNA, 21 bp, Artificial Sequence
  Synthetic
ggcggcggtatttatgtccgt

SEQ ID NO: 24944 - DNA, 20 bp, Artificial Sequence
  Synthetic
aaaaccgctcaaaccgccct

SEQ ID NO: 24945 - DNA, 19 bp, Artificial Sequence
  Synthetic
ggtcaacgcaggcggttcg

SEQ ID NO: 24946 - DNA, 21 bp, Artificial Sequence
  Synthetic
ccaacacacccaagccacaca

SEQ ID NO: 24947 - DNA, 22 bp, Artificial Sequence
  Synthetic
attcggtgactacggctggatg

SEQ ID NO: 24948 - DNA, 20 bp, Artificial Sequence
  Synthetic
caccaacctcaccggctcaa

SEQ ID NO: 24949 - DNA, 21 bp, Artificial Sequence
  Synthetic
gttccgccacaaacaactggg

SEQ ID NO: 24950 - DNA, 21 bp, Artificial Sequence
  Synthetic
ggcttcccaagtacaggcctc

SEQ ID NO: 24951 - DNA, 18 bp, Artificial Sequence
  Synthetic
ggacgtgccgccgatgtt

SEQ ID NO: 24952 - DNA, 21 bp, Artificial Sequence
  Synthetic
ccagaagcgtttgcctgtggc

SEQ ID NO: 24953 - DNA, 22 bp, Artificial Sequence
  Synthetic
gagggtgaggatttcgtcgtgg

SEQ ID NO: 24954 - DNA, 20 bp, Artificial Sequence
  Synthetic
ggtcagacgctcgacggtgt

SEQ ID NO: 24955 - DNA, 19 bp, Artificial Sequence
  Synthetic
gcgtgggcgtatccgtcgt

SEQ ID NO: 24956 - DNA, 18 bp, Artificial Sequence
  Synthetic
gcgcggcaggcatcattc

SEQ ID NO: 24957 - DNA, 19 bp, Artificial Sequence
  Synthetic
agcgtgttcaatggcggcg

SEQ ID NO: 24958 - DNA, 19 bp, Artificial Sequence
  Synthetic
gcacgctcgcgctcttgga

SEQ ID NO: 24959 - DNA, 21 bp, Artificial Sequence
  Synthetic
gtgccgactgttttgccgacg

SEQ ID NO: 24960 - DNA, 22 bp, Artificial Sequence
  Synthetic
ttccgacaaaatccggctcaca

SEQ ID NO: 24961 - DNA, 20 bp, Artificial Sequence
  Synthetic
cgaagccgacgaacgcaagg

SEQ ID NO: 24962 - DNA, 21 bp, Artificial Sequence
  Synthetic
aaacagccgttgaccgcaacc

SEQ ID NO: 24963 - DNA, 20 bp, Artificial Sequence
  Synthetic
gacaaactccgcacgtccgc

SEQ ID NO: 24964 - DNA, 19 bp, Artificial Sequence
  Synthetic
cggcacgcctttcagacgg

SEQ ID NO: 24965 - DNA, 19 bp, Artificial Sequence
  Synthetic
cgaaagcagccacgtcgcc

SEQ ID NO: 24966 - DNA, 21 bp, Artificial Sequence
  Synthetic
ctgaacgaaaaacgcgccgag

SEQ ID NO: 24967 - DNA, 18 bp, Artificial Sequence
  Synthetic
acgtggccaaaccgcacc

SEQ ID NO: 24968 - DNA, 20 bp, Artificial Sequence
  Synthetic
catcgccacacccgttcaga

SEQ ID NO: 24969 - DNA, 18 bp, Artificial Sequence
  Synthetic
accgcacaaaccggcgga

SEQ ID NO: 24970 - DNA, 19 bp, Artificial Sequence
  Synthetic
cgtgatcgacggaggtgcg

SEQ ID NO: 24971 - DNA, 22 bp, Artificial Sequence
  Synthetic
ttggaaaactacgaaggcggcc

SEQ ID NO: 24972 - DNA, 20 bp, Artificial Sequence
  Synthetic
cccgaacctcgattacgccg

SEQ ID NO: 24973 - DNA, 19 bp, Artificial Sequence
  Synthetic
atccgccctctttgctgcg

SEQ ID NO: 24974 - DNA, 21 bp, Artificial Sequence
  Synthetic
gtcgtcgttttgcccacaccg

SEQ ID NO: 24975 - DNA, 18 bp, Artificial Sequence
  Synthetic
gccattgccgccgccaaa

SEQ ID NO: 24976 - DNA, 19 bp, Artificial Sequence
  Synthetic
aaaagccgcagccacctcg

SEQ ID NO: 24977 - DNA, 19 bp, Artificial Sequence
  Synthetic
tgctcgaccgccacttcac

SEQ ID NO: 24978 - DNA, 22 bp, Artificial Sequence
  Synthetic
caggaaatttccgccctcgtca

SEQ ID NO: 24979 - DNA, 22 bp, Artificial Sequence
  Synthetic
caaacttgggactgaacccggc

SEQ ID NO: 24980 - DNA, 19 bp, Artificial Sequence
  Synthetic
aggcgctcggcaaacacaa

SEQ ID NO: 24981 - DNA, 22 bp, Artificial Sequence
  Synthetic
gcgacacctacaacgacacaca

SEQ ID NO: 24982 - DNA, 22 bp, Artificial Sequence
  Synthetic
atcgccgacaaaaccaccatcg

SEQ ID NO: 24983 - DNA, 19 bp, Artificial Sequence
  Synthetic
ccgggcgcggtattctgga

SEQ ID NO: 24984 - DNA, 19 bp, Artificial Sequence
  Synthetic
ggacgacgtacgcgccgaa

SEQ ID NO: 24985 - DNA, 18 bp, Artificial Sequence
  Synthetic
cgacggcggcgagattgt

SEQ ID NO: 24986 - DNA, 24 bp, Artificial Sequence
  Synthetic
accaataccgtaaatagcctgaag

SEQ ID NO: 24987 - DNA, 22 bp, Artificial Sequence
  Synthetic
aaatgtcttccactgtcaagcc

SEQ ID NO: 24988 - DNA, 22 bp, Artificial Sequence
  Synthetic
cgacagcagctttgatttcagg

SEQ ID NO: 24989 - DNA, 20 bp, Artificial Sequence
  Synthetic
cgccgcatattttcagacgg

SEQ ID NO: 24990 - DNA, 19 bp, Artificial Sequence
  Synthetic
ccccttcagacggcatcgc

SEQ ID NO: 24991 - DNA, 21 bp, Artificial Sequence
  Synthetic
gagttcgcggttttcaacgcg

SEQ ID NO: 24992 - DNA, 21 bp, Artificial Sequence
  Synthetic
gtaaccagactgtacgggccg

SEQ ID NO: 24993 - DNA, 21 bp, Artificial Sequence
  Synthetic
gggaatcagaagcggtagcgc

SEQ ID NO: 24994 - DNA, 19 bp, Artificial Sequence
  Synthetic
gccaggccggcggtaatca

SEQ ID NO: 24995 - DNA, 20 bp, Artificial Sequence
  Synthetic
atatgccccgttccgtcggc

SEQ ID NO: 24996 - DNA, 19 bp, Artificial Sequence
  Synthetic
gcgcgtatcagcacggtga

SEQ ID NO: 24997 - DNA, 21 bp, Artificial Sequence
  Synthetic
tggtcgaaaccgccatttccg

SEQ ID NO: 24998 - DNA, 20 bp, Artificial Sequence
  Synthetic
cgctgaacgccaataccgcc

SEQ ID NO: 24999 - DNA, 22 bp, Artificial Sequence
  Synthetic
cggcgcgtatccgtttgaaacc

SEQ ID NO: 25000 - DNA, 20 bp, Artificial Sequence
  Synthetic
acggcgttgaacgaagtcga

SEQ ID NO: 25001 - DNA, 19 bp, Artificial Sequence
  Synthetic
gcgtgggcgtgaactaccg

SEQ ID NO: 25002 - DNA, 22 bp, Artificial Sequence
  Synthetic
aattgttggaatccggcttgtt

SEQ ID NO: 25003 - DNA, 19 bp, Artificial Sequence
  Synthetic
cgcgcgggtcttggacgaa

SEQ ID NO: 25004 - DNA, 21 bp, Artificial Sequence
  Synthetic
tttgaccaactcggcaagcgg

SEQ ID NO: 25005 - DNA, 19 bp, Artificial Sequence
  Synthetic
gcaccagttcgcccgcgat

SEQ ID NO: 25006 - DNA, 20 bp, Artificial Sequence
  Synthetic
cgcccgtggcttctttacgg

SEQ ID NO: 25007 - DNA, 22 bp, Artificial Sequence
  Synthetic
aacgccgccatttccatatcgg

SEQ ID NO: 25008 - DNA, 20 bp, Artificial Sequence
  Synthetic
gcacttctaactccccgccc

SEQ ID NO: 25009 - DNA, 22 bp, Artificial Sequence
  Synthetic
tttgcaaaggtctcagaatgcc

SEQ ID NO: 25010 - DNA, 21 bp, Artificial Sequence
  Synthetic
agcgtaccgaccgacaatccg

SEQ ID NO: 25011 - DNA, 20 bp, Artificial Sequence
  Synthetic
cgtattccccgccggagaga

SEQ ID NO: 25012 - DNA, 20 bp, Artificial Sequence
  Synthetic
aatacgcgatgcagctcgcc

SEQ ID NO: 25013 - DNA, 19 bp, Artificial Sequence
  Synthetic
aagctcgccatgcccttcg

SEQ ID NO: 25014 - DNA, 22 bp, Artificial Sequence
  Synthetic
ttccaaatcatcctgccccacc

SEQ ID NO: 25015 - DNA, 21 bp, Artificial Sequence
  Synthetic
tgagccgccttctcgacaacc

SEQ ID NO: 25016 - DNA, 18 bp, Artificial Sequence
  Synthetic
attccgccatgccgtccg

SEQ ID NO: 25017 - DNA, 20 bp, Artificial Sequence
  Synthetic
cggcgtaatcgtcggctcgc

SEQ ID NO: 25018 - DNA, 20 bp, Artificial Sequence
  Synthetic
cgcataccgcagcgaaatgc

SEQ ID NO: 25019 - DNA, 20 bp, Artificial Sequence
  Synthetic
gcagcagcggaacacaaagc

SEQ ID NO: 25020 - DNA, 19 bp, Artificial Sequence
  Synthetic
cggttccctaaggcgccca

SEQ ID NO: 25021 - DNA, 19 bp, Artificial Sequence
  Synthetic
tgcagaccggcaagctgtt

SEQ ID NO: 25022 - DNA, 19 bp, Artificial Sequence
  Synthetic
gcgggcgaactcgacgctt

SEQ ID NO: 25023 - DNA, 22 bp, Artificial Sequence
  Synthetic
atgattttggacatcggcccga

SEQ ID NO: 25024 - DNA, 21 bp, Artificial Sequence
  Synthetic
ggttggcgcagaagctgtttg

SEQ ID NO: 25025 - DNA, 22 bp, Artificial Sequence
  Synthetic
agacgacctgattattgcccgc

SEQ ID NO: 25026 - DNA, 21 bp, Artificial Sequence
  Synthetic
aagggtttccaacaggctgct

SEQ ID NO: 25027 - DNA, 21 bp, Artificial Sequence
  Synthetic
cgccgacctgttcgcaaatcg

SEQ ID NO: 25028 - DNA, 22 bp, Artificial Sequence
  Synthetic
aaatgccgtctgaacacattgc

SEQ ID NO: 25029 - DNA, 20 bp, Artificial Sequence
  Synthetic
cgggctgccgtttaccatag

SEQ ID NO: 25030 - DNA, 23 bp, Artificial Sequence
  Synthetic
gttcaagtttcggctattgcaaa

SEQ ID NO: 25031 - DNA, 21 bp, Artificial Sequence
  Synthetic
ccgcaacacaagggtatgatt

SEQ ID NO: 25032 - DNA, 20 bp, Artificial Sequence
  Synthetic
ccgcagttttgccctgtcct

SEQ ID NO: 25033 - DNA, 20 bp, Artificial Sequence
  Synthetic
tatcgacatcgggcacgctg

SEQ ID NO: 25034 - DNA, 19 bp, Artificial Sequence
  Synthetic
gtaatcctgccgccgagcg

SEQ ID NO: 25035 - DNA, 19 bp, Artificial Sequence
  Synthetic
ccgggcaatacggcatcgc

SEQ ID NO: 25036 - DNA, 18 bp, Artificial Sequence
  Synthetic
gcatcgggcggcttgtgt

SEQ ID NO: 25037 - DNA, 20 bp, Artificial Sequence
  Synthetic
cgagatagccttgcgcggtc

SEQ ID NO: 25038 - DNA, 20 bp, Artificial Sequence
  Synthetic
ggtacagcccgaagcgcaaa

SEQ ID NO: 25039 - DNA, 20 bp, Artificial Sequence
  Synthetic
ggcagaggtgcggattagcg

SEQ ID NO: 25040 - DNA, 22 bp, Artificial Sequence
  Synthetic
ttttccggccttctgcgagaaa

SEQ ID NO: 25041 - DNA, 19 bp, Artificial Sequence
  Synthetic
agatgaggaggcagcgggc

SEQ ID NO: 25042 - DNA, 24 bp, Artificial Sequence
  Synthetic
ggcatattaacaacatcaaccctg

SEQ ID NO: 25043 - DNA, 21 bp, Artificial Sequence
  Synthetic
cgatggggaggtttggaagct

SEQ ID NO: 25044 - DNA, 19 bp, Artificial Sequence
  Synthetic
cgtaacctacgccgcccag

SEQ ID NO: 25045 - DNA, 19 bp, Artificial Sequence
  Synthetic
cggcatcttgtccgacggc

SEQ ID NO: 25046 - DNA, 19 bp, Artificial Sequence
  Synthetic
ggtaggaacgggcggtggt

SEQ ID NO: 25047 - DNA, 19 bp, Artificial Sequence
  Synthetic
gcggatgggggacgttgag

SEQ ID NO: 25048 - DNA, 19 bp, Artificial Sequence
  Synthetic
gcaaaggcggcttgggcaa

SEQ ID NO: 25049 - DNA, 20 bp, Artificial Sequence
  Synthetic
tgattaccgccgtctccgcc

SEQ ID NO: 25050 - DNA, 21 bp, Artificial Sequence
  Synthetic
ctatcacgcaccggtctgctg

SEQ ID NO: 25051 - DNA, 22 bp, Artificial Sequence
  Synthetic
ggcaggcgtatgcgaaagatgt

SEQ ID NO: 25052 - DNA, 21 bp, Artificial Sequence
  Synthetic
ccatgcccagtttgcggatgc

SEQ ID NO: 25053 - DNA, 18 bp, Artificial Sequence
  Synthetic
gccggaagcggcttggta

SEQ ID NO: 25054 - DNA, 22 bp, Artificial Sequence
  Synthetic
catcggcaagattttcggtcgc

SEQ ID NO: 25055 - DNA, 20 bp, Artificial Sequence
  Synthetic
gcagcagatgccggcgcata

SEQ ID NO: 25056 - DNA, 18 bp, Artificial Sequence
  Synthetic
gcctgttgcggcacttgc

SEQ ID NO: 25057 - DNA, 19 bp, Artificial Sequence
  Synthetic
cgaagcggcgggattcgga

SEQ ID NO: 25058 - DNA, 22 bp, Artificial Sequence
  Synthetic
ttgtcgaacactttgccgaagc

SEQ ID NO: 25059 - DNA, 22 bp, Artificial Sequence
  Synthetic
aacaaccgtccgatttggtgcg

SEQ ID NO: 25060 - DNA, 22 bp, Artificial Sequence
  Synthetic
gcaatacgccgtcaaaacccca

SEQ ID NO: 25061 - DNA, 19 bp, Artificial Sequence
  Synthetic
gacagggcgcggtcgagtt

SEQ ID NO: 25062 - DNA, 19 bp, Artificial Sequence
  Synthetic
gcggttttcgcgccgtagc

SEQ ID NO: 25063 - DNA, 22 bp, Artificial Sequence
  Synthetic
tcatcgtgagcgtgttcagacg

SEQ ID NO: 25064 - DNA, 19 bp, Artificial Sequence
  Synthetic
ggcatgacggcggacagtt

SEQ ID NO: 25065 - DNA, 22 bp, Artificial Sequence
  Synthetic
atttcggcaatcgataccgccg

SEQ ID NO: 25066 - DNA, 18 bp, Artificial Sequence
  Synthetic
gcaaacacgccgccgaca

SEQ ID NO: 25067 - DNA, 21 bp, Artificial Sequence
  Synthetic
cgaactttccggcggtcagaa

SEQ ID NO: 25068 - DNA, 22 bp, Artificial Sequence
  Synthetic
gtcgaattcgtcctgaccgagg

SEQ ID NO: 25069 - DNA, 20 bp, Artificial Sequence
  Synthetic
gttggcgatgctggtggtgg

SEQ ID NO: 25070 - DNA, 19 bp, Artificial Sequence
  Synthetic
ccgcgtccgattccacgct

SEQ ID NO: 25071 - DNA, 19 bp, Artificial Sequence
  Synthetic
ggttcgcccgcttccagca

SEQ ID NO: 25072 - DNA, 19 bp, Artificial Sequence
  Synthetic
tggcagccctctcgcctga

SEQ ID NO: 25073 - DNA, 20 bp, Artificial Sequence
  Synthetic
accttggttgccgcgacttt

SEQ ID NO: 25074 - DNA, 18 bp, Artificial Sequence
  Synthetic
aacggcgtggcgcaaggt

SEQ ID NO: 25075 - DNA, 21 bp, Artificial Sequence
  Synthetic
tttggcagaggcgctcaaaga

SEQ ID NO: 25076 - DNA, 21 bp, Artificial Sequence
  Synthetic
ccggcatcggcgatctcatct

SEQ ID NO: 25077 - DNA, 22 bp, Artificial Sequence
  Synthetic
gtgccgtagtggttttcgagca

SEQ ID NO: 25078 - DNA, 20 bp, Artificial Sequence
  Synthetic
ggaagggcggcttcttctgc

SEQ ID NO: 25079 - DNA, 20 bp, Artificial Sequence
  Synthetic
atgcgctgaaaacacccccg

SEQ ID NO: 25080 - DNA, 22 bp, Artificial Sequence
  Synthetic
ggcatcgggaacttaatcaggg

SEQ ID NO: 25081 - DNA, 21 bp, Artificial Sequence
  Synthetic
gcccgaagatttggtgtgccg

SEQ ID NO: 25082 - DNA, 22 bp, Artificial Sequence
  Synthetic
atgagtatcgtgctgcacggcg

SEQ ID NO: 25083 - DNA, 19 bp, Artificial Sequence
  Synthetic
ggccagccgtccgcattca

SEQ ID NO: 25084 - DNA, 20 bp, Artificial Sequence
  Synthetic
cgacaacgccctgagcaagg

SEQ ID NO: 25085 - DNA, 18 bp, Artificial Sequence
  Synthetic
tcgtctttggcggcgtcg

SEQ ID NO: 25086 - DNA, 19 bp, Artificial Sequence
  Synthetic
gcgaggtaggcggtcagca

SEQ ID NO: 25087 - DNA, 21 bp, Artificial Sequence
  Synthetic
cgtcggtgttgacggcaatgc

SEQ ID NO: 25088 - DNA, 18 bp, Artificial Sequence
  Synthetic
gccgccggcattgtcgat

SEQ ID NO: 25089 - DNA, 22 bp, Artificial Sequence
  Synthetic
cggaaggattgcaggcttttgg

SEQ ID NO: 25090 - DNA, 20 bp, Artificial Sequence
  Synthetic
tcaaacagagcccgacgtgg

SEQ ID NO: 25091 - DNA, 20 bp, Artificial Sequence
  Synthetic
gcgtgaaggtcgccaaaggc

SEQ ID NO: 25092 - DNA, 22 bp, Artificial Sequence
  Synthetic
cgttttcctgatgttccgtctt

SEQ ID NO: 25093 - DNA, 20 bp, Artificial Sequence
  Synthetic
cgggctgtccgtccgtatcg

SEQ ID NO: 25094 - DNA, 22 bp, Artificial Sequence
  Synthetic
attcatcgcggcaggttgacgg

SEQ ID NO: 25095 - DNA, 20 bp, Artificial Sequence
  Synthetic
caggcctcaacccatcctgc

SEQ ID NO: 25096 - DNA, 22 bp, Artificial Sequence
  Synthetic
aagctccctgccgtggattttg

SEQ ID NO: 25097 - DNA, 20 bp, Artificial Sequence
  Synthetic
cggggacgcggatttcagac

SEQ ID NO: 25098 - DNA, 19 bp, Artificial Sequence
  Synthetic
gttccgcgccgatgatgcg

SEQ ID NO: 25099 - DNA, 20 bp, Artificial Sequence
  Synthetic
tgatgttgacggcgcagtgg

SEQ ID NO: 25100 - DNA, 19 bp, Artificial Sequence
  Synthetic
gatgacgggcgcgacgtgt

SEQ ID NO: 25101 - DNA, 21 bp, Artificial Sequence
  Synthetic
aaagacggcttcatgcgtgcg

SEQ ID NO: 25102 - DNA, 20 bp, Artificial Sequence
  Synthetic
gaagcccagtccgacgacgt

SEQ ID NO: 25103 - DNA, 19 bp, Artificial Sequence
  Synthetic
cgtatggcgaggcggtcga

SEQ ID NO: 25104 - DNA, 22 bp, Artificial Sequence
  Synthetic
gcgaaattttgccgcctactgc

SEQ ID NO: 25105 - DNA, 20 bp, Artificial Sequence
  Synthetic
gcctgcctgaaaggttcgga

SEQ ID NO: 25106 - DNA, 19 bp, Artificial Sequence
  Synthetic
gacgatgccgcgctgctgt

SEQ ID NO: 25107 - DNA, 19 bp, Artificial Sequence
  Synthetic
gtagccgcgtttgagggcg

SEQ ID NO: 25108 - DNA, 20 bp, Artificial Sequence
  Synthetic
tcgccttcggcatagggaca

SEQ ID NO: 25109 - DNA, 21 bp, Artificial Sequence
  Synthetic
cccgcgccggtaatcagaatc

SEQ ID NO: 25110 - DNA, 22 bp, Artificial Sequence
  Synthetic
actttgccgagcatatagccgc

SEQ ID NO: 25111 - DNA, 19 bp, Artificial Sequence
  Synthetic
cgcgaagggcagtacgtcc

SEQ ID NO: 25112 - DNA, 21 bp, Artificial Sequence
  Synthetic
atgccgtatcacgttccccct

SEQ ID NO: 25113 - DNA, 19 bp, Artificial Sequence
  Synthetic
gacgccgcctacgcactca

SEQ ID NO: 25114 - DNA, 20 bp, Artificial Sequence
  Synthetic
acaccttggctcgttccaaa

SEQ ID NO: 25115 - DNA, 22 bp, Artificial Sequence
  Synthetic
atcaggtaggcaaacaccgcca

SEQ ID NO: 25116 - DNA, 19 bp, Artificial Sequence
  Synthetic
ccaaggcgaggacggtgca

SEQ ID NO: 25117 - DNA, 19 bp, Artificial Sequence
  Synthetic
cgtcatacaggcgcgggct

SEQ ID NO: 25118 - DNA, 18 bp, Artificial Sequence
  Synthetic
ttccgcgctgcaacacgc

SEQ ID NO: 25119 - DNA, 19 bp, Artificial Sequence
  Synthetic
ccgttaccggggttctgcg

SEQ ID NO: 25120 - DNA, 21 bp, Artificial Sequence
  Synthetic
acctgaacgccttgtcctcca

SEQ ID NO: 25121 - DNA, 19 bp, Artificial Sequence
  Synthetic
gttggcgggttggatgggc

SEQ ID NO: 25122 - DNA, 19 bp, Artificial Sequence
  Synthetic
gccgcatttcaaagcggcg

SEQ ID NO: 25123 - DNA, 22 bp, Artificial Sequence
  Synthetic
cgaacctgccgatgccgtattg

SEQ ID NO: 25124 - DNA, 19 bp, Artificial Sequence
  Synthetic
gtttgttggcggtaggcgc

SEQ ID NO: 25125 - DNA, 18 bp, Artificial Sequence
  Synthetic
cgcgcgttccgaacccaa

SEQ ID NO: 25126 - DNA, 19 bp, Artificial Sequence
  Synthetic
gatgccggaaccgacaccg

SEQ ID NO: 25127 - DNA, 20 bp, Artificial Sequence
  Synthetic
cgccttcaaaccccaagccg

SEQ ID NO: 25128 - DNA, 18 bp, Artificial Sequence
  Synthetic
gcgcggcgttcgtcttgt

SEQ ID NO: 25129 - DNA, 19 bp, Artificial Sequence
  Synthetic
gcggggaggccgtctgaat

SEQ ID NO: 25130 - DNA, 21 bp, Artificial Sequence
  Synthetic
cgctcttcaatcagcgtgccc

SEQ ID NO: 25131 - DNA, 18 bp, Artificial Sequence
  Synthetic
ggcatgcgccgcattgtg

SEQ ID NO: 25132 - DNA, 18 bp, Artificial Sequence
  Synthetic
tggcccggcgtgttttcc

SEQ ID NO: 25133 - DNA, 21 bp, Artificial Sequence
  Synthetic
cctgggctttgctgatgacgc

SEQ ID NO: 25134 - DNA, 19 bp, Artificial Sequence
  Synthetic
ggcggccagcagcttgtct

SEQ ID NO: 25135 - DNA, 18 bp, Artificial Sequence
  Synthetic
gttgcgcgcgtctgtggt

SEQ ID NO: 25136 - DNA, 22 bp, Artificial Sequence
  Synthetic
agtcatcgtcttcatcgtcgcc

SEQ ID NO: 25137 - DNA, 19 bp, Artificial Sequence
  Synthetic
ccagccgccgcctttcctt

SEQ ID NO: 25138 - DNA, 19 bp, Artificial Sequence
  Synthetic
gccgtctgaacgcgaccgt

SEQ ID NO: 25139 - DNA, 22 bp, Artificial Sequence
  Synthetic
tcggtttgattcctaccggcga

SEQ ID NO: 25140 - DNA, 22 bp, Artificial Sequence
  Synthetic
cctgctgaaaaaagccgatgcc

SEQ ID NO: 25141 - DNA, 21 bp, Artificial Sequence
  Synthetic
gtcgccgtcagccattattgc

SEQ ID NO: 25142 - DNA, 22 bp, Artificial Sequence
  Synthetic
ttgccgcttctgatcgattgcc

SEQ ID NO: 25143 - DNA, 20 bp, Artificial Sequence
  Synthetic
taccgcgaacgcatgagggc

SEQ ID NO: 25144 - DNA, 19 bp, Artificial Sequence
  Synthetic
agggcgcgggtcatatcgg

SEQ ID NO: 25145 - DNA, 18 bp, Artificial Sequence
  Synthetic
ggcaatggcgacgcgttg

SEQ ID NO: 25146 - DNA, 20 bp, Artificial Sequence
  Synthetic
ggcgaggaacatcgtctgca

SEQ ID NO: 25147 - DNA, 19 bp, Artificial Sequence
  Synthetic
ggcgatgaaggcggcaaga

SEQ ID NO: 25148 - DNA, 19 bp, Artificial Sequence
  Synthetic
gcagccatggtgcgtccga

SEQ ID NO: 25149 - DNA, 22 bp, Artificial Sequence
  Synthetic
catgagttgtgccagttccgcc

SEQ ID NO: 25150 - DNA, 20 bp, Artificial Sequence
  Synthetic
tggagacaacatgtagcgca

SEQ ID NO: 25151 - DNA, 25 bp, Artificial Sequence
  Synthetic
gacagttggtgtcctaattgtaaca

SEQ ID NO: 25152 - DNA, 24 bp, Artificial Sequence
  Synthetic
aaaggaggttattgtttgaggaca

SEQ ID NO: 25153 - DNA, 23 bp, Artificial Sequence
  Synthetic
acagctgacgttaattagccacc

SEQ ID NO: 25154 - DNA, 25 bp, Artificial Sequence
  Synthetic
atcccttgcgaaatctaaatatgca

SEQ ID NO: 25155 - DNA, 25 bp, Artificial Sequence
  Synthetic
tttggagtgtgcattacaaaaatga

SEQ ID NO: 25156 - DNA, 21 bp, Artificial Sequence
  Synthetic
aacctaaacttgggtcccctg

SEQ ID NO: 25157 - DNA, 24 bp, Artificial Sequence
  Synthetic
tattgcagtgattgatacaccagg

SEQ ID NO: 25158 - DNA, 25 bp, Artificial Sequence
  Synthetic
acaagacaggttttaaatgtcaccg

SEQ ID NO: 25159 - DNA, 25 bp, Artificial Sequence
  Synthetic
accaccagcatttaatgtaaaagtg

SEQ ID NO: 25160 - DNA, 25 bp, Artificial Sequence
  Synthetic
agtaggggttcaaattgatagaggt

SEQ ID NO: 25161 - DNA, 25 bp, Artificial Sequence
  Synthetic
aaggagatagtttacctacagaccc

SEQ ID NO: 25162 - DNA, 25 bp, Artificial Sequence
  Synthetic
acttgatgagtgggaattagcattt

SEQ ID NO: 25163 - DNA, 25 bp, Artificial Sequence
  Synthetic
gacctatgtgtaagtgaccaatagc

SEQ ID NO: 25164 - DNA, 25 bp, Artificial Sequence
  Synthetic
aaatcgaaacaaacaaatttgcagc

SEQ ID NO: 25165 - DNA, 23 bp, Artificial Sequence
  Synthetic
cgagattggagtgacaaggagag

SEQ ID NO: 25166 - DNA, 21 bp, Artificial Sequence
  Synthetic
cggtccaaattcctgctgatg

SEQ ID NO: 25167 - DNA, 21 bp, Artificial Sequence
  Synthetic
aaagtgggcacttggtgagaa

SEQ ID NO: 25168 - DNA, 23 bp, Artificial Sequence
  Synthetic
aggaattacttcacagcagaggt

SEQ ID NO: 25169 - DNA, 23 bp, Artificial Sequence
  Synthetic
gcatggagttttctctcactgac

SEQ ID NO: 25170 - DNA, 25 bp, Artificial Sequence
  Synthetic
tgagaataaatcagaaacatggccc

SEQ ID NO: 25171 - DNA, 22 bp, Artificial Sequence
  Synthetic
agcgataggaggggatgctagg

SEQ ID NO: 25172 - DNA, 21 bp, Artificial Sequence
  Synthetic
tgggatgctcctcccgattcc

SEQ ID NO: 25173 - DNA, 20 bp, Artificial Sequence
  Synthetic
tccttcggatgcccaggtcg

SEQ ID NO: 25174 - DNA, 19 bp, Artificial Sequence
  Synthetic
cgctcccctcgttccacct

SEQ ID NO: 25175 - DNA, 21 bp, Artificial Sequence
  Synthetic
aaggcctcttcctaggtccgg

SEQ ID NO: 25176 - DNA, 20 bp, Artificial Sequence
  Synthetic
agagaacgacccagaacgct

SEQ ID NO: 25177 - DNA, 23 bp, Artificial Sequence
  Synthetic
attggggccagaagaaaaacaaa

SEQ ID NO: 25178 - DNA, 25 bp, Artificial Sequence
  Synthetic
ttggactatgaacaatttgacagct

SEQ ID NO: 25179 - DNA, 21 bp, Artificial Sequence
  Synthetic
ggggtgtacagggtggttttc

SEQ ID NO: 25180 - DNA, 21 bp, Artificial Sequence
  Synthetic
actaggtagtcagaacagccc

SEQ ID NO: 25181 - DNA, 20 bp, Artificial Sequence
  Synthetic
ggaggacgcggacaaagaaa

SEQ ID NO: 25182 - DNA, 20 bp, Artificial Sequence
  Synthetic
acagaagcttggacaatgcg

SEQ ID NO: 25183 - DNA, 21 bp, Artificial Sequence
  Synthetic
tggactttaaacaagaggcgg

SEQ ID NO: 25184 - DNA, 20 bp, Artificial Sequence
  Synthetic
ccactgtcaccacagctgcc

SEQ ID NO: 25185 - DNA, 23 bp, Artificial Sequence
  Synthetic
acctacatttagtggtggcaatg

SEQ ID NO: 25186 - DNA, 23 bp, Artificial Sequence
  Synthetic
cgcaaaggtactgtacgctatag

SEQ ID NO: 25187 - DNA, 23 bp, Artificial Sequence
  Synthetic
taccagttccaagatatgcctcc

SEQ ID NO: 25188 - DNA, 20 bp, Artificial Sequence
  Synthetic
tttcagatggctttgtggcg

SEQ ID NO: 25189 - DNA, 20 bp, Artificial Sequence
  Synthetic
tggattgcctgatccacagt

SEQ ID NO: 25190 - DNA, 20 bp, Artificial Sequence
  Synthetic
gggattgcccccccttagaa

SEQ ID NO: 25191 - DNA, 20 bp, Artificial Sequence
  Synthetic
gggatgctatacccaccact

SEQ ID NO: 25192 - DNA, 25 bp, Artificial Sequence
  Synthetic
acaactgtatgtaatgtaaaggcgt

SEQ ID NO: 25193 - DNA, 22 bp, Artificial Sequence
  Synthetic
ccaccttagtatgtaggcggcg

SEQ ID NO: 25194 - DNA, 20 bp, Artificial Sequence
  Synthetic
ttgcgaggggatctgggagt

SEQ ID NO: 25195 - DNA, 22 bp, Artificial Sequence
  Synthetic
tggagtcaactgggctactggt

SEQ ID NO: 25196 - DNA, 22 bp, Artificial Sequence
  Synthetic
acacccttccaattggactggc

SEQ ID NO: 25197 - DNA, 25 bp, Artificial Sequence
  Synthetic
cgaggggatgtatggttaaattcaa

SEQ ID NO: 25198 - DNA, 20 bp, Artificial Sequence
  Synthetic
gtaccccacctgtggtacgt

SEQ ID NO: 25199 - DNA, 22 bp, Artificial Sequence
  Synthetic
tggagggctgacaataccacct

SEQ ID NO: 25200 - DNA, 23 bp, Artificial Sequence
  Synthetic
gttagggcccatagaatgttggt

SEQ ID NO: 25201 - DNA, 19 bp, Artificial Sequence
  Synthetic
cgccagatgggtgggccat

SEQ ID NO: 25202 - DNA, 22 bp, Artificial Sequence
  Synthetic
gtcccttactcggtgctcttgc

SEQ ID NO: 25203 - DNA, 25 bp, Artificial Sequence
  Synthetic
tcttacatgcaggagaagtatgagg

SEQ ID NO: 25204 - DNA, 25 bp, Artificial Sequence
  Synthetic
acatgccaacataactgagattcaa

SEQ ID NO: 25205 - DNA, 20 bp, Artificial Sequence
  Synthetic
caacctgggttacctgcgat

SEQ ID NO: 25206 - DNA, 22 bp, Artificial Sequence
  Synthetic
cctcatgcagctacaatccttg

SEQ ID NO: 25207 - DNA, 22 bp, Artificial Sequence
  Synthetic
gtctactccgcgttcaatccgg

SEQ ID NO: 25208 - DNA, 25 bp, Artificial Sequence
  Synthetic
ggactagtcttgtcgtcaattatgg

SEQ ID NO: 25209 - DNA, 20 bp, Artificial Sequence
  Synthetic
ccatgccgatgcccctgttg

SEQ ID NO: 25210 - DNA, 21 bp, Artificial Sequence
  Synthetic
caactcgggccatcactagtg

SEQ ID NO: 25211 - DNA, 21 bp, Artificial Sequence
  Synthetic
ttgcagaagtgtgtcgaggca

SEQ ID NO: 25212 - DNA, 22 bp, Artificial Sequence
  Synthetic
aactcagtgaccaacaccgagc

SEQ ID NO: 25213 - DNA, 22 bp, Artificial Sequence
  Synthetic
tgcagacaaacaagcaatgcgt

SEQ ID NO: 25214 - DNA, 21 bp, Artificial Sequence
  Synthetic
gcatcattgctggtgtgcacg

SEQ ID NO: 25215 - DNA, 22 bp, Artificial Sequence
  Synthetic
attgtgatgtttactccccgga

SEQ ID NO: 25216 - DNA, 22 bp, Artificial Sequence
  Synthetic
tggtctgaaggggatgacgtcc

SEQ ID NO: 25217 - DNA, 21 bp, Artificial Sequence
  Synthetic
gaattcaactcccccccaaac

SEQ ID NO: 25218 - DNA, 20 bp, Artificial Sequence
  Synthetic
tggggacatctgggtgacaa

SEQ ID NO: 25219 - DNA, 22 bp, Artificial Sequence
  Synthetic
aacgggggatgataaaaatgca

SEQ ID NO: 25220 - DNA, 21 bp, Artificial Sequence
  Synthetic
atcctggtgtcagatgtgtct

SEQ ID NO: 25221 - DNA, 21 bp, Artificial Sequence
  Synthetic
aatgacgtgtggatgggaaga

SEQ ID NO: 25222 - DNA, 20 bp, Artificial Sequence
  Synthetic
agaagtcagtggcgaggttt

SEQ ID NO: 25223 - DNA, 21 bp, Artificial Sequence
  Synthetic
ggacagctttcctttgtgtgc

SEQ ID NO: 25224 - DNA, 21 bp, Artificial Sequence
  Synthetic
ggaattccctggcgttttaca

SEQ ID NO: 25225 - DNA, 25 bp, Artificial Sequence
  Synthetic
agctgatactcagataagtgtaccc

SEQ ID NO: 25226 - DNA, 25 bp, Artificial Sequence
  Synthetic
ttgcttgttggcaatatatggatgt

SEQ ID NO: 25227 - DNA, 20 bp, Artificial Sequence
  Synthetic
gaagcgtcgacgagctgcag

SEQ ID NO: 25228 - DNA, 22 bp, Artificial Sequence
  Synthetic
ctcttggaagagttcagcgact

SEQ ID NO: 25229 - DNA, 20 bp, Artificial Sequence
  Synthetic
ccggaaggtgcaccaacaaa

SEQ ID NO: 25230 - DNA, 25 bp, Artificial Sequence
  Synthetic
ttcaactacagaaacctcagtttgc

SEQ ID NO: 25231 - DNA, 22 bp, Artificial Sequence
  Synthetic
atcctccagaacaaacagacga

SEQ ID NO: 25232 - DNA, 25 bp, Artificial Sequence
  Synthetic
tggcctgatcttataaaaatggagc

SEQ ID NO: 25233 - DNA, 22 bp, Artificial Sequence
  Synthetic
acaacatgtgcagacaaactga

SEQ ID NO: 25234 - DNA, 21 bp, Artificial Sequence
  Synthetic
aaatggaacgtgttaccctgg

SEQ ID NO: 25235 - DNA, 20 bp, Artificial Sequence
  Synthetic
tgtggggcatacatcaccca

SEQ ID NO: 25236 - DNA, 20 bp, Artificial Sequence
  Synthetic
ggagggagccatggaagaat

SEQ ID NO: 25237 - DNA, 25 bp, Artificial Sequence
  Synthetic
tggtttccagcattcaaatgatcaa

SEQ ID NO: 25238 - DNA, 25 bp, Artificial Sequence
  Synthetic
ctatataacaaggtgaagagggcac

SEQ ID NO: 25239 - DNA, 19 bp, Artificial Sequence
  Synthetic
aaacccgctcaatgcccgg

SEQ ID NO: 25240 - DNA, 20 bp, Artificial Sequence
  Synthetic
gcaggggccctaaattgggt

SEQ ID NO: 25241 - DNA, 20 bp, Artificial Sequence
  Synthetic
cgagcttcggagcagtcacg

SEQ ID NO: 25242 - DNA, 21 bp, Artificial Sequence
  Synthetic
gggcggtactgttggtcaagg

SEQ ID NO: 25243 - DNA, 22 bp, Artificial Sequence
  Synthetic
gatgacaagccgtattgctggc

SEQ ID NO: 25244 - DNA, 20 bp, Artificial Sequence
  Synthetic
ggccaacaggcaacaacagc

SEQ ID NO: 25245 - DNA, 20 bp, Artificial Sequence
  Synthetic
cttcacacctacgcccgctc

SEQ ID NO: 25246 - DNA, 22 bp, Artificial Sequence
  Synthetic
gcttggcttggcatgtcaaggg

SEQ ID NO: 25247 - DNA, 22 bp, Artificial Sequence
  Synthetic
cgtgacgctgtcatcatgctca

SEQ ID NO: 25248 - DNA, 22 bp, Artificial Sequence
  Synthetic
ggagacgaaggtcatcacgtgg

SEQ ID NO: 25249 - DNA, 22 bp, Artificial Sequence
  Synthetic
cggttctaagacccttgctggc

SEQ ID NO: 25250 - DNA, 18 bp, Artificial Sequence
  Synthetic
gtgtgcacgcggggtgtt

SEQ ID NO: 25251 - DNA, 21 bp, Artificial Sequence
  Synthetic
taggactgtcaccaccggagc

SEQ ID NO: 25252 - DNA, 20 bp, Artificial Sequence
  Synthetic
agaggtctagacgtcgccgt

SEQ ID NO: 25253 - DNA, 22 bp, Artificial Sequence
  Synthetic
accggtatgtttcgtctgggga

SEQ ID NO: 25254 - DNA, 20 bp, Artificial Sequence
  Synthetic
gctgggggccgttcagaatg

SEQ ID NO: 25255 - DNA, 19 bp, Artificial Sequence
  Synthetic
tctaggagggtgggtggcc

SEQ ID NO: 25256 - DNA, 21 bp, Artificial Sequence
  Synthetic
caggcgagggggctgtacagt

SEQ ID NO: 25257 - DNA, 22 bp, Artificial Sequence
  Synthetic
catgccagaaggggtacaaggg

SEQ ID NO: 25258 - DNA, 20 bp, Artificial Sequence
  Synthetic
gaggattcaccgcttcgcgc

SEQ ID NO: 25259 - DNA, 20 bp, Artificial Sequence
  Synthetic
acaaggccaccacccagatg

SEQ ID NO: 25260 - DNA, 22 bp, Artificial Sequence
  Synthetic
ttccgcggaggaaaaggaagcc

SEQ ID NO: 25261 - DNA, 21 bp, Artificial Sequence
  Synthetic
gctcatcaccccttgctctgc

SEQ ID NO: 25262 - DNA, 22 bp, Artificial Sequence
  Synthetic
tcgctctctcgacaagaaagcc

SEQ ID NO: 25263 - DNA, 20 bp, Artificial Sequence
  Synthetic
gagagccaggggacacacga

SEQ ID NO: 25264 - DNA, 22 bp, Artificial Sequence
  Synthetic
ctacagagccaggaacagctgg

SEQ ID NO: 25265 - DNA, 22 bp, Artificial Sequence
  Synthetic
actgggcggtgaagacaaaacg

SEQ ID NO: 25266 - DNA, 22 bp, Artificial Sequence
  Synthetic
cgagtaactcgtccctcttctg

SEQ ID NO: 25267 - DNA, 20 bp, Artificial Sequence
  Synthetic
gcgtactgccccagcttgaa

SEQ ID NO: 25268 - DNA, 25 bp, Artificial Sequence
  Synthetic
gtgttgaaaagaaaaagactgaggg

SEQ ID NO: 25269 - DNA, 23 bp, Artificial Sequence
  Synthetic
ccatactggcattactggtgaca

SEQ ID NO: 25270 - DNA, 21 bp, Artificial Sequence
  Synthetic
ccactgtgtggttttccctca

SEQ ID NO: 25271 - DNA, 23 bp, Artificial Sequence
  Synthetic
tgtacaacagacttctcagtggt

SEQ ID NO: 25272 - DNA, 22 bp, Artificial Sequence
  Synthetic
gaagtcttcatcgctcaaagca

SEQ ID NO: 25273 - DNA, 25 bp, Artificial Sequence
  Synthetic
tactggctacaaacaatgtctttcg

SEQ ID NO: 25274 - DNA, 25 bp, Artificial Sequence
  Synthetic
tgatgaaacctgtgaacatgagtac

SEQ ID NO: 25275 - DNA, 21 bp, Artificial Sequence
  Synthetic
gaaacatggtggtggtgtagc

SEQ ID NO: 25276 - DNA, 20 bp, Artificial Sequence
  Synthetic
gtgcagacggttcgtacaca

SEQ ID NO: 25277 - DNA, 25 bp, Artificial Sequence
  Synthetic
ctagtggtgatatcacttgtgttgt

SEQ ID NO: 25278 - DNA, 22 bp, Artificial Sequence
  Synthetic
cataatggcaaccatccaacgt

SEQ ID NO: 25279 - DNA, 23 bp, Artificial Sequence
  Synthetic
aagacatctgaggagcactttgt

SEQ ID NO: 25280 - DNA, 25 bp, Artificial Sequence
  Synthetic
cttgatgagagttttcttggtaggt

SEQ ID NO: 25281 - DNA, 22 bp, Artificial Sequence
  Synthetic
ttaacgggtgtagaagctgtga

SEQ ID NO: 25282 - DNA, 25 bp, Artificial Sequence
  Synthetic
aaggaaacatcttacactacaacca

SEQ ID NO: 25283 - DNA, 25 bp, Artificial Sequence
  Synthetic
agacactattcagcgagtttcaaga

SEQ ID NO: 25284 - DNA, 24 bp, Artificial Sequence
  Synthetic
aacacaagagttaggtcatgagga

SEQ ID NO: 25285 - DNA, 25 bp, Artificial Sequence
  Synthetic
tgcagcatttgtttaagtggattag

SEQ ID NO: 25286 - DNA, 25 bp, Artificial Sequence
  Synthetic
tggaagagctatgttcatatcatgg

SEQ ID NO: 25287 - DNA, 22 bp, Artificial Sequence
  Synthetic
agtgttgctgtgaaaaatggcg

SEQ ID NO: 25288 - DNA, 21 bp, Artificial Sequence
  Synthetic
tacagctcacagcgagttagc

SEQ ID NO: 25289 - DNA, 22 bp, Artificial Sequence
  Synthetic
aattcgtagtgctgccaagaag

SEQ ID NO: 25290 - DNA, 20 bp, Artificial Sequence
  Synthetic
tttagccagcgtggtggttc

SEQ ID NO: 25291 - DNA, 24 bp, Artificial Sequence
  Synthetic
cactcgttatgtgcttatggatgg

SEQ ID NO: 25292 - DNA, 24 bp, Artificial Sequence
  Synthetic
tattgccatattggtgacttgtgc

SEQ ID NO: 25293 - DNA, 22 bp, Artificial Sequence
  Synthetic
agacactgttgccacttacaca

SEQ ID NO: 25294 - DNA, 21 bp, Artificial Sequence
  Synthetic
aggaaaatggcattcccgtca

SEQ ID NO: 25295 - DNA, 24 bp, Artificial Sequence
  Synthetic
atccaacctggtcaaacattttca

SEQ ID NO: 25296 - DNA, 24 bp, Artificial Sequence
  Synthetic
tgacatattgggacctctttctgc

SEQ ID NO: 25297 - DNA, 23 bp, Artificial Sequence
  Synthetic
gtttacgagaatgctttcttgcc

SEQ ID NO: 25298 - DNA, 24 bp, Artificial Sequence
  Synthetic
gctagagctatagtgtttgtgtgt

SEQ ID NO: 25299 - DNA, 25 bp, Artificial Sequence
  Synthetic
aaaccatgtatcaaggttgctactg

SEQ ID NO: 25300 - DNA, 21 bp, Artificial Sequence
  Synthetic
gcgaggaaatgctcgataacc

SEQ ID NO: 25301 - DNA, 24 bp, Artificial Sequence
  Synthetic
acaatgctcttcactatgcttagg

SEQ ID NO: 25302 - DNA, 20 bp, Artificial Sequence
  Synthetic
cggctggtaccacacaaaca

SEQ ID NO: 25303 - DNA, 23 bp, Artificial Sequence
  Synthetic
ttcaactgtgctttccttctgtg

SEQ ID NO: 25304 - DNA, 22 bp, Artificial Sequence
  Synthetic
agaaacacagtctgtaccgtct

SEQ ID NO: 25305 - DNA, 24 bp, Artificial Sequence
  Synthetic
cgtcagcgtctaactaaatacaca

SEQ ID NO: 25306 - DNA, 25 bp, Artificial Sequence
  Synthetic
aatcaggatcttaatgggaactggt

SEQ ID NO: 25307 - DNA, 24 bp, Artificial Sequence
  Synthetic
tctactgtgtttccacctacaagt

SEQ ID NO: 25308 - DNA, 25 bp, Artificial Sequence
  Synthetic
agacttttatgactttgctgtgtct

SEQ ID NO: 25309 - DNA, 21 bp, Artificial Sequence
  Synthetic
ttgaagtcaatagccgccact

SEQ ID NO: 25310 - DNA, 23 bp, Artificial Sequence
  Synthetic
agtgtgcgcaagtattaagtgag

SEQ ID NO: 25311 - DNA, 25 bp, Artificial Sequence
  Synthetic
tgtgtgctataacagtaactatgcg

SEQ ID NO: 25312 - DNA, 22 bp, Artificial Sequence
  Synthetic
acatgatgagcttactggccac

SEQ ID NO: 25313 - DNA, 20 bp, Artificial Sequence
  Synthetic
aatgccccaggttgtgatgt

SEQ ID NO: 25314 - DNA, 20 bp, Artificial Sequence
  Synthetic
tggtattgccactgtacgcg

SEQ ID NO: 25315 - DNA, 25 bp, Artificial Sequence
  Synthetic
atgttgcaaattatcaaaaggtcgg

SEQ ID NO: 25316 - DNA, 22 bp, Artificial Sequence
  Synthetic
agacttcgtgcaaaacactacg

SEQ ID NO: 25317 - DNA, 25 bp, Artificial Sequence
  Synthetic
acagacctcaaataggcgttgtaag

SEQ ID NO: 25318 - DNA, 23 bp, Artificial Sequence
  Synthetic
atgtggctacattacaagcagaa

SEQ ID NO: 25319 - DNA, 20 bp, Artificial Sequence
  Synthetic
tagagggctgtcatgcaact

SEQ ID NO: 25320 - DNA, 25 bp, Artificial Sequence
  Synthetic
tgaagtactttgtcaagattggacc

SEQ ID NO: 25321 - DNA, 25 bp, Artificial Sequence
  Synthetic
ttgctgataagtttccagttcttca

SEQ ID NO: 25322 - DNA, 24 bp, Artificial Sequence
  Synthetic
atgtgaataagcatgcattccaca

SEQ ID NO: 25323 - DNA, 22 bp, Artificial Sequence
  Synthetic
aaaggacactttgatggacacg

SEQ ID NO: 25324 - DNA, 23 bp, Artificial Sequence
  Synthetic
ttgatggtagagtggaaggacag

SEQ ID NO: 25325 - DNA, 22 bp, Artificial Sequence
  Synthetic
gctatgccttcgaacacatcgt

SEQ ID NO: 25326 - DNA, 25 bp, Artificial Sequence
  Synthetic
gtaaggatggacatgttgaaacctt

SEQ ID NO: 25327 - DNA, 21 bp, Artificial Sequence
  Synthetic
ctgtgcaacagtacatacggc

SEQ ID NO: 25328 - DNA, 23 bp, Artificial Sequence
  Synthetic
tggctataccatgcatgctaact

SEQ ID NO: 25329 - DNA, 25 bp, Artificial Sequence
  Synthetic
tgcactttcgagtacatatctgatg

SEQ ID NO: 25330 - DNA, 24 bp, Artificial Sequence
  Synthetic
aaatggtacaatcacagatgctgt

SEQ ID NO: 25331 - DNA, 25 bp, Artificial Sequence
  Synthetic
atgcagattcttttgtagtcaaggg

SEQ ID NO: 25332 - DNA, 25 bp, Artificial Sequence
  Synthetic
tatggtttttacaccactactggca

SEQ ID NO: 25333 - DNA, 24 bp, Artificial Sequence
  Synthetic
tcaagatgttaactgcactgatgt

SEQ ID NO: 25334 - DNA, 25 bp, Artificial Sequence
  Synthetic
acagaagtaatgcctgtttctatgg

SEQ ID NO: 25335 - DNA, 25 bp, Artificial Sequence
  Synthetic
taatgctagagatctcatttgtgcg

SEQ ID NO: 25336 - DNA, 20 bp, Artificial Sequence
  Synthetic
gcaagctgcaagacgttgtt

SEQ ID NO: 25337 - DNA, 22 bp, Artificial Sequence
  Synthetic
acatgtcacgtatgtgccatcc

SEQ ID NO: 25338 - DNA, 23 bp, Artificial Sequence
  Synthetic
catcaccagatgttgatcttggc

SEQ ID NO: 25339 - DNA, 21 bp, Artificial Sequence
  Synthetic
gtggttcttgctgcaagtttg

SEQ ID NO: 25340 - DNA, 23 bp, Artificial Sequence
  Synthetic
attcacatcttttgcttgtcgct

SEQ ID NO: 25341 - DNA, 23 bp, Artificial Sequence
  Synthetic
cgaagtttactaccagcttgagt

SEQ ID NO: 25342 - DNA, 23 bp, Artificial Sequence
  Synthetic
agtcacactagccatccttactg

SEQ ID NO: 25343 - DNA, 23 bp, Artificial Sequence
  Synthetic
taaagcttgttttcctctggctc

SEQ ID NO: 25344 - DNA, 22 bp, Artificial Sequence
  Synthetic
actgtggctacatcacgaacgc

SEQ ID NO: 25345 - DNA, 22 bp, Artificial Sequence
  Synthetic
agtgtgttagaggtacgactgt

SEQ ID NO: 25346 - DNA, 24 bp, Artificial Sequence
  Synthetic
gcttgaagatccttgtaaggtaca

SEQ ID NO: 25347 - DNA, 20 bp, Artificial Sequence
  Synthetic
agcgccgaccccaaggttta

SEQ ID NO: 25348 - DNA, 20 bp, Artificial Sequence
  Synthetic
acaatgctgccaccgtgcta

SEQ ID NO: 25349 - DNA, 21 bp, Artificial Sequence
  Synthetic
gctgaggcatctaaaaagcct

SEQ ID NO: 25350 - DNA, 23 bp, Artificial Sequence
  Synthetic
aagcacattgacgcatacaaaac

SEQ ID NO: 25351 - DNA, 25 bp, Artificial Sequence
  Synthetic
tcaatgtgtaacattagggaggact

SEQ ID NO: 25352 - DNA, 24 bp, Artificial Sequence
  Synthetic
accaataggtgacaatcatccaga

SEQ ID NO: 25353 - DNA, 22 bp, Artificial Sequence
  Synthetic
ttgacaaggtgtgaagagccgc

SEQ ID NO: 25354 - DNA, 22 bp, Artificial Sequence
  Synthetic
gttgggacacactccacacaaa

SEQ ID NO: 25355 - DNA, 25 bp, Artificial Sequence
  Synthetic
cagacagactaatacagataacccg

SEQ ID NO: 25356 - DNA, 25 bp, Artificial Sequence
  Synthetic
ttaccattttctagggagatctgga

SEQ ID NO: 25357 - DNA, 25 bp, Artificial Sequence
  Synthetic
ggtaacttacctatttatccccacc

SEQ ID NO: 25358 - DNA, 25 bp, Artificial Sequence
  Synthetic
taccagttatgttaacacctggatc

SEQ ID NO: 25359 - DNA, 25 bp, Artificial Sequence
  Synthetic
ttagccactactctcataggagaac

SEQ ID NO: 25360 - DNA, 20 bp, Artificial Sequence
  Synthetic
agtccaccgcctcactagtt

SEQ ID NO: 25361 - DNA, 24 bp, Artificial Sequence
  Synthetic
ttaaatgaagttcttgtggtgcca

SEQ ID NO: 25362 - DNA, 21 bp, Artificial Sequence
  Synthetic
aaatgcatctgtgttctggca

SEQ ID NO: 25363 - DNA, 23 bp, Artificial Sequence
  Synthetic
ttgcctatcaacacacacactca

SEQ ID NO: 25364 - DNA, 25 bp, Artificial Sequence
  Synthetic
tccctaattgtgattgcactgaatg

SEQ ID NO: 25365 - DNA, 22 bp, Artificial Sequence
  Synthetic
ctgaggagcaagggttatctga

SEQ ID NO: 25366 - DNA, 23 bp, Artificial Sequence
  Synthetic
ggctccagcttagctatgtacat

SEQ ID NO: 25367 - DNA, 25 bp, Artificial Sequence
  Synthetic
ttgatgggtatgatcaacagagtgt

SEQ ID NO: 25368 - DNA, 22 bp, Artificial Sequence
  Synthetic
ttaccagcaatggcaagaaggt

SEQ ID NO: 25369 - DNA, 23 bp, Artificial Sequence
  Synthetic
gggaacctaaacccaaaagcaga

SEQ ID NO: 25370 - DNA, 23 bp, Artificial Sequence
  Synthetic
ccatgagggtgttaagctagaga

SEQ ID NO: 25371 - DNA, 23 bp, Artificial Sequence
  Synthetic
ttcttggtatacatgttggtggc

SEQ ID NO: 25372 - DNA, 20 bp, Artificial Sequence
  Synthetic
tggttcagcagtagggtgtg

SEQ ID NO: 25373 - DNA, 22 bp, Artificial Sequence
  Synthetic
cgccactctttccttatacacc

SEQ ID NO: 25374 - DNA, 20 bp, Artificial Sequence
  Synthetic
tctgccattcgcattttgca

SEQ ID NO: 25375 - DNA, 25 bp, Artificial Sequence
  Synthetic
agactctctaaattcaaatgtggcg

SEQ ID NO: 25376 - DNA, 25 bp, Artificial Sequence
  Synthetic
gtatgcaacaaatcatattgccacc

SEQ ID NO: 25377 - DNA, 24 bp, Artificial Sequence
  Synthetic
actgggatgcagttagaaaagaaa

SEQ ID NO: 25378 - DNA, 23 bp, Artificial Sequence
  Synthetic
ctagctcctcacggacttttttc

SEQ ID NO: 25379 - DNA, 25 bp, Artificial Sequence
  Synthetic
aaacagaaacatcaaaggtgctagt

SEQ ID NO: 25380 - DNA, 24 bp, Artificial Sequence
  Synthetic
gttccattagttgaaggtacccct

SEQ ID NO: 25381 - DNA, 24 bp, Artificial Sequence
  Synthetic
cctgaatttttggtacagccttcc

SEQ ID NO: 25382 - DNA, 25 bp, Artificial Sequence
  Synthetic
tgtaggtgatggactttttgtagca

SEQ ID NO: 25383 - DNA, 23 bp, Artificial Sequence
  Synthetic
tggtctggagattaatagggctg

SEQ ID NO: 25384 - DNA, 25 bp, Artificial Sequence
  Synthetic
ttactcatgcaggaactataggtga

SEQ ID NO: 25385 - DNA, 22 bp, Artificial Sequence
  Synthetic
agttggcttttattcctcctgc

SEQ ID NO: 25386 - DNA, 25 bp, Artificial Sequence
  Synthetic
cccatggggttggtataaatacaga

SEQ ID NO: 25387 - DNA, 23 bp, Artificial Sequence
  Synthetic
aatttgctggcttcagaagagtc

SEQ ID NO: 25388 - DNA, 23 bp, Artificial Sequence
  Synthetic
attgtggaagaagcagattgtgt

SEQ ID NO: 25389 - DNA, 21 bp, Artificial Sequence
  Synthetic
ggcagcagtacacatttctcc

SEQ ID NO: 25390 - DNA, 25 bp, Artificial Sequence
  Synthetic
tcctagcactttatgaaaaaggagc

SEQ ID NO: 25391 - DNA, 21 bp, Artificial Sequence
  Synthetic
agaagtccttctccgctgaaa

SEQ ID NO: 25392 - DNA, 20 bp, Artificial Sequence
  Synthetic
gcccactgcaccaactcctg

SEQ ID NO: 25393 - DNA, 20 bp, Artificial Sequence
  Synthetic
tccctcagttgtgcctttgc

SEQ ID NO: 25394 - DNA, 23 bp, Artificial Sequence
  Synthetic
cccagacttcattagacagcctt

SEQ ID NO: 25395 - DNA, 20 bp, Artificial Sequence
  Synthetic
tggtacaatttgcgcgggaa

SEQ ID NO: 25396 - DNA, 25 bp, Artificial Sequence
  Synthetic
gctgaaaaattacactgttggttcg

SEQ ID NO: 25397 - DNA, 25 bp, Artificial Sequence
  Synthetic
tgaagcatttgaaatagcagaaggc

SEQ ID NO: 25398 - DNA, 22 bp, Artificial Sequence
  Synthetic
tgaatggaatgggaaagggaga

SEQ ID NO: 25399 - DNA, 20 bp, Artificial Sequence
  Synthetic
gtggagaacgccagaatgct

SEQ ID NO: 25400 - DNA, 22 bp, Artificial Sequence
  Synthetic
gatcaggagaatttggcgtcaa

SEQ ID NO: 25401 - DNA, 21 bp, Artificial Sequence
  Synthetic
tcctgagaggatcagtggccc

SEQ ID NO: 25402 - DNA, 24 bp, Artificial Sequence
  Synthetic
cccaaggggacaactatctactag

SEQ ID NO: 25403 - DNA, 25 bp, Artificial Sequence
  Synthetic
ctgctggttttgaagtttataacgc

SEQ ID NO: 25404 - DNA, 20 bp, Artificial Sequence
  Synthetic
cctgggcttggaaaaaccca

SEQ ID NO: 25405 - DNA, 25 bp, Artificial Sequence
  Synthetic
aatgacagttattcccatcgaagaa

SEQ ID NO: 25406 - DNA, 23 bp, Artificial Sequence
  Synthetic
ggaaattatcccgatacagaccg

SEQ ID NO: 25407 - DNA, 25 bp, Artificial Sequence
  Synthetic
cagtgtactaactgtcagcatgtga

SEQ ID NO: 25408 - DNA, 24 bp, Artificial Sequence
  Synthetic
tgatcccaatgttggtatggtaga

SEQ ID NO: 25409 - DNA, 24 bp, Artificial Sequence
  Synthetic
ttaaacctgttttggaagatggga

SEQ ID NO: 25410 - DNA, 25 bp, Artificial Sequence
  Synthetic
tcaggcgttgataaattaaccagag

SEQ ID NO: 25411 - DNA, 25 bp, Artificial Sequence
  Synthetic
tcaagaaccttgacgttacctttac

SEQ ID NO: 25412 - DNA, 20 bp, Artificial Sequence
  Synthetic
ccatgtgatgggccaattca

SEQ ID NO: 25413 - DNA, 25 bp, Artificial Sequence
  Synthetic
atggttccttattcaaagatggggt

SEQ ID NO: 25414 - DNA, 24 bp, Artificial Sequence
  Synthetic
atcaattaggagatgccacaacaa

SEQ ID NO: 25415 - DNA, 23 bp, Artificial Sequence
  Synthetic
tgagagaggctagaacaacttcc

SEQ ID NO: 25416 - DNA, 25 bp, Artificial Sequence
  Synthetic
aaggcagagttgatctcttaggaga

SEQ ID NO: 25417 - DNA, 21 bp, Artificial Sequence
  Synthetic
tcatgtgatgcgataaccacc

SEQ ID NO: 25418 - DNA, 25 bp, Artificial Sequence
  Synthetic
tttagctgataccggtcttaaaagt

SEQ ID NO: 25419 - DNA, 25 bp, Artificial Sequence
  Synthetic
gataccatgcttaaagatgggttga

SEQ ID NO: 25420 - DNA, 23 bp, Artificial Sequence
  Synthetic
tcaaagatgaggggacagtaact

SEQ ID NO: 25421 - DNA, 20 bp, Artificial Sequence
  Synthetic
tttgggtcacccgattggag

SEQ ID NO: 25422 - DNA, 24 bp, Artificial Sequence
  Synthetic
tgacaaaggcacaaaagacttaac

SEQ ID NO: 25423 - DNA, 21 bp, Artificial Sequence
  Synthetic
ctaactgtgtagcctgcttgc

SEQ ID NO: 25424 - DNA, 24 bp, Artificial Sequence
  Synthetic
gacttgtccctttgatagaggtgc

SEQ ID NO: 25425 - DNA, 25 bp, Artificial Sequence
  Synthetic
accggcttttttagaataaccaaca

SEQ ID NO: 25426 - DNA, 23 bp, Artificial Sequence
  Synthetic
tttgtcaacaaatttgggttcgg

SEQ ID NO: 25427 - DNA, 20 bp, Artificial Sequence
  Synthetic
aacggcaatcgcatgcttag

SEQ ID NO: 25428 - DNA, 22 bp, Artificial Sequence
  Synthetic
tggctcagaagctacaaaaacc

SEQ ID NO: 25429 - DNA, 25 bp, Artificial Sequence
  Synthetic
aatcagatgctctttacgttgttga

SEQ ID NO: 25430 - DNA, 25 bp, Artificial Sequence
  Synthetic
attgacttactcagatggttcagac

SEQ ID NO: 25431 - DNA, 25 bp, Artificial Sequence
  Synthetic
caagctattcagtttgcttttgacc

SEQ ID NO: 25432 - DNA, 23 bp, Artificial Sequence
  Synthetic
attaccctgttgaccaagcaaac

SEQ ID NO: 25433 - DNA, 25 bp, Artificial Sequence
  Synthetic
acgtaaccctaaatcaaatgaacct

SEQ ID NO: 25434 - DNA, 24 bp, Artificial Sequence
  Synthetic
acgatcggttacagaaatcaagtc

SEQ ID NO: 25435 - DNA, 21 bp, Artificial Sequence
  Synthetic
tctgccacctctcaaccgact

SEQ ID NO: 25436 - DNA, 21 bp, Artificial Sequence
  Synthetic
ggcttcaaccacaaacagcag

SEQ ID NO: 25437 - DNA, 25 bp, Artificial Sequence
  Synthetic
tcatgttcatgtctcctttaatgct

SEQ ID NO: 25438 - DNA, 23 bp, Artificial Sequence
  Synthetic
aaggggtagatcagaaatcagct

SEQ ID NO: 25439 - DNA, 24 bp, Artificial Sequence
  Synthetic
tcgtttgattcacaagagaggaaa

SEQ ID NO: 25440 - DNA, 25 bp, Artificial Sequence
  Synthetic
tattgcttacctagaatcacacgac

SEQ ID NO: 25441 - DNA, 25 bp, Artificial Sequence
  Synthetic
tcatcctaaagtgttttaccaggac

SEQ ID NO: 25442 - DNA, 25 bp, Artificial Sequence
  Synthetic
acaagaaaattgaggagtgtacagg

SEQ ID NO: 25443 - DNA, 21 bp, Artificial Sequence
  Synthetic
ttgggggacaacagaagactt

SEQ ID NO: 25444 - DNA, 23 bp, Artificial Sequence
  Synthetic
gtgaaagccagttgacctatgtt

SEQ ID NO: 25445 - DNA, 21 bp, Artificial Sequence
  Synthetic
gaacagcggaatgcacgtatt

SEQ ID NO: 25446 - DNA, 22 bp, Artificial Sequence
  Synthetic
ttttcggcggttcagaagttaa

SEQ ID NO: 25447 - DNA, 25 bp, Artificial Sequence
  Synthetic
agtcactttcattttagtgggatca

SEQ ID NO: 25448 - DNA, 23 bp, Artificial Sequence
  Synthetic
gcccaaggcagtaatcatttcaa

SEQ ID NO: 25449 - DNA, 23 bp, Artificial Sequence
  Synthetic
ttgtcctagttgtacgaggagag

SEQ ID NO: 25450 - DNA, 25 bp, Artificial Sequence
  Synthetic
tgaagtggttacagcattagaatca

SEQ ID NO: 25451 - DNA, 25 bp, Artificial Sequence
  Synthetic
acagaagtgaactcttgtcttgaac

SEQ ID NO: 25452 - DNA, 23 bp, Artificial Sequence
  Synthetic
ttttggatcgtgaagtaacgcaa

SEQ ID NO: 25453 - DNA, 25 bp, Artificial Sequence
  Synthetic
caggctattgctgatgaattagacg

SEQ ID NO: 25454 - DNA, 23 bp, Artificial Sequence
  Synthetic
tctttgactgctatgggagaagc

SEQ ID NO: 25455 - DNA, 24 bp, Artificial Sequence
  Synthetic
cgtaaacgtaaatcagaagcagct

SEQ ID NO: 25456 - DNA, 23 bp, Artificial Sequence
  Synthetic
ataacggctcctaaaaagctacc

SEQ ID NO: 25457 - DNA, 25 bp, Artificial Sequence
  Synthetic
agcgttaatattgtcgatgtcattg

SEQ ID NO: 25458 - DNA, 21 bp, Artificial Sequence
  Synthetic
gcagtacttgctagccaacac

SEQ ID NO: 25459 - DNA, 25 bp, Artificial Sequence
  Synthetic
ctttcgaaatcgtatcatgtttccc

SEQ ID NO: 25460 - DNA, 20 bp, Artificial Sequence
  Synthetic
tgatggtgacgatgctggac

SEQ ID NO: 25461 - DNA, 25 bp, Artificial Sequence
  Synthetic
atgcattaaggattcaagataggca

SEQ ID NO: 25462 - DNA, 23 bp, Artificial Sequence
  Synthetic
tcaagcggctctagaagtactag

SEQ ID NO: 25463 - DNA, 25 bp, Artificial Sequence
  Synthetic
atttgctgttacatgtgattgatgc

SEQ ID NO: 25464 - DNA, 25 bp, Artificial Sequence
  Synthetic
tacacgtttgaccaagaaatagagg

SEQ ID NO: 25465 - DNA, 23 bp, Artificial Sequence
  Synthetic
actgaccaaccatcttttgagga

SEQ ID NO: 25466 - DNA, 24 bp, Artificial Sequence
  Synthetic
gctcttagccaaacattttctggt

SEQ ID NO: 25467 - DNA, 25 bp, Artificial Sequence
  Synthetic
ttaccaggatttttatcaagtcggt

SEQ ID NO: 25468 - DNA, 21 bp, Artificial Sequence
  Synthetic
cagaagccttaaaagcagcgg

SEQ ID NO: 25469 - DNA, 25 bp, Artificial Sequence
  Synthetic
tcttgctcaatcatgtatcagctcg

SEQ ID NO: 25470 - DNA, 24 bp, Artificial Sequence
  Synthetic
attaccaatccagtagccattgag

SEQ ID NO: 25471 - DNA, 25 bp, Artificial Sequence
  Synthetic
cccttcgcttagaattagcggataa

SEQ ID NO: 25472 - DNA, 23 bp, Artificial Sequence
  Synthetic
acttgtctcaactgcatgatcct

SEQ ID NO: 25473 - DNA, 22 bp, Artificial Sequence
  Synthetic
acgggttgctaaaatgtatgcg

SEQ ID NO: 25474 - DNA, 20 bp, Artificial Sequence
  Synthetic
catgaccatgcgaggcatca

SEQ ID NO: 25475 - DNA, 20 bp, Artificial Sequence
  Synthetic
tcatcgacgttggtggagaa

SEQ ID NO: 25476 - DNA, 22 bp, Artificial Sequence
  Synthetic
tctaggcaatagagcacaagca

SEQ ID NO: 25477 - DNA, 25 bp, Artificial Sequence
  Synthetic
ccagttgatgtgaggacttatggat

SEQ ID NO: 25478 - DNA, 23 bp, Artificial Sequence
  Synthetic
agctttttaacgaatttccgcct

SEQ ID NO: 25479 - DNA, 23 bp, Artificial Sequence
  Synthetic
ggtcgtgtgaggcatgaaaaatg

SEQ ID NO: 25480 - DNA, 22 bp, Artificial Sequence
  Synthetic
aatcactacgagctatcacgca

SEQ ID NO: 25481 - DNA, 21 bp, Artificial Sequence
  Synthetic
tatccgctaaggtgcttaccc

SEQ ID NO: 25482 - DNA, 20 bp, Artificial Sequence
  Synthetic
atcggattggtggtgtggaa

SEQ ID NO: 25483 - DNA, 20 bp, Artificial Sequence
  Synthetic
aagagccccacaaccacaga

SEQ ID NO: 25484 - DNA, 20 bp, Artificial Sequence
  Synthetic
aagactagggcaagggacca

SEQ ID NO: 25485 - DNA, 20 bp, Artificial Sequence
  Synthetic
cgcccgcagactgtctgttg

SEQ ID NO: 25486 - DNA, 25 bp, Artificial Sequence
  Synthetic
aaatggtaaccaaaaaggatcctgt

SEQ ID NO: 25487 - DNA, 25 bp, Artificial Sequence
  Synthetic
ttttccatcatgagatttgaccact

SEQ ID NO: 25488 - DNA, 21 bp, Artificial Sequence
  Synthetic
aaatggcacctggtgtttgtg

SEQ ID NO: 25489 - DNA, 25 bp, Artificial Sequence
  Synthetic
catcactatttccaatttggacagc

SEQ ID NO: 25490 - DNA, 22 bp, Artificial Sequence
  Synthetic
gattggggcaaagtaatgacgt

SEQ ID NO: 25491 - DNA, 25 bp, Artificial Sequence
  Synthetic
ctttgatcaagttggatttaggtgc

SEQ ID NO: 25492 - DNA, 24 bp, Artificial Sequence
  Synthetic
ggatacccgtgatgccaatattga

SEQ ID NO: 25493 - DNA, 22 bp, Artificial Sequence
  Synthetic
accagcatcatttctccagagt

SEQ ID NO: 25494 - DNA, 25 bp, Artificial Sequence
  Synthetic
ttccagcaattttatagaggctgtc

SEQ ID NO: 25495 - DNA, 21 bp, Artificial Sequence
  Synthetic
aaagggcttgtcctccataca

SEQ ID NO: 25496 - DNA, 21 bp, Artificial Sequence
  Synthetic
ggaaacgagcatagttgagca

SEQ ID NO: 25497 - DNA, 25 bp, Artificial Sequence
  Synthetic
tggaatgttaatcaaagtgtcacgc

SEQ ID NO: 25498 - DNA, 25 bp, Artificial Sequence
  Synthetic
acagactctgttaaaaaagcatcgt

SEQ ID NO: 25499 - DNA, 25 bp, Artificial Sequence
  Synthetic
acacttgactttcaattgttcgaaa

SEQ ID NO: 25500 - DNA, 25 bp, Artificial Sequence
  Synthetic
ttgctgtcatcataccaatacgatg

SEQ ID NO: 25501 - DNA, 24 bp, Artificial Sequence
  Synthetic
accactcgaatactagttacttgc

SEQ ID NO: 25502 - DNA, 22 bp, Artificial Sequence
  Synthetic
caacctgtgttgttccttttgc

SEQ ID NO: 25503 - DNA, 22 bp, Artificial Sequence
  Synthetic
gctttttgagcttgagtacgca

SEQ ID NO: 25504 - DNA, 23 bp, Artificial Sequence
  Synthetic
atcaaccgtaacaaagttcacca

SEQ ID NO: 25505 - DNA, 22 bp, Artificial Sequence
  Synthetic
agacattttttcgcccttacca

SEQ ID NO: 25506 - DNA, 20 bp, Artificial Sequence
  Synthetic
tgaccctggatgagtgaagc

SEQ ID NO: 25507 - DNA, 20 bp, Artificial Sequence
  Synthetic
ggtacagcacgccagatgat

SEQ ID NO: 25508 - DNA, 24 bp, Artificial Sequence
  Synthetic
atggtcaccaaggataaccaattc

SEQ ID NO: 25509 - DNA, 25 bp, Artificial Sequence
  Synthetic
tgtcatggtattcaatttcagcctc

SEQ ID NO: 25510 - DNA, 22 bp, Artificial Sequence
  Synthetic
gattccttgcttagccaagact

SEQ ID NO: 25511 - DNA, 25 bp, Artificial Sequence
  Synthetic
aactccttttaaacaaacttgcgac

SEQ ID NO: 25512 - DNA, 23 bp, Artificial Sequence
  Synthetic
ggctcagtcgtagaatcagattg

SEQ ID NO: 25513 - DNA, 25 bp, Artificial Sequence
  Synthetic
actaagaagcaattgaatagcctgc

SEQ ID NO: 25514 - DNA, 20 bp, Artificial Sequence
  Synthetic
cccttgaccaacggaccata

SEQ ID NO: 25515 - DNA, 20 bp, Artificial Sequence
  Synthetic
ctgtgttcggcatgggtaca

SEQ ID NO: 25516 - DNA, 22 bp, Artificial Sequence
  Synthetic
tctcaaatttcctacgcccgcg

SEQ ID NO: 25517 - DNA, 22 bp, Artificial Sequence
  Synthetic
cctgctcgagttgtagctctcg

SEQ ID NO: 25518 - DNA, 21 bp, Artificial Sequence
  Synthetic
aagtcagcaccccttctcccg

SEQ ID NO: 25519 - DNA, 24 bp, Artificial Sequence
  Synthetic
ttccaatcgtccggtttagttagc

SEQ ID NO: 25520 - DNA, 23 bp, Artificial Sequence
  Synthetic
actcgactagtgagctattacgc

SEQ ID NO: 25521 - DNA, 22 bp, Artificial Sequence
  Synthetic
cacctttccctcacggtactgg

SEQ ID NO: 25522 - DNA, 21 bp, Artificial Sequence
  Synthetic
gaaaggaggtgatccagccgc

SEQ ID NO: 25523 - DNA, 20 bp, Artificial Sequence
  Synthetic
catcggcttcggcattagct

SEQ ID NO: 25524 - DNA, 24 bp, Artificial Sequence
  Synthetic
tgctgttgagaagacttgtgattt

SEQ ID NO: 25525 - DNA, 21 bp, Artificial Sequence
  Synthetic
tctgaaagggcttgacgaact

SEQ ID NO: 25526 - DNA, 23 bp, Artificial Sequence
  Synthetic
gatacgtcaaatgtaccaccacc

SEQ ID NO: 25527 - DNA, 21 bp, Artificial Sequence
  Synthetic
ttgccttctgggttagcaatg

SEQ ID NO: 25528 - DNA, 20 bp, Artificial Sequence
  Synthetic
cttagcagacgctcgtgcaa

SEQ ID NO: 25529 - DNA, 21 bp, Artificial Sequence
  Synthetic
tagcgttgaagttgttgacgt

SEQ ID NO: 25530 - DNA, 25 bp, Artificial Sequence
  Synthetic
atcaataggaccaatcaaactcagg

SEQ ID NO: 25531 - DNA, 24 bp, Artificial Sequence
  Synthetic
actgtcactggcttagattcatct

SEQ ID NO: 25532 - DNA, 24 bp, Artificial Sequence
  Synthetic
attacgaatagtggcgctactaga

SEQ ID NO: 25533 - DNA, 25 bp, Artificial Sequence
  Synthetic
acttctcatcaatggcttacctatg

SEQ ID NO: 25534 - DNA, 25 bp, Artificial Sequence
  Synthetic
aaaagcactaattctccttcgtcct

SEQ ID NO: 25535 - DNA, 23 bp, Artificial Sequence
  Synthetic
tggtcaccaccattcaaaaactc

SEQ ID NO: 25536 - DNA, 25 bp, Artificial Sequence
  Synthetic
atgtctccatcaatacaccgttaaa

SEQ ID NO: 25537 - DNA, 25 bp, Artificial Sequence
  Synthetic
ctatcactgaaaatgacaatgcgtc

SEQ ID NO: 25538 - DNA, 24 bp, Artificial Sequence
  Synthetic
aaacctcagcacattattcaagct

SEQ ID NO: 25539 - DNA, 25 bp, Artificial Sequence
  Synthetic
ttgcatctgtacaggtctatagtga

SEQ ID NO: 25540 - DNA, 21 bp, Artificial Sequence
  Synthetic
gctatggctgactcactagct

SEQ ID NO: 25541 - DNA, 25 bp, Artificial Sequence
  Synthetic
cttaaaagggcactaggaaaggaaa

SEQ ID NO: 25542 - DNA, 23 bp, Artificial Sequence
  Synthetic
attggcgaacttttccaaatggt

SEQ ID NO: 25543 - DNA, 21 bp, Artificial Sequence
  Synthetic
ccttgcccataaagccaagat

SEQ ID NO: 25544 - DNA, 25 bp, Artificial Sequence
  Synthetic
atccgtcgctttatgttgtaattgt

SEQ ID NO: 25545 - DNA, 25 bp, Artificial Sequence
  Synthetic
ggacaaccgtttttttaaaaggttg

SEQ ID NO: 25546 - DNA, 20 bp, Artificial Sequence
  Synthetic
cctttgccaaacacgagcaa

SEQ ID NO: 25547 - DNA, 23 bp, Artificial Sequence
  Synthetic
gtatgagatggctgaggtcaagg

SEQ ID NO: 25548 - DNA, 22 bp, Artificial Sequence
  Synthetic
aaaagtcccgctaatgaatccc

SEQ ID NO: 25549 - DNA, 25 bp, Artificial Sequence
  Synthetic
atcaactcctgattgattacctgtt

SEQ ID NO: 25550 - DNA, 22 bp, Artificial Sequence
  Synthetic
cctgctaagtcgggattgaagt

SEQ ID NO: 25551 - DNA, 20 bp, Artificial Sequence
  Synthetic
ccacctaaagctacccccaa

SEQ ID NO: 25552 - DNA, 22 bp, Artificial Sequence
  Synthetic
attcacacgaccaatcagacct

SEQ ID NO: 25553 - DNA, 21 bp, Artificial Sequence
  Synthetic
gtggtacgcccctacctgtcg

SEQ ID NO: 25554 - DNA, 19 bp, Artificial Sequence
  Synthetic
cagggcgccctgctactga

SEQ ID NO: 25555 - DNA, 20 bp, Artificial Sequence
  Synthetic
gggtttataccacccgcgct

SEQ ID NO: 25556 - DNA, 22 bp, Artificial Sequence
  Synthetic
tacaccccttacccgaaggcca

SEQ ID NO: 25557 - DNA, 21 bp, Artificial Sequence
  Synthetic
cggtggttgtggcctcctatt

SEQ ID NO: 25558 - DNA, 22 bp, Artificial Sequence
  Synthetic
tgcttcgatcgtgaatacgcct

SEQ ID NO: 25559 - DNA, 21 bp, Artificial Sequence
  Synthetic
tctcacggacgccttccatca

SEQ ID NO: 25560 - DNA, 21 bp, Artificial Sequence
  Synthetic
ggggccgatttccccgaggta

SEQ ID NO: 25561 - DNA, 20 bp, Artificial Sequence
  Synthetic
cggccaacgcccaacacaac

SEQ ID NO: 25562 - DNA, 21 bp, Artificial Sequence
  Synthetic
tataggcaggagacggctgct

SEQ ID NO: 25563 - DNA, 22 bp, Artificial Sequence
  Synthetic
ggtttccctgttatgaccccgc

SEQ ID NO: 25564 - DNA, 20 bp, Artificial Sequence
  Synthetic
cgatgcccccgagatgtgtg

SEQ ID NO: 25565 - DNA, 19 bp, Artificial Sequence
  Synthetic
tcgaggtgcgagctgtggt

SEQ ID NO: 25566 - DNA, 22 bp, Artificial Sequence
  Synthetic
agcttgccgaattggttgaggc

SEQ ID NO: 25567 - DNA, 20 bp, Artificial Sequence
  Synthetic
ggtgttgcaggctccccaag

SEQ ID NO: 25568 - DNA, 21 bp, Artificial Sequence
  Synthetic
gcttgctagtcgcctgtggtc

SEQ ID NO: 25569 - DNA, 21 bp, Artificial Sequence
  Synthetic
tgcggtcgcaggtttgaaagc

SEQ ID NO: 25570 - DNA, 22 bp, Artificial Sequence
  Synthetic
ctctccaccatgcccccacttg

SEQ ID NO: 25571 - DNA, 22 bp, Artificial Sequence
  Synthetic
ttccatcacttccaccgacgtg

SEQ ID NO: 25572 - DNA, 22 bp, Artificial Sequence
  Synthetic
tgacccctggtaacacgaacac

SEQ ID NO: 25573 - DNA, 22 bp, Artificial Sequence
  Synthetic
gcccagtcgcagagtgctatgg

SEQ ID NO: 25574 - DNA, 20 bp, Artificial Sequence
  Synthetic
tctgtgggtctggtgggatg

SEQ ID NO: 25575 - DNA, 22 bp, Artificial Sequence
  Synthetic
tttctgtgtctaagcactggtg

SEQ ID NO: 25576 - DNA, 25 bp, Artificial Sequence
  Synthetic
tgattatgtcattgcattgactggt

SEQ ID NO: 25577 - DNA, 22 bp, Artificial Sequence
  Synthetic
ttctgagagttggagtgttggt

SEQ ID NO: 25578 - DNA, 24 bp, Artificial Sequence
  Synthetic
actggtgttattgacattagtgct

SEQ ID NO: 25579 - DNA, 25 bp, Artificial Sequence
  Synthetic
acaagcttttttctatagtggtggt

SEQ ID NO: 25580 - DNA, 25 bp, Artificial Sequence
  Synthetic
ttctgcattgataattgtggtgagc

SEQ ID NO: 25581 - DNA, 24 bp, Artificial Sequence
  Synthetic
tgaaactgtctgtagtgtcgcata

SEQ ID NO: 25582 - DNA, 24 bp, Artificial Sequence
  Synthetic
tgatgaagagggtggttatgatgt

SEQ ID NO: 25583 - DNA, 25 bp, Artificial Sequence
  Synthetic
agcttgttagtatgaaaggtactgg

SEQ ID NO: 25584 - DNA, 24 bp, Artificial Sequence
  Synthetic
tttgactttgttgtcaatgctgct

SEQ ID NO: 25585 - DNA, 24 bp, Artificial Sequence
  Synthetic
aacttgtgttattgccaatgttcc

SEQ ID NO: 25586 - DNA, 24 bp, Artificial Sequence
  Synthetic
gaagttgactgggttgctttttac

SEQ ID NO: 25587 - DNA, 23 bp, Artificial Sequence
  Synthetic
gtgatgttggtttttgtccacac

SEQ ID NO: 25588 - DNA, 25 bp, Artificial Sequence
  Synthetic
tgtcctatagttgttggtgtttcag

SEQ ID NO: 25589 - DNA, 23 bp, Artificial Sequence
  Synthetic
tgatgacggttacatttgtggtg

SEQ ID NO: 25590 - DNA, 25 bp, Artificial Sequence
  Synthetic
agctacaattccaccttacaatctg

SEQ ID NO: 25591 - DNA, 24 bp, Artificial Sequence
  Synthetic
cataatggtgtcttcttgggagtt

SEQ ID NO: 25592 - DNA, 20 bp, Artificial Sequence
  Synthetic
tgcaagttgagagtgccaac

SEQ ID NO: 25593 - DNA, 20 bp, Artificial Sequence
  Synthetic
tgcaccacatggaccttttg

SEQ ID NO: 25594 - DNA, 25 bp, Artificial Sequence
  Synthetic
cgcaaagtctgaatttgatcatgag

SEQ ID NO: 25595 - DNA, 25 bp, Artificial Sequence
  Synthetic
tgaaactttgacatggcctcttatc

SEQ ID NO: 25596 - DNA, 25 bp, Artificial Sequence
  Synthetic
ttaactgcttgtgctttttctgttg

SEQ ID NO: 25597 - DNA, 20 bp, Artificial Sequence
  Synthetic
gggtgtgcttgtgaccgtac

SEQ ID NO: 25598 - DNA, 23 bp, Artificial Sequence
  Synthetic
tacttggaaagatggcagagtca

SEQ ID NO: 25599 - DNA, 20 bp, Artificial Sequence
  Synthetic
tgctctatgcgatgcgatgg

SEQ ID NO: 25600 - DNA, 24 bp, Artificial Sequence
  Synthetic
actgaacttttgcaatttgtcacc

SEQ ID NO: 25601 - DNA, 22 bp, Artificial Sequence
  Synthetic
agaactgttggtggtgtttctc

SEQ ID NO: 25602 - DNA, 25 bp, Artificial Sequence
  Synthetic
tggcacaagttttaacagaagttgt

SEQ ID NO: 25603 - DNA, 23 bp, Artificial Sequence
  Synthetic
atttgccttacccagatcctagt

SEQ ID NO: 25604 - DNA, 24 bp, Artificial Sequence
  Synthetic
ttgtggttcacaaactgtacttcg

SEQ ID NO: 25605 - DNA, 25 bp, Artificial Sequence
  Synthetic
gtcagtgatgcatatgctaatttgg

SEQ ID NO: 25606 - DNA, 25 bp, Artificial Sequence
  Synthetic
tgttcctttacaggttggtttttca

SEQ ID NO: 25607 - DNA, 20 bp, Artificial Sequence
  Synthetic
ttgagccaaaaccaccacac

SEQ ID NO: 25608 - DNA, 23 bp, Artificial Sequence
  Synthetic
tggtcaacttgatggtctttgtt

SEQ ID NO: 25609 - DNA, 25 bp, Artificial Sequence
  Synthetic
aattgtttgcaaaacgaaaaatggg

SEQ ID NO: 25610 - DNA, 25 bp, Artificial Sequence
  Synthetic
taaccacttgtccactttttatcca

SEQ ID NO: 25611 - DNA, 25 bp, Artificial Sequence
  Synthetic
cacctggtacaactgttttaaaacg

SEQ ID NO: 25612 - DNA, 23 bp, Artificial Sequence
  Synthetic
gttacgggtttattgccaactca

SEQ ID NO: 25613 - DNA, 25 bp, Artificial Sequence
  Synthetic
ttcctgtgtttttagtgttgtcaac

SEQ ID NO: 25614 - DNA, 24 bp, Artificial Sequence
  Synthetic
atcaaccactccgtttaacttgtt

SEQ ID NO: 25615 - DNA, 25 bp, Artificial Sequence
  Synthetic
gcacttttgtgggtattttaccacc

SEQ ID NO: 25616 - DNA, 25 bp, Artificial Sequence
  Synthetic
atgttgcactccccatttattatca

SEQ ID NO: 25617 - DNA, 23 bp, Artificial Sequence
  Synthetic
atcaacaaagcattattggtgcc

SEQ ID NO: 25618 - DNA, 25 bp, Artificial Sequence
  Synthetic
aagttgttacatctggtttgggtac

SEQ ID NO: 25619 - DNA, 23 bp, Artificial Sequence
  Synthetic
atgaccggcttgattcaattcaa

SEQ ID NO: 25620 - DNA, 24 bp, Artificial Sequence
  Synthetic
aatggtgtctttcgtgtaacttcc

SEQ ID NO: 25621 - DNA, 23 bp, Artificial Sequence
  Synthetic
ctacaggttgttgtggttgttgc

SEQ ID NO: 25622 - DNA, 25 bp, Artificial Sequence
  Synthetic
atgtccatttacgtaactggaactt

SEQ ID NO: 25623 - DNA, 25 bp, Artificial Sequence
  Synthetic
cacttcttagtggtgtacttcttgt

SEQ ID NO: 25624 - DNA, 24 bp, Artificial Sequence
  Synthetic
tcctccttcattttacatgcctct

SEQ ID NO: 25625 - DNA, 25 bp, Artificial Sequence
  Synthetic
tttggaaccaaagttctctattgct

SEQ ID NO: 25626 - DNA, 23 bp, Artificial Sequence
  Synthetic
agttcttctggtacttccactcc

SEQ ID NO: 25627 - DNA, 25 bp, Artificial Sequence
  Synthetic
agtgggtgataatgttcagattacc

SEQ ID NO: 25628 - DNA, 25 bp, Artificial Sequence
  Synthetic
ttggacagacctttattgcaaattg

SEQ ID NO: 25629 - DNA, 23 bp, Artificial Sequence
  Synthetic
atctgatttattagacgaggcgc

SEQ ID NO: 25630 - DNA, 21 bp, Artificial Sequence
  Synthetic
tgtggagattgggttttggca

SEQ ID NO: 25631 - DNA, 22 bp, Artificial Sequence
  Synthetic
acaactttggagtggattgcac

SEQ ID NO: 25632 - DNA, 25 bp, Artificial Sequence
  Synthetic
aatggggtaatgagaattggattgc

SEQ ID NO: 25633 - DNA, 24 bp, Artificial Sequence
  Synthetic
taaccctgataatcagacaaggca

SEQ ID NO: 25634 - DNA, 22 bp, Artificial Sequence
  Synthetic
tcgacgtccatcgactacaccg

SEQ ID NO: 25635 - DNA, 20 bp, Artificial Sequence
  Synthetic
agagagttgctttgcccaga

SEQ ID NO: 25636 - DNA, 24 bp, Artificial Sequence
  Synthetic
aatattgcaatatggcagtctggg

SEQ ID NO: 25637 - DNA, 24 bp, Artificial Sequence
  Synthetic
tgcaggttattgcagaaattcacc

SEQ ID NO: 25638 - DNA, 25 bp, Artificial Sequence
  Synthetic
ttaaacttaggccttgaaacagaca

SEQ ID NO: 25639 - DNA, 22 bp, Artificial Sequence
  Synthetic
ctgagcaagcccacattttcgc

SEQ ID NO: 25640 - DNA, 25 bp, Artificial Sequence
  Synthetic
taggtgacacagcatttatacaagg

SEQ ID NO: 25641 - DNA, 21 bp, Artificial Sequence
  Synthetic
atctgaacgtctactgctggt

SEQ ID NO: 25642 - DNA, 24 bp, Artificial Sequence
  Synthetic
tactgcttttgatgcaaaacagac

SEQ ID NO: 25643 - DNA, 25 bp, Artificial Sequence
  Synthetic
atcagaatgaaccatgaagcctatg

SEQ ID NO: 25644 - DNA, 23 bp, Artificial Sequence
  Synthetic
ccagaataatggcatttgctgga

SEQ ID NO: 25645 - DNA, 25 bp, Artificial Sequence
  Synthetic
aatccctacccctaaaatctgtttg

SEQ ID NO: 25646 - DNA, 20 bp, Artificial Sequence
  Synthetic
cgcggttaggacttgtttca

SEQ ID NO: 25647 - DNA, 21 bp, Artificial Sequence
  Synthetic
tttgtgtgaaacctgtgctgc

SEQ ID NO: 25648 - DNA, 24 bp, Artificial Sequence
  Synthetic
ggaattgttccaccaacaggaaag

SEQ ID NO: 25649 - DNA, 23 bp, Artificial Sequence
  Synthetic
ctgatgttacggagagtcaaacc

SEQ ID NO: 25650 - DNA, 24 bp, Artificial Sequence
  Synthetic
acaaacacaagtagggcaaacaga

SEQ ID NO: 25651 - DNA, 20 bp, Artificial Sequence
  Synthetic
acgatgcaacgtcacaatgt

SEQ ID NO: 25652 - DNA, 24 bp, Artificial Sequence
  Synthetic
tttcactatgctcgacaaaatggt

SEQ ID NO: 25653 - DNA, 22 bp, Artificial Sequence
  Synthetic
atctggtggaaggcttggatat

SEQ ID NO: 25654 - DNA, 20 bp, Artificial Sequence
  Synthetic
gggtgacccaaaatgaaggc

SEQ ID NO: 25655 - DNA, 23 bp, Artificial Sequence
  Synthetic
tgtagcagagaccgattttacca

SEQ ID NO: 25656 - DNA, 21 bp, Artificial Sequence
  Synthetic
acaacagacaaaatgtgggct

SEQ ID NO: 25657 - DNA, 24 bp, Artificial Sequence
  Synthetic
atccagactacattaaaatggcgc

SEQ ID NO: 25658 - DNA, 22 bp, Artificial Sequence
  Synthetic
gtggttctctcgtatccacaga

SEQ ID NO: 25659 - DNA, 24 bp, Artificial Sequence
  Synthetic
aacatctcagacaagttgtagcat

SEQ ID NO: 25660 - DNA, 24 bp, Artificial Sequence
  Synthetic
actttgaagcaggaattctggagt

SEQ ID NO: 25661 - DNA, 25 bp, Artificial Sequence
  Synthetic
actgtgtgaaaaatccctcaactag

SEQ ID NO: 25662 - DNA, 25 bp, Artificial Sequence
  Synthetic
aatggagacaagtccttatcaactc

SEQ ID NO: 25663 - DNA, 24 bp, Artificial Sequence
  Synthetic
tatcccaatttggtcaagagcacc

SEQ ID NO: 25664 - DNA, 24 bp, Artificial Sequence
  Synthetic
tttcccttttccctttcctattcc

SEQ ID NO: 25665 - DNA, 25 bp, Artificial Sequence
  Synthetic
tctctttgatcttccacaaggggta

SEQ ID NO: 25666 - DNA, 25 bp, Artificial Sequence
  Synthetic
agtgactggtgcttcttattttact

SEQ ID NO: 25667 - DNA, 25 bp, Artificial Sequence
  Synthetic
tcaagttcagataaaccctacacct

SEQ ID NO: 25668 - DNA, 24 bp, Artificial Sequence
  Synthetic
aatattgggacaggaacttcagct

SEQ ID NO: 25669 - DNA, 25 bp, Artificial Sequence
  Synthetic
cttggacatctattccaactttggc

SEQ ID NO: 25670 - DNA, 25 bp, Artificial Sequence
  Synthetic
tttctggaatcacattaaagcaagc

SEQ ID NO: 25671 - DNA, 21 bp, Artificial Sequence
  Synthetic
ttgcttcccatgtcagagtga

SEQ ID NO: 25672 - DNA, 25 bp, Artificial Sequence
  Synthetic
ttgaggatccagttttagcaaagaa

SEQ ID NO: 25673 - DNA, 24 bp, Artificial Sequence
  Synthetic
tagagggcctttagatctgacaat

SEQ ID NO: 25674 - DNA, 24 bp, Artificial Sequence
  Synthetic
agaagttgggaaacaaagactcaa

SEQ ID NO: 25675 - DNA, 20 bp, Artificial Sequence
  Synthetic
caggcagaagtgtgtggact

SEQ ID NO: 25676 - DNA, 25 bp, Artificial Sequence
  Synthetic
tggtcagatttttgtcagttagtgt

SEQ ID NO: 25677 - DNA, 20 bp, Artificial Sequence
  Synthetic
gcagttggcattcttggagt

SEQ ID NO: 25678 - DNA, 25 bp, Artificial Sequence
  Synthetic
gagagaagaatggatgtgtgagatg

SEQ ID NO: 25679 - DNA, 22 bp, Artificial Sequence
  Synthetic
tccatgttgctggaggaaattc

SEQ ID NO: 25680 - DNA, 25 bp, Artificial Sequence
  Synthetic
agaaccagaggattataaagaggct

SEQ ID NO: 25681 - DNA, 22 bp, Artificial Sequence
  Synthetic
ggagttcatccaagattggctc

SEQ ID NO: 25682 - DNA, 25 bp, Artificial Sequence
  Synthetic
tgctattggcatagatcctgataga

SEQ ID NO: 25683 - DNA, 20 bp, Artificial Sequence
  Synthetic
ggcaccatgcagtaccaaac

SEQ ID NO: 25684 - DNA, 24 bp, Artificial Sequence
  Synthetic
cctacagcaactgttacccttatg

SEQ ID NO: 25685 - DNA, 20 bp, Artificial Sequence
  Synthetic
cgggtacggacaatgaccaa

SEQ ID NO: 25686 - DNA, 23 bp, Artificial Sequence
  Synthetic
atgagatcagatgcacccattgg

SEQ ID NO: 25687 - DNA, 21 bp, Artificial Sequence
  Synthetic
ttgggagggaatggtagacgg

SEQ ID NO: 25688 - DNA, 20 bp, Artificial Sequence
  Synthetic
ttcttgtggccctggagaac

SEQ ID NO: 25689 - DNA, 25 bp, Artificial Sequence
  Synthetic
atggatttcctttgccatatcatgt

SEQ ID NO: 25690 - DNA, 23 bp, Artificial Sequence
  Synthetic
aaagacagtgcagcaacttagaa

SEQ ID NO: 25691 - DNA, 21 bp, Artificial Sequence
  Synthetic
aatctcgcagtggcagtttac

SEQ ID NO: 25692 - DNA, 23 bp, Artificial Sequence
  Synthetic
cattgtgacgaagagttgacaga

SEQ ID NO: 25693 - DNA, 25 bp, Artificial Sequence
  Synthetic
aattggttttctcttgaagcagact

SEQ ID NO: 25694 - DNA, 22 bp, Artificial Sequence
  Synthetic
cctcgtttggaagcaatacctt

SEQ ID NO: 25695 - DNA, 22 bp, Artificial Sequence
  Synthetic
actgggtcgtaactgcatatgg

SEQ ID NO: 25696 - DNA, 25 bp, Artificial Sequence
  Synthetic
caaggtaatacacgcataggtagag

SEQ ID NO: 25697 - DNA, 25 bp, Artificial Sequence
  Synthetic
ccaaattttaaagtatggcagcacc

SEQ ID NO: 25698 - DNA, 21 bp, Artificial Sequence
  Synthetic
tgtccctcttacagacacagg

SEQ ID NO: 25699 - DNA, 24 bp, Artificial Sequence
  Synthetic
taagcactattgacacagaaccct

SEQ ID NO: 25700 - DNA, 21 bp, Artificial Sequence
  Synthetic
tgtcaacaacgggtaaggtct

SEQ ID NO: 25701 - DNA, 25 bp, Artificial Sequence
  Synthetic
gatcctaacagatttgctctagctg

SEQ ID NO: 25702 - DNA, 25 bp, Artificial Sequence
  Synthetic
ccttaccttgtgtagaaaatcctcc

SEQ ID NO: 25703 - DNA, 24 bp, Artificial Sequence
  Synthetic
tgggtcagtaggagacagtattcc

SEQ ID NO: 25704 - DNA, 22 bp, Artificial Sequence
  Synthetic
ttaagcaacatgagtgcgactc

SEQ ID NO: 25705 - DNA, 20 bp, Artificial Sequence
  Synthetic
gtggggacatttgggtgacg

SEQ ID NO: 25706 - DNA, 24 bp, Artificial Sequence
  Synthetic
ctggggatgataaaaatgcaactg

SEQ ID NO: 25707 - DNA, 23 bp, Artificial Sequence
  Synthetic
tcctgacgtcagatgtatctgca

SEQ ID NO: 25708 - DNA, 23 bp, Artificial Sequence
  Synthetic
agaacgatcagcaaggatttacg

SEQ ID NO: 25709 - DNA, 20 bp, Artificial Sequence
  Synthetic
ttccacgcgacagatccgtc

SEQ ID NO: 25710 - DNA, 20 bp, Artificial Sequence
  Synthetic
acagagctggtcctgacgga

SEQ ID NO: 25711 - DNA, 22 bp, Artificial Sequence
  Synthetic
gctgatcctaacggaaggaggc

SEQ ID NO: 25712 - DNA, 19 bp, Artificial Sequence
  Synthetic
cctcccacgcgcgcctata

SEQ ID NO: 25713 - DNA, 20 bp, Artificial Sequence
  Synthetic
acaagacgagggctgcaacg

SEQ ID NO: 25714 - DNA, 20 bp, Artificial Sequence
  Synthetic
cggaggagagagaacggccg

SEQ ID NO: 25715 - DNA, 19 bp, Artificial Sequence
  Synthetic
ggccaaggcaacggcacga

SEQ ID NO: 25716 - DNA, 21 bp, Artificial Sequence
  Synthetic
cgatacagcgcgtcgtcgaac

SEQ ID NO: 25717 - DNA, 20 bp, Artificial Sequence
  Synthetic
gttctcggacgggtccctta

SEQ ID NO: 25718 - DNA, 23 bp, Artificial Sequence
  Synthetic
gcacgttgtctatccaatcgtaa

SEQ ID NO: 25719 - DNA, 21 bp, Artificial Sequence
  Synthetic
cgctttcctccgcatgtacaa

SEQ ID NO: 25720 - DNA, 24 bp, Artificial Sequence
  Synthetic
ttttacacagtgtcgaaatcacca

SEQ ID NO: 25721 - DNA, 22 bp, Artificial Sequence
  Synthetic
aacctgacctcgataaagcact

SEQ ID NO: 25722 - DNA, 23 bp, Artificial Sequence
  Synthetic
aatgacaaaacgtgctctctctg

SEQ ID NO: 25723 - DNA, 23 bp, Artificial Sequence
  Synthetic
gttgcctgagttttcggtattcg

SEQ ID NO: 25724 - DNA, 25 bp, Artificial Sequence
  Synthetic
ggttttgaagaagaagatgggatgt

SEQ ID NO: 25725 - DNA, 25 bp, Artificial Sequence
  Synthetic
aacgattggattttcaaagtttcca

SEQ ID NO: 25726 - DNA, 23 bp, Artificial Sequence
  Synthetic
cgaaaatagttccgcctgtttct

SEQ ID NO: 25727 - DNA, 25 bp, Artificial Sequence
  Synthetic
ggtcaagcgaagataacattctttc

SEQ ID NO: 25728 - DNA, 23 bp, Artificial Sequence
  Synthetic
cattcgactcacatcattgaagc

SEQ ID NO: 25729 - DNA, 24 bp, Artificial Sequence
  Synthetic
aggttagattcggaaaccatagct

SEQ ID NO: 25730 - DNA, 20 bp, Artificial Sequence
  Synthetic
ggctccgcccatgatttcat

SEQ ID NO: 25731 - DNA, 20 bp, Artificial Sequence
  Synthetic
gagtcgcttctagactcgcc

SEQ ID NO: 25732 - DNA, 20 bp, Artificial Sequence
  Synthetic
tatgggcgcaaagtgctgta

SEQ ID NO: 25733 - DNA, 21 bp, Artificial Sequence
  Synthetic
ttggaagcatacgtttgtggc

SEQ ID NO: 25734 - DNA, 21 bp, Artificial Sequence
  Synthetic
tttgcttttactgcagagcgt

SEQ ID NO: 25735 - DNA, 20 bp, Artificial Sequence
  Synthetic
tcggagagcgttgtggattg

SEQ ID NO: 25736 - DNA, 19 bp, Artificial Sequence
  Synthetic
acgacgtgctgcaaggccg

SEQ ID NO: 25737 - DNA, 21 bp, Artificial Sequence
  Synthetic
cagaccgctgctggacgaact

SEQ ID NO: 25738 - DNA, 22 bp, Artificial Sequence
  Synthetic
acatctgttcgacgtgatcgcc

SEQ ID NO: 25739 - DNA, 22 bp, Artificial Sequence
  Synthetic
ttgggtggtcttgactttggcg

SEQ ID NO: 25740 - DNA, 22 bp, Artificial Sequence
  Synthetic
ccctcttccctttaaccccacg

SEQ ID NO: 25741 - DNA, 24 bp, Artificial Sequence
  Synthetic
acaaagggattggctgatgattac

SEQ ID NO: 25742 - DNA, 25 bp, Artificial Sequence
  Synthetic
aactgaggaatatatctgttccagc

SEQ ID NO: 25743 - DNA, 24 bp, Artificial Sequence
  Synthetic
taatgcctttctcctcatgtctga

SEQ ID NO: 25744 - DNA, 25 bp, Artificial Sequence
  Synthetic
agaagtagcaatagatgacgaaacg

SEQ ID NO: 25745 - DNA, 24 bp, Artificial Sequence
  Synthetic
tttgtgagtggaagagaaaaacct

SEQ ID NO: 25746 - DNA, 24 bp, Artificial Sequence
  Synthetic
ggaaggcaaactagtaaaagggtc

SEQ ID NO: 25747 - DNA, 23 bp, Artificial Sequence
  Synthetic
agaagacaagcataacgggaaac

SEQ ID NO: 25748 - DNA, 25 bp, Artificial Sequence
  Synthetic
tcatcgattatgaggagctaagaga

SEQ ID NO: 25749 - DNA, 23 bp, Artificial Sequence
  Synthetic
tgcagatgcatatgtttttgtgg

SEQ ID NO: 25750 - DNA, 25 bp, Artificial Sequence
  Synthetic
attgcaatacaacttgtcaaacacc

SEQ ID NO: 25751 - DNA, 22 bp, Artificial Sequence
  Synthetic
caccatcaaaatgagcaggggt

SEQ ID NO: 25752 - DNA, 20 bp, Artificial Sequence
  Synthetic
cctacaagcgccaggagggt

SEQ ID NO: 25753 - DNA, 19 bp, Artificial Sequence
  Synthetic
ctcggagtcccagcgcgtt

SEQ ID NO: 25754 - DNA, 19 bp, Artificial Sequence
  Synthetic
cacctccctgtggcgcatc

SEQ ID NO: 25755 - DNA, 20 bp, Artificial Sequence
  Synthetic
tatccgtcctccctgggcac

SEQ ID NO: 25756 - DNA, 19 bp, Artificial Sequence
  Synthetic
ccgtccaccgtccctctca

SEQ ID NO: 25757 - DNA, 22 bp, Artificial Sequence
  Synthetic
gaagacctagagctgccggacc

SEQ ID NO: 25758 - DNA, 22 bp, Artificial Sequence
  Synthetic
gtgattctgggaaacgtgccca

SEQ ID NO: 25759 - DNA, 19 bp, Artificial Sequence
  Synthetic
gccctcctgggtacggcaa

SEQ ID NO: 25760 - DNA, 20 bp, Artificial Sequence
  Synthetic
gccgtgcttccagagaccga

SEQ ID NO: 25761 - DNA, 20 bp, Artificial Sequence
  Synthetic
caactcggcctgcgtgatcc

SEQ ID NO: 25762 - DNA, 20 bp, Artificial Sequence
  Synthetic
aagccatgacggtacacagg

SEQ ID NO: 25763 - DNA, 24 bp, Artificial Sequence
  Synthetic
ttaaccgtttcttctgccagttag

SEQ ID NO: 25764 - DNA, 23 bp, Artificial Sequence
  Synthetic
tctccgaacatgatcagaactcg

SEQ ID NO: 25765 - DNA, 24 bp, Artificial Sequence
  Synthetic
acgaaaacttttaacttcgacgga

SEQ ID NO: 25766 - DNA, 20 bp, Artificial Sequence
  Synthetic
actgcaaatcgttccgtcgt

SEQ ID NO: 25767 - DNA, 23 bp, Artificial Sequence
  Synthetic
agcaaagcaataacgaaccttgt

SEQ ID NO: 25768 - DNA, 21 bp, Artificial Sequence
  Synthetic
tatcgtcgagctgtacagacg

SEQ ID NO: 25769 - DNA, 25 bp, Artificial Sequence
  Synthetic
taccttcaaaaatacgtaaacccct

SEQ ID NO: 25770 - DNA, 20 bp, Artificial Sequence
  Synthetic
acaaacttgcaagcctgagc

SEQ ID NO: 25771 - DNA, 20 bp, Artificial Sequence
  Synthetic
ggtaggtcgcgacttgttga

SEQ ID NO: 25772 - DNA, 25 bp, Artificial Sequence
  Synthetic
caaccctgatgtaataaattccgtg

SEQ ID NO: 25773 - DNA, 23 bp, Artificial Sequence
  Synthetic
tcgggagaaaatagatcaagggc

SEQ ID NO: 25774 - DNA, 24 bp, Artificial Sequence
  Synthetic
taattcgcttaagattggcagtgg

SEQ ID NO: 25775 - DNA, 21 bp, Artificial Sequence
  Synthetic
cgtctgttgttaggaccggtt

SEQ ID NO: 25776 - DNA, 24 bp, Artificial Sequence
  Synthetic
tcttcgcatacgtaagaaactacg

SEQ ID NO: 25777 - DNA, 23 bp, Artificial Sequence
  Synthetic
gcaaagcataaattcttctggcg

SEQ ID NO: 25778 - DNA, 21 bp, Artificial Sequence
  Synthetic
tcatggttccgtcttccaagt

SEQ ID NO: 25779 - DNA, 20 bp, Artificial Sequence
  Synthetic
ccagatccgggttatagcga

SEQ ID NO: 25780 - DNA, 20 bp, Artificial Sequence
  Synthetic
ctctctcctgtgtcgatcgc

SEQ ID NO: 25781 - DNA, 20 bp, Artificial Sequence
  Synthetic
atgtgtgacgtccgcatcat

SEQ ID NO: 25782 - DNA, 20 bp, Artificial Sequence
  Synthetic
tgctcctacaagcgccagga

SEQ ID NO: 25783 - DNA, 19 bp, Artificial Sequence
  Synthetic
ggtggccgtgtacgcacct

SEQ ID NO: 25784 - DNA, 22 bp, Artificial Sequence
  Synthetic
atcgaccgactcctgctatccg

SEQ ID NO: 25785 - DNA, 19 bp, Artificial Sequence
  Synthetic
gcggttctgccagggcgtt

SEQ ID NO: 25786 - DNA, 19 bp, Artificial Sequence
  Synthetic
gggaccccgtggcgtatga

SEQ ID NO: 25787 - DNA, 20 bp, Artificial Sequence
  Synthetic
acattccatggggccaaaga

SEQ ID NO: 25788 - DNA, 24 bp, Artificial Sequence
  Synthetic
ttaaatacggactgaaaggagggc

SEQ ID NO: 25789 - DNA, 22 bp, Artificial Sequence
  Synthetic
ctccgccgagatcaaaagtcct

SEQ ID NO: 25790 - DNA, 25 bp, Artificial Sequence
  Synthetic
aggcgatcatggaaaagaacatagt

SEQ ID NO: 25791 - DNA, 22 bp, Artificial Sequence
  Synthetic
gggagaccttcactacctccag

SEQ ID NO: 25792 - DNA, 20 bp, Artificial Sequence
  Synthetic
ggccactatgtctgcacgtt

SEQ ID NO: 25793 - DNA, 24 bp, Artificial Sequence
  Synthetic
agaagtgagaataagatgctgcaa

SEQ ID NO: 25794 - DNA, 20 bp, Artificial Sequence
  Synthetic
cacgcaacaggacttgcaag

SEQ ID NO: 25795 - DNA, 20 bp, Artificial Sequence
  Synthetic
atgtggggtctgggtgttca

SEQ ID NO: 25796 - DNA, 24 bp, Artificial Sequence
  Synthetic
caggtggtagagctgtttaaatgc

SEQ ID NO: 25797 - DNA, 25 bp, Artificial Sequence
  Synthetic
gcttgccaaaatgttaaatgtacca

SEQ ID NO: 25798 - DNA, 25 bp, Artificial Sequence
  Synthetic
tgcacaaatagcagatatagatgca

SEQ ID NO: 25799 - DNA, 22 bp, Artificial Sequence
  Synthetic
gcaaacagctacagcaccatat

SEQ ID NO: 25800 - DNA, 25 bp, Artificial Sequence
  Synthetic
tacaggacacaagtcaagaactatg

SEQ ID NO: 25801 - DNA, 21 bp, Artificial Sequence
  Synthetic
gcacgctcgcctgatattgaa

SEQ ID NO: 25802 - DNA, 25 bp, Artificial Sequence
  Synthetic
aaccccatatttactgatccttcgg

SEQ ID NO: 25803 - DNA, 25 bp, Artificial Sequence
  Synthetic
tcaccttctatacctgccatatctg

SEQ ID NO: 25804 - DNA, 20 bp, Artificial Sequence
  Synthetic
tacgcttgcccgaccctaat

SEQ ID NO: 25805 - DNA, 21 bp, Artificial Sequence
  Synthetic
acaccgtgcaatgcttctaaa

SEQ ID NO: 25806 - DNA, 21 bp, Artificial Sequence
  Synthetic
tgtgtgtgatactcccttgca

SEQ ID NO: 25807 - DNA, 25 bp, Artificial Sequence
  Synthetic
atacgcttccaaacttgcttttagg

SEQ ID NO: 25808 - DNA, 22 bp, Artificial Sequence
  Synthetic
cattgcaccagctatgtgaagt

SEQ ID NO: 25809 - DNA, 25 bp, Artificial Sequence
  Synthetic
taaggtgctacagatgtcaacatcc

SEQ ID NO: 25810 - DNA, 24 bp, Artificial Sequence
  Synthetic
ctcagaggatgaggatgaggatga

SEQ ID NO: 25811 - DNA, 22 bp, Artificial Sequence
  Synthetic
gtaatcagcaaacagtgtgccg

SEQ ID NO: 25812 - DNA, 22 bp, Artificial Sequence
  Synthetic
tgccactgcaacaaatacaaga

SEQ ID NO: 25813 - DNA, 25 bp, Artificial Sequence
  Synthetic
gcatttgacaatgaagtaaccgatg

SEQ ID NO: 25814 - DNA, 22 bp, Artificial Sequence
  Synthetic
cctaaggtatcaaggggtcgag

SEQ ID NO: 25815 - DNA, 24 bp, Artificial Sequence
  Synthetic
atttggataacgacgaagacaagg

SEQ ID NO: 25816 - DNA, 22 bp, Artificial Sequence
  Synthetic
acaaactttaaagacgaggcca

SEQ ID NO: 25817 - DNA, 22 bp, Artificial Sequence
  Synthetic
actgactccaccacacagtcca

SEQ ID NO: 25818 - DNA, 24 bp, Artificial Sequence
  Synthetic
agatgaaacccaacgccaaaaatt

SEQ ID NO: 25819 - DNA, 20 bp, Artificial Sequence
  Synthetic
tttgctgctttgtgtgcctg

SEQ ID NO: 25820 - DNA, 24 bp, Artificial Sequence
  Synthetic
ccaacatctggggttcatagttat

SEQ ID NO: 25821 - DNA, 24 bp, Artificial Sequence
  Synthetic
agacattgtggctttacacagacc

SEQ ID NO: 25822 - DNA, 23 bp, Artificial Sequence
  Synthetic
acgtaggcgtcgtaaacgtattc

SEQ ID NO: 25823 - DNA, 23 bp, Artificial Sequence
  Synthetic
acagatatgtgaaaagtgcagct

SEQ ID NO: 25824 - DNA, 23 bp, Artificial Sequence
  Synthetic
ctgcataccttagtgcttttggg

SEQ ID NO: 25825 - DNA, 20 bp, Artificial Sequence
  Synthetic
ggcaactctccaggttgtct

SEQ ID NO: 25826 - DNA, 20 bp, Artificial Sequence
  Synthetic
ctgcctgcgcacctctcatg

SEQ ID NO: 25827 - DNA, 25 bp, Artificial Sequence
  Synthetic
tgtggctattcagacaggattatgc

SEQ ID NO: 25828 - DNA, 22 bp, Artificial Sequence
  Synthetic
aactccaggatctgggcaattc

SEQ ID NO: 25829 - DNA, 24 bp, Artificial Sequence
  Synthetic
acaactttaattggggagattgca

SEQ ID NO: 25830 - DNA, 22 bp, Artificial Sequence
  Synthetic
tctcttgttgtaccatgggtga

SEQ ID NO: 25831 - DNA, 25 bp, Artificial Sequence
  Synthetic
tggaaaatcacactacaggaaatgg

SEQ ID NO: 25832 - DNA, 25 bp, Artificial Sequence
  Synthetic
ggacagccatttcctagattttctt

SEQ ID NO: 25833 - DNA, 25 bp, Artificial Sequence
  Synthetic
aggaacaaggcataactgattacat

SEQ ID NO: 25834 - DNA, 25 bp, Artificial Sequence
  Synthetic
aaaagttttgcaaatggacccaatt

SEQ ID NO: 25835 - DNA, 21 bp, Artificial Sequence
  Synthetic
ggtggtggatgtcatgtctgc

SEQ ID NO: 25836 - DNA, 25 bp, Artificial Sequence
  Synthetic
aacgatttatgagtcaaaaggttgg

SEQ ID NO: 25837 - DNA, 25 bp, Artificial Sequence
  Synthetic
tatgcgaaaaacttgattgttgtgt

SEQ ID NO: 25838 - DNA, 25 bp, Artificial Sequence
  Synthetic
agatgatgaagttgatgcagaagag

SEQ ID NO: 25839 - DNA, 25 bp, Artificial Sequence
  Synthetic
acaggtaacaactagtggattttca

SEQ ID NO: 25840 - DNA, 24 bp, Artificial Sequence
  Synthetic
aaatgcgtaatatgtcaatggcag

SEQ ID NO: 25841 - DNA, 25 bp, Artificial Sequence
  Synthetic
agatgtaaaagcagaacaatcgttg

SEQ ID NO: 25842 - DNA, 24 bp, Artificial Sequence
  Synthetic
atttggaggcttaaagacacaagt

SEQ ID NO: 25843 - DNA, 22 bp, Artificial Sequence
  Synthetic
aaccttcgacgacgacaaggag

SEQ ID NO: 25844 - DNA, 25 bp, Artificial Sequence
  Synthetic
gaggagctatataaacaatgtgcca

SEQ ID NO: 25845 - DNA, 25 bp, Artificial Sequence
  Synthetic
cagatgagtctgcagtactagatgt

SEQ ID NO: 25846 - DNA, 25 bp, Artificial Sequence
  Synthetic
accttcctattttacaaccgatacc

SEQ ID NO: 25847 - DNA, 25 bp, Artificial Sequence
  Synthetic
ttcagatgacttttacttgcatcct

SEQ ID NO: 25848 - DNA, 22 bp, Artificial Sequence
  Synthetic
gaggacgatactggtgatcaca

SEQ ID NO: 25849 - DNA, 20 bp, Artificial Sequence
  Synthetic
caacaccgagtggctcactg

SEQ ID NO: 25850 - DNA, 25 bp, Artificial Sequence
  Synthetic
ttctgggacgttgatttaacagaga

SEQ ID NO: 25851 - DNA, 21 bp, Artificial Sequence
  Synthetic
ggctgcctgcccctctttgag

SEQ ID NO: 25852 - DNA, 21 bp, Artificial Sequence
  Synthetic
tactgtttgacaccatgggcg

SEQ ID NO: 25853 - DNA, 25 bp, Artificial Sequence
  Synthetic
aggcttaaacaaattactatcggga

SEQ ID NO: 25854 - DNA, 21 bp, Artificial Sequence
  Synthetic
accatcatgcattgggtaggt

SEQ ID NO: 25855 - DNA, 25 bp, Artificial Sequence
  Synthetic
aacatcactatattcccacaccagc

SEQ ID NO: 25856 - DNA, 25 bp, Artificial Sequence
  Synthetic
tggatctcaacaatttctcacaact

SEQ ID NO: 25857 - DNA, 25 bp, Artificial Sequence
  Synthetic
actttgcaaattggtcaggtagtat

SEQ ID NO: 25858 - DNA, 20 bp, Artificial Sequence
  Synthetic
ccaacccagtggtccacaac

SEQ ID NO: 25859 - DNA, 25 bp, Artificial Sequence
  Synthetic
tttgacatggaagttactgttgtca

SEQ ID NO: 25860 - DNA, 25 bp, Artificial Sequence
  Synthetic
tgctgtgtatggtatcacatctaca

SEQ ID NO: 25861 - DNA, 20 bp, Artificial Sequence
  Synthetic
aaactgcaggcccaagtgat

SEQ ID NO: 25862 - DNA, 25 bp, Artificial Sequence
  Synthetic
tggtatcagatagaggaaacctgtt

SEQ ID NO: 25863 - DNA, 25 bp, Artificial Sequence
  Synthetic
ggtttcactgacacacttaaagacc

SEQ ID NO: 25864 - DNA, 20 bp, Artificial Sequence
  Synthetic
ccaagccgacaaggtgatgg

SEQ ID NO: 25865 - DNA, 21 bp, Artificial Sequence
  Synthetic
atggatgatctgggccaaaac

SEQ ID NO: 25866 - DNA, 24 bp, Artificial Sequence
  Synthetic
tcaagtaggcttgctagatactgc

SEQ ID NO: 25867 - DNA, 25 bp, Artificial Sequence
  Synthetic
agaccctaaagtcattcaatactgc

SEQ ID NO: 25868 - DNA, 21 bp, Artificial Sequence
  Synthetic
ccttgcaaggtcctgaacatg

SEQ ID NO: 25869 - DNA, 24 bp, Artificial Sequence
  Synthetic
atacatgtgggtggaaatggtagg

SEQ ID NO: 25870 - DNA, 24 bp, Artificial Sequence
  Synthetic
tgaatgagtacatagaaacagccg

SEQ ID NO: 25871 - DNA, 24 bp, Artificial Sequence
  Synthetic
actttcctaaaggatgaactccgc

SEQ ID NO: 25872 - DNA, 24 bp, Artificial Sequence
  Synthetic
agatggagaactcattgcttttga

SEQ ID NO: 25873 - DNA, 25 bp, Artificial Sequence
  Synthetic
atgagtcaatcagatggactaagga

SEQ ID NO: 25874 - DNA, 23 bp, Artificial Sequence
  Synthetic
aaccctgctctcagaatgaaatg

SEQ ID NO: 25875 - DNA, 25 bp, Artificial Sequence
  Synthetic
caagtacagtccattatccaaaggt

SEQ ID NO: 25876 - DNA, 25 bp, Artificial Sequence
  Synthetic
gtaaaattgctcctttaatggtggc

SEQ ID NO: 25877 - DNA, 20 bp, Artificial Sequence
  Synthetic
ggcggagagcaacagctatc

SEQ ID NO: 25878 - DNA, 25 bp, Artificial Sequence
  Synthetic
cacttccaaaaagatgcaaaagtgc

SEQ ID NO: 25879 - DNA, 23 bp, Artificial Sequence
  Synthetic
cagggaacagagaagttgacaat

SEQ ID NO: 25880 - DNA, 21 bp, Artificial Sequence
  Synthetic
ggaaacggccgattttcccac

SEQ ID NO: 25881 - DNA, 25 bp, Artificial Sequence
  Synthetic
ggtgtttatgttacacatcagctga

SEQ ID NO: 25882 - DNA, 23 bp, Artificial Sequence
  Synthetic
atgattcttcaggctgacatagc

SEQ ID NO: 25883 - DNA, 20 bp, Artificial Sequence
  Synthetic
ggagacccaaatgcttcctg

SEQ ID NO: 25884 - DNA, 20 bp, Artificial Sequence
  Synthetic
ccaggaactaggcgcagctg

SEQ ID NO: 25885 - DNA, 24 bp, Artificial Sequence
  Synthetic
actggtttggaactcctctatctc

SEQ ID NO: 25886 - DNA, 21 bp, Artificial Sequence
  Synthetic
gcttttacagccagcagcgtc

SEQ ID NO: 25887 - DNA, 22 bp, Artificial Sequence
  Synthetic
aacatgcctgctacatctcggg

SEQ ID NO: 25888 - DNA, 22 bp, Artificial Sequence
  Synthetic
ctgctcttccctagaaacgggc

SEQ ID NO: 25889 - DNA, 22 bp, Artificial Sequence
  Synthetic
acgatgagaccaagtccagggt

SEQ ID NO: 25890 - DNA, 21 bp, Artificial Sequence
  Synthetic
gaccatgacctacgcgaccgt

SEQ ID NO: 25891 - DNA, 20 bp, Artificial Sequence
  Synthetic
ggggtggaggtagcaccact

SEQ ID NO: 25892 - DNA, 22 bp, Artificial Sequence
  Synthetic
ggaccaccaggacaatgtagcc

SEQ ID NO: 25893 - DNA, 19 bp, Artificial Sequence
  Synthetic
gggccgtagatgaccccga

SEQ ID NO: 25894 - DNA, 22 bp, Artificial Sequence
  Synthetic
ttgggacgactgcgactgtagg

SEQ ID NO: 25895 - DNA, 20 bp, Artificial Sequence
  Synthetic
tttgggcgcgagaaagaccg

SEQ ID NO: 25896 - DNA, 22 bp, Artificial Sequence
  Synthetic
cgtccacgccaagacaaaggag

SEQ ID NO: 25897 - DNA, 22 bp, Artificial Sequence
  Synthetic
ccctgccgcaatgctttttagg

SEQ ID NO: 25898 - DNA, 20 bp, Artificial Sequence
  Synthetic
ccagcctcggttatgcaggg

SEQ ID NO: 25899 - DNA, 20 bp, Artificial Sequence
  Synthetic
acaactcatgcgagggtgcc

SEQ ID NO: 25900 - DNA, 20 bp, Artificial Sequence
  Synthetic
gaggtgtgcgtcagggcaaa

SEQ ID NO: 25901 - DNA, 22 bp, Artificial Sequence
  Synthetic
aagctcctcgtaggtgaggtcc

SEQ ID NO: 25902 - DNA, 22 bp, Artificial Sequence
  Synthetic
accagcatgaaggggacaagct

SEQ ID NO: 25903 - DNA, 20 bp, Artificial Sequence
  Synthetic
gccctggctggtggttttca

SEQ ID NO: 25904 - DNA, 19 bp, Artificial Sequence
  Synthetic
gcgtcattgacggcggcct

SEQ ID NO: 25905 - DNA, 21 bp, Artificial Sequence
  Synthetic
cgcaggcgctgaaaaaggtag

SEQ ID NO: 25906 - DNA, 20 bp, Artificial Sequence
  Synthetic
cgggagacggtcgacgaagc

SEQ ID NO: 25907 - DNA, 22 bp, Artificial Sequence
  Synthetic
aggaaagcgtctagccaatcgc

SEQ ID NO: 25908 - DNA, 19 bp, Artificial Sequence
  Synthetic
cgacgcgctcggcaaggat

SEQ ID NO: 25909 - DNA, 22 bp, Artificial Sequence
  Synthetic
gtagccgtagaggtagcgggac

SEQ ID NO: 25910 - DNA, 21 bp, Artificial Sequence
  Synthetic
ggctaaagccgcgactaacgt

SEQ ID NO: 25911 - DNA, 21 bp, Artificial Sequence
  Synthetic
gcatcccgtcctgcgccaaat

SEQ ID NO: 25912 - DNA, 19 bp, Artificial Sequence
  Synthetic
tgattgcgcgcgaggaggt

SEQ ID NO: 25913 - DNA, 19 bp, Artificial Sequence
  Synthetic
cgcatggcgctcaaggtgc

SEQ ID NO: 25914 - DNA, 18 bp, Artificial Sequence
  Synthetic
taagggcggcgctgcaaa

SEQ ID NO: 25915 - DNA, 21 bp, Artificial Sequence
  Synthetic
acgaacgtgcagtccaacctg

SEQ ID NO: 25916 - DNA, 21 bp, Artificial Sequence
  Synthetic
cggtcaacggtgagcagcttg

SEQ ID NO: 25917 - DNA, 21 bp, Artificial Sequence
  Synthetic
cactgtcggccgaggaagaaa

SEQ ID NO: 25918 - DNA, 20 bp, Artificial Sequence
  Synthetic
ccgccagggttctacacggg

SEQ ID NO: 25919 - DNA, 19 bp, Artificial Sequence
  Synthetic
gcctggtgtgggacgacga

SEQ ID NO: 25920 - DNA, 22 bp, Artificial Sequence
  Synthetic
accctggaggttccgtttgtgc

SEQ ID NO: 25921 - DNA, 22 bp, Artificial Sequence
  Synthetic
gatgccgggggtctacacctac

SEQ ID NO: 25922 - DNA, 22 bp, Artificial Sequence
  Synthetic
gcaagaggagatagcagtgtcc

SEQ ID NO: 25923 - DNA, 22 bp, Artificial Sequence
  Synthetic
tcagcaactaccccgtggttgg

SEQ ID NO: 25924 - DNA, 19 bp, Artificial Sequence
  Synthetic
cgcgtgctctccagtcgca

SEQ ID NO: 25925 - DNA, 19 bp, Artificial Sequence
  Synthetic
aactacacccccgccccct

SEQ ID NO: 25926 - DNA, 18 bp, Artificial Sequence
  Synthetic
cgtgtactgggtgcgcga

SEQ ID NO: 25927 - DNA, 20 bp, Artificial Sequence
  Synthetic
cggcacggcggtggtgttta

SEQ ID NO: 25928 - DNA, 21 bp, Artificial Sequence
  Synthetic
aaatggatgtggagcccgagg

SEQ ID NO: 25929 - DNA, 20 bp, Artificial Sequence
  Synthetic
ccaggaggcgaagatggggc

SEQ ID NO: 25930 - DNA, 19 bp, Artificial Sequence
  Synthetic
caggagaggcatggcaggc

SEQ ID NO: 25931 - DNA, 20 bp, Artificial Sequence
  Synthetic
gaacgggggcgccttcaatt

SEQ ID NO: 25932 - DNA, 19 bp, Artificial Sequence
  Synthetic
cctgacgcggaggagacga

SEQ ID NO: 25933 - DNA, 21 bp, Artificial Sequence
  Synthetic
gagcacgctgcacagtatcgt

SEQ ID NO: 25934 - DNA, 21 bp, Artificial Sequence
  Synthetic
cacccacgatgtgaccacgga

SEQ ID NO: 25935 - DNA, 22 bp, Artificial Sequence
  Synthetic
aagggtctgcaaattggtgttg

SEQ ID NO: 25936 - DNA, 20 bp, Artificial Sequence
  Synthetic
gaactctgcggtggacagtt

SEQ ID NO: 25937 - DNA, 22 bp, Artificial Sequence
  Synthetic
cctacgagtacatgaacgggcg

SEQ ID NO: 25938 - DNA, 19 bp, Artificial Sequence
  Synthetic
gcgcctccgtccgctttga

SEQ ID NO: 25939 - DNA, 21 bp, Artificial Sequence
  Synthetic
aacgtggcccaatgcaacatg

SEQ ID NO: 25940 - DNA, 19 bp, Artificial Sequence
  Synthetic
cagccctaccccgccaact

SEQ ID NO: 25941 - DNA, 20 bp, Artificial Sequence
  Synthetic
ggcaacgccaccacctaagc

SEQ ID NO: 25942 - DNA, 22 bp, Artificial Sequence
  Synthetic
ttcgagtacgaggccatgttgc

SEQ ID NO: 25943 - DNA, 19 bp, Artificial Sequence
  Synthetic
tccggcgcaaccaggagga

SEQ ID NO: 25944 - DNA, 20 bp, Artificial Sequence
  Synthetic
gtctcgctccacatgcgccg

SEQ ID NO: 25945 - DNA, 22 bp, Artificial Sequence
  Synthetic
ctgcttaaaagcttgctgggcc

SEQ ID NO: 25946 - DNA, 18 bp, Artificial Sequence
  Synthetic
tggccttccacctcggca

SEQ ID NO: 25947 - DNA, 22 bp, Artificial Sequence
  Synthetic
tggtatccatgcccttctccca

SEQ ID NO: 25948 - DNA, 20 bp, Artificial Sequence
  Synthetic
ccggagcccacccgctgata

SEQ ID NO: 25949 - DNA, 22 bp, Artificial Sequence
  Synthetic
acagaaggaaaccaacgctggg

SEQ ID NO: 25950 - DNA, 22 bp, Artificial Sequence
  Synthetic
ctcacccattttgcctaccccg

SEQ ID NO: 25951 - DNA, 22 bp, Artificial Sequence
  Synthetic
cgtggagctaaccaacctggtc

SEQ ID NO: 25952 - DNA, 20 bp, Artificial Sequence
  Synthetic
gccttggacctggccgaaat

SEQ ID NO: 25953 - DNA, 19 bp, Artificial Sequence
  Synthetic
gccactgccgctgcaacct

SEQ ID NO: 25954 - DNA, 20 bp, Artificial Sequence
  Synthetic
ctcgcccaattgcacgccat

SEQ ID NO: 25955 - DNA, 22 bp, Artificial Sequence
  Synthetic
gggatcgagtaaagggtgacgg

SEQ ID NO: 25956 - DNA, 20 bp, Artificial Sequence
  Synthetic
aaatcggtctctgcgctcgc

SEQ ID NO: 25957 - DNA, 20 bp, Artificial Sequence
  Synthetic
gtccgcccagacccgactta

SEQ ID NO: 25958 - DNA, 22 bp, Artificial Sequence
  Synthetic
taccccgacgagttcataccga

SEQ ID NO: 25959 - DNA, 22 bp, Artificial Sequence
  Synthetic
atccagtgtcgtcataatcgca

SEQ ID NO: 25960 - DNA, 20 bp, Artificial Sequence
  Synthetic
ggggtgtactgtcatgccac

SEQ ID NO: 25961 - DNA, 21 bp, Artificial Sequence
  Synthetic
ctgctggtaggggctctaatg

SEQ ID NO: 25962 - DNA, 25 bp, Artificial Sequence
  Synthetic
taatgctgacaagtctcatgaaagg

SEQ ID NO: 25963 - DNA, 25 bp, Artificial Sequence
  Synthetic
atcaacaaataaccttcagccaaca

SEQ ID NO: 25964 - DNA, 25 bp, Artificial Sequence
  Synthetic
acaagttgcagaaactgatcaaaac

SEQ ID NO: 25965 - DNA, 24 bp, Artificial Sequence
  Synthetic
ttgctgcaaagccagaaaaaaatc

SEQ ID NO: 25966 - DNA, 22 bp, Artificial Sequence
  Synthetic
tcctgcagcttatcgactggtg

SEQ ID NO: 25967 - DNA, 20 bp, Artificial Sequence
  Synthetic
ctggaactctgttggggcat

SEQ ID NO: 25968 - DNA, 21 bp, Artificial Sequence
  Synthetic
cgaaaccagcggctgtatcca

SEQ ID NO: 25969 - DNA, 24 bp, Artificial Sequence
  Synthetic
tggaaatgtctcactcaaggttgg

SEQ ID NO: 25970 - DNA, 23 bp, Artificial Sequence
  Synthetic
agaagataaacgcaccctatgga

SEQ ID NO: 25971 - DNA, 20 bp, Artificial Sequence
  Synthetic
ggaaagccacatcaaccagc

SEQ ID NO: 25972 - DNA, 20 bp, Artificial Sequence
  Synthetic
gtgcgggaactggacttggg

SEQ ID NO: 25973 - DNA, 22 bp, Artificial Sequence
  Synthetic
atgttgggaatgatggaaccca

SEQ ID NO: 25974 - DNA, 20 bp, Artificial Sequence
  Synthetic
tggaaactcttgcagcaggg

SEQ ID NO: 25975 - DNA, 21 bp, Artificial Sequence
  Synthetic
gcggaggcaggattggaagaa

SEQ ID NO: 25976 - DNA, 20 bp, Artificial Sequence
  Synthetic
tccgcacatgtggaaaagct

SEQ ID NO: 25977 - DNA, 25 bp, Artificial Sequence
  Synthetic
atcctgtaaatacgtcactaggacc

SEQ ID NO: 25978 - DNA, 20 bp, Artificial Sequence
  Synthetic
actgggttagtatgcccgtg

SEQ ID NO: 25979 - DNA, 23 bp, Artificial Sequence
  Synthetic
aatgacggaaggtgtaaaaaccc

SEQ ID NO: 25980 - DNA, 23 bp, Artificial Sequence
  Synthetic
agtctggcggaggagcaattata

SEQ ID NO: 25981 - DNA, 24 bp, Artificial Sequence
  Synthetic
agttcaagtttggatagtgttggt

SEQ ID NO: 25982 - DNA, 20 bp, Artificial Sequence
  Synthetic
caatgggcgttgctgtggta

SEQ ID NO: 25983 - DNA, 25 bp, Artificial Sequence
  Synthetic
aatgacagcaatgaaagatggatga

SEQ ID NO: 25984 - DNA, 20 bp, Artificial Sequence
  Synthetic
tgatgatgctacagcggctg

SEQ ID NO: 25985 - DNA, 21 bp, Artificial Sequence
  Synthetic
acagaagctggctccatggta

SEQ ID NO: 25986 - DNA, 22 bp, Artificial Sequence
  Synthetic
aaggtatacacagggcctctag

SEQ ID NO: 25987 - DNA, 20 bp, Artificial Sequence
  Synthetic
tccagagcttgaagatgccg

SEQ ID NO: 25988 - DNA, 23 bp, Artificial Sequence
  Synthetic
cactccaaagaacaaccacaacc

SEQ ID NO: 25989 - DNA, 22 bp, Artificial Sequence
  Synthetic
aaagacaaggtttgacccctct

SEQ ID NO: 25990 - DNA, 22 bp, Artificial Sequence
  Synthetic
cctctcaaaacaggtcctgaca

SEQ ID NO: 25991 - DNA, 21 bp, Artificial Sequence
  Synthetic
tctactaccatggtccagccg

SEQ ID NO: 25992 - DNA, 25 bp, Artificial Sequence
  Synthetic
tatcagtgaatctgctggttacact

SEQ ID NO: 25993 - DNA, 25 bp, Artificial Sequence
  Synthetic
ccacatatgaatctagtcatctggg

SEQ ID NO: 25994 - DNA, 25 bp, Artificial Sequence
  Synthetic
aagcagagagaaaaacaacaacaca

SEQ ID NO: 25995 - DNA, 24 bp, Artificial Sequence
  Synthetic
tgtcattggtaccatagcactagg

SEQ ID NO: 25996 - DNA, 25 bp, Artificial Sequence
  Synthetic
aagggaactgtgatagatgttgatt

SEQ ID NO: 25997 - DNA, 23 bp, Artificial Sequence
  Synthetic
ttgacctataccaattgcggttt

SEQ ID NO: 25998 - DNA, 22 bp, Artificial Sequence
  Synthetic
aacctataaggcaacagcatcc

SEQ ID NO: 25999 - DNA, 25 bp, Artificial Sequence
  Synthetic
tctcattattacctggaccaagtct

SEQ ID NO: 26000 - DNA, 24 bp, Artificial Sequence
  Synthetic
acaaggggttatcagttatgctcc

SEQ ID NO: 26001 - DNA, 20 bp, Artificial Sequence
  Synthetic
gtggcttaacaactccgctc

SEQ ID NO: 26002 - DNA, 25 bp, Artificial Sequence
  Synthetic
ccaacctgcaaataggatcattaga

SEQ ID NO: 26003 - DNA, 25 bp, Artificial Sequence
  Synthetic
tcaacatgctaagactcaagaatgt

SEQ ID NO: 26004 - DNA, 25 bp, Artificial Sequence
  Synthetic
agagttactcagactggatatccca

SEQ ID NO: 26005 - DNA, 25 bp, Artificial Sequence
  Synthetic
gaattatgggagcttatcgactctt

SEQ ID NO: 26006 - DNA, 25 bp, Artificial Sequence
  Synthetic
tggtaaagggagaaattgacctact

SEQ ID NO: 26007 - DNA, 22 bp, Artificial Sequence
  Synthetic
gtgacatccagagttcctgtca

SEQ ID NO: 26008 - DNA, 25 bp, Artificial Sequence
  Synthetic
ttgtcagaaatataggtgatccagc

SEQ ID NO: 26009 - DNA, 22 bp, Artificial Sequence
  Synthetic
agaaactccagacccgttagaa

SEQ ID NO: 26010 - DNA, 24 bp, Artificial Sequence
  Synthetic
ttgaagttactcacccctgtatcg

SEQ ID NO: 26011 - DNA, 22 bp, Artificial Sequence
  Synthetic
aaagacacatcacatgcagtcc

SEQ ID NO: 26012 - DNA, 25 bp, Artificial Sequence
  Synthetic
ctgctgaggttcaacacaatatacc

SEQ ID NO: 26013 - DNA, 20 bp, Artificial Sequence
  Synthetic
atctcggagaaggtgcaggt

SEQ ID NO: 26014 - DNA, 20 bp, Artificial Sequence
  Synthetic
ccatacagccatgggacagg

SEQ ID NO: 26015 - DNA, 21 bp, Artificial Sequence
  Synthetic
gtcgtcagacctatgactgga

SEQ ID NO: 26016 - DNA, 25 bp, Artificial Sequence
  Synthetic
aaatggtcacacaacgaacaatagg

SEQ ID NO: 26017 - DNA, 25 bp, Artificial Sequence
  Synthetic
atgactaattcacaagacacagagc

SEQ ID NO: 26018 - DNA, 20 bp, Artificial Sequence
  Synthetic
gcatgaagctccgaacacaa

SEQ ID NO: 26019 - DNA, 21 bp, Artificial Sequence
  Synthetic
ccaatcctctgatgacttcgc

SEQ ID NO: 26020 - DNA, 22 bp, Artificial Sequence
  Synthetic
atgagcattggggtaacagtga

SEQ ID NO: 26021 - DNA, 24 bp, Artificial Sequence
  Synthetic
gtaatcccctgaatccatttgtca

SEQ ID NO: 26022 - DNA, 20 bp, Artificial Sequence
  Synthetic
tcgtacaggagaccagttgg

SEQ ID NO: 26023 - DNA, 21 bp, Artificial Sequence
  Synthetic
aggactacgaggtggactttg

SEQ ID NO: 26024 - DNA, 21 bp, Artificial Sequence
  Synthetic
atacggtgccatgcatgcagc

SEQ ID NO: 26025 - DNA, 22 bp, Artificial Sequence
  Synthetic
ttgttgaacaagcacagcaggc

SEQ ID NO: 26026 - DNA, 25 bp, Artificial Sequence
  Synthetic
agtgataagtcaatatgtggggact

SEQ ID NO: 26027 - DNA, 22 bp, Artificial Sequence
  Synthetic
ccaccaaagattagaagcgcac

SEQ ID NO: 26028 - DNA, 21 bp, Artificial Sequence
  Synthetic
ccttcttggccagtaactgcc

SEQ ID NO: 26029 - DNA, 25 bp, Artificial Sequence
  Synthetic
tgagcctactaaattttctgggagg

SEQ ID NO: 26030 - DNA, 21 bp, Artificial Sequence
  Synthetic
gcaacaagcttgaggaccaaa

SEQ ID NO: 26031 - DNA, 20 bp, Artificial Sequence
  Synthetic
tgtggaatacgcagccacaa

SEQ ID NO: 26032 - DNA, 24 bp, Artificial Sequence
  Synthetic
acatgcaagtgttgtggtatatgg

SEQ ID NO: 26033 - DNA, 22 bp, Artificial Sequence
  Synthetic
gtggatattggccctgtgtccc

SEQ ID NO: 26034 - DNA, 20 bp, Artificial Sequence
  Synthetic
accttgccggccatgtcatt

SEQ ID NO: 26035 - DNA, 22 bp, Artificial Sequence
  Synthetic
atgctgaccctgaggtgttgga

SEQ ID NO: 26036 - DNA, 23 bp, Artificial Sequence
  Synthetic
cgtcgtaaacgtgtaccctattc

SEQ ID NO: 26037 - DNA, 20 bp, Artificial Sequence
  Synthetic
tatccccaaggtgtctggct

SEQ ID NO: 26038 - DNA, 23 bp, Artificial Sequence
  Synthetic
gtttacgcagggaacaaatgttt

SEQ ID NO: 26039 - DNA, 25 bp, Artificial Sequence
  Synthetic
aattgtttgtaaccgttgtggatac

SEQ ID NO: 26040 - DNA, 20 bp, Artificial Sequence
  Synthetic
gcccaaggaggatcgctatg

SEQ ID NO: 26041 - DNA, 25 bp, Artificial Sequence
  Synthetic
gttgttttgtattgtgctgtactgg

SEQ ID NO: 26042 - DNA, 22 bp, Artificial Sequence
  Synthetic
gttccttgtgttcgggtagcca

SEQ ID NO: 26043 - DNA, 24 bp, Artificial Sequence
  Synthetic
tttgtgctgactactttcccttaa

SEQ ID NO: 26044 - DNA, 23 bp, Artificial Sequence
  Synthetic
aacatgtttacaaggtgggacgt

SEQ ID NO: 26045 - DNA, 21 bp, Artificial Sequence
  Synthetic
acctccaacaaagcctgaaga

SEQ ID NO: 26046 - DNA, 21 bp, Artificial Sequence
  Synthetic
aacctgactcacgctcagggc

SEQ ID NO: 26047 - DNA, 20 bp, Artificial Sequence
  Synthetic
cgaccgcgccattccattgg

SEQ ID NO: 26048 - DNA, 22 bp, Artificial Sequence
  Synthetic
atcacccgaaaactagaggaca

SEQ ID NO: 26049 - DNA, 23 bp, Artificial Sequence
  Synthetic
agttggcctaactcaccaaaaac

SEQ ID NO: 26050 - DNA, 19 bp, Artificial Sequence
  Synthetic
tgcgtggtctccggtgcct

SEQ ID NO: 26051 - DNA, 22 bp, Artificial Sequence
  Synthetic
tgggtgggtgtacgtaggttcc

SEQ ID NO: 26052 - DNA, 21 bp, Artificial Sequence
  Synthetic
gagatgctgctgtgtgaggca

SEQ ID NO: 26053 - DNA, 22 bp, Artificial Sequence
  Synthetic
tggaagcctgctcagggatttc

SEQ ID NO: 26054 - DNA, 19 bp, Artificial Sequence
  Synthetic
acgtgggctgggcggatct

SEQ ID NO: 26055 - DNA, 22 bp, Artificial Sequence
  Synthetic
tctcccggattcactgccatct

SEQ ID NO: 26056 - DNA, 22 bp, Artificial Sequence
  Synthetic
ctcttcgcctacgcacaagtgg

SEQ ID NO: 26057 - DNA, 19 bp, Artificial Sequence
  Synthetic
accagtgtcgccagtgcct

SEQ ID NO: 26058 - DNA, 21 bp, Artificial Sequence
  Synthetic
ccgagctcgggactctggtac

SEQ ID NO: 26059 - DNA, 20 bp, Artificial Sequence
  Synthetic
actggatgtgggcaaaggat

SEQ ID NO: 26060 - DNA, 20 bp, Artificial Sequence
  Synthetic
tggcgatctgggagttggcg

SEQ ID NO: 26061 - DNA, 20 bp, Artificial Sequence
  Synthetic
tagaggctgccgatgcctga

SEQ ID NO: 26062 - DNA, 21 bp, Artificial Sequence
  Synthetic
atgggagaggcaccactctgt

SEQ ID NO: 26063 - DNA, 19 bp, Artificial Sequence
  Synthetic
gcaatgccagcgcggggta

SEQ ID NO: 26064 - DNA, 19 bp, Artificial Sequence
  Synthetic
tcgggcgaagagcttccgg

SEQ ID NO: 26065 - DNA, 19 bp, Artificial Sequence
  Synthetic
cggacagtgtcgcgctgca

SEQ ID NO: 26066 - DNA, 19 bp, Artificial Sequence
  Synthetic
gcgctgggcggttgaggtt

SEQ ID NO: 26067 - DNA, 21 bp, Artificial Sequence
  Synthetic
ccctggctgaactcaccgaca

SEQ ID NO: 26068 - DNA, 20 bp, Artificial Sequence
  Synthetic
ggccaccatcccgtgacagg

SEQ ID NO: 26069 - DNA, 20 bp, Artificial Sequence
  Synthetic
ggtatccacacggagcaggc

SEQ ID NO: 26070 - DNA, 19 bp, Artificial Sequence
  Synthetic
ctccagcggcccaaaggga

SEQ ID NO: 26071 - DNA, 19 bp, Artificial Sequence
  Synthetic
accagccaccagacgagca

SEQ ID NO: 26072 - DNA, 20 bp, Artificial Sequence
  Synthetic
cggttgaaggagcccacgtt

SEQ ID NO: 26073 - DNA, 21 bp, Artificial Sequence
  Synthetic
cgtcgcctataccgcatctgc

SEQ ID NO: 26074 - DNA, 19 bp, Artificial Sequence
  Synthetic
agagacacaagcccccccg

SEQ ID NO: 26075 - DNA, 19 bp, Artificial Sequence
  Synthetic
cgcaccgtagcccgcgaaa

SEQ ID NO: 26076 - DNA, 19 bp, Artificial Sequence
  Synthetic
gcagcactacgtggcggga

SEQ ID NO: 26077 - DNA, 20 bp, Artificial Sequence
  Synthetic
aaaagctcagggcatccgcg

SEQ ID NO: 26078 - DNA, 22 bp, Artificial Sequence
  Synthetic
atcctgctgctcctgctcatcc

SEQ ID NO: 26079 - DNA, 22 bp, Artificial Sequence
  Synthetic
cggtggaggtaaaggtgttgcg

SEQ ID NO: 26080 - DNA, 22 bp, Artificial Sequence
  Synthetic
gtgtacctggggcacctcaacc

SEQ ID NO: 26081 - DNA, 22 bp, Artificial Sequence
  Synthetic
atctggatcccttgacctcggc

SEQ ID NO: 26082 - DNA, 20 bp, Artificial Sequence
  Synthetic
ttccttgcaggcgaagaggc

SEQ ID NO: 26083 - DNA, 19 bp, Artificial Sequence
  Synthetic
gacgagtgcagcaccaggt

SEQ ID NO: 26084 - DNA, 18 bp, Artificial Sequence
  Synthetic
accgcgttgtcggagctg

SEQ ID NO: 26085 - DNA, 22 bp, Artificial Sequence
  Synthetic
agctagaggatttgcgattgct

SEQ ID NO: 26086 - DNA, 22 bp, Artificial Sequence
  Synthetic
agacgctgactctagtgtgccc

SEQ ID NO: 26087 - DNA, 20 bp, Artificial Sequence
  Synthetic
ccggtggaggatcaggagga

SEQ ID NO: 26088 - DNA, 25 bp, Artificial Sequence
  Synthetic
atggattgttagacagacgttggta

SEQ ID NO: 26089 - DNA, 22 bp, Artificial Sequence
  Synthetic
agtgttctatggacctgcagac

SEQ ID NO: 26090 - DNA, 25 bp, Artificial Sequence
  Synthetic
gaggaggacagatggaaatatttgc

SEQ ID NO: 26091 - DNA, 22 bp, Artificial Sequence
  Synthetic
aggccatagaggtacagctggc

SEQ ID NO: 26092 - DNA, 21 bp, Artificial Sequence
  Synthetic
gtatccccagtcccagcccca

SEQ ID NO: 26093 - DNA, 24 bp, Artificial Sequence
  Synthetic
gatagcattgccagggtatatgtc

SEQ ID NO: 26094 - DNA, 20 bp, Artificial Sequence
  Synthetic
cacacctaacacccccactt

SEQ ID NO: 26095 - DNA, 22 bp, Artificial Sequence
  Synthetic
gccgtcttggatatcaccccct

SEQ ID NO: 26096 - DNA, 20 bp, Artificial Sequence
  Synthetic
ttgatgagttacccgccgcc

SEQ ID NO: 26097 - DNA, 22 bp, Artificial Sequence
  Synthetic
atgtctatgtcacgcggactaa

SEQ ID NO: 26098 - DNA, 25 bp, Artificial Sequence
  Synthetic
atcctgattatctgaagatggctgc

SEQ ID NO: 26099 - DNA, 22 bp, Artificial Sequence
  Synthetic
atggatccccagttgttagagg

SEQ ID NO: 26100 - DNA, 20 bp, Artificial Sequence
  Synthetic
cttgtgtgtagcccccagtt

SEQ ID NO: 26101 - DNA, 25 bp, Artificial Sequence
  Synthetic
ccttcaattggcagatctaaaacga

SEQ ID NO: 26102 - DNA, 20 bp, Artificial Sequence
  Synthetic
gccagggtgtgtaaggagtt

SEQ ID NO: 26103 - DNA, 20 bp, Artificial Sequence
  Synthetic
tgcatgttggcagttcatgg

SEQ ID NO: 26104 - DNA, 25 bp, Artificial Sequence
  Synthetic
agcaaaacaagctataatgatggcc

SEQ ID NO: 26105 - DNA, 21 bp, Artificial Sequence
  Synthetic
gacgagggggaagtcgaagga

SEQ ID NO: 26106 - DNA, 20 bp, Artificial Sequence
  Synthetic
tggcatagggacaggcaaag

SEQ ID NO: 26107 - DNA, 25 bp, Artificial Sequence
  Synthetic
gtagtggtagtaatactcctgcagt

SEQ ID NO: 26108 - DNA, 25 bp, Artificial Sequence
  Synthetic
aactagaaagaccaaggttctctga

SEQ ID NO: 26109 - DNA, 25 bp, Artificial Sequence
  Synthetic
attaccagcaataataacaccaggc

SEQ ID NO: 26110 - DNA, 24 bp, Artificial Sequence
  Synthetic
gtagtgatcgccttctaacagttg

SEQ ID NO: 26111 - DNA, 24 bp, Artificial Sequence
  Synthetic
tttcagggtagtactgatagcaga

SEQ ID NO: 26112 - DNA, 23 bp, Artificial Sequence
  Synthetic
gtttacagcacgataggtcctca

SEQ ID NO: 26113 - DNA, 25 bp, Artificial Sequence
  Synthetic
gtttactttcctactcctagtggct

SEQ ID NO: 26114 - DNA, 25 bp, Artificial Sequence
  Synthetic
attgtctcagacatctcttggaagg

SEQ ID NO: 26115 - DNA, 22 bp, Artificial Sequence
  Synthetic
gtgtgttactgactcacagggt

SEQ ID NO: 26116 - DNA, 25 bp, Artificial Sequence
  Synthetic
ggatactttagagcgccttgtacag

SEQ ID NO: 26117 - DNA, 25 bp, Artificial Sequence
  Synthetic
tagacgatgatgtggatgaagttga

SEQ ID NO: 26118 - DNA, 20 bp, Artificial Sequence
  Synthetic
gagccgagctctgaaaccaa

SEQ ID NO: 26119 - DNA, 25 bp, Artificial Sequence
  Synthetic
agcagactcatttgatctatcacaa

SEQ ID NO: 26120 - DNA, 22 bp, Artificial Sequence
  Synthetic
actgctgcagaagttggaagca

SEQ ID NO: 26121 - DNA, 24 bp, Artificial Sequence
  Synthetic
aaaagggtgtacgtattgctttgg

SEQ ID NO: 26122 - DNA, 20 bp, Artificial Sequence
  Synthetic
tgggcttggcattggaacag

SEQ ID NO: 26123 - DNA, 21 bp, Artificial Sequence
  Synthetic
tatcagaggtcacaggggttg

SEQ ID NO: 26124 - DNA, 25 bp, Artificial Sequence
  Synthetic
actcatgtgggttatacagaagaca

SEQ ID NO: 26125 - DNA, 22 bp, Artificial Sequence
  Synthetic
atgatttggcagagattgggga

SEQ ID NO: 26126 - DNA, 24 bp, Artificial Sequence
  Synthetic
cctgatggagttctggtagatgac

SEQ ID NO: 26127 - DNA, 24 bp, Artificial Sequence
  Synthetic
ttaagcacagaccaaaataccgtt

SEQ ID NO: 26128 - DNA, 25 bp, Artificial Sequence
  Synthetic
atggattaatcagtgaccaaaagga

SEQ ID NO: 26129 - DNA, 23 bp, Artificial Sequence
  Synthetic
ttgactagcagcgaatcaaacat

SEQ ID NO: 26130 - DNA, 22 bp, Artificial Sequence
  Synthetic
tctgcatttttgttaccccacc

SEQ ID NO: 26131 - DNA, 25 bp, Artificial Sequence
  Synthetic
atcactatatgtgtcagcctcattg

SEQ ID NO: 26132 - DNA, 25 bp, Artificial Sequence
  Synthetic
actcagctcccttgataataagaga

SEQ ID NO: 26133 - DNA, 25 bp, Artificial Sequence
  Synthetic
aatggacatatatcggagttgatgg

SEQ ID NO: 26134 - DNA, 20 bp, Artificial Sequence
  Synthetic
cactgaagagtgcacatgcg

SEQ ID NO: 26135 - DNA, 22 bp, Artificial Sequence
  Synthetic
ggcatcaaaggaggattcgtcc

SEQ ID NO: 26136 - DNA, 23 bp, Artificial Sequence
  Synthetic
acagccatttactgtttgatggg

SEQ ID NO: 26137 - DNA, 25 bp, Artificial Sequence
  Synthetic
aacagatatacatgtaaccgcttgc

SEQ ID NO: 26138 - DNA, 21 bp, Artificial Sequence
  Synthetic
attgacctgcaatgctacgag

SEQ ID NO: 26139 - DNA, 23 bp, Artificial Sequence
  Synthetic
gtgtcgtgaagaaattcggaatg

SEQ ID NO: 26140 - DNA, 25 bp, Artificial Sequence
  Synthetic
cggagcaagtacaaaagttaaaacg

SEQ ID NO: 26141 - DNA, 22 bp, Artificial Sequence
  Synthetic
acaatgggcctatgatagcgat

SEQ ID NO: 26142 - DNA, 22 bp, Artificial Sequence
  Synthetic
aattagagctcagtgacccaga

SEQ ID NO: 26143 - DNA, 22 bp, Artificial Sequence
  Synthetic
tggcagtatctgaaaccaaagc

SEQ ID NO: 26144 - DNA, 22 bp, Artificial Sequence
  Synthetic
gttaccttcgctgatgatgctg

SEQ ID NO: 26145 - DNA, 20 bp, Artificial Sequence
  Synthetic
caccagcaccacagcaacca

SEQ ID NO: 26146 - DNA, 22 bp, Artificial Sequence
  Synthetic
caacctccagagattccagccc

SEQ ID NO: 26147 - DNA, 24 bp, Artificial Sequence
  Synthetic
gatcctccagtaatacttttgcga

SEQ ID NO: 26148 - DNA, 22 bp, Artificial Sequence
  Synthetic
tagaggaacctacaccaccaag

SEQ ID NO: 26149 - DNA, 22 bp, Artificial Sequence
  Synthetic
gctgtagaagaacctccagaca

SEQ ID NO: 26150 - DNA, 22 bp, Artificial Sequence
  Synthetic
gatgctactattgtccaaggcc

SEQ ID NO: 26151 - DNA, 25 bp, Artificial Sequence
  Synthetic
atcctgaacgaaggaattatccaga

SEQ ID NO: 26152 - DNA, 24 bp, Artificial Sequence
  Synthetic
acattcagaggacagacatctact

SEQ ID NO: 26153 - DNA, 25 bp, Artificial Sequence
  Synthetic
acaacaggacatccattgtttaaca

SEQ ID NO: 26154 - DNA, 22 bp, Artificial Sequence
  Synthetic
attacctgcagcaagtcaacag

SEQ ID NO: 26155 - DNA, 25 bp, Artificial Sequence
  Synthetic
cagaaaaactgtctttggatttgga

SEQ ID NO: 26156 - DNA, 24 bp, Artificial Sequence
  Synthetic
tttcagtgtgattttcaatcggct

SEQ ID NO: 26157 - DNA, 25 bp, Artificial Sequence
  Synthetic
tttcctgggaaaataaaagtggtgc

SEQ ID NO: 26158 - DNA, 25 bp, Artificial Sequence
  Synthetic
gctggtacaacaattctatttctgc

SEQ ID NO: 26159 - DNA, 25 bp, Artificial Sequence
  Synthetic
attgtcaccttatagagttgacagc

SEQ ID NO: 26160 - DNA, 21 bp, Artificial Sequence
  Synthetic
tgctcttagtcctcgtttgga

SEQ ID NO: 26161 - DNA, 21 bp, Artificial Sequence
  Synthetic
atctgaacagtggacgtttgc

SEQ ID NO: 26162 - DNA, 25 bp, Artificial Sequence
  Synthetic
tgacaatgaacaaattttgcccttt

SEQ ID NO: 26163 - DNA, 21 bp, Artificial Sequence
  Synthetic
cacaccactgagcctagtttg

SEQ ID NO: 26164 - DNA, 22 bp, Artificial Sequence
  Synthetic
atcccgcctttgatgctgatgt

SEQ ID NO: 26165 - DNA, 24 bp, Artificial Sequence
  Synthetic
tctcagttcattaccaatgcttca

SEQ ID NO: 26166 - DNA, 24 bp, Artificial Sequence
  Synthetic
atacattcgcctatacaagatggc

SEQ ID NO: 26167 - DNA, 23 bp, Artificial Sequence
  Synthetic
aggatgtgaatggtgatcacaga

SEQ ID NO: 26168 - DNA, 20 bp, Artificial Sequence
  Synthetic
tcaacagaagccacctgcag

SEQ ID NO: 26169 - DNA, 23 bp, Artificial Sequence
  Synthetic
tttcagcaactattggtttccga

SEQ ID NO: 26170 - DNA, 23 bp, Artificial Sequence
  Synthetic
atgcccaagttacagaggattca

SEQ ID NO: 26171 - DNA, 24 bp, Artificial Sequence
  Synthetic
tctaacaatgcggtggttgaaaat

SEQ ID NO: 26172 - DNA, 25 bp, Artificial Sequence
  Synthetic
gaactttcaaagatggtacaatggg

SEQ ID NO: 26173 - DNA, 21 bp, Artificial Sequence
  Synthetic
cttccgcgacatggtttatcg

SEQ ID NO: 26174 - DNA, 22 bp, Artificial Sequence
  Synthetic
tggtggaggaacagtttctagg

SEQ ID NO: 26175 - DNA, 25 bp, Artificial Sequence
  Synthetic
tgagcatcctgcagtaataaatgtt

SEQ ID NO: 26176 - DNA, 22 bp, Artificial Sequence
  Synthetic
ttttacagtgagaccgaaagcg

SEQ ID NO: 26177 - DNA, 25 bp, Artificial Sequence
  Synthetic
ttaccagaacaaaatgaaaacaggg

SEQ ID NO: 26178 - DNA, 23 bp, Artificial Sequence
  Synthetic
agatgctgtttgtaaatggcctg

SEQ ID NO: 26179 - DNA, 24 bp, Artificial Sequence
  Synthetic
tcgcatataaatgtgatgaaccca

SEQ ID NO: 26180 - DNA, 22 bp, Artificial Sequence
  Synthetic
ggtcaaattccttttccccacc

SEQ ID NO: 26181 - DNA, 20 bp, Artificial Sequence
  Synthetic
cgcttttgttgctggctgtc

SEQ ID NO: 26182 - DNA, 20 bp, Artificial Sequence
  Synthetic
tagagggcattggagagggt

SEQ ID NO: 26183 - DNA, 25 bp, Artificial Sequence
  Synthetic
gctcgaagaattatcattcgtttgc

SEQ ID NO: 26184 - DNA, 23 bp, Artificial Sequence
  Synthetic
gtagtgagctgggtaaagatggc

SEQ ID NO: 26185 - DNA, 25 bp, Artificial Sequence
  Synthetic
tggtacagtgggcatatgataatga

SEQ ID NO: 26186 - DNA, 22 bp, Artificial Sequence
  Synthetic
ggcccagcagaaagttccatcc

SEQ ID NO: 26187 - DNA, 21 bp, Artificial Sequence
  Synthetic
aaaaggtcctgcaaatcccct

SEQ ID NO: 26188 - DNA, 21 bp, Artificial Sequence
  Synthetic
acgcgtattacctgaagggac

SEQ ID NO: 26189 - DNA, 23 bp, Artificial Sequence
  Synthetic
atatatctcctgcacaaccagcc

SEQ ID NO: 26190 - DNA, 20 bp, Artificial Sequence
  Synthetic
cagtgccacggctaacacaa

SEQ ID NO: 26191 - DNA, 23 bp, Artificial Sequence
  Synthetic
accttcattaggggaacattggg

SEQ ID NO: 26192 - DNA, 25 bp, Artificial Sequence
  Synthetic
tacggtgaccaggtatttttctttg

SEQ ID NO: 26193 - DNA, 22 bp, Artificial Sequence
  Synthetic
tcaaactggtttactggagcgt

SEQ ID NO: 26194 - DNA, 20 bp, Artificial Sequence
  Synthetic
atccggacctcatgccagat

SEQ ID NO: 26195 - DNA, 22 bp, Artificial Sequence
  Synthetic
tgactgactcaaacgttcttgg

SEQ ID NO: 26196 - DNA, 20 bp, Artificial Sequence
  Synthetic
gatcgccagaatgcaactga

SEQ ID NO: 26197 - DNA, 22 bp, Artificial Sequence
  Synthetic
tcagttgctcacaaatcttgcc

SEQ ID NO: 26198 - DNA, 20 bp, Artificial Sequence
  Synthetic
aaaagtatctccgcggggga

SEQ ID NO: 26199 - DNA, 22 bp, Artificial Sequence
  Synthetic
aatacggagggaaggacttcag

SEQ ID NO: 26200 - DNA, 23 bp, Artificial Sequence
  Synthetic
aatttgaaaatacaggcgagcgc

SEQ ID NO: 26201 - DNA, 23 bp, Artificial Sequence
  Synthetic
gagcaattgaacagctcagagga

SEQ ID NO: 26202 - DNA, 25 bp, Artificial Sequence
  Synthetic
aaaacgaaagtatttaggcagtccg

SEQ ID NO: 26203 - DNA, 20 bp, Artificial Sequence
  Synthetic
acgccaccacagcaaataca

SEQ ID NO: 26204 - DNA, 22 bp, Artificial Sequence
  Synthetic
aacagatgacagtgacattgca

SEQ ID NO: 26205 - DNA, 22 bp, Artificial Sequence
  Synthetic
ttttacgaggcacaccaaaaca

SEQ ID NO: 26206 - DNA, 22 bp, Artificial Sequence
  Synthetic
attgtcccgactctgtgtctag

SEQ ID NO: 26207 - DNA, 20 bp, Artificial Sequence
  Synthetic
tttgtgtgcctgtgtgtctg

SEQ ID NO: 26208 - DNA, 20 bp, Artificial Sequence
  Synthetic
gtgtactatggtcgcccacc

SEQ ID NO: 26209 - DNA, 21 bp, Artificial Sequence
  Synthetic
tccacaaactggggaggtatc

SEQ ID NO: 26210 - DNA, 22 bp, Artificial Sequence
  Synthetic
ttgtggctttacacagacctgc

SEQ ID NO: 26211 - DNA, 25 bp, Artificial Sequence
  Synthetic
aacatgttccctattttcttgcaga

SEQ ID NO: 26212 - DNA, 22 bp, Artificial Sequence
  Synthetic
ttcccaaggtgtctgcatttca

SEQ ID NO: 26213 - DNA, 25 bp, Artificial Sequence
  Synthetic
catgactatatctgcaaccacacaa

SEQ ID NO: 26214 - DNA, 24 bp, Artificial Sequence
  Synthetic
aaaagccttgctataacctgtcaa

SEQ ID NO: 26215 - DNA, 20 bp, Artificial Sequence
  Synthetic
cggcggtgattgtttgtgtc

SEQ ID NO: 26216 - DNA, 20 bp, Artificial Sequence
  Synthetic
tggttgttgcacaccactgt

SEQ ID NO: 26217 - DNA, 23 bp, Artificial Sequence
  Synthetic
tgcaaacatctgcaacacaatga

SEQ ID NO: 26218 - DNA, 20 bp, Artificial Sequence
  Synthetic
aacggccatacaagctacca

SEQ ID NO: 26219 - DNA, 25 bp, Artificial Sequence
  Synthetic
ctcagaggatgaggatgaaacagac

SEQ ID NO: 26220 - DNA, 20 bp, Artificial Sequence
  Synthetic
ggaggtgttcgggatggttt

SEQ ID NO: 26221 - DNA, 25 bp, Artificial Sequence
  Synthetic
aatggtacagtgggcatttgataat

SEQ ID NO: 26222 - DNA, 25 bp, Artificial Sequence
  Synthetic
aatgcattagatggcaatcctatgt

SEQ ID NO: 26223 - DNA, 24 bp, Artificial Sequence
  Synthetic
acaaagacgtggtcaaaactagat

SEQ ID NO: 26224 - DNA, 24 bp, Artificial Sequence
  Synthetic
tccaaagggcataatgcaattgaa

SEQ ID NO: 26225 - DNA, 25 bp, Artificial Sequence
  Synthetic
atggtagcattggggtattttttgg

SEQ ID NO: 26226 - DNA, 23 bp, Artificial Sequence
  Synthetic
aacaacatctgtggacagtacac

SEQ ID NO: 26227 - DNA, 23 bp, Artificial Sequence
  Synthetic
gctagaaaaactggcatacgtgt

SEQ ID NO: 26228 - DNA, 24 bp, Artificial Sequence
  Synthetic
gacctactgaggcaaaggtatacc

SEQ ID NO: 26229 - DNA, 20 bp, Artificial Sequence
  Synthetic
gcacaccatgtggtacccaa

SEQ ID NO: 26230 - DNA, 23 bp, Artificial Sequence
  Synthetic
aggtactgtaggcgatgctattc

SEQ ID NO: 26231 - DNA, 23 bp, Artificial Sequence
  Synthetic
aacatgttttggtctgtttgtgc

SEQ ID NO: 26232 - DNA, 24 bp, Artificial Sequence
  Synthetic
aagaacgttactgttacacatgcc

SEQ ID NO: 26233 - DNA, 21 bp, Artificial Sequence
  Synthetic
gttacccaggggatttcaacg

SEQ ID NO: 26234 - DNA, 20 bp, Artificial Sequence
  Synthetic
gatgcggcagagcagacaaa

SEQ ID NO: 26235 - DNA, 25 bp, Artificial Sequence
  Synthetic
agtgaattggaatatggtaactgca

SEQ ID NO: 26236 - DNA, 22 bp, Artificial Sequence
  Synthetic
ggtaccaccatagcaatgagca

SEQ ID NO: 26237 - DNA, 25 bp, Artificial Sequence
  Synthetic
ttcatgactcaaatgtcaagaacct

SEQ ID NO: 26238 - DNA, 25 bp, Artificial Sequence
  Synthetic
actgtcaatttattcaacagtggcg

SEQ ID NO: 26239 - DNA, 20 bp, Artificial Sequence
  Synthetic
gagaacgccagaatgccact

SEQ ID NO: 26240 - DNA, 24 bp, Artificial Sequence
  Synthetic
taaacggaaagtggatgagagaac

SEQ ID NO: 26241 - DNA, 21 bp, Artificial Sequence
  Synthetic
ggtcaggatgatcaaacgtgg

SEQ ID NO: 26242 - DNA, 24 bp, Artificial Sequence
  Synthetic
ggaagctttccactagaggagttc

SEQ ID NO: 26243 - DNA, 20 bp, Artificial Sequence
  Synthetic
cagcaggacgagcaagcttt

SEQ ID NO: 26244 - DNA, 20 bp, Artificial Sequence
  Synthetic
agttgcgtgtatcgtcccaa

SEQ ID NO: 26245 - DNA, 25 bp, Artificial Sequence
  Synthetic
ttcagttttatgctgcaaaatgtcg

SEQ ID NO: 26246 - DNA, 25 bp, Artificial Sequence
  Synthetic
agggctaatagatgatgcaacattt

SEQ ID NO: 26247 - DNA, 20 bp, Artificial Sequence
  Synthetic
accgtttcgatgctgtgcaa

SEQ ID NO: 26248 - DNA, 25 bp, Artificial Sequence
  Synthetic
acgttatggaccgctatttattacc

SEQ ID NO: 26249 - DNA, 20 bp, Artificial Sequence
  Synthetic
aagacgaggctagggatccg

SEQ ID NO: 26250 - DNA, 20 bp, Artificial Sequence
  Synthetic
gctggtgctgaggtgtttgt

SEQ ID NO: 26251 - DNA, 23 bp, Artificial Sequence
  Synthetic
gcatctgctaacattaatggcag

SEQ ID NO: 26252 - DNA, 22 bp, Artificial Sequence
  Synthetic
atttgcatccaagtcacagacg

SEQ ID NO: 26253 - DNA, 22 bp, Artificial Sequence
  Synthetic
caccccttgtaaaggtgaacac

SEQ ID NO: 26254 - DNA, 23 bp, Artificial Sequence
  Synthetic
gtccttagcatctagtgactccc

SEQ ID NO: 26255 - DNA, 25 bp, Artificial Sequence
  Synthetic
ttttgggtggttgatttatcagaca

SEQ ID NO: 26256 - DNA, 25 bp, Artificial Sequence
  Synthetic
gtattactcatgtgttttgcaacgt

SEQ ID NO: 26257 - DNA, 20 bp, Artificial Sequence
  Synthetic
cttgaagcagtagtccttct

SEQ ID NO: 26258 - DNA, 25 bp, Artificial Sequence
  Synthetic
catatctataagcaataattggctc

SEQ ID NO: 26259 - DNA, 18 bp, Artificial Sequence
  Synthetic
tccaaacatacaggggtg

SEQ ID NO: 26260 - DNA, 23 bp, Artificial Sequence
  Synthetic
aaatgtatagcttctttggactt

SEQ ID NO: 26261 - DNA, 18 bp, Artificial Sequence
  Synthetic
ccggtggtgctactagcg

SEQ ID NO: 26262 - DNA, 20 bp, Artificial Sequence
  Synthetic
gcttcagcttcaagtcttgc

SEQ ID NO: 26263 - DNA, 23 bp, Artificial Sequence
  Synthetic
ttataatgagtccaaatgtccat

SEQ ID NO: 26264 - DNA, 19 bp, Artificial Sequence
  Synthetic
ataaaattggcgggctctg

SEQ ID NO: 26265 - DNA, 22 bp, Artificial Sequence
  Synthetic
tcctagcctacttaatcgaatt

SEQ ID NO: 26266 - DNA, 25 bp, Artificial Sequence
  Synthetic
gtcaaaagactcattatatggatct

SEQ ID NO: 26267 - DNA, 21 bp, Artificial Sequence
  Synthetic
tgtaatcctcatcctgttgag

SEQ ID NO: 26268 - DNA, 23 bp, Artificial Sequence
  Synthetic
gcagccaatatggtctattaaat

SEQ ID NO: 26269 - DNA, 19 bp, Artificial Sequence
  Synthetic
ccgtaacataccggtttga

SEQ ID NO: 26270 - DNA, 18 bp, Artificial Sequence
  Synthetic
tttggcgcctttttagca

SEQ ID NO: 26271 - DNA, 22 bp, Artificial Sequence
  Synthetic
aggcagtactaattcttcaaga

SEQ ID NO: 26272 - DNA, 24 bp, Artificial Sequence
  Synthetic
ctacttgtaccttctaaactatca

SEQ ID NO: 26273 - DNA, 20 bp, Artificial Sequence
  Synthetic
agagcttattttcacagcct

SEQ ID NO: 26274 - DNA, 18 bp, Artificial Sequence
  Synthetic
cagttcctgcagtgcatc

SEQ ID NO: 26275 - DNA, 20 bp, Artificial Sequence
  Synthetic
tgtctcaggtgatgttgtgg

SEQ ID NO: 26276 - DNA, 21 bp, Artificial Sequence
  Synthetic
cgatatctccagcatttaagc

SEQ ID NO: 26277 - DNA, 18 bp, Artificial Sequence
  Synthetic
gaatgactgcagagccag

SEQ ID NO: 26278 - DNA, 18 bp, Artificial Sequence
  Synthetic
tgctaaacgtttcggtgg

SEQ ID NO: 26279 - DNA, 18 bp, Artificial Sequence
  Synthetic
atctctgaagcgggtgac

SEQ ID NO: 26280 - DNA, 19 bp, Artificial Sequence
  Synthetic
cgagtttgcattgttccac

SEQ ID NO: 26281 - DNA, 21 bp, Artificial Sequence
  Synthetic
cagatacagtttaccagttgg

SEQ ID NO: 26282 - DNA, 18 bp, Artificial Sequence
  Synthetic
gcgattcggatctggtag

SEQ ID NO: 26283 - DNA, 20 bp, Artificial Sequence
  Synthetic
acaaggctttgctatatccc

SEQ ID NO: 26284 - DNA, 18 bp, Artificial Sequence
  Synthetic
ttgttagtcccctgagca

SEQ ID NO: 26285 - DNA, 20 bp, Artificial Sequence
  Synthetic
cgggcatagagtgggttgat

SEQ ID NO: 26286 - DNA, 18 bp, Artificial Sequence
  Synthetic
tttggggatacgttggcg

SEQ ID NO: 26287 - DNA, 20 bp, Artificial Sequence
  Synthetic
tccctgttgcatagttgacc

SEQ ID NO: 26288 - DNA, 18 bp, Artificial Sequence
  Synthetic
aggtcaatatgcgtccgc

SEQ ID NO: 26289 - DNA, 17 bp, Artificial Sequence
  Synthetic
aacacaccccagtggcc

SEQ ID NO: 26290 - DNA, 18 bp, Artificial Sequence
  Synthetic
aatagggtcgctggtccg

SEQ ID NO: 26291 - DNA, 20 bp, Artificial Sequence
  Synthetic
cggatgtttcctgaagcagt

SEQ ID NO: 26292 - DNA, 20 bp, Artificial Sequence
  Synthetic
gtagataaggccggaagcgg

SEQ ID NO: 26293 - DNA, 19 bp, Artificial Sequence
  Synthetic
ctgcctcgtagatgccaag

SEQ ID NO: 26294 - DNA, 18 bp, Artificial Sequence
  Synthetic
tagcacagcagcacacac

SEQ ID NO: 26295 - DNA, 17 bp, Artificial Sequence
  Synthetic
tgtcgccacaagcagtg

SEQ ID NO: 26296 - DNA, 16 bp, Artificial Sequence
  Synthetic
gtgcccgctccgtgat

SEQ ID NO: 26297 - DNA, 18 bp, Artificial Sequence
  Synthetic
ctgctttggctacaccgc

SEQ ID NO: 26298 - DNA, 18 bp, Artificial Sequence
  Synthetic
acctgaacaacccccgtc

SEQ ID NO: 26299 - DNA, 20 bp, Artificial Sequence
  Synthetic
cccctatagtaagcaacggc

SEQ ID NO: 26300 - DNA, 18 bp, Artificial Sequence
  Synthetic
cgccactggacacgtatc

SEQ ID NO: 26301 - DNA, 18 bp, Artificial Sequence
  Synthetic
tgaacattccgccgatgg

SEQ ID NO: 26302 - DNA, 18 bp, Artificial Sequence
  Synthetic
ccgagaccacgaaagtcg

SEQ ID NO: 26303 - DNA, 18 bp, Artificial Sequence
  Synthetic
atttccacgggaggcgaa

SEQ ID NO: 26304 - DNA, 20 bp, Artificial Sequence
  Synthetic
cgcatcgatccgttcttgac

SEQ ID NO: 26305 - DNA, 18 bp, Artificial Sequence
  Synthetic
tgggttcaggggcgaatc

SEQ ID NO: 26306 - DNA, 16 bp, Artificial Sequence
  Synthetic
gtgccgtggaaaccgc

SEQ ID NO: 26307 - DNA, 20 bp, Artificial Sequence
  Synthetic
ggcaggatttacgcagaaga

SEQ ID NO: 26308 - DNA, 20 bp, Artificial Sequence
  Synthetic
ccacgtacaacctctcggta

SEQ ID NO: 26309 - DNA, 19 bp, Artificial Sequence
  Synthetic
gagtacctggtcattgccg

SEQ ID NO: 26310 - DNA, 17 bp, Artificial Sequence
  Synthetic
tgatccacgtccgcctc

SEQ ID NO: 26311 - DNA, 20 bp, Artificial Sequence
  Synthetic
taagcacctcataacgatgt

SEQ ID NO: 26312 - DNA, 21 bp, Artificial Sequence
  Synthetic
acttcttcaaccatttccatt

SEQ ID NO: 26313 - DNA, 21 bp, Artificial Sequence
  Synthetic
cacatcctgtaacatcagaaa

SEQ ID NO: 26314 - DNA, 19 bp, Artificial Sequence
  Synthetic
tattgttgtgttcagtgcc

SEQ ID NO: 26315 - DNA, 18 bp, Artificial Sequence
  Synthetic
tactgatccctcctggtg

SEQ ID NO: 26316 - DNA, 18 bp, Artificial Sequence
  Synthetic
atctcccctgtggcattt

SEQ ID NO: 26317 - DNA, 22 bp, Artificial Sequence
  Synthetic
caaatgtcctacaaagggattt

SEQ ID NO: 26318 - DNA, 18 bp, Artificial Sequence
  Synthetic
gtgggccatagcttcaag

SEQ ID NO: 26319 - DNA, 18 bp, Artificial Sequence
  Synthetic
cacagtgacattccgctc

SEQ ID NO: 26320 - DNA, 18 bp, Artificial Sequence
  Synthetic
atgtttcacgctgctgag

SEQ ID NO: 26321 - DNA, 20 bp, Artificial Sequence
  Synthetic
tctggtacaatgctctttgt

SEQ ID NO: 26322 - DNA, 22 bp, Artificial Sequence
  Synthetic
tgtatttattgctcccaaagga

SEQ ID NO: 26323 - DNA, 18 bp, Artificial Sequence
  Synthetic
ctgctgcataccctgatc

SEQ ID NO: 26324 - DNA, 21 bp, Artificial Sequence
  Synthetic
tgtgtgttatgatgtctctgg

SEQ ID NO: 26325 - DNA, 18 bp, Artificial Sequence
  Synthetic
actatctcctgtgctccg

SEQ ID NO: 26326 - DNA, 22 bp, Artificial Sequence
  Synthetic
tgtgctataccaaaatgaacaa

SEQ ID NO: 26327 - DNA, 20 bp, Artificial Sequence
  Synthetic
ttgagttgttcagcatatgc

SEQ ID NO: 26328 - DNA, 20 bp, Artificial Sequence
  Synthetic
ttcactttcctcattcctga

SEQ ID NO: 26329 - DNA, 18 bp, Artificial Sequence
  Synthetic
tttttccgggtggctagt

SEQ ID NO: 26330 - DNA, 18 bp, Artificial Sequence
  Synthetic
aaggacacattggcacat

SEQ ID NO: 26331 - DNA, 25 bp, Artificial Sequence
  Synthetic
ctactataaattgactttgtggctt

SEQ ID NO: 26332 - DNA, 24 bp, Artificial Sequence
  Synthetic
tgtctatgttgacagatattgtga

SEQ ID NO: 26333 - DNA, 21 bp, Artificial Sequence
  Synthetic
atgaatatgatggctgcaatt

SEQ ID NO: 26334 - DNA, 21 bp, Artificial Sequence
  Synthetic
tccaggttttttgtttggtat

SEQ ID NO: 26335 - DNA, 20 bp, Artificial Sequence
  Synthetic
tgtgataggtactcggatgt

SEQ ID NO: 26336 - DNA, 18 bp, Artificial Sequence
  Synthetic
gcactgcatgttgtttga

SEQ ID NO: 26337 - DNA, 22 bp, Artificial Sequence
  Synthetic
tcacaataggtaacaactgttt

SEQ ID NO: 26338 - DNA, 20 bp, Artificial Sequence
  Synthetic
actgttcattgtgtcacaaa

SEQ ID NO: 26339 - DNA, 22 bp, Artificial Sequence
  Synthetic
aaatccaatgatagatgggttg

SEQ ID NO: 26340 - DNA, 20 bp, Artificial Sequence
  Synthetic
tcttcattgtccctcagttt

SEQ ID NO: 26341 - DNA, 22 bp, Artificial Sequence
  Synthetic
cagctatcattttctctgctaa

SEQ ID NO: 26342 - DNA, 23 bp, Artificial Sequence
  Synthetic
ttctctgctttataaaagggtaa

SEQ ID NO: 26343 - DNA, 24 bp, Artificial Sequence
  Synthetic
ggctagtatcaaagtgataatttg

SEQ ID NO: 26344 - DNA, 18 bp, Artificial Sequence
  Synthetic
gtcgtcctggcaattccg

SEQ ID NO: 26345 - DNA, 20 bp, Artificial Sequence
  Synthetic
tggggataggctgacgtcta

SEQ ID NO: 26346 - DNA, 20 bp, Artificial Sequence
  Synthetic
agaaagagcaaccaggaagg

SEQ ID NO: 26347 - DNA, 18 bp, Artificial Sequence
  Synthetic
tgcgttgtggggagtttg

SEQ ID NO: 26348 - DNA, 20 bp, Artificial Sequence
  Synthetic
ccaccatggagaaatacgct

SEQ ID NO: 26349 - DNA, 19 bp, Artificial Sequence
  Synthetic
gtcttggagggtagtgcca

SEQ ID NO: 26350 - DNA, 19 bp, Artificial Sequence
  Synthetic
gaagcaatcagtggggcag

SEQ ID NO: 26351 - DNA, 20 bp, Artificial Sequence
  Synthetic
gcagggtcgtgaaagaacac

SEQ ID NO: 26352 - DNA, 18 bp, Artificial Sequence
  Synthetic
gaggccacatcccgtaga

SEQ ID NO: 26353 - DNA, 18 bp, Artificial Sequence
  Synthetic
cggctatcttccgcgcta

SEQ ID NO: 26354 - DNA, 20 bp, Artificial Sequence
  Synthetic
aagccgttgatgatgtcacc

SEQ ID NO: 26355 - DNA, 20 bp, Artificial Sequence
  Synthetic
cacaaggtcttggtccacat

SEQ ID NO: 26356 - DNA, 19 bp, Artificial Sequence
  Synthetic
ggtggagaggagttgtccg

SEQ ID NO: 26357 - DNA, 18 bp, Artificial Sequence
  Synthetic
atgtggcatccgtggagt

SEQ ID NO: 26358 - DNA, 19 bp, Artificial Sequence
  Synthetic
gacagacacgtcaagaccg

SEQ ID NO: 26359 - DNA, 19 bp, Artificial Sequence
  Synthetic
taactgtagtctcggcggg

SEQ ID NO: 26360 - DNA, 17 bp, Artificial Sequence
  Synthetic
ggtgctcgtgacgacct

SEQ ID NO: 26361 - DNA, 20 bp, Artificial Sequence
  Synthetic
agacctcgagtttctgccag

SEQ ID NO: 26362 - DNA, 18 bp, Artificial Sequence
  Synthetic
cacgaggaccttccccag

SEQ ID NO: 26363 - DNA, 17 bp, Artificial Sequence
  Synthetic
tgcagtcgcctcaggag

SEQ ID NO: 26364 - DNA, 19 bp, Artificial Sequence
  Synthetic
caggaaggggagtacaggg

SEQ ID NO: 26365 - DNA, 20 bp, Artificial Sequence
  Synthetic
agggatcagtgagcatggac

SEQ ID NO: 26366 - DNA, 19 bp, Artificial Sequence
  Synthetic
gcgaatctccgagacttcc

SEQ ID NO: 26367 - DNA, 20 bp, Artificial Sequence
  Synthetic
ggggcatggaagaataggac

SEQ ID NO: 26368 - DNA, 18 bp, Artificial Sequence
  Synthetic
ttttgacgccgctgcttt

SEQ ID NO: 26369 - DNA, 18 bp, Artificial Sequence
  Synthetic
aggagcttcccatcacgg

SEQ ID NO: 26370 - DNA, 20 bp, Artificial Sequence
  Synthetic
cagctagttgtcagtacgcc

SEQ ID NO: 26371 - DNA, 20 bp, Artificial Sequence
  Synthetic
tgtgggggcaaacatgatta

SEQ ID NO: 26372 - DNA, 18 bp, Artificial Sequence
  Synthetic
tggacagaagcctagcgc

SEQ ID NO: 26373 - DNA, 22 bp, Artificial Sequence
  Synthetic
catgaaacagacttctaagtgc

SEQ ID NO: 26374 - DNA, 21 bp, Artificial Sequence
  Synthetic
tagtatgtgtgaacttccctc

SEQ ID NO: 26375 - DNA, 20 bp, Artificial Sequence
  Synthetic
ctactttctctggtgccata

SEQ ID NO: 26376 - DNA, 23 bp, Artificial Sequence
  Synthetic
cccttcattatgtattcagtagc

SEQ ID NO: 26377 - DNA, 19 bp, Artificial Sequence
  Synthetic
gtccgtaagagcatgtctc

SEQ ID NO: 26378 - DNA, 18 bp, Artificial Sequence
  Synthetic
aaggttctgcacaccttc

SEQ ID NO: 26379 - DNA, 20 bp, Artificial Sequence
  Synthetic
tcacactgaaattcgctttc

SEQ ID NO: 26380 - DNA, 18 bp, Artificial Sequence
  Synthetic
gttctcgccattttccgt

SEQ ID NO: 26381 - DNA, 18 bp, Artificial Sequence
  Synthetic
gcacaaggaagttgcaaa

SEQ ID NO: 26382 - DNA, 20 bp, Artificial Sequence
  Synthetic
cttgtttgtcaggttgtgtt

SEQ ID NO: 26383 - DNA, 18 bp, Artificial Sequence
  Synthetic
cactgtcctccacatcct

SEQ ID NO: 26384 - DNA, 20 bp, Artificial Sequence
  Synthetic
ttgggccttatcaaacagcc

SEQ ID NO: 26385 - DNA, 21 bp, Artificial Sequence
  Synthetic
gcatttatgttggaggtcact

SEQ ID NO: 26386 - DNA, 23 bp, Artificial Sequence
  Synthetic
ccaatgttctatttggtcctcta

SEQ ID NO: 26387 - DNA, 20 bp, Artificial Sequence
  Synthetic
ctactgtttgtccacgtctt

SEQ ID NO: 26388 - DNA, 19 bp, Artificial Sequence
  Synthetic
gaaaaaatgatgctgctgc

SEQ ID NO: 26389 - DNA, 18 bp, Artificial Sequence
  Synthetic
tgtccataaaggcgggat

SEQ ID NO: 26390 - DNA, 25 bp, Artificial Sequence
  Synthetic
ataagtataactaggatgcaggtaa

SEQ ID NO: 26391 - DNA, 18 bp, Artificial Sequence
  Synthetic
acatttgttcccgcctta

SEQ ID NO: 26392 - DNA, 20 bp, Artificial Sequence
  Synthetic
gggtggtatctacaactgtt

SEQ ID NO: 26393 - DNA, 18 bp, Artificial Sequence
  Synthetic
ttgacatgcaatggcctg

SEQ ID NO: 26394 - DNA, 16 bp, Artificial Sequence
  Synthetic
gagcgccggacaaagg

SEQ ID NO: 26395 - DNA, 16 bp, Artificial Sequence
  Synthetic
agggctagcgctacgg

SEQ ID NO: 26396 - DNA, 20 bp, Artificial Sequence
  Synthetic
aacatagggaggggggattt

SEQ ID NO: 26397 - DNA, 19 bp, Artificial Sequence
  Synthetic
tgctggtgatggagggaag

SEQ ID NO: 26398 - DNA, 18 bp, Artificial Sequence
  Synthetic
gaggcgttctacgaaggc

SEQ ID NO: 26399 - DNA, 18 bp, Artificial Sequence
  Synthetic
tgacatagggggcatggc

SEQ ID NO: 26400 - DNA, 19 bp, Artificial Sequence
  Synthetic
ggaactggctgatttcggg

SEQ ID NO: 26401 - DNA, 18 bp, Artificial Sequence
  Synthetic
aggctggacaagtcaggg

SEQ ID NO: 26402 - DNA, 20 bp, Artificial Sequence
  Synthetic
tgccaggagaatgtcatcca

SEQ ID NO: 26403 - DNA, 20 bp, Artificial Sequence
  Synthetic
cgcagctgcactaatgattg

SEQ ID NO: 26404 - DNA, 20 bp, Artificial Sequence
  Synthetic
tggtttggcagagtagtcca

SEQ ID NO: 26405 - DNA, 19 bp, Artificial Sequence
  Synthetic
tgcaggacaggggtgatta

SEQ ID NO: 26406 - DNA, 22 bp, Artificial Sequence
  Synthetic
atagggttttaagaatgccatt

SEQ ID NO: 26407 - DNA, 16 bp, Artificial Sequence
  Synthetic
tccgacgggtcttggg

SEQ ID NO: 26408 - DNA, 18 bp, Artificial Sequence
  Synthetic
attagggcagggtggctg

SEQ ID NO: 26409 - DNA, 24 bp, Artificial Sequence
  Synthetic
aatattgaggtgtgaaacttcttg

SEQ ID NO: 26410 - DNA, 16 bp, Artificial Sequence
  Synthetic
tcctgccagccactcc

SEQ ID NO: 26411 - DNA, 18 bp, Artificial Sequence
  Synthetic
ttggaaggcgaggtggag

SEQ ID NO: 26412 - DNA, 16 bp, Artificial Sequence
  Synthetic
tccaggggggaaagcg

SEQ ID NO: 26413 - DNA, 20 bp, Artificial Sequence
  Synthetic
tccaaacacgtagactgggt

SEQ ID NO: 26414 - DNA, 20 bp, Artificial Sequence
  Synthetic
gaggaaggagggtggaatgt

SEQ ID NO: 26415 - DNA, 24 bp, Artificial Sequence
  Synthetic
gagatgcaaattatgaaaggaaga

SEQ ID NO: 26416 - DNA, 19 bp, Artificial Sequence
  Synthetic
acggcttgacaaacatggg

SEQ ID NO: 26417 - DNA, 19 bp, Artificial Sequence
  Synthetic
cggacgtagttcaggaggc

SEQ ID NO: 26418 - DNA, 20 bp, Artificial Sequence
  Synthetic
ttcattgccatcatccattt

SEQ ID NO: 26419 - DNA, 20 bp, Artificial Sequence
  Synthetic
ggcgtattttgacttggttt

SEQ ID NO: 26420 - DNA, 18 bp, Artificial Sequence
  Synthetic
ttgttccaccagcaactg

SEQ ID NO: 26421 - DNA, 19 bp, Artificial Sequence
  Synthetic
ctgcctaagaatgtccacc

SEQ ID NO: 26422 - DNA, 20 bp, Artificial Sequence
  Synthetic
attgactgttcgtctcttcc

SEQ ID NO: 26423 - DNA, 20 bp, Artificial Sequence
  Synthetic
cttggagtcatgtctggtaa

SEQ ID NO: 26424 - DNA, 19 bp, Artificial Sequence
  Synthetic
tcagggccattaatctccc

SEQ ID NO: 26425 - DNA, 19 bp, Artificial Sequence
  Synthetic
tctactttgctttggtggg

SEQ ID NO: 26426 - DNA, 19 bp, Artificial Sequence
  Synthetic
tgatgcttaatgctggtcc

SEQ ID NO: 26427 - DNA, 19 bp, Artificial Sequence
  Synthetic
tcacactgaagttcgcttt

SEQ ID NO: 26428 - DNA, 21 bp, Artificial Sequence
  Synthetic
tcccattctcattactgcttc

SEQ ID NO: 26429 - DNA, 20 bp, Artificial Sequence
  Synthetic
ccactttcccttttctgagt

SEQ ID NO: 26430 - DNA, 18 bp, Artificial Sequence
  Synthetic
tatggtgttggccaatgc

SEQ ID NO: 26431 - DNA, 21 bp, Artificial Sequence
  Synthetic
cgatagcccttctttttaact

SEQ ID NO: 26432 - DNA, 18 bp, Artificial Sequence
  Synthetic
catcgccaggaacattcg

SEQ ID NO: 26433 - DNA, 21 bp, Artificial Sequence
  Synthetic
gaagaggccttattttctcaa

SEQ ID NO: 26434 - DNA, 20 bp, Artificial Sequence
  Synthetic
aggtcctgtagaatctgtcc

SEQ ID NO: 26435 - DNA, 20 bp, Artificial Sequence
  Synthetic
ctcccctatggcacctatat

SEQ ID NO: 26436 - DNA, 18 bp, Artificial Sequence
  Synthetic
gaatcgtgtgcgcgaaag

SEQ ID NO: 26437 - DNA, 16 bp, Artificial Sequence
  Synthetic
tgggctggggtggttt

SEQ ID NO: 26438 - DNA, 16 bp, Artificial Sequence
  Synthetic
gttcaccgcgtcgtgc

SEQ ID NO: 26439 - DNA, 20 bp, Artificial Sequence
  Synthetic
gacggattcctgaggctaca

SEQ ID NO: 26440 - DNA, 19 bp, Artificial Sequence
  Synthetic
ggtcggaccatccacccat

SEQ ID NO: 26441 - DNA, 20 bp, Artificial Sequence
  Synthetic
gacgcgttaatcgaactttc

SEQ ID NO: 26442 - DNA, 19 bp, Artificial Sequence
  Synthetic
cggccgctgaaaaaagagt

SEQ ID NO: 26443 - DNA, 18 bp, Artificial Sequence
  Synthetic
ggtcggtccaggtcaacg

SEQ ID NO: 26444 - DNA, 20 bp, Artificial Sequence
  Synthetic
cgttatagcgccgtctttcg

SEQ ID NO: 26445 - DNA, 18 bp, Artificial Sequence
  Synthetic
ccaggctgtgggtctcgt

SEQ ID NO: 26446 - DNA, 17 bp, Artificial Sequence
  Synthetic
tacgcggtgccgttcac

SEQ ID NO: 26447 - DNA, 18 bp, Artificial Sequence
  Synthetic
cggatccgtcagccagta

SEQ ID NO: 26448 - DNA, 18 bp, Artificial Sequence
  Synthetic
tcttcctcagagacggcc

SEQ ID NO: 26449 - DNA, 17 bp, Artificial Sequence
  Synthetic
catgacgcgttcgggac

SEQ ID NO: 26450 - DNA, 20 bp, Artificial Sequence
  Synthetic
tggagcctcggtttggatac

SEQ ID NO: 26451 - DNA, 18 bp, Artificial Sequence
  Synthetic
tctcggacgagggctatg

SEQ ID NO: 26452 - DNA, 16 bp, Artificial Sequence
  Synthetic
gcagcggctcatcagg

SEQ ID NO: 26453 - DNA, 19 bp, Artificial Sequence
  Synthetic
atacgtggtgtgcacgttg

SEQ ID NO: 26454 - DNA, 15 bp, Artificial Sequence
  Synthetic
tacgcggcgacagct

SEQ ID NO: 26455 - DNA, 17 bp, Artificial Sequence
  Synthetic
tcgatgggtccgcttca

SEQ ID NO: 26456 - DNA, 19 bp, Artificial Sequence
  Synthetic
agtacgactcgtaggccgt

SEQ ID NO: 26457 - DNA, 16 bp, Artificial Sequence
  Synthetic
aatgcgggcaggcgtg

SEQ ID NO: 26458 - DNA, 17 bp, Artificial Sequence
  Synthetic
gacagttgagcgcgtcg

SEQ ID NO: 26459 - DNA, 19 bp, Artificial Sequence
  Synthetic
ggcggtgtttccagcattt

SEQ ID NO: 26460 - DNA, 20 bp, Artificial Sequence
  Synthetic
tgtgctagaccgtaccgaat

SEQ ID NO: 26461 - DNA, 17 bp, Artificial Sequence
  Synthetic
gccgatttttcgccgca

SEQ ID NO: 26462 - DNA, 19 bp, Artificial Sequence
  Synthetic
cggataatctcctgggcca

SEQ ID NO: 26463 - DNA, 18 bp, Artificial Sequence
  Synthetic
cacgctgatgtcctcggg

SEQ ID NO: 26464 - DNA, 19 bp, Artificial Sequence
  Synthetic
cgacgccatcaccgagaac

SEQ ID NO: 26465 - DNA, 19 bp, Artificial Sequence
  Synthetic
cgcccaccatgaaggattt

SEQ ID NO: 26466 - DNA, 18 bp, Artificial Sequence
  Synthetic
tccaccagctggactacg

SEQ ID NO: 26467 - DNA, 18 bp, Artificial Sequence
  Synthetic
ttcatgacgcccaagtgg

SEQ ID NO: 26468 - DNA, 18 bp, Artificial Sequence
  Synthetic
aatcgcccctcacgtcag

SEQ ID NO: 26469 - DNA, 18 bp, Artificial Sequence
  Synthetic
gcgtacgccgtgtaccac

SEQ ID NO: 26470 - DNA, 18 bp, Artificial Sequence
  Synthetic
cgaccgggatcacgacga

SEQ ID NO: 26471 - DNA, 18 bp, Artificial Sequence
  Synthetic
gtacctggtgtcgcggtc

SEQ ID NO: 26472 - DNA, 20 bp, Artificial Sequence
  Synthetic
ccgtgagtgttacttcccca

SEQ ID NO: 26473 - DNA, 16 bp, Artificial Sequence
  Synthetic
tctccatcgccagcgc

SEQ ID NO: 26474 - DNA, 20 bp, Artificial Sequence
  Synthetic
ctttgatttgagcgtgctgc

SEQ ID NO: 26475 - DNA, 17 bp, Artificial Sequence
  Synthetic
tacccaagctggccgag

SEQ ID NO: 26476 - DNA, 18 bp, Artificial Sequence
  Synthetic
cactggcagaccttggtc

SEQ ID NO: 26477 - DNA, 19 bp, Artificial Sequence
  Synthetic
ttacggtctggatctcgcg

SEQ ID NO: 26478 - DNA, 19 bp, Artificial Sequence
  Synthetic
tgtcgctgctgatctgacg

SEQ ID NO: 26479 - DNA, 16 bp, Artificial Sequence
  Synthetic
gcctggcttacgggga

SEQ ID NO: 26480 - DNA, 17 bp, Artificial Sequence
  Synthetic
cgcgccaacgagttgac

SEQ ID NO: 26481 - DNA, 17 bp, Artificial Sequence
  Synthetic
cgccacatccagcatgt

SEQ ID NO: 26482 - DNA, 20 bp, Artificial Sequence
  Synthetic
gcaactctagcattttggcg

SEQ ID NO: 26483 - DNA, 20 bp, Artificial Sequence
  Synthetic
gcgtttcctcttcctcttcg

SEQ ID NO: 26484 - DNA, 18 bp, Artificial Sequence
  Synthetic
cgttgatccgcccgtcta

SEQ ID NO: 26485 - DNA, 18 bp, Artificial Sequence
  Synthetic
acagctcgcgaagtgtct

SEQ ID NO: 26486 - DNA, 16 bp, Artificial Sequence
  Synthetic
tgcgctagcgtcacgg

SEQ ID NO: 26487 - DNA, 16 bp, Artificial Sequence
  Synthetic
acttcgcacgggcacg

SEQ ID NO: 26488 - DNA, 17 bp, Artificial Sequence
  Synthetic
ctttgcgactctgggcc

SEQ ID NO: 26489 - DNA, 18 bp, Artificial Sequence
  Synthetic
cggagtgctgacgaagtg

SEQ ID NO: 26490 - DNA, 20 bp, Artificial Sequence
  Synthetic
gaatgtcctgggctaagcag

SEQ ID NO: 26491 - DNA, 17 bp, Artificial Sequence
  Synthetic
ttgagaaacagcggcgg

SEQ ID NO: 26492 - DNA, 18 bp, Artificial Sequence
  Synthetic
gtcggacgcgattgatgg

SEQ ID NO: 26493 - DNA, 19 bp, Artificial Sequence
  Synthetic
gctccggcagtaacagtag

SEQ ID NO: 26494 - DNA, 20 bp, Artificial Sequence
  Synthetic
tacagcaaaggtacgacggt

SEQ ID NO: 26495 - DNA, 16 bp, Artificial Sequence
  Synthetic
agggggaggggcgaat

SEQ ID NO: 26496 - DNA, 17 bp, Artificial Sequence
  Synthetic
agcagcaacagtcgcag

SEQ ID NO: 26497 - DNA, 19 bp, Artificial Sequence
  Synthetic
ggattgcgaccccgaagtg

SEQ ID NO: 26498 - DNA, 18 bp, Artificial Sequence
  Synthetic
ctcatcgaccccgtgacg

SEQ ID NO: 26499 - DNA, 19 bp, Artificial Sequence
  Synthetic
catacgcaaggcatcgtgg

SEQ ID NO: 26500 - DNA, 19 bp, Artificial Sequence
  Synthetic
aacgcaggagattctggcc

SEQ ID NO: 26501 - DNA, 18 bp, Artificial Sequence
  Synthetic
aagccgtcccgaacatca

SEQ ID NO: 26502 - DNA, 20 bp, Artificial Sequence
  Synthetic
agggaaaaaaaggtggggcc

SEQ ID NO: 26503 - DNA, 16 bp, Artificial Sequence
  Synthetic
tctcacggcggcagtc

SEQ ID NO: 26504 - DNA, 17 bp, Artificial Sequence
  Synthetic
acgtctggcaccctacc

SEQ ID NO: 26505 - DNA, 19 bp, Artificial Sequence
  Synthetic
tctggatgaccgtatgggc

SEQ ID NO: 26506 - DNA, 16 bp, Artificial Sequence
  Synthetic
accgctgcccgtctac

SEQ ID NO: 26507 - DNA, 18 bp, Artificial Sequence
  Synthetic
acgtctacctggcctacc

SEQ ID NO: 26508 - DNA, 16 bp, Artificial Sequence
  Synthetic
cgggtgacggcgacat

SEQ ID NO: 26509 - DNA, 16 bp, Artificial Sequence
  Synthetic
acaggcggttgagcgc

SEQ ID NO: 26510 - DNA, 16 bp, Artificial Sequence
  Synthetic
gccttcccaagcggca

SEQ ID NO: 26511 - DNA, 16 bp, Artificial Sequence
  Synthetic
atcgtcccgtagcccg

SEQ ID NO: 26512 - DNA, 16 bp, Artificial Sequence
  Synthetic
agcctgcgactgctgc

SEQ ID NO: 26513 - DNA, 20 bp, Artificial Sequence
  Synthetic
gtcgtcgtggttgatgttga

SEQ ID NO: 26514 - DNA, 18 bp, Artificial Sequence
  Synthetic
ctgccacggtagcacctg

SEQ ID NO: 26515 - DNA, 17 bp, Artificial Sequence
  Synthetic
ataccgcccggagagtc

SEQ ID NO: 26516 - DNA, 20 bp, Artificial Sequence
  Synthetic
gcctgggaaactcaagtctt

SEQ ID NO: 26517 - DNA, 19 bp, Artificial Sequence
  Synthetic
atgtttgccggcttcgagg

SEQ ID NO: 26518 - DNA, 18 bp, Artificial Sequence
  Synthetic
tcccgggcgtctccatag

SEQ ID NO: 26519 - DNA, 19 bp, Artificial Sequence
  Synthetic
taaacatcaagggccgctg

SEQ ID NO: 26520 - DNA, 17 bp, Artificial Sequence
  Synthetic
actgccaggtgcttcgg

SEQ ID NO: 26521 - DNA, 16 bp, Artificial Sequence
  Synthetic
ggccgagcgcaaacac

SEQ ID NO: 26522 - DNA, 19 bp, Artificial Sequence
  Synthetic
acaatcagctgcaggtgca

SEQ ID NO: 26523 - DNA, 20 bp, Artificial Sequence
  Synthetic
acgcaccaagtcaaatccac

SEQ ID NO: 26524 - DNA, 17 bp, Artificial Sequence
  Synthetic
ggtgcgacgacccttct

SEQ ID NO: 26525 - DNA, 19 bp, Artificial Sequence
  Synthetic
tgataccgcggaatcaacg

SEQ ID NO: 26526 - DNA, 20 bp, Artificial Sequence
  Synthetic
tgatcgacatgaagaccgcc

SEQ ID NO: 26527 - DNA, 18 bp, Artificial Sequence
  Synthetic
gccctggatcgtacccat

SEQ ID NO: 26528 - DNA, 19 bp, Artificial Sequence
  Synthetic
acctcaagacgctgctagt

SEQ ID NO: 26529 - DNA, 18 bp, Artificial Sequence
  Synthetic
ggtaacgcgcatctcagc

SEQ ID NO: 26530 - DNA, 16 bp, Artificial Sequence
  Synthetic
tgtgccacccggtgct

SEQ ID NO: 26531 - DNA, 17 bp, Artificial Sequence
  Synthetic
tgctttccccgagctcc

SEQ ID NO: 26532 - DNA, 20 bp, Artificial Sequence
  Synthetic
gtaccagatgttcaccgtgg

SEQ ID NO: 26533 - DNA, 19 bp, Artificial Sequence
  Synthetic
agaggctcggcaattctcg

SEQ ID NO: 26534 - DNA, 17 bp, Artificial Sequence
  Synthetic
acgtcgaacgcgatcgg

SEQ ID NO: 26535 - DNA, 19 bp, Artificial Sequence
  Synthetic
gtgttcctgataggcccgg

SEQ ID NO: 26536 - DNA, 16 bp, Artificial Sequence
  Synthetic
acaccaaccaggcggc

SEQ ID NO: 26537 - DNA, 20 bp, Artificial Sequence
  Synthetic
tcaacgtggtctcttacgtg

SEQ ID NO: 26538 - DNA, 17 bp, Artificial Sequence
  Synthetic
agttttgggggcggagg

SEQ ID NO: 26539 - DNA, 17 bp, Artificial Sequence
  Synthetic
cttggatcacgtcggcg

SEQ ID NO: 26540 - DNA, 18 bp, Artificial Sequence
  Synthetic
ccacctcctgcatctcca

SEQ ID NO: 26541 - DNA, 19 bp, Artificial Sequence
  Synthetic
ttcaggtggatcctccgtc

SEQ ID NO: 26542 - DNA, 16 bp, Artificial Sequence
  Synthetic
acgtcgaaaccccggc

SEQ ID NO: 26543 - DNA, 18 bp, Artificial Sequence
  Synthetic
gcaagccgtggtaaccgt

SEQ ID NO: 26544 - DNA, 16 bp, Artificial Sequence
  Synthetic
agcgccgacaactccg

SEQ ID NO: 26545 - DNA, 18 bp, Artificial Sequence
  Synthetic
cgtagctcatttgcgccg

SEQ ID NO: 26546 - DNA, 16 bp, Artificial Sequence
  Synthetic
ttttccccgccggtgg

SEQ ID NO: 26547 - DNA, 17 bp, Artificial Sequence
  Synthetic
agccactaccgcagagc

SEQ ID NO: 26548 - DNA, 17 bp, Artificial Sequence
  Synthetic
tcagagacgcgttccgc

SEQ ID NO: 26549 - DNA, 17 bp, Artificial Sequence
  Synthetic
cagacgcagacaggtgc

SEQ ID NO: 26550 - DNA, 20 bp, Artificial Sequence
  Synthetic
ccgttgccgtagaagaagtt

SEQ ID NO: 26551 - DNA, 18 bp, Artificial Sequence
  Synthetic
tttctgggctactccgcc

SEQ ID NO: 26552 - DNA, 20 bp, Artificial Sequence
  Synthetic
gctggaggtccatacggatt

SEQ ID NO: 26553 - DNA, 18 bp, Artificial Sequence
  Synthetic
aagctgctgttcaccacg

SEQ ID NO: 26554 - DNA, 20 bp, Artificial Sequence
  Synthetic
acgctctttgacaccatcac

SEQ ID NO: 26555 - DNA, 16 bp, Artificial Sequence
  Synthetic
agaggtcctcgcaggc

SEQ ID NO: 26556 - DNA, 16 bp, Artificial Sequence
  Synthetic
ggtctgcgtgggcgaa

SEQ ID NO: 26557 - DNA, 20 bp, Artificial Sequence
  Synthetic
gtgtgatccatgagttcggc

SEQ ID NO: 26558 - DNA, 20 bp, Artificial Sequence
  Synthetic
ggcgattgtaggtaacgagc

SEQ ID NO: 26559 - DNA, 16 bp, Artificial Sequence
  Synthetic
tgcaccacctcggggt

SEQ ID NO: 26560 - DNA, 20 bp, Artificial Sequence
  Synthetic
gactcttggcgatggtcatg

SEQ ID NO: 26561 - DNA, 16 bp, Artificial Sequence
  Synthetic
ttgcctggacgcctgg

SEQ ID NO: 26562 - DNA, 20 bp, Artificial Sequence
  Synthetic
cctgctgtacaacaatccgg

SEQ ID NO: 26563 - DNA, 18 bp, Artificial Sequence
  Synthetic
ctctcatcgtgccgcaga

SEQ ID NO: 26564 - DNA, 19 bp, Artificial Sequence
  Synthetic
tgcttactgtgtgaagcgg

SEQ ID NO: 26565 - DNA, 16 bp, Artificial Sequence
  Synthetic
acgccacaggccgtag

SEQ ID NO: 26566 - DNA, 18 bp, Artificial Sequence
  Synthetic
aggtgacgcgacctcctg

SEQ ID NO: 26567 - DNA, 19 bp, Artificial Sequence
  Synthetic
gctacggctgctgatacga

SEQ ID NO: 26568 - DNA, 16 bp, Artificial Sequence
  Synthetic
cgctcggcagctcctt

SEQ ID NO: 26569 - DNA, 18 bp, Artificial Sequence
  Synthetic
ctacggaccgtctgtcga

SEQ ID NO: 26570 - DNA, 24 bp, Artificial Sequence
  Synthetic
ttgtctctctttatctttcttgtg

SEQ ID NO: 26571 - DNA, 21 bp, Artificial Sequence
  Synthetic
caagtcatgattcgtaactgc

SEQ ID NO: 26572 - DNA, 20 bp, Artificial Sequence
  Synthetic
cgcttcgtaattctgacgca

SEQ ID NO: 26573 - DNA, 19 bp, Artificial Sequence
  Synthetic
aagatgtgggccgagaact

SEQ ID NO: 26574 - DNA, 16 bp, Artificial Sequence
  Synthetic
aagccgccgttcaagc

SEQ ID NO: 26575 - DNA, 18 bp, Artificial Sequence
  Synthetic
tggtggacgagacgagac

SEQ ID NO: 26576 - DNA, 17 bp, Artificial Sequence
  Synthetic
aaacccaagccggtcgg

SEQ ID NO: 26577 - DNA, 16 bp, Artificial Sequence
  Synthetic
tacgctagcggggctg

SEQ ID NO: 26578 - DNA, 20 bp, Artificial Sequence
  Synthetic
taacgtgggtttcaggggaa

SEQ ID NO: 26579 - DNA, 17 bp, Artificial Sequence
  Synthetic
actgcagaccgtacggg

SEQ ID NO: 26580 - DNA, 16 bp, Artificial Sequence
  Synthetic
ttctgcaccgccgacg

SEQ ID NO: 26581 - DNA, 18 bp, Artificial Sequence
  Synthetic
acccagcactccatcgac

SEQ ID NO: 26582 - DNA, 18 bp, Artificial Sequence
  Synthetic
catacgccacagcatgcg

SEQ ID NO: 26583 - DNA, 15 bp, Artificial Sequence
  Synthetic
tgtgcactgccgcga

SEQ ID NO: 26584 - DNA, 18 bp, Artificial Sequence
  Synthetic
aggccgtggaaaaccacc

SEQ ID NO: 26585 - DNA, 18 bp, Artificial Sequence
  Synthetic
caggcatgggtctgtcga

SEQ ID NO: 26586 - DNA, 18 bp, Artificial Sequence
  Synthetic
gagactggcagggacacg

SEQ ID NO: 26587 - DNA, 18 bp, Artificial Sequence
  Synthetic
ctggccgtcctgttcctg

SEQ ID NO: 26588 - DNA, 16 bp, Artificial Sequence
  Synthetic
accgttgacgtgggcg

SEQ ID NO: 26589 - DNA, 18 bp, Artificial Sequence
  Synthetic
gcgacagacatccccctg

SEQ ID NO: 26590 - DNA, 20 bp, Artificial Sequence
  Synthetic
gttcagtgttggatcagact

SEQ ID NO: 26591 - DNA, 16 bp, Artificial Sequence
  Synthetic
ctcgcgggtttgggga

SEQ ID NO: 26592 - DNA, 16 bp, Artificial Sequence
  Synthetic
gaaggcaccgcgacag

SEQ ID NO: 26593 - DNA, 16 bp, Artificial Sequence
  Synthetic
accccagcaacggcct

SEQ ID NO: 26594 - DNA, 20 bp, Artificial Sequence
  Synthetic
gattgctgacgctggaaacc

SEQ ID NO: 26595 - DNA, 17 bp, Artificial Sequence
  Synthetic
cagagaacgcagcgcac

SEQ ID NO: 26596 - DNA, 18 bp, Artificial Sequence
  Synthetic
tcctcctggtgcctgtgg

SEQ ID NO: 26597 - DNA, 17 bp, Artificial Sequence
  Synthetic
gggccgcccaaacatct

SEQ ID NO: 26598 - DNA, 20 bp, Artificial Sequence
  Synthetic
cccttgagtttgatggtgcc

SEQ ID NO: 26599 - DNA, 17 bp, Artificial Sequence
  Synthetic
cgggactttgacagccg

SEQ ID NO: 26600 - DNA, 18 bp, Artificial Sequence
  Synthetic
tctcctttacggggctgg

SEQ ID NO: 26601 - DNA, 17 bp, Artificial Sequence
  Synthetic
gggcctgaagcgatgga

SEQ ID NO: 26602 - DNA, 17 bp, Artificial Sequence
  Synthetic
tacgatcctccggcgct

SEQ ID NO: 26603 - DNA, 17 bp, Artificial Sequence
  Synthetic
caggctggaacgcaacg

SEQ ID NO: 26604 - DNA, 19 bp, Artificial Sequence
  Synthetic
ccacagacgccgtttgcta

SEQ ID NO: 26605 - DNA, 19 bp, Artificial Sequence
  Synthetic
ttgagtgccagtacagcgc

SEQ ID NO: 26606 - DNA, 16 bp, Artificial Sequence
  Synthetic
gtgacgccggttgtcc

SEQ ID NO: 26607 - DNA, 19 bp, Artificial Sequence
  Synthetic
tttcctgtgcaccgtcatc

SEQ ID NO: 26608 - DNA, 19 bp, Artificial Sequence
  Synthetic
tggatgattttgcgcgaca

SEQ ID NO: 26609 - DNA, 19 bp, Artificial Sequence
  Synthetic
gaagatcgtcctctcgccg

SEQ ID NO: 26610 - DNA, 20 bp, Artificial Sequence
  Synthetic
ccgacaggtaagatgtggct

SEQ ID NO: 26611 - DNA, 16 bp, Artificial Sequence
  Synthetic
tcctccgggttcctgc

SEQ ID NO: 26612 - DNA, 19 bp, Artificial Sequence
  Synthetic
gcagcacacgcaactagtc

SEQ ID NO: 26613 - DNA, 25 bp, Artificial Sequence
  Synthetic
caatgaaatggaagtctgaatacat

SEQ ID NO: 26614 - DNA, 23 bp, Artificial Sequence
  Synthetic
tcggattttatcttgttagcttt

SEQ ID NO: 26615 - DNA, 19 bp, Artificial Sequence
  Synthetic
aaggctggagaagttaggt

SEQ ID NO: 26616 - DNA, 19 bp, Artificial Sequence
  Synthetic
tgctatcgatctgagctct

SEQ ID NO: 26617 - DNA, 18 bp, Artificial Sequence
  Synthetic
catccatggctgcacaag

SEQ ID NO: 26618 - DNA, 21 bp, Artificial Sequence
  Synthetic
cctacttcaagaacacagtac

SEQ ID NO: 26619 - DNA, 18 bp, Artificial Sequence
  Synthetic
aaggttctgcacaccttc

SEQ ID NO: 26620 - DNA, 20 bp, Artificial Sequence
  Synthetic
gaatcagcctcccttcattg

SEQ ID NO: 26621 - DNA, 20 bp, Artificial Sequence
  Synthetic
atgccatatcatcagatggg

SEQ ID NO: 26622 - DNA, 18 bp, Artificial Sequence
  Synthetic
gtgctgctgtttggaatt

SEQ ID NO: 26623 - DNA, 25 bp, Artificial Sequence
  Synthetic
ttcttatagcccaatatctacttct

SEQ ID NO: 26624 - DNA, 18 bp, Artificial Sequence
  Synthetic
gaggctcagagttcactc

SEQ ID NO: 26625 - DNA, 21 bp, Artificial Sequence
  Synthetic
tcgtaaagagacggaacataa

SEQ ID NO: 26626 - DNA, 18 bp, Artificial Sequence
  Synthetic
gttccctatcagcggcag

SEQ ID NO: 26627 - DNA, 19 bp, Artificial Sequence
  Synthetic
caggtgctcaaagtccatt

SEQ ID NO: 26628 - DNA, 20 bp, Artificial Sequence
  Synthetic
tcaccctatttaccaccttg

SEQ ID NO: 26629 - DNA, 20 bp, Artificial Sequence
  Synthetic
tttacttctccaccaccgca

SEQ ID NO: 26630 - DNA, 21 bp, Artificial Sequence
  Synthetic
tgcattcgacatctaaaagca

SEQ ID NO: 26631 - DNA, 20 bp, Artificial Sequence
  Synthetic
caaaacgtcgcatagtttga

SEQ ID NO: 26632 - DNA, 18 bp, Artificial Sequence
  Synthetic
tagcacaatgggacgaag

SEQ ID NO: 26633 - DNA, 20 bp, Artificial Sequence
  Synthetic
agcattcgaagccaagtgat

SEQ ID NO: 26634 - DNA, 19 bp, Artificial Sequence
  Synthetic
cactaacccggaacatgaa

SEQ ID NO: 26635 - DNA, 19 bp, Artificial Sequence
  Synthetic
tttccatgcctttccttct

SEQ ID NO: 26636 - DNA, 19 bp, Artificial Sequence
  Synthetic
cgcgtccgacaaatgatga

SEQ ID NO: 26637 - DNA, 20 bp, Artificial Sequence
  Synthetic
ggacaaaaccctcgtccatt

SEQ ID NO: 26638 - DNA, 19 bp, Artificial Sequence
  Synthetic
agttattgtggcgcagatg

SEQ ID NO: 26639 - DNA, 18 bp, Artificial Sequence
  Synthetic
aacgatcggtacccttcc

SEQ ID NO: 26640 - DNA, 22 bp, Artificial Sequence
  Synthetic
tgatcaaatggaagaaagccta

SEQ ID NO: 26641 - DNA, 20 bp, Artificial Sequence
  Synthetic
cggtgaagtagttaccagcg

SEQ ID NO: 26642 - DNA, 19 bp, Artificial Sequence
  Synthetic
gcgccttcacatgagctat

SEQ ID NO: 26643 - DNA, 19 bp, Artificial Sequence
  Synthetic
ttaagaaaggctgcacaag

SEQ ID NO: 26644 - DNA, 24 bp, Artificial Sequence
  Synthetic
gagttgtatatagtaggacacaat

SEQ ID NO: 26645 - DNA, 20 bp, Artificial Sequence
  Synthetic
tcttgtcaaacatgccttac

SEQ ID NO: 26646 - DNA, 18 bp, Artificial Sequence
  Synthetic
ctgctttctggtgcgagg

SEQ ID NO: 26647 - DNA, 20 bp, Artificial Sequence
  Synthetic
gcggacatgcttttctctct

SEQ ID NO: 26648 - DNA, 16 bp, Artificial Sequence
  Synthetic
tcccctgccagagcgt

SEQ ID NO: 26649 - DNA, 21 bp, Artificial Sequence
  Synthetic
ggaacgaaattggactaaacg

SEQ ID NO: 26650 - DNA, 19 bp, Artificial Sequence
  Synthetic
gcaacgcctcatttcccat

SEQ ID NO: 26651 - DNA, 18 bp, Artificial Sequence
  Synthetic
gcctgcgaattcaacaag

SEQ ID NO: 26652 - DNA, 19 bp, Artificial Sequence
  Synthetic
acacagaaactgtacagcc

SEQ ID NO: 26653 - DNA, 20 bp, Artificial Sequence
  Synthetic
cgtggcaactattgaacgct

SEQ ID NO: 26654 - DNA, 20 bp, Artificial Sequence
  Synthetic
aagactcctctccgtgtctg

SEQ ID NO: 26655 - DNA, 15 bp, Artificial Sequence
  Synthetic
aaatccgcggcgcag

SEQ ID NO: 26656 - DNA, 23 bp, Artificial Sequence
  Synthetic
cattgtctctactatgttgaact

SEQ ID NO: 26657 - DNA, 16 bp, Artificial Sequence
  Synthetic
gccggtcgctgcatct

SEQ ID NO: 26658 - DNA, 18 bp, Artificial Sequence
  Synthetic
ctgttatagcgtgccacg

SEQ ID NO: 26659 - DNA, 24 bp, Artificial Sequence
  Synthetic
cttgcaaatttttaaaagcctgag

SEQ ID NO: 26660 - DNA, 20 bp, Artificial Sequence
  Synthetic
gactgtccgtaacatcatcc

SEQ ID NO: 26661 - DNA, 20 bp, Artificial Sequence
  Synthetic
agcaaatgggtttcctgacc

SEQ ID NO: 26662 - DNA, 18 bp, Artificial Sequence
  Synthetic
atggtttggccttcgttg

SEQ ID NO: 26663 - DNA, 18 bp, Artificial Sequence
  Synthetic
aaaatcaaccccgcaacc

SEQ ID NO: 26664 - DNA, 18 bp, Artificial Sequence
  Synthetic
gtccatgaccgaactcct

SEQ ID NO: 26665 - DNA, 18 bp, Artificial Sequence
  Synthetic
cgtctacagtggtgcgac

SEQ ID NO: 26666 - DNA, 19 bp, Artificial Sequence
  Synthetic
tcgcgcacccagtatacat

SEQ ID NO: 26667 - DNA, 20 bp, Artificial Sequence
  Synthetic
ccgggagaaaaaaccactgt

SEQ ID NO: 26668 - DNA, 24 bp, Artificial Sequence
  Synthetic
cttttttatcggacgtacttttac

SEQ ID NO: 26669 - DNA, 20 bp, Artificial Sequence
  Synthetic
ttgtacaacgcgacgtactg

SEQ ID NO: 26670 - DNA, 20 bp, Artificial Sequence
  Synthetic
ggttctgttgtgtgcgttac

SEQ ID NO: 26671 - DNA, 18 bp, Artificial Sequence
  Synthetic
actccgaggcatcctgac

SEQ ID NO: 26672 - DNA, 20 bp, Artificial Sequence
  Synthetic
ttgtgaagcattaggagcgc

SEQ ID NO: 26673 - DNA, 20 bp, Artificial Sequence
  Synthetic
gcttaaacacaagatgcgtg

SEQ ID NO: 26674 - DNA, 19 bp, Artificial Sequence
  Synthetic
cctactgcgctaagaggaa

SEQ ID NO: 26675 - DNA, 22 bp, Artificial Sequence
  Synthetic
cgatattgacataggtatccac

SEQ ID NO: 26676 - DNA, 19 bp, Artificial Sequence
  Synthetic
tgtgccatgggaaaaaagt

SEQ ID NO: 26677 - DNA, 20 bp, Artificial Sequence
  Synthetic
ttcatttggggttagcaaac

SEQ ID NO: 26678 - DNA, 19 bp, Artificial Sequence
  Synthetic
cacagctgtttggcctata

SEQ ID NO: 26679 - DNA, 18 bp, Artificial Sequence
  Synthetic
gtgtacgcccccagtttc

SEQ ID NO: 26680 - DNA, 20 bp, Artificial Sequence
  Synthetic
cctgaggactttgtagcata

SEQ ID NO: 26681 - DNA, 20 bp, Artificial Sequence
  Synthetic
ggccctaattgcgacttcaa

SEQ ID NO: 26682 - DNA, 22 bp, Artificial Sequence
  Synthetic
ggaataattctttctccggaaa

SEQ ID NO: 26683 - DNA, 18 bp, Artificial Sequence
  Synthetic
tcaggagctcatgggacg

SEQ ID NO: 26684 - DNA, 18 bp, Artificial Sequence
  Synthetic
aaatggaaaccaggcagg

SEQ ID NO: 26685 - DNA, 20 bp, Artificial Sequence
  Synthetic
tgctttgtcgctgtagatgt

SEQ ID NO: 26686 - DNA, 25 bp, Artificial Sequence
  Synthetic
gacctaaaccttcaaaaattttagg

SEQ ID NO: 26687 - DNA, 20 bp, Artificial Sequence
  Synthetic
cgctgttgtagttcgttgga

SEQ ID NO: 26688 - DNA, 18 bp, Artificial Sequence
  Synthetic
tgtccgttcgtcaaaacc

SEQ ID NO: 26689 - DNA, 18 bp, Artificial Sequence
  Synthetic
ggttcaaatttgcgcagg

SEQ ID NO: 26690 - DNA, 19 bp, Artificial Sequence
  Synthetic
ctgcctgactctcccaaga

SEQ ID NO: 26691 - DNA, 20 bp, Artificial Sequence
  Synthetic
gaatcgccactccatcatgg

SEQ ID NO: 26692 - DNA, 23 bp, Artificial Sequence
  Synthetic
agtatttattgaacagagcttct

SEQ ID NO: 26693 - DNA, 20 bp, Artificial Sequence
  Synthetic
cgaggcaaaagtacagtggt

SEQ ID NO: 26694 - DNA, 18 bp, Artificial Sequence
  Synthetic
cttcttcaggcggtacag

SEQ ID NO: 26695 - DNA, 18 bp, Artificial Sequence
  Synthetic
gaaggagaaactgcctcg

SEQ ID NO: 26696 - DNA, 19 bp, Artificial Sequence
  Synthetic
agggttacattatggccag

SEQ ID NO: 26697 - DNA, 23 bp, Artificial Sequence
  Synthetic
agcttttagtaatacctgaaaca

SEQ ID NO: 26698 - DNA, 18 bp, Artificial Sequence
  Synthetic
atcaaggtcactgactgc

SEQ ID NO: 26699 - DNA, 18 bp, Artificial Sequence
  Synthetic
aacaacagaaggaggacg

SEQ ID NO: 26700 - DNA, 18 bp, Artificial Sequence
  Synthetic
aataggtaccgagcccac

SEQ ID NO: 26701 - DNA, 18 bp, Artificial Sequence
  Synthetic
catactgggttctgctgc

SEQ ID NO: 26702 - DNA, 20 bp, Artificial Sequence
  Synthetic
tcttgtgttaagtgtgaggg

SEQ ID NO: 26703 - DNA, 20 bp, Artificial Sequence
  Synthetic
gacaaggctaaggaaccgtt

SEQ ID NO: 26704 - DNA, 21 bp, Artificial Sequence
  Synthetic
agttgttaagttccagtttgt

SEQ ID NO: 26705 - DNA, 23 bp, Artificial Sequence
  Synthetic
taacagtattggtagacactgat

SEQ ID NO: 26706 - DNA, 18 bp, Artificial Sequence
  Synthetic
tacaaagggggaaaggga

SEQ ID NO: 26707 - DNA, 23 bp, Artificial Sequence
  Synthetic
taattatgcatcatcgagcaatt

SEQ ID NO: 26708 - DNA, 18 bp, Artificial Sequence
  Synthetic
tacatggtcatgagcggt

SEQ ID NO: 26709 - DNA, 18 bp, Artificial Sequence
  Synthetic
cagacggtatcgctacag

SEQ ID NO: 26710 - DNA, 23 bp, Artificial Sequence
  Synthetic
ttgaacatttggaaaatcgctta

SEQ ID NO: 26711 - DNA, 21 bp, Artificial Sequence
  Synthetic
ttgtgcaagttgtatgttctg

SEQ ID NO: 26712 - DNA, 18 bp, Artificial Sequence
  Synthetic
cgtgttttgcgatgttcg

SEQ ID NO: 26713 - DNA, 19 bp, Artificial Sequence
  Synthetic
tctggtaaggcattatggc

SEQ ID NO: 26714 - DNA, 20 bp, Artificial Sequence
  Synthetic
acatctagcctcatctgcca

SEQ ID NO: 26715 - DNA, 19 bp, Artificial Sequence
  Synthetic
cacagcgtcttgggttgtt

SEQ ID NO: 26716 - DNA, 20 bp, Artificial Sequence
  Synthetic
atgggtgtgctcatagctca

SEQ ID NO: 26717 - DNA, 18 bp, Artificial Sequence
  Synthetic
tggtggggtgaaatcctg

SEQ ID NO: 26718 - DNA, 18 bp, Artificial Sequence
  Synthetic
ccattatagcccctgtgg

SEQ ID NO: 26719 - DNA, 23 bp, Artificial Sequence
  Synthetic
tcaaatctaacataggtgaacaa

SEQ ID NO: 26720 - DNA, 22 bp, Artificial Sequence
  Synthetic
tgttaaggaaatgttttggctc

SEQ ID NO: 26721 - DNA, 21 bp, Artificial Sequence
  Synthetic
tgagctgtagtttctcaagtc

SEQ ID NO: 26722 - DNA, 18 bp, Artificial Sequence
  Synthetic
taatgtgtccgacttgcg

SEQ ID NO: 26723 - DNA, 20 bp, Artificial Sequence
  Synthetic
ctctgcccttatcttcaaga

SEQ ID NO: 26724 - DNA, 20 bp, Artificial Sequence
  Synthetic
catccctctttctcacagaa

SEQ ID NO: 26725 - DNA, 22 bp, Artificial Sequence
  Synthetic
ggtagtctggtatgaatcttct

SEQ ID NO: 26726 - DNA, 19 bp, Artificial Sequence
  Synthetic
cttggacaaaacagctgtt

SEQ ID NO: 26727 - DNA, 20 bp, Artificial Sequence
  Synthetic
atcacaccctatagctgaac

SEQ ID NO: 26728 - DNA, 21 bp, Artificial Sequence
  Synthetic
gcattatcccagttgactttc

SEQ ID NO: 26729 - DNA, 21 bp, Artificial Sequence
  Synthetic
agatcgacagtatgagaacaa

SEQ ID NO: 26730 - DNA, 23 bp, Artificial Sequence
  Synthetic
gcagcatacaatgtaattcttac

SEQ ID NO: 26731 - DNA, 23 bp, Artificial Sequence
  Synthetic
gttagaaatgtttgaatcgtcat

SEQ ID NO: 26732 - DNA, 22 bp, Artificial Sequence
  Synthetic
gaattttcagcttcatcttcga

SEQ ID NO: 26733 - DNA, 20 bp, Artificial Sequence
  Synthetic
gttgctgcttgatgacttac

SEQ ID NO: 26734 - DNA, 25 bp, Artificial Sequence
  Synthetic
gcattttcttttctgatattttccc

SEQ ID NO: 26735 - DNA, 18 bp, Artificial Sequence
  Synthetic
gtcgaaggaggaggagta

SEQ ID NO: 26736 - DNA, 19 bp, Artificial Sequence
  Synthetic
ttcggtctctcctcctcct

SEQ ID NO: 26737 - DNA, 22 bp, Artificial Sequence
  Synthetic
gtcagtgctatcaaatgcaata

SEQ ID NO: 26738 - DNA, 20 bp, Artificial Sequence
  Synthetic
ggattatacccagttgaccc

SEQ ID NO: 26739 - DNA, 24 bp, Artificial Sequence
  Synthetic
ctcttgtatctccactatctactg

SEQ ID NO: 26740 - DNA, 24 bp, Artificial Sequence
  Synthetic
acaaatacattcagatcagatgac

SEQ ID NO: 26741 - DNA, 18 bp, Artificial Sequence
  Synthetic
gcatcaaaggcgggattt

SEQ ID NO: 26742 - DNA, 24 bp, Artificial Sequence
  Synthetic
gataattcaatagcatcagcagta

SEQ ID NO: 26743 - DNA, 20 bp, Artificial Sequence
  Synthetic
gtagtacctataccaagcgg

SEQ ID NO: 26744 - DNA, 18 bp, Artificial Sequence
  Synthetic
tggtagagcatctcccat

SEQ ID NO: 26745 - DNA, 21 bp, Artificial Sequence
  Synthetic
tcaacaacccaaaaagacaaa

SEQ ID NO: 26746 - DNA, 23 bp, Artificial Sequence
  Synthetic
ggaaatttgaagaggatatgtcc

SEQ ID NO: 26747 - DNA, 16 bp, Artificial Sequence
  Synthetic
actgctgccgtgcgac

SEQ ID NO: 26748 - DNA, 21 bp, Artificial Sequence
  Synthetic
cttactgaacgacatcgaaat

SEQ ID NO: 26749 - DNA, 20 bp, Artificial Sequence
  Synthetic
actacattaacggtctccat

SEQ ID NO: 26750 - DNA, 16 bp, Artificial Sequence
  Synthetic
cgtcgcgcgaattcgg

SEQ ID NO: 26751 - DNA, 24 bp, Artificial Sequence
  Synthetic
gttcttgagtagtcatatgttctt

SEQ ID NO: 26752 - DNA, 19 bp, Artificial Sequence
  Synthetic
gtcttccttccgtaagtct

SEQ ID NO: 26753 - DNA, 20 bp, Artificial Sequence
  Synthetic
tgttggcattcattccattt

SEQ ID NO: 26754 - DNA, 21 bp, Artificial Sequence
  Synthetic
tcgctctaaattcttggagac

SEQ ID NO: 26755 - DNA, 19 bp, Artificial Sequence
  Synthetic
tttcttctatggcctctcc

SEQ ID NO: 26756 - DNA, 22 bp, Artificial Sequence
  Synthetic
gcaaaacacacaattaatttgc

SEQ ID NO: 26757 - DNA, 19 bp, Artificial Sequence
  Synthetic
tttctacttcacacagcgg

SEQ ID NO: 26758 - DNA, 22 bp, Artificial Sequence
  Synthetic
ggtcactatttggaaatgttgt

SEQ ID NO: 26759 - DNA, 19 bp, Artificial Sequence
  Synthetic
ccatgtcatacccactgtc

SEQ ID NO: 26760 - DNA, 18 bp, Artificial Sequence
  Synthetic
tggtttgaaacagccgtc

SEQ ID NO: 26761 - DNA, 18 bp, Artificial Sequence
  Synthetic
taccaagtaatgctgccc

SEQ ID NO: 26762 - DNA, 25 bp, Artificial Sequence
  Synthetic
gcatattgctatttaaaaatgctcg

SEQ ID NO: 26763 - DNA, 25 bp, Artificial Sequence
  Synthetic
cagtactgttttcttcataaagttc

SEQ ID NO: 26764 - DNA, 18 bp, Artificial Sequence
  Synthetic
ttctacagttttgccccg

SEQ ID NO: 26765 - DNA, 23 bp, Artificial Sequence
  Synthetic
actttaaacaattggattcacct

SEQ ID NO: 26766 - DNA, 23 bp, Artificial Sequence
  Synthetic
atgtacagttgtattacaccaat

SEQ ID NO: 26767 - DNA, 20 bp, Artificial Sequence
  Synthetic
catcattgctgtgtggtaac

SEQ ID NO: 26768 - DNA, 21 bp, Artificial Sequence
  Synthetic
tccccttcatatacagggtta

SEQ ID NO: 26769 - DNA, 19 bp, Artificial Sequence
  Synthetic
aaacagggcctgtaggtaa

SEQ ID NO: 26770 - DNA, 19 bp, Artificial Sequence
  Synthetic
cagttttgttagcccgttt

SEQ ID NO: 26771 - DNA, 20 bp, Artificial Sequence
  Synthetic
acatttgttccttccgtaga

SEQ ID NO: 26772 - DNA, 18 bp, Artificial Sequence
  Synthetic
atgttggtactgcgtgtg

SEQ ID NO: 26773 - DNA, 23 bp, Artificial Sequence
  Synthetic
aacagtaagagcaaaaaaatgtg

SEQ ID NO: 26774 - DNA, 16 bp, Artificial Sequence
  Synthetic
aggcctttcgcgaccc

SEQ ID NO: 26775 - DNA, 19 bp, Artificial Sequence
  Synthetic
tcttccacgaggttgcgac

SEQ ID NO: 26776 - DNA, 20 bp, Artificial Sequence
  Synthetic
cgaaagaagtgccaagagga

SEQ ID NO: 26777 - DNA, 20 bp, Artificial Sequence
  Synthetic
ccccaccatcaaatccacat

SEQ ID NO: 26778 - DNA, 20 bp, Artificial Sequence
  Synthetic
caacccctgcaaagaggaat

SEQ ID NO: 26779 - DNA, 16 bp, Artificial Sequence
  Synthetic
atcccgcatggccgag

SEQ ID NO: 26780 - DNA, 18 bp, Artificial Sequence
  Synthetic
cctgaagcaatcggtggg

SEQ ID NO: 26781 - DNA, 18 bp, Artificial Sequence
  Synthetic
atcaagccggtggagagg

SEQ ID NO: 26782 - DNA, 16 bp, Artificial Sequence
  Synthetic
gacaacgatggcgccg

SEQ ID NO: 26783 - DNA, 20 bp, Artificial Sequence
  Synthetic
gccctaagatggccagaaga

SEQ ID NO: 26784 - DNA, 20 bp, Artificial Sequence
  Synthetic
gtctccacccctttgatgtt

SEQ ID NO: 26785 - DNA, 19 bp, Artificial Sequence
  Synthetic
gattgacaggtcccttcgg

SEQ ID NO: 26786 - DNA, 16 bp, Artificial Sequence
  Synthetic
ggtgcgtgtaggtgcg

SEQ ID NO: 26787 - DNA, 18 bp, Artificial Sequence
  Synthetic
atgtcgtatgcccctccg

SEQ ID NO: 26788 - DNA, 20 bp, Artificial Sequence
  Synthetic
ctctgtagtaggctacggca

SEQ ID NO: 26789 - DNA, 20 bp, Artificial Sequence
  Synthetic
gcagtgtcaaacatgcctga

SEQ ID NO: 26790 - DNA, 18 bp, Artificial Sequence
  Synthetic
tctgtagaggaggggcgt

SEQ ID NO: 26791 - DNA, 20 bp, Artificial Sequence
  Synthetic
cctaaggccttctgcttgaa

SEQ ID NO: 26792 - DNA, 18 bp, Artificial Sequence
  Synthetic
ttttgccaaggcccacac

SEQ ID NO: 26793 - DNA, 17 bp, Artificial Sequence
  Synthetic
acacgtgattgcctcgc

SEQ ID NO: 26794 - DNA, 18 bp, Artificial Sequence
  Synthetic
acctgccagatctgctcc

SEQ ID NO: 26795 - DNA, 20 bp, Artificial Sequence
  Synthetic
ttgtgatcccactacgaacg

SEQ ID NO: 26796 - DNA, 20 bp, Artificial Sequence
  Synthetic
agacccccacaagaggttag

SEQ ID NO: 26797 - DNA, 20 bp, Artificial Sequence
  Synthetic
gccaaagcggtagaaacaac

SEQ ID NO: 26798 - DNA, 20 bp, Artificial Sequence
  Synthetic
tgaattgctcagggggctaa

SEQ ID NO: 26799 - DNA, 20 bp, Artificial Sequence
  Synthetic
tggccatgattgttgttgga

SEQ ID NO: 26800 - DNA, 18 bp, Artificial Sequence
  Synthetic
atgactttgcgggcttcg

SEQ ID NO: 26801 - DNA, 16 bp, Artificial Sequence
  Synthetic
agcgtcacctggggga

SEQ ID NO: 26802 - DNA, 18 bp, Artificial Sequence
  Synthetic
ggtcgggcatgagacatg

SEQ ID NO: 26803 - DNA, 21 bp, Artificial Sequence
  Synthetic
ttgattttcgtgagatccact

SEQ ID NO: 26804 - DNA, 19 bp, Artificial Sequence
  Synthetic
cataacacacaacagcgtt

SEQ ID NO: 26805 - DNA, 22 bp, Artificial Sequence
  Synthetic
tactgtgtaacctgatcttcct

SEQ ID NO: 26806 - DNA, 20 bp, Artificial Sequence
  Synthetic
gtgatccagaccaatgtgta

SEQ ID NO: 26807 - DNA, 25 bp, Artificial Sequence
  Synthetic
gaagtataagagaagtttgatacca

SEQ ID NO: 26808 - DNA, 20 bp, Artificial Sequence
  Synthetic
gggactttttgtgtgtgttt

SEQ ID NO: 26809 - DNA, 22 bp, Artificial Sequence
  Synthetic
taaggcacactaaaccttgatg

SEQ ID NO: 26810 - DNA, 23 bp, Artificial Sequence
  Synthetic
cctttcctcttcttaattactgg

SEQ ID NO: 26811 - DNA, 20 bp, Artificial Sequence
  Synthetic
acttgggtaataagggcttc

SEQ ID NO: 26812 - DNA, 18 bp, Artificial Sequence
  Synthetic
agtgaacccgacaccaaa

SEQ ID NO: 26813 - DNA, 20 bp, Artificial Sequence
  Synthetic
actttctgaaccatccatca

SEQ ID NO: 26814 - DNA, 20 bp, Artificial Sequence
  Synthetic
catcaaagtgcttgggatct

SEQ ID NO: 26815 - DNA, 23 bp, Artificial Sequence
  Synthetic
tgcaaacatatatctaggtcaaa

SEQ ID NO: 26816 - DNA, 21 bp, Artificial Sequence
  Synthetic
accaaagatcttaccagtagc

SEQ ID NO: 26817 - DNA, 25 bp, Artificial Sequence
  Synthetic
cccttgtacttagagaataatgatt

SEQ ID NO: 26818 - DNA, 19 bp, Artificial Sequence
  Synthetic
cacatcaggatcacaaccc

SEQ ID NO: 26819 - DNA, 23 bp, Artificial Sequence
  Synthetic
atgtatatctttcatgggcataa

SEQ ID NO: 26820 - DNA, 20 bp, Artificial Sequence
  Synthetic
tcgaccgaaatccacgaaag

SEQ ID NO: 26821 - DNA, 19 bp, Artificial Sequence
  Synthetic
gcataaaagcgctcgtggt

SEQ ID NO: 26822 - DNA, 19 bp, Artificial Sequence
  Synthetic
atcgtcaagcactgcgtac

SEQ ID NO: 26823 - DNA, 18 bp, Artificial Sequence
  Synthetic
cactgccaagctggacac

SEQ ID NO: 26824 - DNA, 18 bp, Artificial Sequence
  Synthetic
gaacgcctgcagatcgac

SEQ ID NO: 26825 - DNA, 21 bp, Artificial Sequence
  Synthetic
gcttcaaattttgcactaagc

SEQ ID NO: 26826 - DNA, 18 bp, Artificial Sequence
  Synthetic
gtcacgaaaaagcagtcg

SEQ ID NO: 26827 - DNA, 18 bp, Artificial Sequence
  Synthetic
ttaaggagctctgcgtcc

SEQ ID NO: 26828 - DNA, 25 bp, Artificial Sequence
  Synthetic
gagtcttctgttaattgattgtcat

SEQ ID NO: 26829 - DNA, 19 bp, Artificial Sequence
  Synthetic
tccatctaatgcatttcgc

SEQ ID NO: 26830 - DNA, 18 bp, Artificial Sequence
  Synthetic
agtgcttgcctcctcctg

SEQ ID NO: 26831 - DNA, 18 bp, Artificial Sequence
  Synthetic
taatggattagcaggccc

SEQ ID NO: 26832 - DNA, 18 bp, Artificial Sequence
  Synthetic
atcaccaccttggacaca

SEQ ID NO: 26833 - DNA, 19 bp, Artificial Sequence
  Synthetic
gcaacaggaaggacgtctg

SEQ ID NO: 26834 - DNA, 20 bp, Artificial Sequence
  Synthetic
tctgatataaatctcgcgcc

SEQ ID NO: 26835 - DNA, 18 bp, Artificial Sequence
  Synthetic
taagcggcttacacgaat

SEQ ID NO: 26836 - DNA, 21 bp, Artificial Sequence
  Synthetic
cacatggtttagctaaatccc

SEQ ID NO: 26837 - DNA, 24 bp, Artificial Sequence
  Synthetic
tactccatctttacaaaacatgtg

SEQ ID NO: 26838 - DNA, 18 bp, Artificial Sequence
  Synthetic
aagttcgtttccccatgc

SEQ ID NO: 26839 - DNA, 22 bp, Artificial Sequence
  Synthetic
ggagtactggatgtataggtat

SEQ ID NO: 26840 - DNA, 21 bp, Artificial Sequence
  Synthetic
acaaagtaaagtgtgccaaat

SEQ ID NO: 26841 - DNA, 19 bp, Artificial Sequence
  Synthetic
gctggatgggatggttcca

SEQ ID NO: 26842 - DNA, 18 bp, Artificial Sequence
  Synthetic
gcagtaagtgcggtcagc

SEQ ID NO: 26843 - DNA, 16 bp, Artificial Sequence
  Synthetic
accacaacgcgcctgc

SEQ ID NO: 26844 - DNA, 20 bp, Artificial Sequence
  Synthetic
tggaaatagggagggggtac

SEQ ID NO: 26845 - DNA, 18 bp, Artificial Sequence
  Synthetic
cttctgagcatgctcccg

SEQ ID NO: 26846 - DNA, 20 bp, Artificial Sequence
  Synthetic
ggttgtaggaaacaggtgca

SEQ ID NO: 26847 - DNA, 18 bp, Artificial Sequence
  Synthetic
tttactgtggcggtcagc

SEQ ID NO: 26848 - DNA, 16 bp, Artificial Sequence
  Synthetic
cgggggcaaaaaccgc

SEQ ID NO: 26849 - DNA, 20 bp, Artificial Sequence
  Synthetic
tggtcaacattagacgcgtt

SEQ ID NO: 26850 - DNA, 18 bp, Artificial Sequence
  Synthetic
gcacctggtatatgccgg

SEQ ID NO: 26851 - DNA, 16 bp, Artificial Sequence
  Synthetic
actgcacaacgccggg

SEQ ID NO: 26852 - DNA, 16 bp, Artificial Sequence
  Synthetic
aaggtggacggtggcg

SEQ ID NO: 26853 - DNA, 17 bp, Artificial Sequence
  Synthetic
gttggcggccttagctg

SEQ ID NO: 26854 - DNA, 18 bp, Artificial Sequence
  Synthetic
attggcgtcaggattgcc

SEQ ID NO: 26855 - DNA, 18 bp, Artificial Sequence
  Synthetic
gtctcccccgtggtgaat

SEQ ID NO: 26856 - DNA, 20 bp, Artificial Sequence
  Synthetic
catccacacacatctgagct

SEQ ID NO: 26857 - DNA, 16 bp, Artificial Sequence
  Synthetic
agcgaccgcggttagc

SEQ ID NO: 26858 - DNA, 17 bp, Artificial Sequence
  Synthetic
tggtgagctcggcagtc

SEQ ID NO: 26859 - DNA, 19 bp, Artificial Sequence
  Synthetic
tgtgaccttggtccagtcg

SEQ ID NO: 26860 - DNA, 19 bp, Artificial Sequence
  Synthetic
tcctcaagcaatgctagcg

SEQ ID NO: 26861 - DNA, 21 bp, Artificial Sequence
  Synthetic
ttaaaaaatccgttggtcgtc

SEQ ID NO: 26862 - DNA, 23 bp, Artificial Sequence
  Synthetic
caaacatctttgaattgtttcca

SEQ ID NO: 26863 - DNA, 20 bp, Artificial Sequence
  Synthetic
attgaagtttggtttacgcg

SEQ ID NO: 26864 - DNA, 19 bp, Artificial Sequence
  Synthetic
catacgaaactgtgcaagc

SEQ ID NO: 26865 - DNA, 22 bp, Artificial Sequence
  Synthetic
ggaatacgttcaattaaagctc

SEQ ID NO: 26866 - DNA, 19 bp, Artificial Sequence
  Synthetic
cgatgtacggcaaatcaat

SEQ ID NO: 26867 - DNA, 18 bp, Artificial Sequence
  Synthetic
taggccaacgttttccac

SEQ ID NO: 26868 - DNA, 18 bp, Artificial Sequence
  Synthetic
agtaaatttgggacgccg

SEQ ID NO: 26869 - DNA, 20 bp, Artificial Sequence
  Synthetic
aagccagtttttcattggtg

SEQ ID NO: 26870 - DNA, 21 bp, Artificial Sequence
  Synthetic
aaggctgttatcatctgatcg

SEQ ID NO: 26871 - DNA, 20 bp, Artificial Sequence
  Synthetic
agccctgaattaaaaaaggc

SEQ ID NO: 26872 - DNA, 20 bp, Artificial Sequence
  Synthetic
atgttacaaaatacgcacgc

SEQ ID NO: 26873 - DNA, 17 bp, Artificial Sequence
  Synthetic
tcggtggcgctgtatgc

SEQ ID NO: 26874 - DNA, 17 bp, Artificial Sequence
  Synthetic
acaccgtgtgtacccgc

SEQ ID NO: 26875 - DNA, 19 bp, Artificial Sequence
  Synthetic
gataattcccccggtgtcg

SEQ ID NO: 26876 - DNA, 16 bp, Artificial Sequence
  Synthetic
tcggacagcgttcccg

SEQ ID NO: 26877 - DNA, 22 bp, Artificial Sequence
  Synthetic
cagtatttgtctacagccttct

SEQ ID NO: 26878 - DNA, 18 bp, Artificial Sequence
  Synthetic
gcctgatgtaccatttgc

SEQ ID NO: 26879 - DNA, 21 bp, Artificial Sequence
  Synthetic
catcctatttgttcctgaagg

SEQ ID NO: 26880 - DNA, 19 bp, Artificial Sequence
  Synthetic
agccaaaactcttgcctta

SEQ ID NO: 26881 - DNA, 25 bp, Artificial Sequence
  Synthetic
tgtattgatagataactatgtctgg

SEQ ID NO: 26882 - DNA, 23 bp, Artificial Sequence
  Synthetic
aggagtttacataattgccttac

SEQ ID NO: 26883 - DNA, 18 bp, Artificial Sequence
  Synthetic
actcaggaatccaggtgg

SEQ ID NO: 26884 - DNA, 20 bp, Artificial Sequence
  Synthetic
ctgacatttatcacagctgg

SEQ ID NO: 26885 - DNA, 18 bp, Artificial Sequence
  Synthetic
attcctgcttgattcccg

SEQ ID NO: 26886 - DNA, 20 bp, Artificial Sequence
  Synthetic
aaatgccagtctctttctcc

SEQ ID NO: 26887 - DNA, 18 bp, Artificial Sequence
  Synthetic
ttctggggcttgttccat

SEQ ID NO: 26888 - DNA, 19 bp, Artificial Sequence
  Synthetic
tctgtcgagtaacgcctat

SEQ ID NO: 26889 - DNA, 18 bp, Artificial Sequence
  Synthetic
tacttcttgtgggttggg

SEQ ID NO: 26890 - DNA, 21 bp, Artificial Sequence
  Synthetic
tgtccgtgaaattgacagatc

SEQ ID NO: 26891 - DNA, 20 bp, Artificial Sequence
  Synthetic
cacttctccaattgtccctc

SEQ ID NO: 26892 - DNA, 20 bp, Artificial Sequence
  Synthetic
ggtatctttccacagccagg

SEQ ID NO: 26893 - DNA, 19 bp, Artificial Sequence
  Synthetic
ggaaaacccacctcctcct

SEQ ID NO: 26894 - DNA, 18 bp, Artificial Sequence
  Synthetic
tgcaggatctgagggctc

SEQ ID NO: 26895 - DNA, 20 bp, Artificial Sequence
  Synthetic
gcctcgaacatctccgtgtc

SEQ ID NO: 26896 - DNA, 17 bp, Artificial Sequence
  Synthetic
ccatggccatcaacgcc

SEQ ID NO: 26897 - DNA, 16 bp, Artificial Sequence
  Synthetic
agggcctttctggggc

SEQ ID NO: 26898 - DNA, 17 bp, Artificial Sequence
  Synthetic
ttaagcacctgggcccg

SEQ ID NO: 26899 - DNA, 16 bp, Artificial Sequence
  Synthetic
aacagccaggtcgcgg

SEQ ID NO: 26900 - DNA, 20 bp, Artificial Sequence
  Synthetic
aagttacatcaccaacccgg

SEQ ID NO: 26901 - DNA, 18 bp, Artificial Sequence
  Synthetic
cggcgtatctcatcaccg

SEQ ID NO: 26902 - DNA, 20 bp, Artificial Sequence
  Synthetic
ccgctagagtacgagatcga

SEQ ID NO: 26903 - DNA, 16 bp, Artificial Sequence
  Synthetic
aagggagacgcgtggc

SEQ ID NO: 26904 - DNA, 18 bp, Artificial Sequence
  Synthetic
gcaaaacagggccgagag

SEQ ID NO: 26905 - DNA, 18 bp, Artificial Sequence
  Synthetic
cctggcccatgatgcagg

SEQ ID NO: 26906 - DNA, 19 bp, Artificial Sequence
  Synthetic
cgaacctttagccccgagg

SEQ ID NO: 26907 - DNA, 20 bp, Artificial Sequence
  Synthetic
ggcggctttacgaccactac

SEQ ID NO: 26908 - DNA, 19 bp, Artificial Sequence
  Synthetic
catgaactacgggccggac

SEQ ID NO: 26909 - DNA, 17 bp, Artificial Sequence
  Synthetic
cgttgccaggttctgcc

SEQ ID NO: 26910 - DNA, 16 bp, Artificial Sequence
  Synthetic
cgaaacagccgcctgg

SEQ ID NO: 26911 - DNA, 18 bp, Artificial Sequence
  Synthetic
caccggagctctcggtaa

SEQ ID NO: 26912 - DNA, 20 bp, Artificial Sequence
  Synthetic
aaaagagtggtttgccgtgg

SEQ ID NO: 26913 - DNA, 18 bp, Artificial Sequence
  Synthetic
ccagaccctgcagctaca

SEQ ID NO: 26914 - DNA, 17 bp, Artificial Sequence
  Synthetic
ccgtagtctccgcgaga

SEQ ID NO: 26915 - DNA, 17 bp, Artificial Sequence
  Synthetic
accggggaaacaggcac

SEQ ID NO: 26916 - DNA, 16 bp, Artificial Sequence
  Synthetic
tcagcctcgcagaccc

SEQ ID NO: 26917 - DNA, 18 bp, Artificial Sequence
  Synthetic
gcttcatggagggcagcc

SEQ ID NO: 26918 - DNA, 19 bp, Artificial Sequence
  Synthetic
cggatctggtggccatagg

SEQ ID NO: 26919 - DNA, 16 bp, Artificial Sequence
  Synthetic
gttggtcgggttgccc

SEQ ID NO: 26920 - DNA, 16 bp, Artificial Sequence
  Synthetic
agccccggatcctcgt

SEQ ID NO: 26921 - DNA, 18 bp, Artificial Sequence
  Synthetic
gagggcgggttcatcctg

SEQ ID NO: 26922 - DNA, 16 bp, Artificial Sequence
  Synthetic
tcctggagtcggcgac

SEQ ID NO: 26923 - DNA, 16 bp, Artificial Sequence
  Synthetic
atcgcgatcgggggag

SEQ ID NO: 26924 - DNA, 16 bp, Artificial Sequence
  Synthetic
tccaatccggacgccc

SEQ ID NO: 26925 - DNA, 20 bp, Artificial Sequence
  Synthetic
gggctacgtgtacttcgagg

SEQ ID NO: 26926 - DNA, 16 bp, Artificial Sequence
  Synthetic
acagcttcgcccagcc

SEQ ID NO: 26927 - DNA, 18 bp, Artificial Sequence
  Synthetic
ctttcccaacggcaagcc

SEQ ID NO: 26928 - DNA, 18 bp, Artificial Sequence
  Synthetic
gtacgtatggcgctgagc

SEQ ID NO: 26929 - DNA, 17 bp, Artificial Sequence
  Synthetic
ggcaggtcacacatggc

SEQ ID NO: 26930 - DNA, 19 bp, Artificial Sequence
  Synthetic
gcaccatcgagctgtacaa

SEQ ID NO: 26931 - DNA, 16 bp, Artificial Sequence
  Synthetic
tgctccgccgtgatcg

SEQ ID NO: 26932 - DNA, 16 bp, Artificial Sequence
  Synthetic
tgcgaacggcgtcctc

SEQ ID NO: 26933 - DNA, 20 bp, Artificial Sequence
  Synthetic
ccaacaatctgtcgacagga

SEQ ID NO: 26934 - DNA, 16 bp, Artificial Sequence
  Synthetic
atacaggcgggcggac

SEQ ID NO: 26935 - DNA, 18 bp, Artificial Sequence
  Synthetic
ttccaggtacacgcacgc

SEQ ID NO: 26936 - DNA, 19 bp, Artificial Sequence
  Synthetic
gttcaggtcccggaactcg

SEQ ID NO: 26937 - DNA, 17 bp, Artificial Sequence
  Synthetic
tggggcacaccggaatc

SEQ ID NO: 26938 - DNA, 20 bp, Artificial Sequence
  Synthetic
cgacaggaaggcaaacagaa

SEQ ID NO: 26939 - DNA, 17 bp, Artificial Sequence
  Synthetic
tcgtgcaggtccccaac

SEQ ID NO: 26940 - DNA, 20 bp, Artificial Sequence
  Synthetic
tggaaaagaagacaaccggc

SEQ ID NO: 26941 - DNA, 16 bp, Artificial Sequence
  Synthetic
agacgctgcagcaggg

SEQ ID NO: 26942 - DNA, 19 bp, Artificial Sequence
  Synthetic
ctgccggggtaaaatccac

SEQ ID NO: 26943 - DNA, 17 bp, Artificial Sequence
  Synthetic
atacaacggctcggccc

SEQ ID NO: 26944 - DNA, 16 bp, Artificial Sequence
  Synthetic
cggtccaacagcaccg

SEQ ID NO: 26945 - DNA, 16 bp, Artificial Sequence
  Synthetic
tccgtcagggtctcgc

SEQ ID NO: 26946 - DNA, 18 bp, Artificial Sequence
  Synthetic
gcaggcggttgttatcgc

SEQ ID NO: 26947 - DNA, 19 bp, Artificial Sequence
  Synthetic
caaaagataggtcgccggg

SEQ ID NO: 26948 - DNA, 17 bp, Artificial Sequence
  Synthetic
gcccacgatgacgccaa

SEQ ID NO: 26949 - DNA, 16 bp, Artificial Sequence
  Synthetic
ataactccgcgcggcc

SEQ ID NO: 26950 - DNA, 16 bp, Artificial Sequence
  Synthetic
tagtggtcggcgtggg

SEQ ID NO: 26951 - DNA, 16 bp, Artificial Sequence
  Synthetic
cccaccacaacacggc

SEQ ID NO: 26952 - DNA, 16 bp, Artificial Sequence
  Synthetic
acggacgagatcgccc

SEQ ID NO: 26953 - DNA, 18 bp, Artificial Sequence
  Synthetic
gaacgcagctgtcttcgc

SEQ ID NO: 26954 - DNA, 17 bp, Artificial Sequence
  Synthetic
tgggtcgtgccatccga

SEQ ID NO: 26955 - DNA, 17 bp, Artificial Sequence
  Synthetic
aacacgcttcaccccgg

SEQ ID NO: 26956 - DNA, 19 bp, Artificial Sequence
  Synthetic
tgtacgtgtgctttcgggc

SEQ ID NO: 26957 - DNA, 18 bp, Artificial Sequence
  Synthetic
tcgcaggagccgtagtcc

SEQ ID NO: 26958 - DNA, 20 bp, Artificial Sequence
  Synthetic
cgagtcgaaatcccacacag

SEQ ID NO: 26959 - DNA, 18 bp, Artificial Sequence
  Synthetic
aaggtcgctgaggctctg

SEQ ID NO: 26960 - DNA, 21 bp, Artificial Sequence
  Synthetic
caatttcttgcaggtcaacac

SEQ ID NO: 26961 - DNA, 19 bp, Artificial Sequence
  Synthetic
gccattctgctcgacacag

SEQ ID NO: 26962 - DNA, 23 bp, Artificial Sequence
  Synthetic
gaacagtataatgccatcattgt

SEQ ID NO: 26963 - DNA, 18 bp, Artificial Sequence
  Synthetic
cagatcgttgtccagtgc

SEQ ID NO: 26964 - DNA, 21 bp, Artificial Sequence
  Synthetic
tgatacctcagaaaatgcaca

SEQ ID NO: 26965 - DNA, 18 bp, Artificial Sequence
  Synthetic
atgttttggtccgcgtac

SEQ ID NO: 26966 - DNA, 19 bp, Artificial Sequence
  Synthetic
acagactcgtggtcaatgt

SEQ ID NO: 26967 - DNA, 16 bp, Artificial Sequence
  Synthetic
ttaggggctggggcga

SEQ ID NO: 26968 - DNA, 18 bp, Artificial Sequence
  Synthetic
aacatcgggtggacaatc

SEQ ID NO: 26969 - DNA, 16 bp, Artificial Sequence
  Synthetic
acacggggtgccatgg

SEQ ID NO: 26970 - DNA, 20 bp, Artificial Sequence
  Synthetic
atcgctcctgtataggcaca

SEQ ID NO: 26971 - DNA, 20 bp, Artificial Sequence
  Synthetic
agcctacctgaacaccagag

SEQ ID NO: 26972 - DNA, 25 bp, Artificial Sequence
  Synthetic
gcagttaataaatctatttcctgca

SEQ ID NO: 26973 - DNA, 18 bp, Artificial Sequence
  Synthetic
gaccacctctttgccatc

SEQ ID NO: 26974 - DNA, 18 bp, Artificial Sequence
  Synthetic
agcagctgtgtttgctta

SEQ ID NO: 26975 - DNA, 21 bp, Artificial Sequence
  Synthetic
cacaatatctaatggggcatc

SEQ ID NO: 26976 - DNA, 20 bp, Artificial Sequence
  Synthetic
aaattctcaggggtaaggtc

SEQ ID NO: 26977 - DNA, 21 bp, Artificial Sequence
  Synthetic
gaaacaaaaacttcctgccaa

SEQ ID NO: 26978 - DNA, 19 bp, Artificial Sequence
  Synthetic
cgcctaaatccttgcgctt

SEQ ID NO: 26979 - DNA, 18 bp, Artificial Sequence
  Synthetic
aaaggccccaatacctcc

SEQ ID NO: 26980 - DNA, 22 bp, Artificial Sequence
  Synthetic
gatttgtagcttcatcttcctc

SEQ ID NO: 26981 - DNA, 25 bp, Artificial Sequence
  Synthetic
cttttctagcatagtataaagtcac

SEQ ID NO: 26982 - DNA, 20 bp, Artificial Sequence
  Synthetic
gcagcaggtgtaataggttt

SEQ ID NO: 26983 - DNA, 19 bp, Artificial Sequence
  Synthetic
aaaatctggatctggtgca

SEQ ID NO: 26984 - DNA, 23 bp, Artificial Sequence
  Synthetic
actttctgcaagattatccacta

SEQ ID NO: 26985 - DNA, 23 bp, Artificial Sequence
  Synthetic
ctaactttaggaacttctacagc

SEQ ID NO: 26986 - DNA, 19 bp, Artificial Sequence
  Synthetic
atcatgtgctacgtccatg

SEQ ID NO: 26987 - DNA, 18 bp, Artificial Sequence
  Synthetic
ctcaaactcaaaccgtgc

SEQ ID NO: 26988 - DNA, 20 bp, Artificial Sequence
  Synthetic
tgatatcacgcaaagtaggt

SEQ ID NO: 26989 - DNA, 18 bp, Artificial Sequence
  Synthetic
gatctgccatggcgatag

SEQ ID NO: 26990 - DNA, 19 bp, Artificial Sequence
  Synthetic
gtcttctgtaacctgctgg

SEQ ID NO: 26991 - DNA, 20 bp, Artificial Sequence
  Synthetic
actacaccgtaacagttcaa

SEQ ID NO: 26992 - DNA, 21 bp, Artificial Sequence
  Synthetic
catctgcagctaaagcataat

SEQ ID NO: 26993 - DNA, 18 bp, Artificial Sequence
  Synthetic
tcgaaacgctctgtcaga

SEQ ID NO: 26994 - DNA, 20 bp, Artificial Sequence
  Synthetic
gaggtttccgaagacgagga

SEQ ID NO: 26995 - DNA, 20 bp, Artificial Sequence
  Synthetic
agtttgcaggaccttgaaca

SEQ ID NO: 26996 - DNA, 18 bp, Artificial Sequence
  Synthetic
atcaggagggcatgtacc

SEQ ID NO: 26997 - DNA, 20 bp, Artificial Sequence
  Synthetic
tgtctagagggacaccaaat

SEQ ID NO: 26998 - DNA, 23 bp, Artificial Sequence
  Synthetic
aaggtgtaatttctaataaggct

SEQ ID NO: 26999 - DNA, 21 bp, Artificial Sequence
  Synthetic
ccataaagttctctgggtctt

SEQ ID NO: 27000 - DNA, 18 bp, Artificial Sequence
  Synthetic
cgtatatttccgctgggc

SEQ ID NO: 27001 - DNA, 20 bp, Artificial Sequence
  Synthetic
cttcacgaaacacatcatcc

SEQ ID NO: 27002 - DNA, 24 bp, Artificial Sequence
  Synthetic
cattctgcctattatcattaccag

SEQ ID NO: 27003 - DNA, 21 bp, Artificial Sequence
  Synthetic
ggccatttgcaagtttgatta

SEQ ID NO: 27004 - DNA, 20 bp, Artificial Sequence
  Synthetic
agctgacaacatgtatgagg

SEQ ID NO: 27005 - DNA, 18 bp, Artificial Sequence
  Synthetic
actcccggtacatgagtg

SEQ ID NO: 27006 - DNA, 18 bp, Artificial Sequence
  Synthetic
aatttgctgctcattgcc

SEQ ID NO: 27007 - DNA, 20 bp, Artificial Sequence
  Synthetic
tcctttctgctgaataaagc

SEQ ID NO: 27008 - DNA, 21 bp, Artificial Sequence
  Synthetic
ttgttatggccgttttctcat

SEQ ID NO: 27009 - DNA, 24 bp, Artificial Sequence
  Synthetic
ccacatcaattaaatcttgtcttg

SEQ ID NO: 27010 - DNA, 23 bp, Artificial Sequence
  Synthetic
ttttcaggtaaatcaagcaatga

SEQ ID NO: 27011 - DNA, 21 bp, Artificial Sequence
  Synthetic
cgcaactggtatctatttgga

SEQ ID NO: 27012 - DNA, 20 bp, Artificial Sequence
  Synthetic
ctgtcatcgaataagcgtct

SEQ ID NO: 27013 - DNA, 22 bp, Artificial Sequence
  Synthetic
tttagtatcttgcaatggttgt

SEQ ID NO: 27014 - DNA, 23 bp, Artificial Sequence
  Synthetic
ccaagtctattatagccactctt

SEQ ID NO: 27015 - DNA, 18 bp, Artificial Sequence
  Synthetic
atcccacctgcgaaggag

SEQ ID NO: 27016 - DNA, 18 bp, Artificial Sequence
  Synthetic
aatacctgttgtgccctc

SEQ ID NO: 27017 - DNA, 25 bp, Artificial Sequence
  Synthetic
caatttcacctgtaatattagcatc

SEQ ID NO: 27018 - DNA, 18 bp, Artificial Sequence
  Synthetic
aatctggatcaggagccg

SEQ ID NO: 27019 - DNA, 23 bp, Artificial Sequence
  Synthetic
ctactgtatgcccagataaaatt

SEQ ID NO: 27020 - DNA, 22 bp, Artificial Sequence
  Synthetic
tttcatagtagggatggtctac

SEQ ID NO: 27021 - DNA, 23 bp, Artificial Sequence
  Synthetic
gctttgttaaataaaggatgacc

SEQ ID NO: 27022 - DNA, 21 bp, Artificial Sequence
  Synthetic
agttcttaaaatttgctgccc

SEQ ID NO: 27023 - DNA, 20 bp, Artificial Sequence
  Synthetic
agcatttgtaggtggcaata

SEQ ID NO: 27024 - DNA, 22 bp, Artificial Sequence
  Synthetic
tcttgcaaatcaactaaccaaa

SEQ ID NO: 27025 - DNA, 19 bp, Artificial Sequence
  Synthetic
cgccaaaataccagagacg

SEQ ID NO: 27026 - DNA, 23 bp, Artificial Sequence
  Synthetic
caaattaacaggcaataccaaat

SEQ ID NO: 27027 - DNA, 19 bp, Artificial Sequence
  Synthetic
agacagatcacaggcaatt

SEQ ID NO: 27028 - DNA, 19 bp, Artificial Sequence
  Synthetic
aagtccccaatagctctgt

SEQ ID NO: 27029 - DNA, 23 bp, Artificial Sequence
  Synthetic
ccaaataaatctttgaatttgcc

SEQ ID NO: 27030 - DNA, 23 bp, Artificial Sequence
  Synthetic
acattaaatctattcctccaaca

SEQ ID NO: 27031 - DNA, 18 bp, Artificial Sequence
  Synthetic
aagggtatgacatcagcg

SEQ ID NO: 27032 - DNA, 21 bp, Artificial Sequence
  Synthetic
gtctggatttctggtttgaac

SEQ ID NO: 27033 - DNA, 23 bp, Artificial Sequence
  Synthetic
ctggattataaactttgggatct

SEQ ID NO: 27034 - DNA, 21 bp, Artificial Sequence
  Synthetic
tcccaatgttctcctattgtg

SEQ ID NO: 27035 - DNA, 23 bp, Artificial Sequence
  Synthetic
gcagattttttagaaactgaagt

SEQ ID NO: 27036 - DNA, 18 bp, Artificial Sequence
  Synthetic
aggttgtaaagcgtccag

SEQ ID NO: 27037 - DNA, 20 bp, Artificial Sequence
  Synthetic
atcttcccatgttctaggtg

SEQ ID NO: 27038 - DNA, 18 bp, Artificial Sequence
  Synthetic
tgtcaaagttgctccacg

SEQ ID NO: 27039 - DNA, 18 bp, Artificial Sequence
  Synthetic
aatagggatcgagctggg

SEQ ID NO: 27040 - DNA, 20 bp, Artificial Sequence
  Synthetic
catgcgagtcttcacaccat

SEQ ID NO: 27041 - DNA, 18 bp, Artificial Sequence
  Synthetic
tatggtggaattgcccag

SEQ ID NO: 27042 - DNA, 23 bp, Artificial Sequence
  Synthetic
ctatgaaatttggtagcattgca

SEQ ID NO: 27043 - DNA, 25 bp, Artificial Sequence
  Synthetic
gtcctcaaatttataaattggtgag

SEQ ID NO: 27044 - DNA, 21 bp, Artificial Sequence
  Synthetic
gtctgtcatctgtagtgagaa

SEQ ID NO: 27045 - DNA, 20 bp, Artificial Sequence
  Synthetic
tcctgtgtacatgagtgaaa

SEQ ID NO: 27046 - DNA, 23 bp, Artificial Sequence
  Synthetic
cccagcactagtataagtatcag

SEQ ID NO: 27047 - DNA, 25 bp, Artificial Sequence
  Synthetic
gacttgaaaggttaattttccaatc

SEQ ID NO: 27048 - DNA, 20 bp, Artificial Sequence
  Synthetic
aaaagggacactaaacctgg

SEQ ID NO: 27049 - DNA, 18 bp, Artificial Sequence
  Synthetic
tctggggtagttagtgcg

SEQ ID NO: 27050 - DNA, 18 bp, Artificial Sequence
  Synthetic
agtacgagctaccctcaa

SEQ ID NO: 27051 - DNA, 20 bp, Artificial Sequence
  Synthetic
tgctctccctaaactggtaa

SEQ ID NO: 27052 - DNA, 22 bp, Artificial Sequence
  Synthetic
ttgtgacatttgttctaaccac

SEQ ID NO: 27053 - DNA, 22 bp, Artificial Sequence
  Synthetic
aatgttttggatcaggaggtaa

SEQ ID NO: 27054 - DNA, 18 bp, Artificial Sequence
  Synthetic
tgtgctgtgcatgcaaat

SEQ ID NO: 27055 - DNA, 25 bp, Artificial Sequence
  Synthetic
ggatctactagtttgtatttgtctt

SEQ ID NO: 27056 - DNA, 19 bp, Artificial Sequence
  Synthetic
tttttcctgttgtgcacaa

SEQ ID NO: 27057 - DNA, 21 bp, Artificial Sequence
  Synthetic
gtctagggtcattgtcattga

SEQ ID NO: 27058 - DNA, 24 bp, Artificial Sequence
  Synthetic
gaaatctgaatacatgaagcatac

SEQ ID NO: 27059 - DNA, 19 bp, Artificial Sequence
  Synthetic
tgggtcctcaatgcttaat

SEQ ID NO: 27060 - DNA, 18 bp, Artificial Sequence
  Synthetic
tgatgtacacccccttca

SEQ ID NO: 27061 - DNA, 25 bp, Artificial Sequence
  Synthetic
cttagaagcatatctcctatctcaa

SEQ ID NO: 27062 - DNA, 18 bp, Artificial Sequence
  Synthetic
ttcctccactcctttggg

SEQ ID NO: 27063 - DNA, 20 bp, Artificial Sequence
  Synthetic
ccattatccttttgtctgcc

SEQ ID NO: 27064 - DNA, 18 bp, Artificial Sequence
  Synthetic
ctaagatctgcatggccc

SEQ ID NO: 27065 - DNA, 19 bp, Artificial Sequence
  Synthetic
cgatatacacgctgcttgt

SEQ ID NO: 27066 - DNA, 21 bp, Artificial Sequence
  Synthetic
gttcttctgttgggttttgtc

SEQ ID NO: 27067 - DNA, 19 bp, Artificial Sequence
  Synthetic
cccactcactatcagttgg

SEQ ID NO: 27068 - DNA, 20 bp, Artificial Sequence
  Synthetic
tgtcaggcaatattccgatc

SEQ ID NO: 27069 - DNA, 24 bp, Artificial Sequence
  Synthetic
attgatatgtgttaactagcactg

SEQ ID NO: 27070 - DNA, 19 bp, Artificial Sequence
  Synthetic
acaggagaattgcctctca

SEQ ID NO: 27071 - DNA, 23 bp, Artificial Sequence
  Synthetic
aattgttactctatcacctttca

SEQ ID NO: 27072 - DNA, 18 bp, Artificial Sequence
  Synthetic
actcctctgcacactgta

SEQ ID NO: 27073 - DNA, 19 bp, Artificial Sequence
  Synthetic
actattacatgcggcactt

SEQ ID NO: 27074 - DNA, 18 bp, Artificial Sequence
  Synthetic
cgctctgcgtctgtgctt

SEQ ID NO: 27075 - DNA, 24 bp, Artificial Sequence
  Synthetic
ccaacactttaatgtattctgagg

SEQ ID NO: 27076 - DNA, 18 bp, Artificial Sequence
  Synthetic
aattgcaggccttactgg

SEQ ID NO: 27077 - DNA, 23 bp, Artificial Sequence
  Synthetic
ttgtacttgaacatctatctgag

SEQ ID NO: 27078 - DNA, 19 bp, Artificial Sequence
  Synthetic
gaagataaagccgtccagt

SEQ ID NO: 27079 - DNA, 24 bp, Artificial Sequence
  Synthetic
gcaaatttattaggatcaggtaac

SEQ ID NO: 27080 - DNA, 23 bp, Artificial Sequence
  Synthetic
ataaaaagctgattttgtttggg

SEQ ID NO: 27081 - DNA, 18 bp, Artificial Sequence
  Synthetic
gtcgtcctggcaattccg

SEQ ID NO: 27082 - DNA, 16 bp, Artificial Sequence
  Synthetic
agatgggcgcgccttg

SEQ ID NO: 27083 - DNA, 19 bp, Artificial Sequence
  Synthetic
ccacatgtttgcggaaccc

SEQ ID NO: 27084 - DNA, 20 bp, Artificial Sequence
  Synthetic
accttcaaccaattgcctga

SEQ ID NO: 27085 - DNA, 19 bp, Artificial Sequence
  Synthetic
gcatagtgccagcagtagg

SEQ ID NO: 27086 - DNA, 18 bp, Artificial Sequence
  Synthetic
gggcacaggagctggtta

SEQ ID NO: 27087 - DNA, 20 bp, Artificial Sequence
  Synthetic
atgaggacgacatactccca

SEQ ID NO: 27088 - DNA, 15 bp, Artificial Sequence
  Synthetic
aggtgcatgcgggca

SEQ ID NO: 27089 - DNA, 19 bp, Artificial Sequence
  Synthetic
gtcccagcagcaccaagtc

SEQ ID NO: 27090 - DNA, 18 bp, Artificial Sequence
  Synthetic
aagtgacctagcccccag

SEQ ID NO: 27091 - DNA, 19 bp, Artificial Sequence
  Synthetic
ggcgaggagttgtcggtaa

SEQ ID NO: 27092 - DNA, 17 bp, Artificial Sequence
  Synthetic
cgtagcgagcaccgtga

SEQ ID NO: 27093 - DNA, 18 bp, Artificial Sequence
  Synthetic
tctaccacctgcgtcacg

SEQ ID NO: 27094 - DNA, 20 bp, Artificial Sequence
  Synthetic
ggagtgtttaggtaggcacg

SEQ ID NO: 27095 - DNA, 20 bp, Artificial Sequence
  Synthetic
acttccaggtctgcagacat

SEQ ID NO: 27096 - DNA, 20 bp, Artificial Sequence
  Synthetic
ccacatgtgtttcctccaga

SEQ ID NO: 27097 - DNA, 19 bp, Artificial Sequence
  Synthetic
ccggcaaggatgtcaacaa

SEQ ID NO: 27098 - DNA, 18 bp, Artificial Sequence
  Synthetic
tctcgcagccatgaggac

SEQ ID NO: 27099 - DNA, 19 bp, Artificial Sequence
  Synthetic
gcacactagggctggtagt

SEQ ID NO: 27100 - DNA, 20 bp, Artificial Sequence
  Synthetic
cagtgagcattgacgtgact

SEQ ID NO: 27101 - DNA, 18 bp, Artificial Sequence
  Synthetic
tcgtatccgggcatttgc

SEQ ID NO: 27102 - DNA, 20 bp, Artificial Sequence
  Synthetic
ggggcattgagctaaaggat

SEQ ID NO: 27103 - DNA, 18 bp, Artificial Sequence
  Synthetic
tgcagatcccatcacggt

SEQ ID NO: 27104 - DNA, 19 bp, Artificial Sequence
  Synthetic
gatgttggctgccctacac

SEQ ID NO: 27105 - DNA, 20 bp, Artificial Sequence
  Synthetic
tgatgatgttgcccaaccac

SEQ ID NO: 27106 - DNA, 20 bp, Artificial Sequence
  Synthetic
accttgggcaatgagtttgg

SEQ ID NO: 27107 - DNA, 23 bp, Artificial Sequence
  Synthetic
ctttttcaattgctatgccattt

SEQ ID NO: 27108 - DNA, 23 bp, Artificial Sequence
  Synthetic
tttgctctgtttagttcatttcc

SEQ ID NO: 27109 - DNA, 20 bp, Artificial Sequence
  Synthetic
ctcctcttttgccttctctc

SEQ ID NO: 27110 - DNA, 18 bp, Artificial Sequence
  Synthetic
agagtaagtctggcagcc

SEQ ID NO: 27111 - DNA, 20 bp, Artificial Sequence
  Synthetic
gagaaagcactgttgaaact

SEQ ID NO: 27112 - DNA, 19 bp, Artificial Sequence
  Synthetic
tcatcttcttggcttgtcc

SEQ ID NO: 27113 - DNA, 24 bp, Artificial Sequence
  Synthetic
gctgttgaaattcaaataaagcag

SEQ ID NO: 27114 - DNA, 19 bp, Artificial Sequence
  Synthetic
aagatcgtctcctggaaca

SEQ ID NO: 27115 - DNA, 18 bp, Artificial Sequence
  Synthetic
cagttgctcgccaattag

SEQ ID NO: 27116 - DNA, 19 bp, Artificial Sequence
  Synthetic
aatcaaattggtctgcagc

SEQ ID NO: 27117 - DNA, 19 bp, Artificial Sequence
  Synthetic
aacatatacacaggctccc

SEQ ID NO: 27118 - DNA, 23 bp, Artificial Sequence
  Synthetic
atgtttcttttccaaatggtgat

SEQ ID NO: 27119 - DNA, 21 bp, Artificial Sequence
  Synthetic
gtggttctagagtaagagctg

SEQ ID NO: 27120 - DNA, 19 bp, Artificial Sequence
  Synthetic
ccccaacccatttaaacac

SEQ ID NO: 27121 - DNA, 20 bp, Artificial Sequence
  Synthetic
attatagctgatgcctctgg

SEQ ID NO: 27122 - DNA, 19 bp, Artificial Sequence
  Synthetic
ttcaaattgaacagcccga

SEQ ID NO: 27123 - DNA, 24 bp, Artificial Sequence
  Synthetic
ttcctaattcaggtggtaaactag

SEQ ID NO: 27124 - DNA, 25 bp, Artificial Sequence
  Synthetic
gatctattaaagcaaacttgttagg

SEQ ID NO: 27125 - DNA, 20 bp, Artificial Sequence
  Synthetic
gagcatgtggttcaggtatg

SEQ ID NO: 27126 - DNA, 18 bp, Artificial Sequence
  Synthetic
gtcctcaataccggatgg

SEQ ID NO: 27127 - DNA, 18 bp, Artificial Sequence
  Synthetic
tgtttgttttgacagccg

SEQ ID NO: 27128 - DNA, 18 bp, Artificial Sequence
  Synthetic
tatgaggcccatgcaact

SEQ ID NO: 27129 - DNA, 21 bp, Artificial Sequence
  Synthetic
atagactcaggtactccttcc

SEQ ID NO: 27130 - DNA, 21 bp, Artificial Sequence
  Synthetic
ctgtttctgcctgtgttaaat

SEQ ID NO: 27131 - DNA, 18 bp, Artificial Sequence
  Synthetic
ccccacttccaccactat

SEQ ID NO: 27132 - DNA, 25 bp, Artificial Sequence
  Synthetic
ttgtaataaatagcacattctaggc

SEQ ID NO: 27133 - DNA, 22 bp, Artificial Sequence
  Synthetic
gttactgatgcttcttcacaaa

SEQ ID NO: 27134 - DNA, 18 bp, Artificial Sequence
  Synthetic
aatgccctccagtttctg

SEQ ID NO: 27135 - DNA, 20 bp, Artificial Sequence
  Synthetic
gcaagtagtctggatgttcc

SEQ ID NO: 27136 - DNA, 25 bp, Artificial Sequence
  Synthetic
ccaatttatttaataaaggatggcc

SEQ ID NO: 27137 - DNA, 21 bp, Artificial Sequence
  Synthetic
aacttcacttttgttagcctg

SEQ ID NO: 27138 - DNA, 19 bp, Artificial Sequence
  Synthetic
tgtgctcgttgtaaccaat

SEQ ID NO: 27139 - DNA, 22 bp, Artificial Sequence
  Synthetic
tgtagcttttcgttttcctaat

SEQ ID NO: 27140 - DNA, 22 bp, Artificial Sequence
  Synthetic
taaaaaacaatggaatggttgg

SEQ ID NO: 27141 - DNA, 19 bp, Artificial Sequence
  Synthetic
tcccgaaaagcaaagtcat

SEQ ID NO: 27142 - DNA, 20 bp, Artificial Sequence
  Synthetic
cgtgttcttgatgatctgca

SEQ ID NO: 27143 - DNA, 18 bp, Artificial Sequence
  Synthetic
ttgtacgcacaaccgaag

SEQ ID NO: 27144 - DNA, 18 bp, Artificial Sequence
  Synthetic
agttgattcgcctcgttc

SEQ ID NO: 27145 - DNA, 25 bp, Artificial Sequence
  Synthetic
ctttctctaggtaatatatgtggac

SEQ ID NO: 27146 - DNA, 19 bp, Artificial Sequence
  Synthetic
tcctcaaagtccaccttct

SEQ ID NO: 27147 - DNA, 24 bp, Artificial Sequence
  Synthetic
ctgtatttatgtacactcccttca

SEQ ID NO: 27148 - DNA, 18 bp, Artificial Sequence
  Synthetic
cttggcctactgcagttc

SEQ ID NO: 27149 - DNA, 18 bp, Artificial Sequence
  Synthetic
aaggttctgcacaccttc

SEQ ID NO: 27150 - DNA, 21 bp, Artificial Sequence
  Synthetic
gcatcctttgtcattgtgttc

SEQ ID NO: 27151 - DNA, 20 bp, Artificial Sequence
  Synthetic
aattgtgaaggagagctctg

SEQ ID NO: 27152 - DNA, 23 bp, Artificial Sequence
  Synthetic
ctctcttgttgatttgttgaagt

SEQ ID NO: 27153 - DNA, 19 bp, Artificial Sequence
  Synthetic
acctatctactcctgcctg

SEQ ID NO: 27154 - DNA, 18 bp, Artificial Sequence
  Synthetic
cccctgtgacatcggtat

SEQ ID NO: 27155 - DNA, 22 bp, Artificial Sequence
  Synthetic
atttccttatgactgacaaacg

SEQ ID NO: 27156 - DNA, 22 bp, Artificial Sequence
  Synthetic
tcaataaatgggatacggagag

SEQ ID NO: 27157 - DNA, 23 bp, Artificial Sequence
  Synthetic
agaaacaacagctaacttttctg

SEQ ID NO: 27158 - DNA, 18 bp, Artificial Sequence
  Synthetic
gccttaacagctgatcgc

SEQ ID NO: 27159 - DNA, 23 bp, Artificial Sequence
  Synthetic
atctgatatgtcactttcagatc

SEQ ID NO: 27160 - DNA, 19 bp, Artificial Sequence
  Synthetic
ttgcctttttttccctctg

SEQ ID NO: 27161 - DNA, 20 bp, Artificial Sequence
  Synthetic
aactacagcatgtcttgttg

SEQ ID NO: 27162 - DNA, 19 bp, Artificial Sequence
  Synthetic
cttgtagccagtctaagcg

SEQ ID NO: 27163 - DNA, 22 bp, Artificial Sequence
  Synthetic
tggtgctaaaaagatttctctg

SEQ ID NO: 27164 - DNA, 20 bp, Artificial Sequence
  Synthetic
tctgagggtggtatctctgg

SEQ ID NO: 27165 - DNA, 19 bp, Artificial Sequence
  Synthetic
tttgtatatcaggggggca

SEQ ID NO: 27166 - DNA, 24 bp, Artificial Sequence
  Synthetic
aatattatcagatgctgaagcttc

SEQ ID NO: 27167 - DNA, 19 bp, Artificial Sequence
  Synthetic
gtaactaaggaagcaggcc

SEQ ID NO: 27168 - DNA, 19 bp, Artificial Sequence
  Synthetic
cgatgcagcaagagaactt

SEQ ID NO: 27169 - DNA, 18 bp, Artificial Sequence
  Synthetic
ttggtgatcggttgggta

SEQ ID NO: 27170 - DNA, 22 bp, Artificial Sequence
  Synthetic
ccaaactagtctctcagtttct

SEQ ID NO: 27171 - DNA, 25 bp, Artificial Sequence
  Synthetic
cctcaataactgtgttaactaattc

SEQ ID NO: 27172 - DNA, 21 bp, Artificial Sequence
  Synthetic
attcacatgtatattcaggcc

SEQ ID NO: 27173 - DNA, 18 bp, Artificial Sequence
  Synthetic
aacttcaaaattcgcgcg

SEQ ID NO: 27174 - DNA, 24 bp, Artificial Sequence
  Synthetic
cataatcactgagtttgagttcag

SEQ ID NO: 27175 - DNA, 22 bp, Artificial Sequence
  Synthetic
tgtttgaaattttcctttgagg

SEQ ID NO: 27176 - DNA, 20 bp, Artificial Sequence
  Synthetic
gaccacttggctgttttgga

SEQ ID NO: 27177 - DNA, 19 bp, Artificial Sequence
  Synthetic
cccagtatctgcttctcag

SEQ ID NO: 27178 - DNA, 19 bp, Artificial Sequence
  Synthetic
cccatttgaatgcctgtca

SEQ ID NO: 27179 - DNA, 25 bp, Artificial Sequence
  Synthetic
ccatcagtcattatagtaaaacatg

SEQ ID NO: 27180 - DNA, 25 bp, Artificial Sequence
  Synthetic
gtatcctatttgataatccaggttt

SEQ ID NO: 27181 - DNA, 20 bp, Artificial Sequence
  Synthetic
caatcagtcattgccacaac

SEQ ID NO: 27182 - DNA, 18 bp, Artificial Sequence
  Synthetic
gtcataggtttggcgacc

SEQ ID NO: 27183 - DNA, 25 bp, Artificial Sequence
  Synthetic
agtaattgtaaaagagagctctgta

SEQ ID NO: 27184 - DNA, 19 bp, Artificial Sequence
  Synthetic
tcaagtcaatgcttgcaag

SEQ ID NO: 27185 - DNA, 20 bp, Artificial Sequence
  Synthetic
cctgcttctattccctcatg

SEQ ID NO: 27186 - DNA, 20 bp, Artificial Sequence
  Synthetic
gtggcatcggtatgggtatc

SEQ ID NO: 27187 - DNA, 20 bp, Artificial Sequence
  Synthetic
tcttgcagtgaagtgttcag

SEQ ID NO: 27188 - DNA, 18 bp, Artificial Sequence
  Synthetic
ttcaacggtttctggcac

SEQ ID NO: 27189 - DNA, 24 bp, Artificial Sequence
  Synthetic
catctatttcatcgttttcttcct

SEQ ID NO: 27190 - DNA, 18 bp, Artificial Sequence
  Synthetic
tctgtatccacctccagc

SEQ ID NO: 27191 - DNA, 25 bp, Artificial Sequence
  Synthetic
ctatattgctattgtcacttgtacc

SEQ ID NO: 27192 - DNA, 25 bp, Artificial Sequence
  Synthetic
ggctcctaaaaatgttataaactct

SEQ ID NO: 27193 - DNA, 23 bp, Artificial Sequence
  Synthetic
gttcaatagctttatgtgcttta

SEQ ID NO: 27194 - DNA, 19 bp, Artificial Sequence
  Synthetic
cgtgttgtacccttccttt

SEQ ID NO: 27195 - DNA, 19 bp, Artificial Sequence
  Synthetic
gagtccacagtgtccaggt

SEQ ID NO: 27196 - DNA, 23 bp, Artificial Sequence
  Synthetic
tctttgtgtttcactatggtatg

SEQ ID NO: 27197 - DNA, 21 bp, Artificial Sequence
  Synthetic
gcaatagtaacatgggcaata

SEQ ID NO: 27198 - DNA, 23 bp, Artificial Sequence
  Synthetic
ctaatctactaaagcgaacagtc

SEQ ID NO: 27199 - DNA, 21 bp, Artificial Sequence
  Synthetic
cagaagatatagtgggcgaat

SEQ ID NO: 27200 - DNA, 19 bp, Artificial Sequence
  Synthetic
taagttctaaaggggggca

SEQ ID NO: 27201 - DNA, 18 bp, Artificial Sequence
  Synthetic
caggtgaagcaggcatac

SEQ ID NO: 27202 - DNA, 22 bp, Artificial Sequence
  Synthetic
atcatattcctcaacatgtctg

SEQ ID NO: 27203 - DNA, 20 bp, Artificial Sequence
  Synthetic
aaaccacagacataagccaa

SEQ ID NO: 27204 - DNA, 19 bp, Artificial Sequence
  Synthetic
actgatgtgtcctgttgac

SEQ ID NO: 27205 - DNA, 18 bp, Artificial Sequence
  Synthetic
agtcataggtctgtcggc

SEQ ID NO: 27206 - DNA, 19 bp, Artificial Sequence
  Synthetic
aagaaagttcggtgtcctg

SEQ ID NO: 27207 - DNA, 19 bp, Artificial Sequence
  Synthetic
cggcttgaatcccttcatg

SEQ ID NO: 27208 - DNA, 19 bp, Artificial Sequence
  Synthetic
tgctggaccaagatcattg

SEQ ID NO: 27209 - DNA, 18 bp, Artificial Sequence
  Synthetic
gcatcaattcgggctctg

SEQ ID NO: 27210 - DNA, 17 bp, Artificial Sequence
  Synthetic
tccagggaagcggtcac

SEQ ID NO: 27211 - DNA, 16 bp, Artificial Sequence
  Synthetic
tgccgcctgtagcacg

SEQ ID NO: 27212 - DNA, 19 bp, Artificial Sequence
  Synthetic
cgagggagaatggttcacc

SEQ ID NO: 27213 - DNA, 19 bp, Artificial Sequence
  Synthetic
tgatgtccagcctaggagg

SEQ ID NO: 27214 - DNA, 18 bp, Artificial Sequence
  Synthetic
ctcctgggcagctcatca

SEQ ID NO: 27215 - DNA, 19 bp, Artificial Sequence
  Synthetic
cactgggattccgggaatc

SEQ ID NO: 27216 - DNA, 19 bp, Artificial Sequence
  Synthetic
accaacatggcaagaacca

SEQ ID NO: 27217 - DNA, 16 bp, Artificial Sequence
  Synthetic
tggcgccagaaagggc

SEQ ID NO: 27218 - DNA, 20 bp, Artificial Sequence
  Synthetic
ctgccaacactagcatgact

SEQ ID NO: 27219 - DNA, 20 bp, Artificial Sequence
  Synthetic
acacacttcagcagcaatgt

SEQ ID NO: 27220 - DNA, 20 bp, Artificial Sequence
  Synthetic
gcacaccattcactctctga

SEQ ID NO: 27221 - DNA, 18 bp, Artificial Sequence
  Synthetic
ttctcacgacccaaacgc

SEQ ID NO: 27222 - DNA, 20 bp, Artificial Sequence
  Synthetic
acgatagccggttttacccg

SEQ ID NO: 27223 - DNA, 18 bp, Artificial Sequence
  Synthetic
gggtcgcagtggcaaaca

SEQ ID NO: 27224 - DNA, 19 bp, Artificial Sequence
  Synthetic
cacatcaccggctggaatt

SEQ ID NO: 27225 - DNA, 19 bp, Artificial Sequence
  Synthetic
taccacgtgacaccagcct

SEQ ID NO: 27226 - DNA, 16 bp, Artificial Sequence
  Synthetic
ccgccaagcaaggggt

SEQ ID NO: 27227 - DNA, 19 bp, Artificial Sequence
  Synthetic
cgtagctagcagccatggg

SEQ ID NO: 27228 - DNA, 16 bp, Artificial Sequence
  Synthetic
aggagcagagcagccg

SEQ ID NO: 27229 - DNA, 18 bp, Artificial Sequence
  Synthetic
agacggttgacccagtcg

SEQ ID NO: 27230 - DNA, 18 bp, Artificial Sequence
  Synthetic
atccacaagtacagcgcg

SEQ ID NO: 27231 - DNA, 18 bp, Artificial Sequence
  Synthetic
ggcaaatcaccggcgaag

SEQ ID NO: 27232 - DNA, 19 bp, Artificial Sequence
  Synthetic
tctcggcaagaacagtcgt

SEQ ID NO: 27233 - DNA, 19 bp, Artificial Sequence
  Synthetic
ccctcccacaacctaaggg

SEQ ID NO: 27234 - DNA, 18 bp, Artificial Sequence
  Synthetic
caaagcatgcacccggac

SEQ ID NO: 27235 - DNA, 19 bp, Artificial Sequence
  Synthetic
ggcttccgcatatccgtac

SEQ ID NO: 27236 - DNA, 18 bp, Artificial Sequence
  Synthetic
gcgaggcaagagcttcag

SEQ ID NO: 27237 - DNA, 18 bp, Artificial Sequence
  Synthetic
agcacgcaaacacacaat

SEQ ID NO: 27238 - DNA, 22 bp, Artificial Sequence
  Synthetic
agctccagaataatatcttgca

SEQ ID NO: 27239 - DNA, 20 bp, Artificial Sequence
  Synthetic
agtttttgcaattgctcctc

SEQ ID NO: 27240 - DNA, 20 bp, Artificial Sequence
  Synthetic
aacctactccaaacgactct

SEQ ID NO: 27241 - DNA, 18 bp, Artificial Sequence
  Synthetic
tatgaactgtcccgcgat

SEQ ID NO: 27242 - DNA, 19 bp, Artificial Sequence
  Synthetic
caaatttggcctggttgtt

SEQ ID NO: 27243 - DNA, 24 bp, Artificial Sequence
  Synthetic
tgttacatcatccaatagagctat

SEQ ID NO: 27244 - DNA, 18 bp, Artificial Sequence
  Synthetic
attgaaacgctcgctgag

SEQ ID NO: 27245 - DNA, 20 bp, Artificial Sequence
  Synthetic
tcggtttgttgtggctgttt

SEQ ID NO: 27246 - DNA, 18 bp, Artificial Sequence
  Synthetic
gtgtggtgcaggaggagg

SEQ ID NO: 27247 - DNA, 18 bp, Artificial Sequence
  Synthetic
tttagctctgttgcggac

SEQ ID NO: 27248 - DNA, 22 bp, Artificial Sequence
  Synthetic
cgccatagcaaatacaaaatgt

SEQ ID NO: 27249 - DNA, 19 bp, Artificial Sequence
  Synthetic
tgacccgtgttggaggaat

SEQ ID NO: 27250 - DNA, 18 bp, Artificial Sequence
  Synthetic
catatcccgctggtgttg

SEQ ID NO: 27251 - DNA, 18 bp, Artificial Sequence
  Synthetic
ttttacgtttgcgcctgt

SEQ ID NO: 27252 - DNA, 20 bp, Artificial Sequence
  Synthetic
tcattttctgcacatggaac

SEQ ID NO: 27253 - DNA, 21 bp, Artificial Sequence
  Synthetic
ccattattatgaccttgggct

SEQ ID NO: 27254 - DNA, 23 bp, Artificial Sequence
  Synthetic
ttccttgaatactgtgtaaaagt

SEQ ID NO: 27255 - DNA, 23 bp, Artificial Sequence
  Synthetic
actatctctgttatgttcctttc

SEQ ID NO: 27256 - DNA, 20 bp, Artificial Sequence
  Synthetic
ttgttgttcaaagtggttcc

SEQ ID NO: 27257 - DNA, 20 bp, Artificial Sequence
  Synthetic
tgagttctgaggatgttctt

SEQ ID NO: 27258 - DNA, 24 bp, Artificial Sequence
  Synthetic
acatttatatatagcacgggtcta

SEQ ID NO: 27259 - DNA, 23 bp, Artificial Sequence
  Synthetic
tgacttgcctatttatttgtgac

SEQ ID NO: 27260 - DNA, 18 bp, Artificial Sequence
  Synthetic
gttcgtttgttgcttggc

SEQ ID NO: 27261 - DNA, 23 bp, Artificial Sequence
  Synthetic
ttcagttttcttgtcatcagttg

SEQ ID NO: 27262 - DNA, 20 bp, Artificial Sequence
  Synthetic
tcataatcctctgctgtgtc

SEQ ID NO: 27263 - DNA, 20 bp, Artificial Sequence
  Synthetic
tatagtaaccggtgctggtt

SEQ ID NO: 27264 - DNA, 24 bp, Artificial Sequence
  Synthetic
tggtagaactaagctttctaattc

SEQ ID NO: 27265 - DNA, 25 bp, Artificial Sequence
  Synthetic
gttaagtcagtacctttattactgt

SEQ ID NO: 27266 - DNA, 18 bp, Artificial Sequence
  Synthetic
gctgaggagaggtggtaa

SEQ ID NO: 27267 - DNA, 18 bp, Artificial Sequence
  Synthetic
atgcttcagaaacgcagc

SEQ ID NO: 27268 - DNA, 21 bp, Artificial Sequence
  Synthetic
ttcaattgagtaggtgctcta

SEQ ID NO: 27269 - DNA, 25 bp, Artificial Sequence
  Synthetic
ctcataaagattcattaggttttcc

SEQ ID NO: 27270 - DNA, 18 bp, Artificial Sequence
  Synthetic
cgtcgtcgtcgtcgtaac

SEQ ID NO: 27271 - DNA, 21 bp, Artificial Sequence
  Synthetic
taatagtgtcatgtgcaaaca

SEQ ID NO: 27272 - DNA, 22 bp, Artificial Sequence
  Synthetic
aacttgctgtacaaaacgtcta

SEQ ID NO: 27273 - DNA, 18 bp, Artificial Sequence
  Synthetic
cacctttgcaacaggctt

SEQ ID NO: 27274 - DNA, 22 bp, Artificial Sequence
  Synthetic
tactagtctccatactaatcgc

SEQ ID NO: 27275 - DNA, 18 bp, Artificial Sequence
  Synthetic
tactgtcctgttggtggt

SEQ ID NO: 27276 - DNA, 21 bp, Artificial Sequence
  Synthetic
tcttgcataaagctgttcctt

SEQ ID NO: 27277 - DNA, 23 bp, Artificial Sequence
  Synthetic
ctgaagttaatatttcgcgtatt

SEQ ID NO: 27278 - DNA, 19 bp, Artificial Sequence
  Synthetic
tttgtgctacgtttgcagt

SEQ ID NO: 27279 - DNA, 19 bp, Artificial Sequence
  Synthetic
tgtgttctgttgactgtgt

SEQ ID NO: 27280 - DNA, 18 bp, Artificial Sequence
  Synthetic
ggccttgggttagtttgt

SEQ ID NO: 27281 - DNA, 23 bp, Artificial Sequence
  Synthetic
gctcttattagatagcctctctt

SEQ ID NO: 27282 - DNA, 21 bp, Artificial Sequence
  Synthetic
tgaaagaaagctcagtgtctt

SEQ ID NO: 27283 - DNA, 23 bp, Artificial Sequence
  Synthetic
cattgaaatacttcaggtcaatg

SEQ ID NO: 27284 - DNA, 21 bp, Artificial Sequence
  Synthetic
gaatctatccactcctgcttg

SEQ ID NO: 27285 - DNA, 21 bp, Artificial Sequence
  Synthetic
tcctctatggcacctatatgt

SEQ ID NO: 27286 - DNA, 20 bp, Artificial Sequence
  Synthetic
cagggggttacaaagtcttc

SEQ ID NO: 27287 - DNA, 18 bp, Artificial Sequence
  Synthetic
attctggcatcaatccgg

SEQ ID NO: 27288 - DNA, 22 bp, Artificial Sequence
  Synthetic
acaagcactgtagctctaattc

SEQ ID NO: 27289 - DNA, 19 bp, Artificial Sequence
  Synthetic
gacacaacacagtctaacg

SEQ ID NO: 27290 - DNA, 22 bp, Artificial Sequence
  Synthetic
ttttcagcttcatcttcaatcc

SEQ ID NO: 27291 - DNA, 18 bp, Artificial Sequence
  Synthetic
tgtcgtacgatgtggaag

SEQ ID NO: 27292 - DNA, 21 bp, Artificial Sequence
  Synthetic
aatgtcccatagagtacgtag

SEQ ID NO: 27293 - DNA, 18 bp, Artificial Sequence
  Synthetic
tgagttggccttccagac

SEQ ID NO: 27294 - DNA, 24 bp, Artificial Sequence
  Synthetic
ctacttcaaattcttcgttagagg

SEQ ID NO: 27295 - DNA, 23 bp, Artificial Sequence
  Synthetic
acaaacctattacctaattgggt

SEQ ID NO: 27296 - DNA, 24 bp, Artificial Sequence
  Synthetic
cttactcttattgtaccttctgag

SEQ ID NO: 27297 - DNA, 21 bp, Artificial Sequence
  Synthetic
actttgatatctccaccatct

SEQ ID NO: 27298 - DNA, 25 bp, Artificial Sequence
  Synthetic
gtttgtttaggatctatagacaagt

SEQ ID NO: 27299 - DNA, 19 bp, Artificial Sequence
  Synthetic
tcaggccataagctgattg

SEQ ID NO: 27300 - DNA, 22 bp, Artificial Sequence
  Synthetic
caactgaaacaatacacaacaa

SEQ ID NO: 27301 - DNA, 20 bp, Artificial Sequence
  Synthetic
cccattgctatcagactcag

SEQ ID NO: 27302 - DNA, 19 bp, Artificial Sequence
  Synthetic
gttgttctctccgttgggc

SEQ ID NO: 27303 - DNA, 18 bp, Artificial Sequence
  Synthetic
ccttcagcaacccatgaa

SEQ ID NO: 27304 - DNA, 21 bp, Artificial Sequence
  Synthetic
gcactactatttcaggaccaa

SEQ ID NO: 27305 - DNA, 19 bp, Artificial Sequence
  Synthetic
ctgtagtggccacaaatgt

SEQ ID NO: 27306 - DNA, 19 bp, Artificial Sequence
  Synthetic
aattgaactgaatcgcctg

SEQ ID NO: 27307 - DNA, 19 bp, Artificial Sequence
  Synthetic
acctttaatgctgctccac

SEQ ID NO: 27308 - DNA, 21 bp, Artificial Sequence
  Synthetic
aatcatctgtactcagcactc

SEQ ID NO: 27309 - DNA, 22 bp, Artificial Sequence
  Synthetic
gcaagtagaacaaagttcacat

SEQ ID NO: 27310 - DNA, 21 bp, Artificial Sequence
  Synthetic
gttgcaagaggattatgtctc

SEQ ID NO: 27311 - DNA, 22 bp, Artificial Sequence
  Synthetic
cataacaaaatggtcctttcca

SEQ ID NO: 27312 - DNA, 19 bp, Artificial Sequence
  Synthetic
ctgagaaagaagcagttgc

SEQ ID NO: 27313 - DNA, 25 bp, Artificial Sequence
  Synthetic
cattgttattttcagttccagtttc

SEQ ID NO: 27314 - DNA, 19 bp, Artificial Sequence
  Synthetic
atgactcactagctgtagc

SEQ ID NO: 27315 - DNA, 21 bp, Artificial Sequence
  Synthetic
ggattaccatctaaacccgtt

SEQ ID NO: 27316 - DNA, 23 bp, Artificial Sequence
  Synthetic
acataataacatgctcttgtctt

SEQ ID NO: 27317 - DNA, 19 bp, Artificial Sequence
  Synthetic
atagtttcggagttccagg

SEQ ID NO: 27318 - DNA, 23 bp, Artificial Sequence
  Synthetic
ttaacccttttactggtattcat

SEQ ID NO: 27319 - DNA, 19 bp, Artificial Sequence
  Synthetic
ggaccagaaacagtgacat

SEQ ID NO: 27320 - DNA, 18 bp, Artificial Sequence
  Synthetic
tctgctcctcctcaaagg

SEQ ID NO: 27321 - DNA, 23 bp, Artificial Sequence
  Synthetic
attgcaggttcaatattagaagt

SEQ ID NO: 27322 - DNA, 20 bp, Artificial Sequence
  Synthetic
gtagttccaataccaagcgg

SEQ ID NO: 27323 - DNA, 18 bp, Artificial Sequence
  Synthetic
tctcccattgttcctgct

SEQ ID NO: 27324 - DNA, 18 bp, Artificial Sequence
  Synthetic
cagcttgttcaggacagg

SEQ ID NO: 27325 - DNA, 23 bp, Artificial Sequence
  Synthetic
gatggacagtctaaaatctgttt

SEQ ID NO: 27326 - DNA, 18 bp, Artificial Sequence
  Synthetic
taccactcccggtcattg

SEQ ID NO: 27327 - DNA, 16 bp, Artificial Sequence
  Synthetic
cccgtctggtccacca

SEQ ID NO: 27328 - DNA, 20 bp, Artificial Sequence
  Synthetic
gaggaaatgctggcaggttc

SEQ ID NO: 27329 - DNA, 16 bp, Artificial Sequence
  Synthetic
tgtggcctcccgttcc

SEQ ID NO: 27330 - DNA, 19 bp, Artificial Sequence
  Synthetic
gccataaacgccgactacg

SEQ ID NO: 27331 - DNA, 17 bp, Artificial Sequence
  Synthetic
ctttgcggacgagctgc

SEQ ID NO: 27332 - DNA, 16 bp, Artificial Sequence
  Synthetic
gcccggcctgacgatt

SEQ ID NO: 27333 - DNA, 16 bp, Artificial Sequence
  Synthetic
aacctccccggctgga

SEQ ID NO: 27334 - DNA, 17 bp, Artificial Sequence
  Synthetic
accacaccccccagtac

SEQ ID NO: 27335 - DNA, 16 bp, Artificial Sequence
  Synthetic
cgagccacgccagaac

SEQ ID NO: 27336 - DNA, 17 bp, Artificial Sequence
  Synthetic
acagggccgagagaacg

SEQ ID NO: 27337 - DNA, 15 bp, Artificial Sequence
  Synthetic
agccgtcaagcgcgt

SEQ ID NO: 27338 - DNA, 16 bp, Artificial Sequence
  Synthetic
tgcagcaccatggccg

SEQ ID NO: 27339 - DNA, 20 bp, Artificial Sequence
  Synthetic
ggggcgataacatctgcatt

SEQ ID NO: 27340 - DNA, 17 bp, Artificial Sequence
  Synthetic
accttccccaacgcgag

SEQ ID NO: 27341 - DNA, 18 bp, Artificial Sequence
  Synthetic
gatacgtcccgctcagga

SEQ ID NO: 27342 - DNA, 18 bp, Artificial Sequence
  Synthetic
cgcatcgatccggagatc

SEQ ID NO: 27343 - DNA, 17 bp, Artificial Sequence
  Synthetic
agccacttccccgactg

SEQ ID NO: 27344 - DNA, 16 bp, Artificial Sequence
  Synthetic
accttccgtcccctgc

SEQ ID NO: 27345 - DNA, 16 bp, Artificial Sequence
  Synthetic
cccaagattcggcgcg

SEQ ID NO: 27346 - DNA, 18 bp, Artificial Sequence
  Synthetic
tccccctcgcacatcctc

SEQ ID NO: 27347 - DNA, 16 bp, Artificial Sequence
  Synthetic
tggaggagcaagcggc

SEQ ID NO: 27348 - DNA, 20 bp, Artificial Sequence
  Synthetic
gccgagatttacaaggacca

SEQ ID NO: 27349 - DNA, 16 bp, Artificial Sequence
  Synthetic
tttaaccgcgagcgcc

SEQ ID NO: 27350 - DNA, 20 bp, Artificial Sequence
  Synthetic
gagcggctcaagatctttcg

SEQ ID NO: 27351 - DNA, 15 bp, Artificial Sequence
  Synthetic
tacgcgcgccaaacc

SEQ ID NO: 27352 - DNA, 16 bp, Artificial Sequence
  Synthetic
gaggccgctgttggtg

SEQ ID NO: 27353 - DNA, 17 bp, Artificial Sequence
  Synthetic
gcgaatgtgtgcggagg

SEQ ID NO: 27354 - DNA, 16 bp, Artificial Sequence
  Synthetic
agtgtcacgcgggagg

SEQ ID NO: 27355 - DNA, 17 bp, Artificial Sequence
  Synthetic
gtgcgcctggattcgct

SEQ ID NO: 27356 - DNA, 19 bp, Artificial Sequence
  Synthetic
gtgctcagcccctgcttta

SEQ ID NO: 27357 - DNA, 20 bp, Artificial Sequence
  Synthetic
catcatcagctcaagacggg

SEQ ID NO: 27358 - DNA, 20 bp, Artificial Sequence
  Synthetic
cggtgttttacctgctgcag

SEQ ID NO: 27359 - DNA, 17 bp, Artificial Sequence
  Synthetic
gttgcgcgccatccaac

SEQ ID NO: 27360 - DNA, 20 bp, Artificial Sequence
  Synthetic
atgcaaacagcctgtacgac

SEQ ID NO: 27361 - DNA, 20 bp, Artificial Sequence
  Synthetic
tgttttgggggatgtccgtg

SEQ ID NO: 27362 - DNA, 19 bp, Artificial Sequence
  Synthetic
ggtttcggtccgttgtgac

SEQ ID NO: 27363 - DNA, 20 bp, Artificial Sequence
  Synthetic
cgagagcgtgtttatcctgg

SEQ ID NO: 27364 - DNA, 18 bp, Artificial Sequence
  Synthetic
gtttttctcgggggacgc

SEQ ID NO: 27365 - DNA, 17 bp, Artificial Sequence
  Synthetic
tcatcccgccgaccttg

SEQ ID NO: 27366 - DNA, 18 bp, Artificial Sequence
  Synthetic
tgtggcctcgaataccga

SEQ ID NO: 27367 - DNA, 18 bp, Artificial Sequence
  Synthetic
tgagtcttcggacctcgc

SEQ ID NO: 27368 - DNA, 16 bp, Artificial Sequence
  Synthetic
acgaccacctgctccg

SEQ ID NO: 27369 - DNA, 17 bp, Artificial Sequence
  Synthetic
ggaatagtggcgctggc

SEQ ID NO: 27370 - DNA, 19 bp, Artificial Sequence
  Synthetic
ctcaagaaccccaccaacc

SEQ ID NO: 27371 - DNA, 18 bp, Artificial Sequence
  Synthetic
caccttcggtgggggcta

SEQ ID NO: 27372 - DNA, 16 bp, Artificial Sequence
  Synthetic
tgccatcgcgtggtgc

SEQ ID NO: 27373 - DNA, 16 bp, Artificial Sequence
  Synthetic
tgggggactgcatcgg

SEQ ID NO: 27374 - DNA, 16 bp, Artificial Sequence
  Synthetic
tggcctgggactgggt

SEQ ID NO: 27375 - DNA, 17 bp, Artificial Sequence
  Synthetic
aagcgcgtggacatcct

SEQ ID NO: 27376 - DNA, 17 bp, Artificial Sequence
  Synthetic
gccctgagtcagtgcca

SEQ ID NO: 27377 - DNA, 19 bp, Artificial Sequence
  Synthetic
tcatgcaggagacgtaccg

SEQ ID NO: 27378 - DNA, 19 bp, Artificial Sequence
  Synthetic
accgagggcttcaaggagg

SEQ ID NO: 27379 - DNA, 18 bp, Artificial Sequence
  Synthetic
ggattacctccgttcgcg

SEQ ID NO: 27380 - DNA, 17 bp, Artificial Sequence
  Synthetic
atggccgggcagaagtt

SEQ ID NO: 27381 - DNA, 17 bp, Artificial Sequence
  Synthetic
cttgatggcggcctgct

SEQ ID NO: 27382 - DNA, 20 bp, Artificial Sequence
  Synthetic
ggtgaacgtcttttcgcact

SEQ ID NO: 27383 - DNA, 20 bp, Artificial Sequence
  Synthetic
agctttttttcgtccacacg

SEQ ID NO: 27384 - DNA, 16 bp, Artificial Sequence
  Synthetic
gcagcagctggaaggc

SEQ ID NO: 27385 - DNA, 16 bp, Artificial Sequence
  Synthetic
tcggggcccatgaacc

SEQ ID NO: 27386 - DNA, 16 bp, Artificial Sequence
  Synthetic
atccagcggggccaga

SEQ ID NO: 27387 - DNA, 16 bp, Artificial Sequence
  Synthetic
ggcgaggtgggcttct

SEQ ID NO: 27388 - DNA, 19 bp, Artificial Sequence
  Synthetic
gcagggcacatatgatcgc

SEQ ID NO: 27389 - DNA, 19 bp, Artificial Sequence
  Synthetic
cctacgttctggccctggt

SEQ ID NO: 27390 - DNA, 18 bp, Artificial Sequence
  Synthetic
gaaccttaccaccccggc

SEQ ID NO: 27391 - DNA, 16 bp, Artificial Sequence
  Synthetic
agcaagacccggggga

SEQ ID NO: 27392 - DNA, 20 bp, Artificial Sequence
  Synthetic
gaccggcaagtttccaaagc

SEQ ID NO: 27393 - DNA, 16 bp, Artificial Sequence
  Synthetic
ccttgagggcgggcat

SEQ ID NO: 27394 - DNA, 17 bp, Artificial Sequence
  Synthetic
cgcttcccaggttgcag

SEQ ID NO: 27395 - DNA, 18 bp, Artificial Sequence
  Synthetic
aggacatccgcgacgaaa

SEQ ID NO: 27396 - DNA, 19 bp, Artificial Sequence
  Synthetic
ttgtgtttggagccaaggc

SEQ ID NO: 27397 - DNA, 19 bp, Artificial Sequence
  Synthetic
cgcttctggtccacgagag

SEQ ID NO: 27398 - DNA, 19 bp, Artificial Sequence
  Synthetic
ggtgacgcaggtactcgtg

SEQ ID NO: 27399 - DNA, 16 bp, Artificial Sequence
  Synthetic
tgtgcgttcgatgcgg

SEQ ID NO: 27400 - DNA, 17 bp, Artificial Sequence
  Synthetic
tcgtgcgtctgcgtgtc

SEQ ID NO: 27401 - DNA, 18 bp, Artificial Sequence
  Synthetic
tttgccgacaccgtggtg

SEQ ID NO: 27402 - DNA, 16 bp, Artificial Sequence
  Synthetic
acgacgcccccgaaga

SEQ ID NO: 27403 - DNA, 19 bp, Artificial Sequence
  Synthetic
gggaagtcacgaggtacgg

SEQ ID NO: 27404 - DNA, 17 bp, Artificial Sequence
  Synthetic
tcaccaccatccgcgtg

SEQ ID NO: 27405 - DNA, 18 bp, Artificial Sequence
  Synthetic
cacagagggccactcacg

SEQ ID NO: 27406 - DNA, 16 bp, Artificial Sequence
  Synthetic
cccgacgcctcgtgaa

SEQ ID NO: 27407 - DNA, 20 bp, Artificial Sequence
  Synthetic
ctccacaaaatctcggtcca

SEQ ID NO: 27408 - DNA, 17 bp, Artificial Sequence
  Synthetic
tgcaggcggttgctgtc

SEQ ID NO: 27409 - DNA, 16 bp, Artificial Sequence
  Synthetic
tgttggtgccggtggg

SEQ ID NO: 27410 - DNA, 19 bp, Artificial Sequence
  Synthetic
gcctgcgtagttcaagagg

SEQ ID NO: 27411 - DNA, 18 bp, Artificial Sequence
  Synthetic
tcctctccgtgggggtct

SEQ ID NO: 27412 - DNA, 16 bp, Artificial Sequence
  Synthetic
ggcgcggaccaggtaa

SEQ ID NO: 27413 - DNA, 18 bp, Artificial Sequence
  Synthetic
acgtacgccgaggctatg

SEQ ID NO: 27414 - DNA, 16 bp, Artificial Sequence
  Synthetic
ttgctgatcccccgcc

SEQ ID NO: 27415 - DNA, 17 bp, Artificial Sequence
  Synthetic
caaaatccgccggggtg

SEQ ID NO: 27416 - DNA, 19 bp, Artificial Sequence
  Synthetic
ttggggagaagcaggtgtc

SEQ ID NO: 27417 - DNA, 16 bp, Artificial Sequence
  Synthetic
tgtcgtcggggtcgtc

SEQ ID NO: 27418 - DNA, 17 bp, Artificial Sequence
  Synthetic
gcgtgtatgggcatgcc

SEQ ID NO: 27419 - DNA, 18 bp, Artificial Sequence
  Synthetic
atcgtgcgcactaggtcc

SEQ ID NO: 27420 - DNA, 17 bp, Artificial Sequence
  Synthetic
agaacaacgccctgccc

SEQ ID NO: 27421 - DNA, 20 bp, Artificial Sequence
  Synthetic
acaaaacttacgacaggcca

SEQ ID NO: 27422 - DNA, 16 bp, Artificial Sequence
  Synthetic
tgacacaggcgctcgg

SEQ ID NO: 27423 - DNA, 16 bp, Artificial Sequence
  Synthetic
tggtcgaggggggctt

SEQ ID NO: 27424 - DNA, 16 bp, Artificial Sequence
  Synthetic
aggatcgccgggtggt

SEQ ID NO: 27425 - DNA, 19 bp, Artificial Sequence
  Synthetic
cctggcggtgaatgtagtc

SEQ ID NO: 27426 - DNA, 20 bp, Artificial Sequence
  Synthetic
tctggatgcggggaaaactc

SEQ ID NO: 27427 - DNA, 19 bp, Artificial Sequence
  Synthetic
cctcctcctccagtccaat

SEQ ID NO: 27428 - DNA, 18 bp, Artificial Sequence
  Synthetic
tccggatagccaggcctg

SEQ ID NO: 27429 - DNA, 18 bp, Artificial Sequence
  Synthetic
ctggggtgaggggacact

SEQ ID NO: 27430 - DNA, 16 bp, Artificial Sequence
  Synthetic
tcacacggccgggcta

SEQ ID NO: 27431 - DNA, 18 bp, Artificial Sequence
  Synthetic
ggtcccccacaaagcgaa

SEQ ID NO: 27432 - DNA, 18 bp, Artificial Sequence
  Synthetic
gagccgttgtacgccaga

SEQ ID NO: 27433 - DNA, 16 bp, Artificial Sequence
  Synthetic
ccaccaggaccaccga

SEQ ID NO: 27434 - DNA, 16 bp, Artificial Sequence
  Synthetic
accgactgttggcggc

SEQ ID NO: 27435 - DNA, 20 bp, Artificial Sequence
  Synthetic
gtgatgggggggaagagaga

SEQ ID NO: 27436 - DNA, 20 bp, Artificial Sequence
  Synthetic
tgatttacccaggtgttgtt

SEQ ID NO: 27437 - DNA, 22 bp, Artificial Sequence
  Synthetic
ttgagttctcagtatgttgttc

SEQ ID NO: 27438 - DNA, 24 bp, Artificial Sequence
  Synthetic
ccaaattttgattgaaagataccc

SEQ ID NO: 27439 - DNA, 18 bp, Artificial Sequence
  Synthetic
caccgagaagctactgtc

SEQ ID NO: 27440 - DNA, 20 bp, Artificial Sequence
  Synthetic
accactgaacaaatggcact

SEQ ID NO: 27441 - DNA, 20 bp, Artificial Sequence
  Synthetic
aggcctgttaataggaagtt

SEQ ID NO: 27442 - DNA, 18 bp, Artificial Sequence
  Synthetic
atgcctcaaggtcggtcg

SEQ ID NO: 27443 - DNA, 20 bp, Artificial Sequence
  Synthetic
cacaagagttgcctgaactt

SEQ ID NO: 27444 - DNA, 20 bp, Artificial Sequence
  Synthetic
aggtgtccttgttgggattg

SEQ ID NO: 27445 - DNA, 19 bp, Artificial Sequence
  Synthetic
tcctaagtgacgggttctt

SEQ ID NO: 27446 - DNA, 23 bp, Artificial Sequence
  Synthetic
atgttttaacctttcgactttgt

SEQ ID NO: 27447 - DNA, 21 bp, Artificial Sequence
  Synthetic
ctgtctaagaatgtccaccat

SEQ ID NO: 27448 - DNA, 21 bp, Artificial Sequence
  Synthetic
atcttctggttgcttttctga

SEQ ID NO: 27449 - DNA, 18 bp, Artificial Sequence
  Synthetic
ccatcacactgtcgatgt

SEQ ID NO: 27450 - DNA, 23 bp, Artificial Sequence
  Synthetic
atgatccattgataggtattgac

SEQ ID NO: 27451 - DNA, 18 bp, Artificial Sequence
  Synthetic
tgctttgctttggtggag

SEQ ID NO: 27452 - DNA, 22 bp, Artificial Sequence
  Synthetic
cttttgcaaggttactcagttc

SEQ ID NO: 27453 - DNA, 19 bp, Artificial Sequence
  Synthetic
gtgcaacacatctcacaca

SEQ ID NO: 27454 - DNA, 19 bp, Artificial Sequence
  Synthetic
gcatcttagaagcattcgc

SEQ ID NO: 27455 - DNA, 19 bp, Artificial Sequence
  Synthetic
ttggggcaaagaaacgaaa

SEQ ID NO: 27456 - DNA, 18 bp, Artificial Sequence
  Synthetic
tttgtcacaatcctcccg

SEQ ID NO: 27457 - DNA, 23 bp, Artificial Sequence
  Synthetic
tgctttctgattagttctttcca

SEQ ID NO: 27458 - DNA, 24 bp, Artificial Sequence
  Synthetic
cttttttaatgactgcaacaacag

SEQ ID NO: 27459 - DNA, 19 bp, Artificial Sequence
  Synthetic
actggtactagagccgacc

SEQ ID NO: 27460 - DNA, 19 bp, Artificial Sequence
  Synthetic
ctgtgactctaggtgttgt

SEQ ID NO: 27461 - DNA, 24 bp, Artificial Sequence
  Synthetic
gctatattttcatcttgtcctgta

SEQ ID NO: 27462 - DNA, 21 bp, Artificial Sequence
  Synthetic
taactctaacgcgaccactat

SEQ ID NO: 27463 - DNA, 25 bp, Artificial Sequence
  Synthetic
cctcatcatcaaattgtatttcact

SEQ ID NO: 27464 - DNA, 19 bp, Artificial Sequence
  Synthetic
cctcaacagtttcctgagg

SEQ ID NO: 27465 - DNA, 18 bp, Artificial Sequence
  Synthetic
agctgtgtttgttttggg

SEQ ID NO: 27466 - DNA, 24 bp, Artificial Sequence
  Synthetic
gaaaatctggatatttacaggtgc

SEQ ID NO: 27467 - DNA, 21 bp, Artificial Sequence
  Synthetic
gctcttttctaacacgtttgt

SEQ ID NO: 27468 - DNA, 20 bp, Artificial Sequence
  Synthetic
tgaaaaatatttgccagccc

SEQ ID NO: 27469 - DNA, 20 bp, Artificial Sequence
  Synthetic
aaacacttgagtcagccata

SEQ ID NO: 27470 - DNA, 19 bp, Artificial Sequence
  Synthetic
attgtgacacttggagtct

SEQ ID NO: 27471 - DNA, 19 bp, Artificial Sequence
  Synthetic
gtctttttgcaccaacagt

SEQ ID NO: 27472 - DNA, 20 bp, Artificial Sequence
  Synthetic
agtcgtgagtaaccgtgtct

SEQ ID NO: 27473 - DNA, 21 bp, Artificial Sequence
  Synthetic
gtctagtcactggtaagtctg

SEQ ID NO: 27474 - DNA, 21 bp, Artificial Sequence
  Synthetic
tagctgtctcactttcttctg

SEQ ID NO: 27475 - DNA, 18 bp, Artificial Sequence
  Synthetic
tgagctggtgttcgtaaa

SEQ ID NO: 27476 - DNA, 20 bp, Artificial Sequence
  Synthetic
tccttctgatgtagcagaca

SEQ ID NO: 27477 - DNA, 22 bp, Artificial Sequence
  Synthetic
gctcgtttaccatttaacaaac

SEQ ID NO: 27478 - DNA, 19 bp, Artificial Sequence
  Synthetic
tctcacaaatggacgtctg

SEQ ID NO: 27479 - DNA, 20 bp, Artificial Sequence
  Synthetic
actgatactagcttccacag

SEQ ID NO: 27480 - DNA, 20 bp, Artificial Sequence
  Synthetic
tgctagtgctggagagaacc

SEQ ID NO: 27481 - DNA, 18 bp, Artificial Sequence
  Synthetic
cgtggtttgttcctgccg

SEQ ID NO: 27482 - DNA, 18 bp, Artificial Sequence
  Synthetic
gactccaacaggctctct

SEQ ID NO: 27483 - DNA, 20 bp, Artificial Sequence
  Synthetic
cccgaacttcttttcctcca

SEQ ID NO: 27484 - DNA, 22 bp, Artificial Sequence
  Synthetic
ttttggtccctgttttatgtct

SEQ ID NO: 27485 - DNA, 20 bp, Artificial Sequence
  Synthetic
tttgccatgatgtgtcctgg

SEQ ID NO: 27486 - DNA, 18 bp, Artificial Sequence
  Synthetic
gccttggtccatctttcc

SEQ ID NO: 27487 - DNA, 20 bp, Artificial Sequence
  Synthetic
ctggtagggtaaatgcagta

SEQ ID NO: 27488 - DNA, 18 bp, Artificial Sequence
  Synthetic
ttggccatagttcacagc

SEQ ID NO: 27489 - DNA, 21 bp, Artificial Sequence
  Synthetic
ggattttctcttcctggtgta

SEQ ID NO: 27490 - DNA, 21 bp, Artificial Sequence
  Synthetic
catatcctgcttttccctctt

SEQ ID NO: 27491 - DNA, 25 bp, Artificial Sequence
  Synthetic
gggttagttcttttataatgctatg

SEQ ID NO: 27492 - DNA, 18 bp, Artificial Sequence
  Synthetic
acctacccaccatgccac

SEQ ID NO: 27493 - DNA, 19 bp, Artificial Sequence
  Synthetic
ttccacagtagttcaccag

SEQ ID NO: 27494 - DNA, 18 bp, Artificial Sequence
  Synthetic
cttcacctgccgtaaagc

SEQ ID NO: 27495 - DNA, 25 bp, Artificial Sequence
  Synthetic
gcacaaatatctatactttgtgtag

SEQ ID NO: 27496 - DNA, 18 bp, Artificial Sequence
  Synthetic
tacatcccgctctgaagt

SEQ ID NO: 27497 - DNA, 23 bp, Artificial Sequence
  Synthetic
acaatatactaagcaagcacttg

SEQ ID NO: 27498 - DNA, 18 bp, Artificial Sequence
  Synthetic
gaggttgtggaactcgag

SEQ ID NO: 27499 - DNA, 22 bp, Artificial Sequence
  Synthetic
ttacatcttaatagggcaaagc

SEQ ID NO: 27500 - DNA, 18 bp, Artificial Sequence
  Synthetic
ggtttgcttcacctcctg

SEQ ID NO: 27501 - DNA, 24 bp, Artificial Sequence
  Synthetic
gtccgatttttatctatgtcaatg

SEQ ID NO: 27502 - DNA, 21 bp, Artificial Sequence
  Synthetic
tgatatttgcctctaggtagc

SEQ ID NO: 27503 - DNA, 19 bp, Artificial Sequence
  Synthetic
cctcgcgaatgcttggaaa

SEQ ID NO: 27504 - DNA, 25 bp, Artificial Sequence
  Synthetic
catatctattgccaatttataggtc

SEQ ID NO: 27505 - DNA, 24 bp, Artificial Sequence
  Synthetic
cctgttattcactatatggtatcc

SEQ ID NO: 27506 - DNA, 20 bp, Artificial Sequence
  Synthetic
tgcttctaactggcagcttt

SEQ ID NO: 27507 - DNA, 19 bp, Artificial Sequence
  Synthetic
atcacaccagtcacattga

SEQ ID NO: 27508 - DNA, 24 bp, Artificial Sequence
  Synthetic
ctctgagaagattaggtagttgtc

SEQ ID NO: 27509 - DNA, 21 bp, Artificial Sequence
  Synthetic
ttttgtcatcagagtggaacc

SEQ ID NO: 27510 - DNA, 21 bp, Artificial Sequence
  Synthetic
cttttattaccttgctcctgc

SEQ ID NO: 27511 - DNA, 19 bp, Artificial Sequence
  Synthetic
acctgcaatcattccttcc

SEQ ID NO: 27512 - DNA, 24 bp, Artificial Sequence
  Synthetic
ctcatcttcactgtttattatccc

SEQ ID NO: 27513 - DNA, 19 bp, Artificial Sequence
  Synthetic
ctagaagcagcagttgagt

SEQ ID NO: 27514 - DNA, 24 bp, Artificial Sequence
  Synthetic
ttgtatatgagacccatacaactg

SEQ ID NO: 27515 - DNA, 20 bp, Artificial Sequence
  Synthetic
cccaattgtcctcattgcct

SEQ ID NO: 27516 - DNA, 19 bp, Artificial Sequence
  Synthetic
gaaggccctcttttcaaac

SEQ ID NO: 27517 - DNA, 20 bp, Artificial Sequence
  Synthetic
tcctccataacaaaccagtt

SEQ ID NO: 27518 - DNA, 21 bp, Artificial Sequence
  Synthetic
aacagaatgtttcggactaca

SEQ ID NO: 27519 - DNA, 18 bp, Artificial Sequence
  Synthetic
gagtctcctgtagtgcag

SEQ ID NO: 27520 - DNA, 19 bp, Artificial Sequence
  Synthetic
ccatatctggcagcatctg

SEQ ID NO: 27521 - DNA, 24 bp, Artificial Sequence
  Synthetic
acccaagtatattacacttccaaa

SEQ ID NO: 27522 - DNA, 25 bp, Artificial Sequence
  Synthetic
ctatgtcaataatagatggatcagg

SEQ ID NO: 27523 - DNA, 23 bp, Artificial Sequence
  Synthetic
tttcaccttgataatttggtgaa

SEQ ID NO: 27524 - DNA, 20 bp, Artificial Sequence
  Synthetic
aatattcaaactgcacagcg

SEQ ID NO: 27525 - DNA, 25 bp, Artificial Sequence
  Synthetic
gactcaatagcagataaatcttgat

SEQ ID NO: 27526 - DNA, 18 bp, Artificial Sequence
  Synthetic
aagtactctggctgtggg

SEQ ID NO: 27527 - DNA, 20 bp, Artificial Sequence
  Synthetic
ccaacacctagaggatttcc

SEQ ID NO: 27528 - DNA, 18 bp, Artificial Sequence
  Synthetic
cctggcttcaagggtcta

SEQ ID NO: 27529 - DNA, 18 bp, Artificial Sequence
  Synthetic
atccccaacatttcctgc

SEQ ID NO: 27530 - DNA, 25 bp, Artificial Sequence
  Synthetic
caagaagacaaatatctgtatgtgt

SEQ ID NO: 27531 - DNA, 24 bp, Artificial Sequence
  Synthetic
gcatacagtaaacatttcacagta

SEQ ID NO: 27532 - DNA, 20 bp, Artificial Sequence
  Synthetic
aatagcccatgcaaatcttg

SEQ ID NO: 27533 - DNA, 20 bp, Artificial Sequence
  Synthetic
gtagctaacacacacagtct

SEQ ID NO: 27534 - DNA, 22 bp, Artificial Sequence
  Synthetic
caaaatatcctgtaaggcagtg

SEQ ID NO: 27535 - DNA, 18 bp, Artificial Sequence
  Synthetic
gtatgcaatggctggttc

SEQ ID NO: 27536 - DNA, 24 bp, Artificial Sequence
  Synthetic
agcataatactccaatacactttc

SEQ ID NO: 27537 - DNA, 18 bp, Artificial Sequence
  Synthetic
cttgtcctcgtcgtcgtc

SEQ ID NO: 27538 - DNA, 23 bp, Artificial Sequence
  Synthetic
tttcccaaatatataacactgct

SEQ ID NO: 27539 - DNA, 20 bp, Artificial Sequence
  Synthetic
tgtttctgctcctaaaccag

SEQ ID NO: 27540 - DNA, 22 bp, Artificial Sequence
  Synthetic
cgggattttcaaattcaaatgt

SEQ ID NO: 27541 - DNA, 21 bp, Artificial Sequence
  Synthetic
ctggcacatttttttcactag

SEQ ID NO: 27542 - DNA, 18 bp, Artificial Sequence
  Synthetic
taccgactccaagaggac

SEQ ID NO: 27543 - DNA, 18 bp, Artificial Sequence
  Synthetic
gctcatctggaggattcc

SEQ ID NO: 27544 - DNA, 22 bp, Artificial Sequence
  Synthetic
ctttaggacacatagctgctaa

SEQ ID NO: 27545 - DNA, 18 bp, Artificial Sequence
  Synthetic
aagacacaggcaccgata

SEQ ID NO: 27546 - DNA, 18 bp, Artificial Sequence
  Synthetic
tttgtcagctgtgatcgg

SEQ ID NO: 27547 - DNA, 22 bp, Artificial Sequence
  Synthetic
tccgtgttttaatctttcaacc

SEQ ID NO: 27548 - DNA, 18 bp, Artificial Sequence
  Synthetic
aggaatctggtcttgcga

SEQ ID NO: 27549 - DNA, 19 bp, Artificial Sequence
  Synthetic
ccaatttgtgtgctatggc

SEQ ID NO: 27550 - DNA, 18 bp, Artificial Sequence
  Synthetic
cccttccgctgactatca

SEQ ID NO: 27551 - DNA, 20 bp, Artificial Sequence
  Synthetic
acattgtcgatgggttcaat

SEQ ID NO: 27552 - DNA, 18 bp, Artificial Sequence
  Synthetic
tctggcccgttaatctcc

SEQ ID NO: 27553 - DNA, 18 bp, Artificial Sequence
  Synthetic
cctactctgttccggtgg

SEQ ID NO: 27554 - DNA, 18 bp, Artificial Sequence
  Synthetic
tgcttaatgctggtccat

SEQ ID NO: 27555 - DNA, 20 bp, Artificial Sequence
  Synthetic
gatgtttgttcgttccactg

SEQ ID NO: 27556 - DNA, 23 bp, Artificial Sequence
  Synthetic
ccattagttcttattccactgta

SEQ ID NO: 27557 - DNA, 22 bp, Artificial Sequence
  Synthetic
caattcttccagatagaccatt

SEQ ID NO: 27558 - DNA, 22 bp, Artificial Sequence
  Synthetic
ctcctttgcttaacatatctcg

SEQ ID NO: 27559 - DNA, 23 bp, Artificial Sequence
  Synthetic
tgttatttgatcaattgccgatt

SEQ ID NO: 27560 - DNA, 23 bp, Artificial Sequence
  Synthetic
tgaaatatttcaaagcaaccagt

SEQ ID NO: 27561 - DNA, 21 bp, Artificial Sequence
  Synthetic
gcagatttgtaaattccgcag

SEQ ID NO: 27562 - DNA, 25 bp, Artificial Sequence
  Synthetic
gtccacctatttaaaatgaatctga

SEQ ID NO: 27563 - DNA, 18 bp, Artificial Sequence
  Synthetic
tgcagctgttgtatgtcc

SEQ ID NO: 27564 - DNA, 21 bp, Artificial Sequence
  Synthetic
accaaatgacaatccaaacag

SEQ ID NO: 27565 - DNA, 23 bp, Artificial Sequence
  Synthetic
gctctattaacagttgattagca

SEQ ID NO: 27566 - DNA, 23 bp, Artificial Sequence
  Synthetic
tgtctacacataattccacaatc

SEQ ID NO: 27567 - DNA, 20 bp, Artificial Sequence
  Synthetic
ccatttcacgagccttaaat

SEQ ID NO: 27568 - DNA, 23 bp, Artificial Sequence
  Synthetic
cgtatataaatgtccatgctgta

SEQ ID NO: 27569 - DNA, 18 bp, Artificial Sequence
  Synthetic
ttgtgacgccgtagtgct

SEQ ID NO: 27570 - DNA, 18 bp, Artificial Sequence
  Synthetic
agctagcaagacaggagg

SEQ ID NO: 27571 - DNA, 23 bp, Artificial Sequence
  Synthetic
tacaaacaatacaaaaacccaac

SEQ ID NO: 27572 - DNA, 23 bp, Artificial Sequence
  Synthetic
cgtaaagtaaaaggatcactgta

SEQ ID NO: 27573 - DNA, 20 bp, Artificial Sequence
  Synthetic
tcattaattgcggatgaagc

SEQ ID NO: 27574 - DNA, 20 bp, Artificial Sequence
  Synthetic
actgctggcatgataaaagt

SEQ ID NO: 27575 - DNA, 21 bp, Artificial Sequence
  Synthetic
cacctcagcttttgaagtttg

SEQ ID NO: 27576 - DNA, 18 bp, Artificial Sequence
  Synthetic
tatggcctgagactgcac

SEQ ID NO: 27577 - DNA, 21 bp, Artificial Sequence
  Synthetic
ctttctaaaacatgcttgtgc

SEQ ID NO: 27578 - DNA, 23 bp, Artificial Sequence
  Synthetic
aaagcataatagtaagcaattgc

SEQ ID NO: 27579 - DNA, 25 bp, Artificial Sequence
  Synthetic
ccctgatacttaagtaaattagcaa

SEQ ID NO: 27580 - DNA, 19 bp, Artificial Sequence
  Synthetic
tcgtcgtcgttgtcctctt

SEQ ID NO: 27581 - DNA, 25 bp, Artificial Sequence
  Synthetic
ctccaacatttcaatttattagcac

SEQ ID NO: 27582 - DNA, 19 bp, Artificial Sequence
  Synthetic
agctgcacatcgatttgag

SEQ ID NO: 27583 - DNA, 19 bp, Artificial Sequence
  Synthetic
atcaccaacaactccatct

SEQ ID NO: 27584 - DNA, 20 bp, Artificial Sequence
  Synthetic
ttccctgagctttatgtacc

SEQ ID NO: 27585 - DNA, 18 bp, Artificial Sequence
  Synthetic
cctgaggaggtgaaggaa

SEQ ID NO: 27586 - DNA, 19 bp, Artificial Sequence
  Synthetic
gtttagtagtgcgacgctt

SEQ ID NO: 27587 - DNA, 18 bp, Artificial Sequence
  Synthetic
acgtttgtgtgcgatgtt

SEQ ID NO: 27588 - DNA, 21 bp, Artificial Sequence
  Synthetic
cagaagatgactcaaatgcct

SEQ ID NO: 27589 - DNA, 20 bp, Artificial Sequence
  Synthetic
ccatttgcctagcctgactt

SEQ ID NO: 27590 - DNA, 18 bp, Artificial Sequence
  Synthetic
agactcaggcactccttc

SEQ ID NO: 27591 - DNA, 24 bp, Artificial Sequence
  Synthetic
gttttagatctttctcgatcatgt

SEQ ID NO: 27592 - DNA, 21 bp, Artificial Sequence
  Synthetic
cttgtctgaaagcttccaatc

SEQ ID NO: 27593 - DNA, 23 bp, Artificial Sequence
  Synthetic
ccaagttcatcttctagtgttga

SEQ ID NO: 27594 - DNA, 18 bp, Artificial Sequence
  Synthetic
taggtcttcttgggggtc

SEQ ID NO: 27595 - DNA, 21 bp, Artificial Sequence
  Synthetic
gatcaatatcctccgtgttct

SEQ ID NO: 27596 - DNA, 19 bp, Artificial Sequence
  Synthetic
agttgtgtttgtctgttcg

SEQ ID NO: 27597 - DNA, 23 bp, Artificial Sequence
  Synthetic
gttgcatttgattcattgtatga

SEQ ID NO: 27598 - DNA, 22 bp, Artificial Sequence
  Synthetic
tctaaataccgagatccatgtt

SEQ ID NO: 27599 - DNA, 23 bp, Artificial Sequence
  Synthetic
cgtacaattcacgaagattactc

SEQ ID NO: 27600 - DNA, 25 bp, Artificial Sequence
  Synthetic
gtcctaagtttttgattatccctta

SEQ ID NO: 27601 - DNA, 19 bp, Artificial Sequence
  Synthetic
cccctccaaagaatcgttt

SEQ ID NO: 27602 - DNA, 18 bp, Artificial Sequence
  Synthetic
acatctgctccacctaga

SEQ ID NO: 27603 - DNA, 21 bp, Artificial Sequence
  Synthetic
tgtgtagaatgcaagagttcc

SEQ ID NO: 27604 - DNA, 21 bp, Artificial Sequence
  Synthetic
gagcttgttgttatgagtagc

SEQ ID NO: 27605 - DNA, 18 bp, Artificial Sequence
  Synthetic
cacagccatcaacagtcg

SEQ ID NO: 27606 - DNA, 21 bp, Artificial Sequence
  Synthetic
gactataagatgcctgattgc

SEQ ID NO: 27607 - DNA, 18 bp, Artificial Sequence
  Synthetic
ccagctgagagtgttctg

SEQ ID NO: 27608 - DNA, 23 bp, Artificial Sequence
  Synthetic
aattgtcaaatcctcatctaact

SEQ ID NO: 27609 - DNA, 23 bp, Artificial Sequence
  Synthetic
tgaataaccattctcaattgctt

SEQ ID NO: 27610 - DNA, 19 bp, Artificial Sequence
  Synthetic
atgcagcaactgatggatc

SEQ ID NO: 27611 - DNA, 22 bp, Artificial Sequence
  Synthetic
ttctgatcctgttattaccacc

SEQ ID NO: 27612 - DNA, 24 bp, Artificial Sequence
  Synthetic
ttgcagtatcttttaatctgtgtg

SEQ ID NO: 27613 - DNA, 18 bp, Artificial Sequence
  Synthetic
aatctcgtgacggaacac

SEQ ID NO: 27614 - DNA, 20 bp, Artificial Sequence
  Synthetic
tgcagacccataacatatgt

SEQ ID NO: 27615 - DNA, 23 bp, Artificial Sequence
  Synthetic
accatgcacatattcaatctctt

SEQ ID NO: 27616 - DNA, 19 bp, Artificial Sequence
  Synthetic
actgatcacgttgcaacaa

SEQ ID NO: 27617 - DNA, 18 bp, Artificial Sequence
  Synthetic
tttcagcacccaacatgg

SEQ ID NO: 27618 - DNA, 19 bp, Artificial Sequence
  Synthetic
aagcgcattatcaagcaaa

SEQ ID NO: 27619 - DNA, 19 bp, Artificial Sequence
  Synthetic
acatcgccaattacaacag

SEQ ID NO: 27620 - DNA, 20 bp, Artificial Sequence
  Synthetic
ttagactctgcagctttcac

SEQ ID NO: 27621 - DNA, 23 bp, Artificial Sequence
  Synthetic
acaatgtaaggtttatcaaaagc

SEQ ID NO: 27622 - DNA, 23 bp, Artificial Sequence
  Synthetic
ttcttataaaagacgtgctcatc

SEQ ID NO: 27623 - DNA, 21 bp, Artificial Sequence
  Synthetic
cgccttcttcatcataaatgt

SEQ ID NO: 27624 - DNA, 20 bp, Artificial Sequence
  Synthetic
cgtatacattgctcagcagt

SEQ ID NO: 27625 - DNA, 21 bp, Artificial Sequence
  Synthetic
aactgcctaattgtacacatg

SEQ ID NO: 27626 - DNA, 22 bp, Artificial Sequence
  Synthetic
gtcaacaccattaacaacagta

SEQ ID NO: 27627 - DNA, 21 bp, Artificial Sequence
  Synthetic
acacacaacaagtcttctgta

SEQ ID NO: 27628 - DNA, 25 bp, Artificial Sequence
  Synthetic
cctacaaaagaaacattacaagtca

SEQ ID NO: 27629 - DNA, 21 bp, Artificial Sequence
  Synthetic
ccattaacaacagcactttca

SEQ ID NO: 27630 - DNA, 19 bp, Artificial Sequence
  Synthetic
agcaacaccactcaaaagt

SEQ ID NO: 27631 - DNA, 22 bp, Artificial Sequence
  Synthetic
gcaaaactactgagtacaatgt

SEQ ID NO: 27632 - DNA, 21 bp, Artificial Sequence
  Synthetic
tgacaatgaaaggttgcatat

SEQ ID NO: 27633 - DNA, 22 bp, Artificial Sequence
  Synthetic
acaaaacttactaccaccattt

SEQ ID NO: 27634 - DNA, 18 bp, Artificial Sequence
  Synthetic
tacaacacgccaagtcat

SEQ ID NO: 27635 - DNA, 20 bp, Artificial Sequence
  Synthetic
atcaaacacacaagaccaca

SEQ ID NO: 27636 - DNA, 19 bp, Artificial Sequence
  Synthetic
caggtgttgtgactccaaa

SEQ ID NO: 27637 - DNA, 18 bp, Artificial Sequence
  Synthetic
aacgtaaccattggcaac

SEQ ID NO: 27638 - DNA, 21 bp, Artificial Sequence
  Synthetic
tcagcaaactaggtaacaaac

SEQ ID NO: 27639 - DNA, 18 bp, Artificial Sequence
  Synthetic
atagcagacacggacaac

SEQ ID NO: 27640 - DNA, 19 bp, Artificial Sequence
  Synthetic
tgttcacaccaaaaacacc

SEQ ID NO: 27641 - DNA, 22 bp, Artificial Sequence
  Synthetic
tcattataatgctccacaaaca

SEQ ID NO: 27642 - DNA, 23 bp, Artificial Sequence
  Synthetic
aaatgtaagacagagtgacaaag

SEQ ID NO: 27643 - DNA, 20 bp, Artificial Sequence
  Synthetic
accagcaaactaacgtagtc

SEQ ID NO: 27644 - DNA, 22 bp, Artificial Sequence
  Synthetic
agtttaaaagacagaaagagcg

SEQ ID NO: 27645 - DNA, 19 bp, Artificial Sequence
  Synthetic
aagaaaaaggccaacaacg

SEQ ID NO: 27646 - DNA, 19 bp, Artificial Sequence
  Synthetic
tgcatggcactaacaactt

SEQ ID NO: 27647 - DNA, 18 bp, Artificial Sequence
  Synthetic
acgacacgttcacaagtc

SEQ ID NO: 27648 - DNA, 22 bp, Artificial Sequence
  Synthetic
agatacttaatttggggtccag

SEQ ID NO: 27649 - DNA, 19 bp, Artificial Sequence
  Synthetic
tcctgcgtagtgttggaat

SEQ ID NO: 27650 - DNA, 20 bp, Artificial Sequence
  Synthetic
aatgcacggacacagtaatc

SEQ ID NO: 27651 - DNA, 20 bp, Artificial Sequence
  Synthetic
tctatggggtcaaaccaatt

SEQ ID NO: 27652 - DNA, 24 bp, Artificial Sequence
  Synthetic
aagatgtcacttttcataaagcac

SEQ ID NO: 27653 - DNA, 22 bp, Artificial Sequence
  Synthetic
tgttaacatctttgttccacac

SEQ ID NO: 27654 - DNA, 18 bp, Artificial Sequence
  Synthetic
attgcagcatcacccttt

SEQ ID NO: 27655 - DNA, 20 bp, Artificial Sequence
  Synthetic
gccataaaacttggtagtgc

SEQ ID NO: 27656 - DNA, 20 bp, Artificial Sequence
  Synthetic
agatcttcctcagtccaaca

SEQ ID NO: 27657 - DNA, 21 bp, Artificial Sequence
  Synthetic
agatgtttgacccagtctaac

SEQ ID NO: 27658 - DNA, 19 bp, Artificial Sequence
  Synthetic
gcgaatgtcagaccaatca

SEQ ID NO: 27659 - DNA, 22 bp, Artificial Sequence
  Synthetic
agcaacattatgagaagtcaaa

SEQ ID NO: 27660 - DNA, 18 bp, Artificial Sequence
  Synthetic
aacactcaactctggcac

SEQ ID NO: 27661 - DNA, 23 bp, Artificial Sequence
  Synthetic
caacattatagtcaattggttcc

SEQ ID NO: 27662 - DNA, 25 bp, Artificial Sequence
  Synthetic
gcgaatataacatagtcatattcac

SEQ ID NO: 27663 - DNA, 22 bp, Artificial Sequence
  Synthetic
cacatgttcataggtacaaaca

SEQ ID NO: 27664 - DNA, 20 bp, Artificial Sequence
  Synthetic
gttagaacacaaccttcagg

SEQ ID NO: 27665 - DNA, 22 bp, Artificial Sequence
  Synthetic
caatgcatgtttaaagcaacaa

SEQ ID NO: 27666 - DNA, 21 bp, Artificial Sequence
  Synthetic
gattgctttagggttgtacaa

SEQ ID NO: 27667 - DNA, 18 bp, Artificial Sequence
  Synthetic
aacggtgctggtttcaat

SEQ ID NO: 27668 - DNA, 22 bp, Artificial Sequence
  Synthetic
ctaatggctactggtaattcac

SEQ ID NO: 27669 - DNA, 21 bp, Artificial Sequence
  Synthetic
cagagtaaaacgttcgtatga

SEQ ID NO: 27670 - DNA, 20 bp, Artificial Sequence
  Synthetic
cacgcctatatccatgttca

SEQ ID NO: 27671 - DNA, 23 bp, Artificial Sequence
  Synthetic
gcattatctttacaccatagcat

SEQ ID NO: 27672 - DNA, 18 bp, Artificial Sequence
  Synthetic
aacaacaattgcgtcgtg

SEQ ID NO: 27673 - DNA, 25 bp, Artificial Sequence
  Synthetic
gtgtttgcaattaaatttactcagg

SEQ ID NO: 27674 - DNA, 23 bp, Artificial Sequence
  Synthetic
aggaaccaattattgaatgcaaa

SEQ ID NO: 27675 - DNA, 18 bp, Artificial Sequence
  Synthetic
aatgtcctgtgcgtgaaa

SEQ ID NO: 27676 - DNA, 20 bp, Artificial Sequence
  Synthetic
taacagttaaagcacttgcc

SEQ ID NO: 27677 - DNA, 21 bp, Artificial Sequence
  Synthetic
cagcttgctgataaacaacaa

SEQ ID NO: 27678 - DNA, 18 bp, Artificial Sequence
  Synthetic
ctcaacctggaccgaagt

SEQ ID NO: 27679 - DNA, 18 bp, Artificial Sequence
  Synthetic
cttctatggcactgcgac

SEQ ID NO: 27680 - DNA, 22 bp, Artificial Sequence
  Synthetic
tgttaaaagatgcagcaagaat

SEQ ID NO: 27681 - DNA, 18 bp, Artificial Sequence
  Synthetic
ttgttgtgcaagctgtct

SEQ ID NO: 27682 - DNA, 23 bp, Artificial Sequence
  Synthetic
gtgacattgcaattttcaatttg

SEQ ID NO: 27683 - DNA, 20 bp, Artificial Sequence
  Synthetic
agccactttaagtcgactaa

SEQ ID NO: 27684 - DNA, 21 bp, Artificial Sequence
  Synthetic
gcattgctaagcgattgatta

SEQ ID NO: 27685 - DNA, 21 bp, Artificial Sequence
  Synthetic
gtgtggttacattgaagacaa

SEQ ID NO: 27686 - DNA, 23 bp, Artificial Sequence
  Synthetic
atatgattggtaaatgtggtaca

SEQ ID NO: 27687 - DNA, 19 bp, Artificial Sequence
  Synthetic
taacgagtgttgatacggc

SEQ ID NO: 27688 - DNA, 21 bp, Artificial Sequence
  Synthetic
ctttcgttttctgtcatgttg

SEQ ID NO: 27689 - DNA, 19 bp, Artificial Sequence
  Synthetic
ggtcctgtgccaagataat

SEQ ID NO: 27690 - DNA, 20 bp, Artificial Sequence
  Synthetic
tacgagaaggcttaggagta

SEQ ID NO: 27691 - DNA, 21 bp, Artificial Sequence
  Synthetic
tttagctttaacaccattggc

SEQ ID NO: 27692 - DNA, 23 bp, Artificial Sequence
  Synthetic
gcatgtttagtttacttcatcaa

SEQ ID NO: 27693 - DNA, 21 bp, Artificial Sequence
  Synthetic
tgcgatctttgattactccag

SEQ ID NO: 27694 - DNA, 21 bp, Artificial Sequence
  Synthetic
aagtagccaaatacctaggac

SEQ ID NO: 27695 - DNA, 18 bp, Artificial Sequence
  Synthetic
cacacttagcagctgact

SEQ ID NO: 27696 - DNA, 19 bp, Artificial Sequence
  Synthetic
tgcaaaatgtccaggcact

SEQ ID NO: 27697 - DNA, 21 bp, Artificial Sequence
  Synthetic
attgcaccataggagctaatt

SEQ ID NO: 27698 - DNA, 24 bp, Artificial Sequence
  Synthetic
attaattagctttttccagtctcc

SEQ ID NO: 27699 - DNA, 21 bp, Artificial Sequence
  Synthetic
aggtcttctgaatcttggtaa

SEQ ID NO: 27700 - DNA, 22 bp, Artificial Sequence
  Synthetic
gtgtgttagatggtccttttac

SEQ ID NO: 27701 - DNA, 18 bp, Artificial Sequence
  Synthetic
acatacccagaggaaccc

SEQ ID NO: 27702 - DNA, 20 bp, Artificial Sequence
  Synthetic
gcagagggtctacaggtaca

SEQ ID NO: 27703 - DNA, 25 bp, Artificial Sequence
  Synthetic
tatccaaaggtatagattcaccaat

SEQ ID NO: 27704 - DNA, 18 bp, Artificial Sequence
  Synthetic
gcagcagcagcaagtgta

SEQ ID NO: 27705 - DNA, 21 bp, Artificial Sequence
  Synthetic
gtttaccaccagtagaggtta

SEQ ID NO: 27706 - DNA, 20 bp, Artificial Sequence
  Synthetic
cacgtaatcatctgtaggca

SEQ ID NO: 27707 - DNA, 19 bp, Artificial Sequence
  Synthetic
gtagacccaacacctaacg

SEQ ID NO: 27708 - DNA, 23 bp, Artificial Sequence
  Synthetic
gactccccaggaataatatatgt

SEQ ID NO: 27709 - DNA, 18 bp, Artificial Sequence
  Synthetic
tttccttagggggctctg

SEQ ID NO: 27710 - DNA, 20 bp, Artificial Sequence
  Synthetic
attgatggcctggaactgac

SEQ ID NO: 27711 - DNA, 17 bp, Artificial Sequence
  Synthetic
tgaccctgtccgtgtgc

SEQ ID NO: 27712 - DNA, 20 bp, Artificial Sequence
  Synthetic
gatccaggtgtagatgcagg

SEQ ID NO: 27713 - DNA, 19 bp, Artificial Sequence
  Synthetic
cgctcctccacctcaaaca

SEQ ID NO: 27714 - DNA, 20 bp, Artificial Sequence
  Synthetic
ggcaaaggatgaccaggttc

SEQ ID NO: 27715 - DNA, 20 bp, Artificial Sequence
  Synthetic
gcaaaacatatggcatcccg

SEQ ID NO: 27716 - DNA, 22 bp, Artificial Sequence
  Synthetic
atgatagaattccaggaggttt

SEQ ID NO: 27717 - DNA, 16 bp, Artificial Sequence
  Synthetic
aagtttgggggcgccc

SEQ ID NO: 27718 - DNA, 19 bp, Artificial Sequence
  Synthetic
ggtggagtgttgggcttag

SEQ ID NO: 27719 - DNA, 19 bp, Artificial Sequence
  Synthetic
tacccctgaaggtgaaccg

SEQ ID NO: 27720 - DNA, 16 bp, Artificial Sequence
  Synthetic
agagaagggccggtgg

SEQ ID NO: 27721 - DNA, 20 bp, Artificial Sequence
  Synthetic
taccacctcctcttcttgct

SEQ ID NO: 27722 - DNA, 20 bp, Artificial Sequence
  Synthetic
ccactttataccaggggcag

SEQ ID NO: 27723 - DNA, 19 bp, Artificial Sequence
  Synthetic
ggacccttctacggactcg

SEQ ID NO: 27724 - DNA, 20 bp, Artificial Sequence
  Synthetic
ggaaatgcataggagtgcga

SEQ ID NO: 27725 - DNA, 16 bp, Artificial Sequence
  Synthetic
ccttcttccacggcgc

SEQ ID NO: 27726 - DNA, 16 bp, Artificial Sequence
  Synthetic
tccacacccaccaccg

SEQ ID NO: 27727 - DNA, 16 bp, Artificial Sequence
  Synthetic
atcgagctcgctggcg

SEQ ID NO: 27728 - DNA, 18 bp, Artificial Sequence
  Synthetic
catcactctcccaggccc

SEQ ID NO: 27729 - DNA, 20 bp, Artificial Sequence
  Synthetic
tccttctacgagcacgaaga

SEQ ID NO: 27730 - DNA, 19 bp, Artificial Sequence
  Synthetic
aacgctgcaggatctggtc

SEQ ID NO: 27731 - DNA, 17 bp, Artificial Sequence
  Synthetic
aagtcgagggcatggcc

SEQ ID NO: 27732 - DNA, 20 bp, Artificial Sequence
  Synthetic
gccgctatgctattgggaat

SEQ ID NO: 27733 - DNA, 18 bp, Artificial Sequence
  Synthetic
agagtatggggcccctcc

SEQ ID NO: 27734 - DNA, 19 bp, Artificial Sequence
  Synthetic
aggaggagaacccgaggat

SEQ ID NO: 27735 - DNA, 17 bp, Artificial Sequence
  Synthetic
aaaaccatcccccggcc

SEQ ID NO: 27736 - DNA, 16 bp, Artificial Sequence
  Synthetic
tttgctcgcacggccc

SEQ ID NO: 27737 - DNA, 18 bp, Artificial Sequence
  Synthetic
cagatccctctggcgacg

SEQ ID NO: 27738 - DNA, 20 bp, Artificial Sequence
  Synthetic
acctccctcttttcactcct

SEQ ID NO: 27739 - DNA, 18 bp, Artificial Sequence
  Synthetic
tactgccggtccctgagg

SEQ ID NO: 27740 - DNA, 18 bp, Artificial Sequence
  Synthetic
agagcctctccaggtccc

SEQ ID NO: 27741 - DNA, 15 bp, Artificial Sequence
  Synthetic
gcaggtcgcgccaaa

SEQ ID NO: 27742 - DNA, 17 bp, Artificial Sequence
  Synthetic
tcatccccctgcgtgtc

SEQ ID NO: 27743 - DNA, 17 bp, Artificial Sequence
  Synthetic
ctaacggccggaatgcg

SEQ ID NO: 27744 - DNA, 17 bp, Artificial Sequence
  Synthetic
cctcgcgagctgaacag

SEQ ID NO: 27745 - DNA, 20 bp, Artificial Sequence
  Synthetic
tgatagagggacatctgggc

SEQ ID NO: 27746 - DNA, 17 bp, Artificial Sequence
  Synthetic
gcgcacctacttcaccc

SEQ ID NO: 27747 - DNA, 16 bp, Artificial Sequence
  Synthetic
tgccatcctctcgcgg

SEQ ID NO: 27748 - DNA, 18 bp, Artificial Sequence
  Synthetic
cctccagaatcagcggcg

SEQ ID NO: 27749 - DNA, 20 bp, Artificial Sequence
  Synthetic
aacaagaccaccatcctgct

SEQ ID NO: 27750 - DNA, 20 bp, Artificial Sequence
  Synthetic
ctggtcaaagaaggcgagaa

SEQ ID NO: 27751 - DNA, 20 bp, Artificial Sequence
  Synthetic
ggtttaacgagcagagaaga

SEQ ID NO: 27752 - DNA, 20 bp, Artificial Sequence
  Synthetic
ccgtcgctaaaaacacctgg

SEQ ID NO: 27753 - DNA, 19 bp, Artificial Sequence
  Synthetic
tttgacctgtgcctcagca

SEQ ID NO: 27754 - DNA, 17 bp, Artificial Sequence
  Synthetic
tgaacaggccactcggg

SEQ ID NO: 27755 - DNA, 18 bp, Artificial Sequence
  Synthetic
tacgttgttgcatgccgc

SEQ ID NO: 27756 - DNA, 16 bp, Artificial Sequence
  Synthetic
tcgcaggggcattggc

SEQ ID NO: 27757 - DNA, 20 bp, Artificial Sequence
  Synthetic
gagtccggacagtttcatgc

SEQ ID NO: 27758 - DNA, 20 bp, Artificial Sequence
  Synthetic
tttcctccagaaagagtgac

SEQ ID NO: 27759 - DNA, 17 bp, Artificial Sequence
  Synthetic
gcaaggatcccatgccc

SEQ ID NO: 27760 - DNA, 20 bp, Artificial Sequence
  Synthetic
ggtagatggcgagactcttg

SEQ ID NO: 27761 - DNA, 20 bp, Artificial Sequence
  Synthetic
atctacgcttttagccacgg

SEQ ID NO: 27762 - DNA, 16 bp, Artificial Sequence
  Synthetic
gcgaaccaagcccagg

SEQ ID NO: 27763 - DNA, 19 bp, Artificial Sequence
  Synthetic
agacactccgagcctactg

SEQ ID NO: 27764 - DNA, 18 bp, Artificial Sequence
  Synthetic
ttctggtagaggcgctgc

SEQ ID NO: 27765 - DNA, 18 bp, Artificial Sequence
  Synthetic
aacttccagcaccaggcg

SEQ ID NO: 27766 - DNA, 18 bp, Artificial Sequence
  Synthetic
tcgacctggtcctcggag

SEQ ID NO: 27767 - DNA, 16 bp, Artificial Sequence
  Synthetic
tcttgagccggctggg

SEQ ID NO: 27768 - DNA, 20 bp, Artificial Sequence
  Synthetic
tcttccagcctctctttcca

SEQ ID NO: 27769 - DNA, 18 bp, Artificial Sequence
  Synthetic
acaagcgttttgacccac

SEQ ID NO: 27770 - DNA, 18 bp, Artificial Sequence
  Synthetic
gacctgcttctggacgcc

SEQ ID NO: 27771 - DNA, 19 bp, Artificial Sequence
  Synthetic
tggtatcatgcacctcgct

SEQ ID NO: 27772 - DNA, 18 bp, Artificial Sequence
  Synthetic
cttctacggccccaggtc

SEQ ID NO: 27773 - DNA, 16 bp, Artificial Sequence
  Synthetic
cggctactcgggggtt

SEQ ID NO: 27774 - DNA, 19 bp, Artificial Sequence
  Synthetic
ctcaagggggtcagtacct

SEQ ID NO: 27775 - DNA, 16 bp, Artificial Sequence
  Synthetic
ttcgctcttggccggg

SEQ ID NO: 27776 - DNA, 19 bp, Artificial Sequence
  Synthetic
acattttccccaggcagtc

SEQ ID NO: 27777 - DNA, 19 bp, Artificial Sequence
  Synthetic
tgtcgcccgatgtcgtaaa

SEQ ID NO: 27778 - DNA, 19 bp, Artificial Sequence
  Synthetic
ttcactatctgctgctgac

SEQ ID NO: 27779 - DNA, 20 bp, Artificial Sequence
  Synthetic
cgatttgacctcacacgaga

SEQ ID NO: 27780 - DNA, 18 bp, Artificial Sequence
  Synthetic
gtggtgctacgcgagttg

SEQ ID NO: 27781 - DNA, 20 bp, Artificial Sequence
  Synthetic
gggtcacctgactactgaga

SEQ ID NO: 27782 - DNA, 19 bp, Artificial Sequence
  Synthetic
tctcttcgaacacctggcc

SEQ ID NO: 27783 - DNA, 20 bp, Artificial Sequence
  Synthetic
gcagcctatttttgagcacc

SEQ ID NO: 27784 - DNA, 17 bp, Artificial Sequence
  Synthetic
catgtgtgtgggcgcag

SEQ ID NO: 27785 - DNA, 17 bp, Artificial Sequence
  Synthetic
cgtgagtggcaagggct

SEQ ID NO: 27786 - DNA, 19 bp, Artificial Sequence
  Synthetic
gcggcctgtttctaaacgt

SEQ ID NO: 27787 - DNA, 20 bp, Artificial Sequence
  Synthetic
ccagatcttcctcagtggct

SEQ ID NO: 27788 - DNA, 17 bp, Artificial Sequence
  Synthetic
acgagcgggatagcagg

SEQ ID NO: 27789 - DNA, 17 bp, Artificial Sequence
  Synthetic
tccgtgaaggcagggtc

SEQ ID NO: 27790 - DNA, 16 bp, Artificial Sequence
  Synthetic
ttgccgatgccctggc

SEQ ID NO: 27791 - DNA, 17 bp, Artificial Sequence
  Synthetic
aagaagctgctggcggc

SEQ ID NO: 27792 - DNA, 17 bp, Artificial Sequence
  Synthetic
tcttgcgggccaacacc

SEQ ID NO: 27793 - DNA, 16 bp, Artificial Sequence
  Synthetic
acggccaccaacgagg

SEQ ID NO: 27794 - DNA, 17 bp, Artificial Sequence
  Synthetic
gccaagctgcagtcctg

SEQ ID NO: 27795 - DNA, 17 bp, Artificial Sequence
  Synthetic
cgctttcggggcgtaag

SEQ ID NO: 27796 - DNA, 19 bp, Artificial Sequence
  Synthetic
actggcagctgaaccagaa

SEQ ID NO: 27797 - DNA, 16 bp, Artificial Sequence
  Synthetic
ccggccagcctcaact

SEQ ID NO: 27798 - DNA, 19 bp, Artificial Sequence
  Synthetic
tgcacagactagcgaggat

SEQ ID NO: 27799 - DNA, 18 bp, Artificial Sequence
  Synthetic
cggtgttcacccgggatg

SEQ ID NO: 27800 - DNA, 18 bp, Artificial Sequence
  Synthetic
atatccgccgtctgctgc

SEQ ID NO: 27801 - DNA, 19 bp, Artificial Sequence
  Synthetic
ctgctaactcttgcaaaca

SEQ ID NO: 27802 - DNA, 20 bp, Artificial Sequence
  Synthetic
ctctataagggctatgctcc

SEQ ID NO: 27803 - DNA, 22 bp, Artificial Sequence
  Synthetic
aaacaatcgtcttttgctttgt

SEQ ID NO: 27804 - DNA, 21 bp, Artificial Sequence
  Synthetic
gctgactcatgactaagcata

SEQ ID NO: 27805 - DNA, 19 bp, Artificial Sequence
  Synthetic
agtgcatcgaaacgaactg

SEQ ID NO: 27806 - DNA, 18 bp, Artificial Sequence
  Synthetic
ggaggaactgactgatcc

SEQ ID NO: 27807 - DNA, 23 bp, Artificial Sequence
  Synthetic
ggggtaatttctgatagaggtac

SEQ ID NO: 27808 - DNA, 18 bp, Artificial Sequence
  Synthetic
ctgaatgtgacgcccata

SEQ ID NO: 27809 - DNA, 23 bp, Artificial Sequence
  Synthetic
tttcatcgtctacagtatccatt

SEQ ID NO: 27810 - DNA, 18 bp, Artificial Sequence
  Synthetic
ggccaaagagctgtttca

SEQ ID NO: 27811 - DNA, 25 bp, Artificial Sequence
  Synthetic
gtcatatctatttcccaaaatgtgt

SEQ ID NO: 27812 - DNA, 19 bp, Artificial Sequence
  Synthetic
aaacggttggtgaatgtcc

SEQ ID NO: 27813 - DNA, 20 bp, Artificial Sequence
  Synthetic
aggttaacagagtgtgtcac

SEQ ID NO: 27814 - DNA, 23 bp, Artificial Sequence
  Synthetic
ttctttgggaaatatttcgaatc

SEQ ID NO: 27815 - DNA, 25 bp, Artificial Sequence
  Synthetic
attctgatagatattctgttgatcc

SEQ ID NO: 27816 - DNA, 21 bp, Artificial Sequence
  Synthetic
tgttacactcatgcattgatg

SEQ ID NO: 27817 - DNA, 21 bp, Artificial Sequence
  Synthetic
ccctgttcattctgatgatga

SEQ ID NO: 27818 - DNA, 18 bp, Artificial Sequence
  Synthetic
gaaactgattgcccccag

SEQ ID NO: 27819 - DNA, 21 bp, Artificial Sequence
  Synthetic
gcggtcatatgaaaatgtgta

SEQ ID NO: 27820 - DNA, 21 bp, Artificial Sequence
  Synthetic
tcttttccaactacagcaaat

SEQ ID NO: 27821 - DNA, 21 bp, Artificial Sequence
  Synthetic
ccacctctggtatagtagctt

SEQ ID NO: 27822 - DNA, 25 bp, Artificial Sequence
  Synthetic
ctacagcattctttaggatctaatt

SEQ ID NO: 27823 - DNA, 19 bp, Artificial Sequence
  Synthetic
gcaattgtgtttgttgctc

SEQ ID NO: 27824 - DNA, 20 bp, Artificial Sequence
  Synthetic
acagctttcacattgctatg

SEQ ID NO: 27825 - DNA, 20 bp, Artificial Sequence
  Synthetic
acttcagatacttgcagcaa

SEQ ID NO: 27826 - DNA, 20 bp, Artificial Sequence
  Synthetic
gtaaaaaagccctggcatta

SEQ ID NO: 27827 - DNA, 19 bp, Artificial Sequence
  Synthetic
gctgagagtttccatcctc

SEQ ID NO: 27828 - DNA, 22 bp, Artificial Sequence
  Synthetic
gcaatagtaaaaccatgccaat

SEQ ID NO: 27829 - DNA, 20 bp, Artificial Sequence
  Synthetic
gggatgatgtcctggatcct

SEQ ID NO: 27830 - DNA, 16 bp, Artificial Sequence
  Synthetic
ggagtgggagcgggaa

SEQ ID NO: 27831 - DNA, 18 bp, Artificial Sequence
  Synthetic
aatcattcgcgctcttcc

SEQ ID NO: 27832 - DNA, 18 bp, Artificial Sequence
  Synthetic
gtggacatgtaccagcag

SEQ ID NO: 27833 - DNA, 20 bp, Artificial Sequence
  Synthetic
gggtcaattggtctgactgt

SEQ ID NO: 27834 - DNA, 18 bp, Artificial Sequence
  Synthetic
attgagttcgtgcaacac

SEQ ID NO: 27835 - DNA, 18 bp, Artificial Sequence
  Synthetic
tacgtgtgcggattgttg

SEQ ID NO: 27836 - DNA, 25 bp, Artificial Sequence
  Synthetic
gaattaaaatccacatcttcaacag

SEQ ID NO: 27837 - DNA, 21 bp, Artificial Sequence
  Synthetic
agacactttagggacttcaat

SEQ ID NO: 27838 - DNA, 20 bp, Artificial Sequence
  Synthetic
gatgtgttttgcctgtcatc

SEQ ID NO: 27839 - DNA, 24 bp, Artificial Sequence
  Synthetic
gttactaatgacccacttactgta

SEQ ID NO: 27840 - DNA, 19 bp, Artificial Sequence
  Synthetic
cttggattttcgtgtcctc

SEQ ID NO: 27841 - DNA, 21 bp, Artificial Sequence
  Synthetic
gtcccaggatatattcgtctc

SEQ ID NO: 27842 - DNA, 18 bp, Artificial Sequence
  Synthetic
tgtcctatgagcgctgat

SEQ ID NO: 27843 - DNA, 21 bp, Artificial Sequence
  Synthetic
agatttcttcttacccttggg

SEQ ID NO: 27844 - DNA, 20 bp, Artificial Sequence
  Synthetic
gaatgctcaaatcaaaggcg

SEQ ID NO: 27845 - DNA, 23 bp, Artificial Sequence
  Synthetic
tactctgaaatggattcttgatg

SEQ ID NO: 27846 - DNA, 22 bp, Artificial Sequence
  Synthetic
tagacatgaagtatgcagagac

SEQ ID NO: 27847 - DNA, 20 bp, Artificial Sequence
  Synthetic
aagcgatacgactatctagc

SEQ ID NO: 27848 - DNA, 22 bp, Artificial Sequence
  Synthetic
ccatattcaaagcctaaaacgg

SEQ ID NO: 27849 - DNA, 23 bp, Artificial Sequence
  Synthetic
cttttttctggatcaaaacgttc

SEQ ID NO: 27850 - DNA, 22 bp, Artificial Sequence
  Synthetic
actctctccatgatctttcaag

SEQ ID NO: 27851 - DNA, 22 bp, Artificial Sequence
  Synthetic
cgattcttttctcgttcaatga

SEQ ID NO: 27852 - DNA, 24 bp, Artificial Sequence
  Synthetic
tgattatctaattcaaacagctcc

SEQ ID NO: 27853 - DNA, 20 bp, Artificial Sequence
  Synthetic
caggcgttatggttatgcta

SEQ ID NO: 27854 - DNA, 21 bp, Artificial Sequence
  Synthetic
acaaaacaatcacaacagctc

SEQ ID NO: 27855 - DNA, 20 bp, Artificial Sequence
  Synthetic
aagagagctcagatctgtgt

SEQ ID NO: 27856 - DNA, 18 bp, Artificial Sequence
  Synthetic
acaggagacaatggcaac

SEQ ID NO: 27857 - DNA, 19 bp, Artificial Sequence
  Synthetic
ccattattccacccccatc

SEQ ID NO: 27858 - DNA, 21 bp, Artificial Sequence
  Synthetic
gttggtaaaggatgtctgatg

SEQ ID NO: 27859 - DNA, 23 bp, Artificial Sequence
  Synthetic
gtatgagactgatagatgtttgt

SEQ ID NO: 27860 - DNA, 25 bp, Artificial Sequence
  Synthetic
ctctagatccttaaatagagcattt

SEQ ID NO: 27861 - DNA, 21 bp, Artificial Sequence
  Synthetic
ctctgctatcgaaaaggtttc

SEQ ID NO: 27862 - DNA, 19 bp, Artificial Sequence
  Synthetic
gagttcgaggtgtttctct

SEQ ID NO: 27863 - DNA, 20 bp, Artificial Sequence
  Synthetic
tggtttatgaagtggtggat

SEQ ID NO: 27864 - DNA, 21 bp, Artificial Sequence
  Synthetic
ttgttgcttataagaaggctg

SEQ ID NO: 27865 - DNA, 21 bp, Artificial Sequence
  Synthetic
tacttctcccagactgttctt

SEQ ID NO: 27866 - DNA, 21 bp, Artificial Sequence
  Synthetic
tcgatattacggagacaaaga

SEQ ID NO: 27867 - DNA, 21 bp, Artificial Sequence
  Synthetic
acgaactcatagactagggat

SEQ ID NO: 27868 - DNA, 20 bp, Artificial Sequence
  Synthetic
cttgtggttcagtaggagaa

SEQ ID NO: 27869 - DNA, 18 bp, Artificial Sequence
  Synthetic
gaacccctacatccatgc

SEQ ID NO: 27870 - DNA, 20 bp, Artificial Sequence
  Synthetic
ataccataaacagcctcagt

SEQ ID NO: 27871 - DNA, 23 bp, Artificial Sequence
  Synthetic
ccacaaaccaaaaccttctatag

SEQ ID NO: 27872 - DNA, 18 bp, Artificial Sequence
  Synthetic
taaccgcgaatcccatag

SEQ ID NO: 27873 - DNA, 19 bp, Artificial Sequence
  Synthetic
ttgggttcttctgagctag

SEQ ID NO: 27874 - DNA, 24 bp, Artificial Sequence
  Synthetic
catactaagttgtccattgttgat

SEQ ID NO: 27875 - DNA, 21 bp, Artificial Sequence
  Synthetic
aaacttcaataaacgaaagcg

SEQ ID NO: 27876 - DNA, 20 bp, Artificial Sequence
  Synthetic
acggtaaaagaaggtcgttt

SEQ ID NO: 27877 - DNA, 20 bp, Artificial Sequence
  Synthetic
ctgagagagattgtggtact

SEQ ID NO: 27878 - DNA, 23 bp, Artificial Sequence
  Synthetic
ttaaaaaacacttgttggagaga

SEQ ID NO: 27879 - DNA, 20 bp, Artificial Sequence
  Synthetic
tggttcggtttctttacctc

SEQ ID NO: 27880 - DNA, 18 bp, Artificial Sequence
  Synthetic
aagaagaaggtggacgac

SEQ ID NO: 27881 - DNA, 21 bp, Artificial Sequence
  Synthetic
gttactggggttgaaatgttc

SEQ ID NO: 27882 - DNA, 21 bp, Artificial Sequence
  Synthetic
atagagttgtacaagcgattg

SEQ ID NO: 27883 - DNA, 21 bp, Artificial Sequence
  Synthetic
tcctccaactaaaagaccatt

SEQ ID NO: 27884 - DNA, 25 bp, Artificial Sequence
  Synthetic
cgttttatttttatagcggacttct

SEQ ID NO: 27885 - DNA, 18 bp, Artificial Sequence
  Synthetic
taaggatggccgattcgt

SEQ ID NO: 27886 - DNA, 22 bp, Artificial Sequence
  Synthetic
ctgatacaccagaaatagtcga

SEQ ID NO: 27887 - DNA, 19 bp, Artificial Sequence
  Synthetic
aggacttggagaagctttc

SEQ ID NO: 27888 - DNA, 18 bp, Artificial Sequence
  Synthetic
agttcacgagcagtttgc

SEQ ID NO: 27889 - DNA, 18 bp, Artificial Sequence
  Synthetic
gcgctcatttcttggttg

SEQ ID NO: 27890 - DNA, 21 bp, Artificial Sequence
  Synthetic
cttgaagcttttggtacagta

SEQ ID NO: 27891 - DNA, 18 bp, Artificial Sequence
  Synthetic
gtcggagatactgggagg

SEQ ID NO: 27892 - DNA, 18 bp, Artificial Sequence
  Synthetic
agcaattgtggctatcgc

SEQ ID NO: 27893 - DNA, 22 bp, Artificial Sequence
  Synthetic
atctgtatcaaaaaaaggcagc

SEQ ID NO: 27894 - DNA, 23 bp, Artificial Sequence
  Synthetic
cttttttatggttttgtctgtgc

SEQ ID NO: 27895 - DNA, 20 bp, Artificial Sequence
  Synthetic
gtaacgacatcattgcatga

SEQ ID NO: 27896 - DNA, 18 bp, Artificial Sequence
  Synthetic
gggatttggcgaagaaga

SEQ ID NO: 27897 - DNA, 18 bp, Artificial Sequence
  Synthetic
gatcgtgtgtgtcgtgat

SEQ ID NO: 27898 - DNA, 22 bp, Artificial Sequence
  Synthetic
caaaattttcgcaaaagcatac

SEQ ID NO: 27899 - DNA, 25 bp, Artificial Sequence
  Synthetic
ctttagagaaagtcataaatacgga

SEQ ID NO: 27900 - DNA, 20 bp, Artificial Sequence
  Synthetic
gctttagttgtggcttcaac

SEQ ID NO: 27901 - DNA, 20 bp, Artificial Sequence
  Synthetic
ggaaagactcctttggtgtt

SEQ ID NO: 27902 - DNA, 21 bp, Artificial Sequence
  Synthetic
gatcttttttggagcatatgc

SEQ ID NO: 27903 - DNA, 22 bp, Artificial Sequence
  Synthetic
acagtttctccatagatagcac

SEQ ID NO: 27904 - DNA, 19 bp, Artificial Sequence
  Synthetic
tcttggagcatcttgtgga

SEQ ID NO: 27905 - DNA, 24 bp, Artificial Sequence
  Synthetic
tcttcttcattaaaatcagcaacg

SEQ ID NO: 27906 - DNA, 19 bp, Artificial Sequence
  Synthetic
ggtcgaggacaatatgctc

SEQ ID NO: 27907 - DNA, 19 bp, Artificial Sequence
  Synthetic
caaagagactcccgtagac

SEQ ID NO: 27908 - DNA, 21 bp, Artificial Sequence
  Synthetic
aaagagttcagttccttggat

SEQ ID NO: 27909 - DNA, 20 bp, Artificial Sequence
  Synthetic
agtgcatgagaatcgtcttg

SEQ ID NO: 27910 - DNA, 18 bp, Artificial Sequence
  Synthetic
gttggagcacacatcacg

SEQ ID NO: 27911 - DNA, 22 bp, Artificial Sequence
  Synthetic
agaacgtccctaatattgaaga

SEQ ID NO: 27912 - DNA, 20 bp, Artificial Sequence
  Synthetic
aaggactggatatgaagtgg

SEQ ID NO: 27913 - DNA, 19 bp, Artificial Sequence
  Synthetic
gtaaaagagtgccttggtg

SEQ ID NO: 27914 - DNA, 24 bp, Artificial Sequence
  Synthetic
ggttacttccggatattaatgatc

SEQ ID NO: 27915 - DNA, 21 bp, Artificial Sequence
  Synthetic
ggatgagatgttgaagagagc

SEQ ID NO: 27916 - DNA, 23 bp, Artificial Sequence
  Synthetic
gaagagtaagaagttcattgctt

SEQ ID NO: 27917 - DNA, 19 bp, Artificial Sequence
  Synthetic
atgggaatgacgagtgatt

SEQ ID NO: 27918 - DNA, 18 bp, Artificial Sequence
  Synthetic
tgacttcggcgaatttgg

SEQ ID NO: 27919 - DNA, 22 bp, Artificial Sequence
  Synthetic
tttgggagtaaaagttcaggtt

SEQ ID NO: 27920 - DNA, 20 bp, Artificial Sequence
  Synthetic
gtagtgttgttgaagctcaa

SEQ ID NO: 27921 - DNA, 23 bp, Artificial Sequence
  Synthetic
taagaaaaggtccttttgttgat

SEQ ID NO: 27922 - DNA, 20 bp, Artificial Sequence
  Synthetic
gccattccactaaaaagcct

SEQ ID NO: 27923 - DNA, 19 bp, Artificial Sequence
  Synthetic
aaaacaattcccctgtgga

SEQ ID NO: 27924 - DNA, 25 bp, Artificial Sequence
  Synthetic
cctttggagataataatagaggatt

SEQ ID NO: 27925 - DNA, 18 bp, Artificial Sequence
  Synthetic
gaggggaaagcatcatca

SEQ ID NO: 27926 - DNA, 20 bp, Artificial Sequence
  Synthetic
acgccaatcaaaatctcctt

SEQ ID NO: 27927 - DNA, 19 bp, Artificial Sequence
  Synthetic
cctccgggatagtcttagg

SEQ ID NO: 27928 - DNA, 23 bp, Artificial Sequence
  Synthetic
tgttcttacacatatcgatcgta

SEQ ID NO: 27929 - DNA, 22 bp, Artificial Sequence
  Synthetic
atacgcggaaatttctacttct

SEQ ID NO: 27930 - DNA, 20 bp, Artificial Sequence
  Synthetic
ggtaagggatcaggaattcc

SEQ ID NO: 27931 - DNA, 21 bp, Artificial Sequence
  Synthetic
gtgttccaatttggtttggtt

SEQ ID NO: 27932 - DNA, 19 bp, Artificial Sequence
  Synthetic
tgttgttcgagatccttgg

SEQ ID NO: 27933 - DNA, 19 bp, Artificial Sequence
  Synthetic
ccattggagataaaagcgc

SEQ ID NO: 27934 - DNA, 22 bp, Artificial Sequence
  Synthetic
ctcttgatacagtttgaaagct

SEQ ID NO: 27935 - DNA, 19 bp, Artificial Sequence
  Synthetic
caagatattggtgtgcggt

SEQ ID NO: 27936 - DNA, 20 bp, Artificial Sequence
  Synthetic
acaggaaactctaacccttt

SEQ ID NO: 27937 - DNA, 20 bp, Artificial Sequence
  Synthetic
gtcaaaaagaaacggatcgt

SEQ ID NO: 27938 - DNA, 22 bp, Artificial Sequence
  Synthetic
agaagatacccacaataaaagc

SEQ ID NO: 27939 - DNA, 18 bp, Artificial Sequence
  Synthetic
ttctgccccatatctgca

SEQ ID NO: 27940 - DNA, 19 bp, Artificial Sequence
  Synthetic
tggtaagtgttcttcccac

SEQ ID NO: 27941 - DNA, 18 bp, Artificial Sequence
  Synthetic
aagctcactgttgctgtt

SEQ ID NO: 27942 - DNA, 23 bp, Artificial Sequence
  Synthetic
gcgatatatcaatgaggtaggac

SEQ ID NO: 27943 - DNA, 23 bp, Artificial Sequence
  Synthetic
tgtagtaggtatctgaatctgtg

SEQ ID NO: 27944 - DNA, 19 bp, Artificial Sequence
  Synthetic
ggagcaactcttactgacg

SEQ ID NO: 27945 - DNA, 21 bp, Artificial Sequence
  Synthetic
ccctcaaactcaacaagaact

SEQ ID NO: 27946 - DNA, 20 bp, Artificial Sequence
  Synthetic
tcgcaatctaatgacgagaa

SEQ ID NO: 27947 - DNA, 20 bp, Artificial Sequence
  Synthetic
cagcgtattccattccattt

SEQ ID NO: 27948 - DNA, 22 bp, Artificial Sequence
  Synthetic
aaaaccttcctcttaagtctcc

SEQ ID NO: 27949 - DNA, 18 bp, Artificial Sequence
  Synthetic
tatcgcggctatcgtctt

SEQ ID NO: 27950 - DNA, 19 bp, Artificial Sequence
  Synthetic
caaggccctattgacaaag

SEQ ID NO: 27951 - DNA, 21 bp, Artificial Sequence
  Synthetic
caaaaattctccaacggaaag

SEQ ID NO: 27952 - DNA, 19 bp, Artificial Sequence
  Synthetic
acaaaagagggcgtgattg

SEQ ID NO: 27953 - DNA, 21 bp, Artificial Sequence
  Synthetic
aaagatgctgttattgatgcg

SEQ ID NO: 27954 - DNA, 18 bp, Artificial Sequence
  Synthetic
acccgtcactaaacactg

SEQ ID NO: 27955 - DNA, 20 bp, Artificial Sequence
  Synthetic
atgtctccggaaaagacaac

SEQ ID NO: 27956 - DNA, 19 bp, Artificial Sequence
  Synthetic
tccagtaggagcatacagc

SEQ ID NO: 27957 - DNA, 18 bp, Artificial Sequence
  Synthetic
aaattggctattcgtgcg

SEQ ID NO: 27958 - DNA, 24 bp, Artificial Sequence
  Synthetic
ggttctcgtatttaaaatcgattc

SEQ ID NO: 27959 - DNA, 23 bp, Artificial Sequence
  Synthetic
ttggaagttgcaaaaaagattgt

SEQ ID NO: 27960 - DNA, 18 bp, Artificial Sequence
  Synthetic
atatcgcaaacgccttgt

SEQ ID NO: 27961 - DNA, 19 bp, Artificial Sequence
  Synthetic
aacgtcttccctaatccca

SEQ ID NO: 27962 - DNA, 20 bp, Artificial Sequence
  Synthetic
ctgcttgctctctaaactct

SEQ ID NO: 27963 - DNA, 19 bp, Artificial Sequence
  Synthetic
ccttcccatgaatgcctat

SEQ ID NO: 27964 - DNA, 18 bp, Artificial Sequence
  Synthetic
cacactttcttcgcgaag

SEQ ID NO: 27965 - DNA, 20 bp, Artificial Sequence
  Synthetic
gaacgcttactacaggagat

SEQ ID NO: 27966 - DNA, 18 bp, Artificial Sequence
  Synthetic
acaatcacacatcccacc

SEQ ID NO: 27967 - DNA, 19 bp, Artificial Sequence
  Synthetic
tcgatccgagatggcttta

SEQ ID NO: 27968 - DNA, 19 bp, Artificial Sequence
  Synthetic
gcaagctttgaatacggtg

SEQ ID NO: 27969 - DNA, 20 bp, Artificial Sequence
  Synthetic
gtatggctaaggagattcgc

SEQ ID NO: 27970 - DNA, 23 bp, Artificial Sequence
  Synthetic
ctatcgatcagatttatgcagat

SEQ ID NO: 27971 - DNA, 21 bp, Artificial Sequence
  Synthetic
agttttgcgttagtagaagct

SEQ ID NO: 27972 - DNA, 21 bp, Artificial Sequence
  Synthetic
gatgtcggttttatgcttagt

SEQ ID NO: 27973 - DNA, 20 bp, Artificial Sequence
  Synthetic
gtgtttgcctctctacaaga

SEQ ID NO: 27974 - DNA, 20 bp, Artificial Sequence
  Synthetic
ctagcattgcatcaggacta

SEQ ID NO: 27975 - DNA, 18 bp, Artificial Sequence
  Synthetic
tagcactgcattcacagc

SEQ ID NO: 27976 - DNA, 23 bp, Artificial Sequence
  Synthetic
ttgctaagaaactatctctctgg

SEQ ID NO: 27977 - DNA, 18 bp, Artificial Sequence
  Synthetic
acaggctgtgatggaaat

SEQ ID NO: 27978 - DNA, 21 bp, Artificial Sequence
  Synthetic
tgctttaccaataagctcgaa

SEQ ID NO: 27979 - DNA, 18 bp, Artificial Sequence
  Synthetic
ctccaagcaagcgtctac

SEQ ID NO: 27980 - DNA, 19 bp, Artificial Sequence
  Synthetic
agcatgatctttgttgcag

SEQ ID NO: 27981 - DNA, 22 bp, Artificial Sequence
  Synthetic
tttctaaggacaaaaaccactg

SEQ ID NO: 27982 - DNA, 20 bp, Artificial Sequence
  Synthetic
cgactctcctagtactccat

SEQ ID NO: 27983 - DNA, 22 bp, Artificial Sequence
  Synthetic
caccacattctgaaatccaaat

SEQ ID NO: 27984 - DNA, 25 bp, Artificial Sequence
  Synthetic
ctgtctgattactagaaaattgcat

SEQ ID NO: 27985 - DNA, 22 bp, Artificial Sequence
  Synthetic
ttgactaaacatccgattgttc

SEQ ID NO: 27986 - DNA, 18 bp, Artificial Sequence
  Synthetic
ccaccctttcctggagta

SEQ ID NO: 27987 - DNA, 20 bp, Artificial Sequence
  Synthetic
cacaatgacatcttcttggc

SEQ ID NO: 27988 - DNA, 25 bp, Artificial Sequence
  Synthetic
gaaatcggatcatctaaattctgaa

SEQ ID NO: 27989 - DNA, 18 bp, Artificial Sequence
  Synthetic
tgcgttatcgagcgtatg

SEQ ID NO: 27990 - DNA, 18 bp, Artificial Sequence
  Synthetic
gtatccccttctgcgatg

SEQ ID NO: 27991 - DNA, 20 bp, Artificial Sequence
  Synthetic
tgatgttttgtcgagcaatt

SEQ ID NO: 27992 - DNA, 23 bp, Artificial Sequence
  Synthetic
aggattcttcaagaaatctacga

SEQ ID NO: 27993 - DNA, 23 bp, Artificial Sequence
  Synthetic
tctgtcatatttctgaattgtct

SEQ ID NO: 27994 - DNA, 25 bp, Artificial Sequence
  Synthetic
tcatatccttaatcttatgacacag

SEQ ID NO: 27995 - DNA, 19 bp, Artificial Sequence
  Synthetic
ccagctcctaaacgcaaat

SEQ ID NO: 27996 - DNA, 19 bp, Artificial Sequence
  Synthetic
tgcaggtatcagcatttgg

SEQ ID NO: 27997 - DNA, 20 bp, Artificial Sequence
  Synthetic
ctctcgtaacagcagatacc

SEQ ID NO: 27998 - DNA, 19 bp, Artificial Sequence
  Synthetic
tgcgtcgggttaattttcc

SEQ ID NO: 27999 - DNA, 21 bp, Artificial Sequence
  Synthetic
ctttactgtatcggtgtcaaa

SEQ ID NO: 28000 - DNA, 19 bp, Artificial Sequence
  Synthetic
attatatcaccccccctcc

SEQ ID NO: 28001 - DNA, 24 bp, Artificial Sequence
  Synthetic
caacagaatccctataaagaatgt

SEQ ID NO: 28002 - DNA, 18 bp, Artificial Sequence
  Synthetic
tagaccgatgaaacgcat

SEQ ID NO: 28003 - DNA, 18 bp, Artificial Sequence
  Synthetic
agcatcgtcgctacaatc

SEQ ID NO: 28004 - DNA, 19 bp, Artificial Sequence
  Synthetic
ctcaaagaggggaagagtc

SEQ ID NO: 28005 - DNA, 19 bp, Artificial Sequence
  Synthetic
aagaattgtacagggccac

SEQ ID NO: 28006 - DNA, 20 bp, Artificial Sequence
  Synthetic
cgaaactccagaaacccata

SEQ ID NO: 28007 - DNA, 19 bp, Artificial Sequence
  Synthetic
ccaatctctccaaccagac

SEQ ID NO: 28008 - DNA, 20 bp, Artificial Sequence
  Synthetic
ccggactgattaatcgtgac

SEQ ID NO: 28009 - DNA, 18 bp, Artificial Sequence
  Synthetic
aaaagaggcgaggtctct

SEQ ID NO: 28010 - DNA, 21 bp, Artificial Sequence
  Synthetic
tttcatttttttctcacgtcg

SEQ ID NO: 28011 - DNA, 19 bp, Artificial Sequence
  Synthetic
gcccctcataatcactgag

SEQ ID NO: 28012 - DNA, 25 bp, Artificial Sequence
  Synthetic
ggtatgttgtatcattcaaattgga

SEQ ID NO: 28013 - DNA, 22 bp, Artificial Sequence
  Synthetic
ttttcctttgagaatgttgcac

SEQ ID NO: 28014 - DNA, 19 bp, Artificial Sequence
  Synthetic
gtacactgatttgacctgc

SEQ ID NO: 28015 - DNA, 22 bp, Artificial Sequence
  Synthetic
ttgagtcaagaagaaggttctg

SEQ ID NO: 28016 - DNA, 20 bp, Artificial Sequence
  Synthetic
acacatgcacattcagactc

SEQ ID NO: 28017 - DNA, 19 bp, Artificial Sequence
  Synthetic
ttctggttgaaagacaccc

SEQ ID NO: 28018 - DNA, 24 bp, Artificial Sequence
  Synthetic
cgatatcttgctttattgagaagt

SEQ ID NO: 28019 - DNA, 18 bp, Artificial Sequence
  Synthetic
tatcgtcagcatccacag

SEQ ID NO: 28020 - DNA, 18 bp, Artificial Sequence
  Synthetic
tcaagacagaggctccag

SEQ ID NO: 28021 - DNA, 23 bp, Artificial Sequence
  Synthetic
ttcagtttgatatcagtccaatt

SEQ ID NO: 28022 - DNA, 21 bp, Artificial Sequence
  Synthetic
gcaagattttctttcccacat

SEQ ID NO: 28023 - DNA, 18 bp, Artificial Sequence
  Synthetic
gtttcagctggagcatgt

SEQ ID NO: 28024 - DNA, 19 bp, Artificial Sequence
  Synthetic
cgtaaaagggctggtttca

SEQ ID NO: 28025 - DNA, 19 bp, Artificial Sequence
  Synthetic
ctgcttcaacgattgcaac

SEQ ID NO: 28026 - DNA, 24 bp, Artificial Sequence
  Synthetic
gttcccataaagattcttgtaatc

SEQ ID NO: 28027 - DNA, 19 bp, Artificial Sequence
  Synthetic
gccaatgaaatagcagcag

SEQ ID NO: 28028 - DNA, 18 bp, Artificial Sequence
  Synthetic
ccaaaagcagcttctgtg

SEQ ID NO: 28029 - DNA, 20 bp, Artificial Sequence
  Synthetic
cttctggtaggcctgcaaat

SEQ ID NO: 28030 - DNA, 24 bp, Artificial Sequence
  Synthetic
tccaatggaatatctaactgtctt

SEQ ID NO: 28031 - DNA, 20 bp, Artificial Sequence
  Synthetic
gtctattctttgaggtgcag

SEQ ID NO: 28032 - DNA, 18 bp, Artificial Sequence
  Synthetic
tttcccaattctgcgtcc

SEQ ID NO: 28033 - DNA, 21 bp, Artificial Sequence
  Synthetic
gaatcttcagcttcatgagtt

SEQ ID NO: 28034 - DNA, 23 bp, Artificial Sequence
  Synthetic
tcatattcctgatgagaaagcaa

SEQ ID NO: 28035 - DNA, 23 bp, Artificial Sequence
  Synthetic
gttccaatgttcaatttgatctt

SEQ ID NO: 28036 - DNA, 18 bp, Artificial Sequence
  Synthetic
gttggtggagctggtaac

SEQ ID NO: 28037 - DNA, 20 bp, Artificial Sequence
  Synthetic
tgtgatcccgatctcgatcc

SEQ ID NO: 28038 - DNA, 19 bp, Artificial Sequence
  Synthetic
gccacttgtgccaacagat

SEQ ID NO: 28039 - DNA, 23 bp, Artificial Sequence
  Synthetic
tctttgagatttactggtaaagc

SEQ ID NO: 28040 - DNA, 18 bp, Artificial Sequence
  Synthetic
agaagcactggggtcaat

SEQ ID NO: 28041 - DNA, 22 bp, Artificial Sequence
  Synthetic
ccctaaaaaaatgtacctgacc

SEQ ID NO: 28042 - DNA, 18 bp, Artificial Sequence
  Synthetic
tttgtacccttgcaaccg

SEQ ID NO: 28043 - DNA, 20 bp, Artificial Sequence
  Synthetic
cagacatgtcagctaaagca

SEQ ID NO: 28044 - DNA, 18 bp, Artificial Sequence
  Synthetic
ctctaatggtgggcatcc

SEQ ID NO: 28045 - DNA, 18 bp, Artificial Sequence
  Synthetic
gggatggtatcacccaca

SEQ ID NO: 28046 - DNA, 22 bp, Artificial Sequence
  Synthetic
gtcagaaacagttcattactcc

SEQ ID NO: 28047 - DNA, 18 bp, Artificial Sequence
  Synthetic
cattgtgacctatgggcg

SEQ ID NO: 28048 - DNA, 18 bp, Artificial Sequence
  Synthetic
aaaactgcttcacgggac

SEQ ID NO: 28049 - DNA, 23 bp, Artificial Sequence
  Synthetic
tccatgatctttattgtaagcac

SEQ ID NO: 28050 - DNA, 20 bp, Artificial Sequence
  Synthetic
aaccatcacacaagtcttca

SEQ ID NO: 28051 - DNA, 19 bp, Artificial Sequence
  Synthetic
tgccatcaaatcacctact

SEQ ID NO: 28052 - DNA, 23 bp, Artificial Sequence
  Synthetic
acagaggtttataaacacctcta

SEQ ID NO: 28053 - DNA, 20 bp, Artificial Sequence
  Synthetic
gatgaatgtaacaagccacg

SEQ ID NO: 28054 - DNA, 19 bp, Artificial Sequence
  Synthetic
ggaactctccatgcttgat

SEQ ID NO: 28055 - DNA, 20 bp, Artificial Sequence
  Synthetic
agacttcagaagactcctcc

SEQ ID NO: 28056 - DNA, 21 bp, Artificial Sequence
  Synthetic
actgccaatcacataaggtta

SEQ ID NO: 28057 - DNA, 24 bp, Artificial Sequence
  Synthetic
cgctctaacaatacataactttgt

SEQ ID NO: 28058 - DNA, 23 bp, Artificial Sequence
  Synthetic
gtgctatatcatgtcttaaggat

SEQ ID NO: 28059 - DNA, 22 bp, Artificial Sequence
  Synthetic
actggaaaaagactttaccttt

SEQ ID NO: 28060 - DNA, 19 bp, Artificial Sequence
  Synthetic
ctacaaatctagcagggcg

SEQ ID NO: 28061 - DNA, 23 bp, Artificial Sequence
  Synthetic
atgaattagctttttaccgcaag

SEQ ID NO: 28062 - DNA, 23 bp, Artificial Sequence
  Synthetic
ctttagagctatcaaaacccaac

SEQ ID NO: 28063 - DNA, 23 bp, Artificial Sequence
  Synthetic
tggttttttaacaccacttaact

SEQ ID NO: 28064 - DNA, 23 bp, Artificial Sequence
  Synthetic
agagcttaataaaagaggcaata

SEQ ID NO: 28065 - DNA, 22 bp, Artificial Sequence
  Synthetic
cttaacatcagtaaccgtatga

SEQ ID NO: 28066 - DNA, 23 bp, Artificial Sequence
  Synthetic
ggtgtagttaaaacagagacatt

SEQ ID NO: 28067 - DNA, 22 bp, Artificial Sequence
  Synthetic
tacgatatttgactatgtggcg

SEQ ID NO: 28068 - DNA, 22 bp, Artificial Sequence
  Synthetic
taaagcatataccctcatcagc

SEQ ID NO: 28069 - DNA, 20 bp, Artificial Sequence
  Synthetic
acaccacacaatcacgttaa

SEQ ID NO: 28070 - DNA, 23 bp, Artificial Sequence
  Synthetic
agtaggatttaccattttcacaa

SEQ ID NO: 28071 - DNA, 22 bp, Artificial Sequence
  Synthetic
ctaagctccaattgatgcatat

SEQ ID NO: 28072 - DNA, 23 bp, Artificial Sequence
  Synthetic
accattcttaagacgcttaatag

SEQ ID NO: 28073 - DNA, 20 bp, Artificial Sequence
  Synthetic
gtgtactcaactgatggaac

SEQ ID NO: 28074 - DNA, 23 bp, Artificial Sequence
  Synthetic
tagcacaaaagcactatcttaat

SEQ ID NO: 28075 - DNA, 23 bp, Artificial Sequence
  Synthetic
acttagaattagaagcaacatgc

SEQ ID NO: 28076 - DNA, 22 bp, Artificial Sequence
  Synthetic
gctttctctagctgttttaact

SEQ ID NO: 28077 - DNA, 25 bp, Artificial Sequence
  Synthetic
atcagatatctcattcaactgctta

SEQ ID NO: 28078 - DNA, 22 bp, Artificial Sequence
  Synthetic
cttaggatctacagaaaacgca

SEQ ID NO: 28079 - DNA, 23 bp, Artificial Sequence
  Synthetic
catgtgtcaaaacataagacaca

SEQ ID NO: 28080 - DNA, 22 bp, Artificial Sequence
  Synthetic
cttttacacgctcatagcattt

SEQ ID NO: 28081 - DNA, 23 bp, Artificial Sequence
  Synthetic
cagcataggcatgatataagaat

SEQ ID NO: 28082 - DNA, 19 bp, Artificial Sequence
  Synthetic
acactaaaacagcaagtgc

SEQ ID NO: 28083 - DNA, 25 bp, Artificial Sequence
  Synthetic
tagtataagcgtaaatttcatcctg

SEQ ID NO: 28084 - DNA, 19 bp, Artificial Sequence
  Synthetic
cccaacccataagtacagg

SEQ ID NO: 28085 - DNA, 22 bp, Artificial Sequence
  Synthetic
ccatcatcactcaaaatcatca

SEQ ID NO: 28086 - DNA, 21 bp, Artificial Sequence
  Synthetic
acaaaacatccagctcctaat

SEQ ID NO: 28087 - DNA, 18 bp, Artificial Sequence
  Synthetic
ttctgatgcaactgccac

SEQ ID NO: 28088 - DNA, 22 bp, Artificial Sequence
  Synthetic
ctgatgcataactctgcttaaa

SEQ ID NO: 28089 - DNA, 19 bp, Artificial Sequence
  Synthetic
gcaagatgtgacttccctg

SEQ ID NO: 28090 - DNA, 23 bp, Artificial Sequence
  Synthetic
tggtaagcatactaacttcatct

SEQ ID NO: 28091 - DNA, 20 bp, Artificial Sequence
  Synthetic
tgtttctgcagtctgtgaat

SEQ ID NO: 28092 - DNA, 18 bp, Artificial Sequence
  Synthetic
aaatcgccagttgcctta

SEQ ID NO: 28093 - DNA, 18 bp, Artificial Sequence
  Synthetic
tcaccaggaggagctttc

SEQ ID NO: 28094 - DNA, 23 bp, Artificial Sequence
  Synthetic
tacaagtaatcacatgtaacact

SEQ ID NO: 28095 - DNA, 23 bp, Artificial Sequence
  Synthetic
cttatccacattacagttccaaa

SEQ ID NO: 28096 - DNA, 21 bp, Artificial Sequence
  Synthetic
acctaaattgcatcttgtgat

SEQ ID NO: 28097 - DNA, 18 bp, Artificial Sequence
  Synthetic
ttaagctctgggtggtgt

SEQ ID NO: 28098 - DNA, 19 bp, Artificial Sequence
  Synthetic
caaccttgtccaccactac

SEQ ID NO: 28099 - DNA, 21 bp, Artificial Sequence
  Synthetic
aaacaaactcctgaacaacca

SEQ ID NO: 28100 - DNA, 20 bp, Artificial Sequence
  Synthetic
ttcatcatacagcctgtagg

SEQ ID NO: 28101 - DNA, 23 bp, Artificial Sequence
  Synthetic
gccaattaaaaatccttcactag

SEQ ID NO: 28102 - DNA, 19 bp, Artificial Sequence
  Synthetic
ccatcaccccaatgcatat

SEQ ID NO: 28103 - DNA, 22 bp, Artificial Sequence
  Synthetic
ccagtgactaactatggtttca

SEQ ID NO: 28104 - DNA, 21 bp, Artificial Sequence
  Synthetic
aacaagcctttattctgcatc

SEQ ID NO: 28105 - DNA, 18 bp, Artificial Sequence
  Synthetic
gttatcagactgcctggc

SEQ ID NO: 28106 - DNA, 21 bp, Artificial Sequence
  Synthetic
ggttaggatgacaaatcgttt

SEQ ID NO: 28107 - DNA, 22 bp, Artificial Sequence
  Synthetic
actcatacaatcaacagcatta

SEQ ID NO: 28108 - DNA, 23 bp, Artificial Sequence
  Synthetic
ccatatatcttagcagcatcaat

SEQ ID NO: 28109 - DNA, 23 bp, Artificial Sequence
  Synthetic
acagaaatttttaggagctttga

SEQ ID NO: 28110 - DNA, 18 bp, Artificial Sequence
  Synthetic
tctgcagaccaacccaaa

SEQ ID NO: 28111 - DNA, 18 bp, Artificial Sequence
  Synthetic
cagctgtcgtgtaagact

SEQ ID NO: 28112 - DNA, 25 bp, Artificial Sequence
  Synthetic
gcattaatgttatcacagaaactac

SEQ ID NO: 28113 - DNA, 18 bp, Artificial Sequence
  Synthetic
ggcagccaaagtgtatcc

SEQ ID NO: 28114 - DNA, 19 bp, Artificial Sequence
  Synthetic
ccttctccatagcttgtgc

SEQ ID NO: 28115 - DNA, 18 bp, Artificial Sequence
  Synthetic
acagcgcaggtactcata

SEQ ID NO: 28116 - DNA, 25 bp, Artificial Sequence
  Synthetic
aatagtaaaacaagcatagctacac

SEQ ID NO: 28117 - DNA, 24 bp, Artificial Sequence
  Synthetic
ggatttaccataaagagtgaatgt

SEQ ID NO: 28118 - DNA, 25 bp, Artificial Sequence
  Synthetic
gtacctagttttataccttgaatgt

SEQ ID NO: 28119 - DNA, 18 bp, Artificial Sequence
  Synthetic
aaactggtcggactgatc

SEQ ID NO: 28120 - DNA, 20 bp, Artificial Sequence
  Synthetic
cggaatagcctcatcgctac

SEQ ID NO: 28121 - DNA, 21 bp, Artificial Sequence
  Synthetic
atgcttagttacttgctgagg

SEQ ID NO: 28122 - DNA, 22 bp, Artificial Sequence
  Synthetic
tgataggcattcaaattctcat

SEQ ID NO: 28123 - DNA, 24 bp, Artificial Sequence
  Synthetic
ctatagtctgctataaccttctct

SEQ ID NO: 28124 - DNA, 20 bp, Artificial Sequence
  Synthetic
ttcgctttcaacatgatgtt

SEQ ID NO: 28125 - DNA, 22 bp, Artificial Sequence
  Synthetic
ttctgttttggagtaagtggag

SEQ ID NO: 28126 - DNA, 20 bp, Artificial Sequence
  Synthetic
gtggcagttctgatgtccag

SEQ ID NO: 28127 - DNA, 22 bp, Artificial Sequence
  Synthetic
ttcaatatgatggttttaccca

SEQ ID NO: 28128 - DNA, 19 bp, Artificial Sequence
  Synthetic
tcccattctcatcactgct

SEQ ID NO: 28129 - DNA, 18 bp, Artificial Sequence
  Synthetic
gtcaccccagcgattccg

SEQ ID NO: 28130 - DNA, 19 bp, Artificial Sequence
  Synthetic
cagaagttttacgcgtcgc

SEQ ID NO: 28131 - DNA, 16 bp, Artificial Sequence
  Synthetic
tcaagggccctcacgc

SEQ ID NO: 28132 - DNA, 20 bp, Artificial Sequence
  Synthetic
cgcgcctactaataggtcca

SEQ ID NO: 28133 - DNA, 18 bp, Artificial Sequence
  Synthetic
gccaagatgccccaatgg

SEQ ID NO: 28134 - DNA, 18 bp, Artificial Sequence
  Synthetic
ggccgcagacacttgatg

SEQ ID NO: 28135 - DNA, 19 bp, Artificial Sequence
  Synthetic
cgcacgtcttgagaaaccc

SEQ ID NO: 28136 - DNA, 20 bp, Artificial Sequence
  Synthetic
agcaaggcagtatagcaagc

SEQ ID NO: 28137 - DNA, 18 bp, Artificial Sequence
  Synthetic
ttaccccgcacgtaccac

SEQ ID NO: 28138 - DNA, 19 bp, Artificial Sequence
  Synthetic
ctaatcgtgcagagacggg

SEQ ID NO: 28139 - DNA, 19 bp, Artificial Sequence
  Synthetic
cccaacgaggtcctgatct

SEQ ID NO: 28140 - DNA, 20 bp, Artificial Sequence
  Synthetic
tgctaagggtttccactggt

SEQ ID NO: 28141 - DNA, 20 bp, Artificial Sequence
  Synthetic
ccgcgagaaacttaccgtag

SEQ ID NO: 28142 - DNA, 18 bp, Artificial Sequence
  Synthetic
acagaggacgaccgagtc

SEQ ID NO: 28143 - DNA, 20 bp, Artificial Sequence
  Synthetic
ggtccatgtagtgttggctt

SEQ ID NO: 28144 - DNA, 20 bp, Artificial Sequence
  Synthetic
ccttgaactggtgggctatt

SEQ ID NO: 28145 - DNA, 19 bp, Artificial Sequence
  Synthetic
caagccgcttaccacgaac

SEQ ID NO: 28146 - DNA, 16 bp, Artificial Sequence
  Synthetic
tggttgccccgggatg

SEQ ID NO: 28147 - DNA, 18 bp, Artificial Sequence
  Synthetic
cagttattgctgccccgc

SEQ ID NO: 28148 - DNA, 18 bp, Artificial Sequence
  Synthetic
aggggcttacatggaggg

SEQ ID NO: 28149 - DNA, 20 bp, Artificial Sequence
  Synthetic
tgtaatgttgctgcccatct

SEQ ID NO: 28150 - DNA, 19 bp, Artificial Sequence
  Synthetic
tcctgtggtttcgaggacg

SEQ ID NO: 28151 - DNA, 20 bp, Artificial Sequence
  Synthetic
cgcttctagacgacgttgaa

SEQ ID NO: 28152 - DNA, 16 bp, Artificial Sequence
  Synthetic
tgcggccccctttagc

SEQ ID NO: 28153 - DNA, 18 bp, Artificial Sequence
  Synthetic
cgataaccacactgggcc

SEQ ID NO: 28154 - DNA, 18 bp, Artificial Sequence
  Synthetic
tggcctgtggagcatctc

SEQ ID NO: 28155 - DNA, 20 bp, Artificial Sequence
  Synthetic
ttcattgccatcatccattt

SEQ ID NO: 28156 - DNA, 21 bp, Artificial Sequence
  Synthetic
acgtattttgacttggtttct

SEQ ID NO: 28157 - DNA, 20 bp, Artificial Sequence
  Synthetic
ctctccaacatgtatgcaac

SEQ ID NO: 28158 - DNA, 20 bp, Artificial Sequence
  Synthetic
ctgcttaaggatgtctacca

SEQ ID NO: 28159 - DNA, 19 bp, Artificial Sequence
  Synthetic
tcaatctcctggttgcttt

SEQ ID NO: 28160 - DNA, 20 bp, Artificial Sequence
  Synthetic
gcaatatcccaatcattccc

SEQ ID NO: 28161 - DNA, 20 bp, Artificial Sequence
  Synthetic
ttgaccaacactgattcagg

SEQ ID NO: 28162 - DNA, 18 bp, Artificial Sequence
  Synthetic
actttgctttggtggagc

SEQ ID NO: 28163 - DNA, 20 bp, Artificial Sequence
  Synthetic
gccttctctcctttcgcaag

SEQ ID NO: 28164 - DNA, 20 bp, Artificial Sequence
  Synthetic
gcttccgttggcataactga

SEQ ID NO: 28165 - DNA, 20 bp, Artificial Sequence
  Synthetic
gaaacaatcagtggggcaga

SEQ ID NO: 28166 - DNA, 19 bp, Artificial Sequence
  Synthetic
ggcagggtcgtgaaagaac

SEQ ID NO: 28167 - DNA, 18 bp, Artificial Sequence
  Synthetic
ggaggagaggccacatcc

SEQ ID NO: 28168 - DNA, 18 bp, Artificial Sequence
  Synthetic
cggctatcttccgcgcta

SEQ ID NO: 28169 - DNA, 19 bp, Artificial Sequence
  Synthetic
gtatctcctggcccctacg

SEQ ID NO: 28170 - DNA, 18 bp, Artificial Sequence
  Synthetic
taaaggtccgaggagccg

SEQ ID NO: 28171 - DNA, 16 bp, Artificial Sequence
  Synthetic
gagcatgcaggtgggc

SEQ ID NO: 28172 - DNA, 18 bp, Artificial Sequence
  Synthetic
ggtcaaggacagtgccga

SEQ ID NO: 28173 - DNA, 18 bp, Artificial Sequence
  Synthetic
gagcatcggtcgacacga

SEQ ID NO: 28174 - DNA, 20 bp, Artificial Sequence
  Synthetic
agcctaactgtagtctcggc

SEQ ID NO: 28175 - DNA, 18 bp, Artificial Sequence
  Synthetic
ttgacaggcaatacgcgg

SEQ ID NO: 28176 - DNA, 20 bp, Artificial Sequence
  Synthetic
cccgccaagtattgtatccc

SEQ ID NO: 28177 - DNA, 16 bp, Artificial Sequence
  Synthetic
agaggatggcgggcag

SEQ ID NO: 28178 - DNA, 20 bp, Artificial Sequence
  Synthetic
acactccgagcttatccact

SEQ ID NO: 28179 - DNA, 18 bp, Artificial Sequence
  Synthetic
tagttcggcgcaggaagg

SEQ ID NO: 28180 - DNA, 20 bp, Artificial Sequence
  Synthetic
cgcctctgctgttatatggg

SEQ ID NO: 28181 - DNA, 19 bp, Artificial Sequence
  Synthetic
ccacaggtggttcgtagtc

SEQ ID NO: 28182 - DNA, 17 bp, Artificial Sequence
  Synthetic
ccatgacccgtcgctga

SEQ ID NO: 28183 - DNA, 19 bp, Artificial Sequence
  Synthetic
catggcaacggacgtcttt

SEQ ID NO: 28184 - DNA, 17 bp, Artificial Sequence
  Synthetic
ccgctgtcctggtgagt

SEQ ID NO: 28185 - DNA, 18 bp, Artificial Sequence
  Synthetic
gcatggtgcagtcctgga

SEQ ID NO: 28186 - DNA, 20 bp, Artificial Sequence
  Synthetic
tatcatcctcgcccacagtg

SEQ ID NO: 28187 - DNA, 20 bp, Artificial Sequence
  Synthetic
tgcccagttgaagaggtact

SEQ ID NO: 28188 - DNA, 23 bp, Artificial Sequence
  Synthetic
tgttttgtgcaaaatatacagca

SEQ ID NO: 28189 - DNA, 20 bp, Artificial Sequence
  Synthetic
tgatattttgtgcagtcgtc

SEQ ID NO: 28190 - DNA, 18 bp, Artificial Sequence
  Synthetic
tgcactctaccaccagtc

SEQ ID NO: 28191 - DNA, 19 bp, Artificial Sequence
  Synthetic
acctgtgtttggccatagc

SEQ ID NO: 28192 - DNA, 19 bp, Artificial Sequence
  Synthetic
tttagccactgtttccctg

SEQ ID NO: 28193 - DNA, 19 bp, Artificial Sequence
  Synthetic
cagataatggctgcaacca

SEQ ID NO: 28194 - DNA, 18 bp, Artificial Sequence
  Synthetic
taaacggttcgctagggt

SEQ ID NO: 28195 - DNA, 18 bp, Artificial Sequence
  Synthetic
cccacatgtacctcccat

SEQ ID NO: 28196 - DNA, 19 bp, Artificial Sequence
  Synthetic
aaccgggtcctgtcactgt

SEQ ID NO: 28197 - DNA, 24 bp, Artificial Sequence
  Synthetic
tgtaaatataatgctataaggccc

SEQ ID NO: 28198 - DNA, 18 bp, Artificial Sequence
  Synthetic
gttccaatgcctaggccc

SEQ ID NO: 28199 - DNA, 23 bp, Artificial Sequence
  Synthetic
gcaggatttgtaaagtttgtact

SEQ ID NO: 28200 - DNA, 20 bp, Artificial Sequence
  Synthetic
tcaccatcatcaacatcagc

SEQ ID NO: 28201 - DNA, 18 bp, Artificial Sequence
  Synthetic
tggcctacagtaagcaac

SEQ ID NO: 28202 - DNA, 20 bp, Artificial Sequence
  Synthetic
ctgcgcaagtaaaagaacat

SEQ ID NO: 28203 - DNA, 23 bp, Artificial Sequence
  Synthetic
aaatctatatgtgtcctccaagc

SEQ ID NO: 28204 - DNA, 18 bp, Artificial Sequence
  Synthetic
aattggtggtgtgcacac

SEQ ID NO: 28205 - DNA, 23 bp, Artificial Sequence
  Synthetic
acagcaaagataattcttgttgt

SEQ ID NO: 28206 - DNA, 25 bp, Artificial Sequence
  Synthetic
gcaatagtattattacagtcctctg

SEQ ID NO: 28207 - DNA, 24 bp, Artificial Sequence
  Synthetic
aaagtacattccatcataatccac

SEQ ID NO: 28208 - DNA, 19 bp, Artificial Sequence
  Synthetic
tgagacagtgcctctctcc

SEQ ID NO: 28209 - DNA, 19 bp, Artificial Sequence
  Synthetic
taagctgtttcccggacct

SEQ ID NO: 28210 - DNA, 23 bp, Artificial Sequence
  Synthetic
agtgggatattaaaaggtcttgt

SEQ ID NO: 28211 - DNA, 25 bp, Artificial Sequence
  Synthetic
tcatatgcaggatttaaaactgtag

SEQ ID NO: 28212 - DNA, 22 bp, Artificial Sequence
  Synthetic
tgaaagtctatatctggtgcag

SEQ ID NO: 28213 - DNA, 22 bp, Artificial Sequence
  Synthetic
gggtgcaagaaaaaatcataat

SEQ ID NO: 28214 - DNA, 22 bp, Artificial Sequence
  Synthetic
tttccaggatcaattacatcaa

SEQ ID NO: 28215 - DNA, 21 bp, Artificial Sequence
  Synthetic
agacacgtccattctattgtc

SEQ ID NO: 28216 - DNA, 24 bp, Artificial Sequence
  Synthetic
taggtactcctgatttatcttcct

SEQ ID NO: 28217 - DNA, 22 bp, Artificial Sequence
  Synthetic
ttgagtataaagagccactagg

SEQ ID NO: 28218 - DNA, 20 bp, Artificial Sequence
  Synthetic
tgtttgaacttgcacttacc

SEQ ID NO: 28219 - DNA, 18 bp, Artificial Sequence
  Synthetic
ttgccatatcacccttgg

SEQ ID NO: 28220 - DNA, 19 bp, Artificial Sequence
  Synthetic
ttactctctcaacagggcc

SEQ ID NO: 28221 - DNA, 18 bp, Artificial Sequence
  Synthetic
tactggcaggaaccttct

SEQ ID NO: 28222 - DNA, 18 bp, Artificial Sequence
  Synthetic
acatcacctccatccagg

SEQ ID NO: 28223 - DNA, 22 bp, Artificial Sequence
  Synthetic
gtgtcttgagaaaataccatgc

SEQ ID NO: 28224 - DNA, 23 bp, Artificial Sequence
  Synthetic
aatgtatagtcagatgcattcat

SEQ ID NO: 28225 - DNA, 23 bp, Artificial Sequence
  Synthetic
actaaatttttaagcacccattg

SEQ ID NO: 28226 - DNA, 24 bp, Artificial Sequence
  Synthetic
caaaaattgataaggctctccatt

SEQ ID NO: 28227 - DNA, 18 bp, Artificial Sequence
  Synthetic
acgggctttccttggtaa

SEQ ID NO: 28228 - DNA, 18 bp, Artificial Sequence
  Synthetic
cattgcgacctatgggag

SEQ ID NO: 28229 - DNA, 23 bp, Artificial Sequence
  Synthetic
aacatgtagatcttcatgaacaa

SEQ ID NO: 28230 - DNA, 23 bp, Artificial Sequence
  Synthetic
atcatggttaacagtatcagtac

SEQ ID NO: 28231 - DNA, 20 bp, Artificial Sequence
  Synthetic
aaaaccatctccacaaactg

SEQ ID NO: 28232 - DNA, 22 bp, Artificial Sequence
  Synthetic
caacaggtttctcgttaaaatt

SEQ ID NO: 28233 - DNA, 18 bp, Artificial Sequence
  Synthetic
tttacctgcagctacagc

SEQ ID NO: 28234 - DNA, 22 bp, Artificial Sequence
  Synthetic
gctaaaacaagagcaactaacc

SEQ ID NO: 28235 - DNA, 19 bp, Artificial Sequence
  Synthetic
gcctacacctacacccata

SEQ ID NO: 28236 - DNA, 23 bp, Artificial Sequence
  Synthetic
acatataaatcatcagatgccaa

SEQ ID NO: 28237 - DNA, 25 bp, Artificial Sequence
  Synthetic
ccaccattagcagtaatatcataat

SEQ ID NO: 28238 - DNA, 25 bp, Artificial Sequence
  Synthetic
cactctttaaatatgtaggtaccaa

SEQ ID NO: 28239 - DNA, 24 bp, Artificial Sequence
  Synthetic
ccttcactaataacatcaggaaat

SEQ ID NO: 28240 - DNA, 18 bp, Artificial Sequence
  Synthetic
gaaatgccccttgtggtc

SEQ ID NO: 28241 - DNA, 18 bp, Artificial Sequence
  Synthetic
tttgccatagcccaaaca

SEQ ID NO: 28242 - DNA, 19 bp, Artificial Sequence
  Synthetic
acgaaccatgctaaaaagc

SEQ ID NO: 28243 - DNA, 24 bp, Artificial Sequence
  Synthetic
ccacgtaatttacatataccatct

SEQ ID NO: 28244 - DNA, 25 bp, Artificial Sequence
  Synthetic
gtcaacataggcatcatataagaat

SEQ ID NO: 28245 - DNA, 23 bp, Artificial Sequence
  Synthetic
cactaaaacaacaagttcgtaaa

SEQ ID NO: 28246 - DNA, 22 bp, Artificial Sequence
  Synthetic
ggcctgtcatagtactaagaat

SEQ ID NO: 28247 - DNA, 21 bp, Artificial Sequence
  Synthetic
tcaaaacttgagcacattcat

SEQ ID NO: 28248 - DNA, 21 bp, Artificial Sequence
  Synthetic
acacgaaagactttttggtat

SEQ ID NO: 28249 - DNA, 19 bp, Artificial Sequence
  Synthetic
tggtagcagaagcatagct

SEQ ID NO: 28250 - DNA, 18 bp, Artificial Sequence
  Synthetic
agactttcccgtaccagg

SEQ ID NO: 28251 - DNA, 24 bp, Artificial Sequence
  Synthetic
aagtataacaatctctctcagcaa

SEQ ID NO: 28252 - DNA, 23 bp, Artificial Sequence
  Synthetic
atctttatgcacatcatagacat

SEQ ID NO: 28253 - DNA, 25 bp, Artificial Sequence
  Synthetic
ggtagttacaatattcttcagcatg

SEQ ID NO: 28254 - DNA, 18 bp, Artificial Sequence
  Synthetic
ctgtctgttcggctgaag

SEQ ID NO: 28255 - DNA, 19 bp, Artificial Sequence
  Synthetic
ccagatggtaaccactgtc

SEQ ID NO: 28256 - DNA, 21 bp, Artificial Sequence
  Synthetic
caggtaaacaagaacacctac

SEQ ID NO: 28257 - DNA, 22 bp, Artificial Sequence
  Synthetic
aaactgacattaaagggttcaa

SEQ ID NO: 28258 - DNA, 21 bp, Artificial Sequence
  Synthetic
ccttctccatagctaaagcag

SEQ ID NO: 28259 - DNA, 23 bp, Artificial Sequence
  Synthetic
tacagtaacatatacgggcaaat

SEQ ID NO: 28260 - DNA, 21 bp, Artificial Sequence
  Synthetic
agacacagtgaatttaggttg

SEQ ID NO: 28261 - DNA, 22 bp, Artificial Sequence
  Synthetic
ccaagctttaacatttcagcat

SEQ ID NO: 28262 - DNA, 22 bp, Artificial Sequence
  Synthetic
ggatcatcaagagtagcaagta

SEQ ID NO: 28263 - DNA, 19 bp, Artificial Sequence
  Synthetic
tcgccttgttcattgatga

SEQ ID NO: 28264 - DNA, 18 bp, Artificial Sequence
  Synthetic
tttcggtgggagactttg

SEQ ID NO: 28265 - DNA, 21 bp, Artificial Sequence
  Synthetic
ttcaatgctcaatttcaaagc

SEQ ID NO: 28266 - DNA, 22 bp, Artificial Sequence
  Synthetic
tgtcaaagtctactttctctgg

SEQ ID NO: 28267 - DNA, 24 bp, Artificial Sequence
  Synthetic
cagtattaatgtatacccccttca

SEQ ID NO: 28268 - DNA, 20 bp, Artificial Sequence
  Synthetic
ccttgaaatttggcctatgg

SEQ ID NO: 28269 - DNA, 22 bp, Artificial Sequence
  Synthetic
tgacttagccaatagagtccta

SEQ ID NO: 28270 - DNA, 20 bp, Artificial Sequence
  Synthetic
atcaaccttccttcttggtc

SEQ ID NO: 28271 - DNA, 19 bp, Artificial Sequence
  Synthetic
ttccctttgaggatgttgc

SEQ ID NO: 28272 - DNA, 18 bp, Artificial Sequence
  Synthetic
tatccactggccacagcg

SEQ ID NO: 28273 - DNA, 19 bp, Artificial Sequence
  Synthetic
gaatccattgcttccacgt

SEQ ID NO: 28274 - DNA, 22 bp, Artificial Sequence
  Synthetic
ctgtatatttctcctagcacac

SEQ ID NO: 28275 - DNA, 20 bp, Artificial Sequence
  Synthetic
ttcaatgttggacgaggagg

SEQ ID NO: 28276 - DNA, 21 bp, Artificial Sequence
  Synthetic
aaaactgtagtgcatgctaaa

SEQ ID NO: 28277 - DNA, 20 bp, Artificial Sequence
  Synthetic
tgcaagtgtagtttgttcaa

SEQ ID NO: 28278 - DNA, 18 bp, Artificial Sequence
  Synthetic
ttgcagatgactcaggag

SEQ ID NO: 28279 - DNA, 18 bp, Artificial Sequence
  Synthetic
ctgggctgttgcatcaat

SEQ ID NO: 28280 - DNA, 22 bp, Artificial Sequence
  Synthetic
tggatcacttataggtacctgt

SEQ ID NO: 28281 - DNA, 20 bp, Artificial Sequence
  Synthetic
gtgcactgtttgacctatag

SEQ ID NO: 28282 - DNA, 25 bp, Artificial Sequence
  Synthetic
gtttactaattgtattgcaggacaa

SEQ ID NO: 28283 - DNA, 18 bp, Artificial Sequence
  Synthetic
atcacccatagtccctgc

SEQ ID NO: 28284 - DNA, 18 bp, Artificial Sequence
  Synthetic
ggtaaatgacagcgggtt

SEQ ID NO: 28285 - DNA, 23 bp, Artificial Sequence
  Synthetic
tgcagtattgtaaacaacattct

SEQ ID NO: 28286 - DNA, 20 bp, Artificial Sequence
  Synthetic
gctttaaagtgcacggtaac

SEQ ID NO: 28287 - DNA, 18 bp, Artificial Sequence
  Synthetic
atagtgcattcgggtcac

SEQ ID NO: 28288 - DNA, 22 bp, Artificial Sequence
  Synthetic
tattttgttggctttctctagg

SEQ ID NO: 28289 - DNA, 18 bp, Artificial Sequence
  Synthetic
gttcggtgggagactttg

SEQ ID NO: 28290 - DNA, 18 bp, Artificial Sequence
  Synthetic
tagagatctgggctctgg

SEQ ID NO: 28291 - DNA, 18 bp, Artificial Sequence
  Synthetic
aaagtcatccatggctgc

SEQ ID NO: 28292 - DNA, 18 bp, Artificial Sequence
  Synthetic
ataggaacatgggcctcg

SEQ ID NO: 28293 - DNA, 21 bp, Artificial Sequence
  Synthetic
agacgcatatagactgttgaa

SEQ ID NO: 28294 - DNA, 18 bp, Artificial Sequence
  Synthetic
caagtgtgctgcctcttc

SEQ ID NO: 28295 - DNA, 23 bp, Artificial Sequence
  Synthetic
actgagaaatttgctttaaggat

SEQ ID NO: 28296 - DNA, 20 bp, Artificial Sequence
  Synthetic
ctgttttggagggagtgaag

SEQ ID NO: 28297 - DNA, 20 bp, Artificial Sequence
  Synthetic
agctcttttttgtcagcttt

SEQ ID NO: 28298 - DNA, 24 bp, Artificial Sequence
  Synthetic
gttagtcatcatctttctcacaac

SEQ ID NO: 28299 - DNA, 20 bp, Artificial Sequence
  Synthetic
cctgcttgtattccctcatg

SEQ ID NO: 28300 - DNA, 23 bp, Artificial Sequence
  Synthetic
tgtagtctttaatgaacagctga

SEQ ID NO: 28301 - DNA, 18 bp, Artificial Sequence
  Synthetic
atcaattcgggccctaga

SEQ ID NO: 28302 - DNA, 18 bp, Artificial Sequence
  Synthetic
cttgcagtgatgtgtcca

SEQ ID NO: 28303 - DNA, 22 bp, Artificial Sequence
  Synthetic
cctctgagttgtttaattcctc

SEQ ID NO: 28304 - DNA, 19 bp, Artificial Sequence
  Synthetic
cttgctgtatcacgacatg

SEQ ID NO: 28305 - DNA, 24 bp, Artificial Sequence
  Synthetic
tcatatgctatgtcactttcatct

SEQ ID NO: 28306 - DNA, 18 bp, Artificial Sequence
  Synthetic
aacgttgggatagggcat

SEQ ID NO: 28307 - DNA, 22 bp, Artificial Sequence
  Synthetic
actctgatttagcaagactctc

SEQ ID NO: 28308 - DNA, 18 bp, Artificial Sequence
  Synthetic
gaacccccactcttttgg

SEQ ID NO: 28309 - DNA, 18 bp, Artificial Sequence
  Synthetic
aacaggagctccagatgt

SEQ ID NO: 28310 - DNA, 18 bp, Artificial Sequence
  Synthetic
aataggttcggtgcctct

SEQ ID NO: 28311 - DNA, 25 bp, Artificial Sequence
  Synthetic
gacatagttagttttttacccaatc

SEQ ID NO: 28312 - DNA, 18 bp, Artificial Sequence
  Synthetic
taacacctaaaggctgcc

SEQ ID NO: 28313 - DNA, 18 bp, Artificial Sequence
  Synthetic
cagtcacctgtttgcaca

SEQ ID NO: 28314 - DNA, 19 bp, Artificial Sequence
  Synthetic
ctgcatctcctatagtgcc

SEQ ID NO: 28315 - DNA, 18 bp, Artificial Sequence
  Synthetic
tgttgttccttggctgag

SEQ ID NO: 28316 - DNA, 18 bp, Artificial Sequence
  Synthetic
agtatgtttcgggcccat

SEQ ID NO: 28317 - DNA, 25 bp, Artificial Sequence
  Synthetic
gcatatatattgactagtgtgtgtc

SEQ ID NO: 28318 - DNA, 22 bp, Artificial Sequence
  Synthetic
ggctttgatctatcatctgtca

SEQ ID NO: 28319 - DNA, 19 bp, Artificial Sequence
  Synthetic
attgccatcatccacttca

SEQ ID NO: 28320 - DNA, 25 bp, Artificial Sequence
  Synthetic
cctccttattttaacttgatttctg

SEQ ID NO: 28321 - DNA, 18 bp, Artificial Sequence
  Synthetic
taaacactgcctgttccg

SEQ ID NO: 28322 - DNA, 19 bp, Artificial Sequence
  Synthetic
gtctaaggatgtccaccat

SEQ ID NO: 28323 - DNA, 20 bp, Artificial Sequence
  Synthetic
ctctcccgcttactatcaac

SEQ ID NO: 28324 - DNA, 21 bp, Artificial Sequence
  Synthetic
caatttcccagttcctgatta

SEQ ID NO: 28325 - DNA, 19 bp, Artificial Sequence
  Synthetic
tcaaccctgatcctctcac

SEQ ID NO: 28326 - DNA, 20 bp, Artificial Sequence
  Synthetic
acattagccttctctccttt

SEQ ID NO: 28327 - DNA, 18 bp, Artificial Sequence
  Synthetic
atggcaaaacacgcatct

SEQ ID NO: 28328 - DNA, 21 bp, Artificial Sequence
  Synthetic
aagagaagcacttgaagactg

SEQ ID NO: 28329 - DNA, 24 bp, Artificial Sequence
  Synthetic
ctacctgtgtaacagtattttcag

SEQ ID NO: 28330 - DNA, 19 bp, Artificial Sequence
  Synthetic
attaatggcggatcccaag

SEQ ID NO: 28331 - DNA, 23 bp, Artificial Sequence
  Synthetic
catctactgttacagatggtctt

SEQ ID NO: 28332 - DNA, 23 bp, Artificial Sequence
  Synthetic
ctagaactgcaaaactagtctca

SEQ ID NO: 28333 - DNA, 24 bp, Artificial Sequence
  Synthetic
tttctgttagtataggtctgtgta

SEQ ID NO: 28334 - DNA, 21 bp, Artificial Sequence
  Synthetic
gctttctgcatattcatcctc

SEQ ID NO: 28335 - DNA, 20 bp, Artificial Sequence
  Synthetic
acaattcattcgttggtctg

SEQ ID NO: 28336 - DNA, 20 bp, Artificial Sequence
  Synthetic
tatcactggtcatgcgtaag

SEQ ID NO: 28337 - DNA, 18 bp, Artificial Sequence
  Synthetic
caggcgccaaaaacttac

SEQ ID NO: 28338 - DNA, 24 bp, Artificial Sequence
  Synthetic
aagatgtacctttagtgtctttgt

SEQ ID NO: 28339 - DNA, 21 bp, Artificial Sequence
  Synthetic
ttccttatatcccactccaaa

SEQ ID NO: 28340 - DNA, 22 bp, Artificial Sequence
  Synthetic
attgttccatgtacaaaacttg

SEQ ID NO: 28341 - DNA, 22 bp, Artificial Sequence
  Synthetic
gaggtaatttaatttgcactgg

SEQ ID NO: 28342 - DNA, 22 bp, Artificial Sequence
  Synthetic
ccatattgggatttctttaggc

SEQ ID NO: 28343 - DNA, 18 bp, Artificial Sequence
  Synthetic
ttccagtcctcacttgcc

SEQ ID NO: 28344 - DNA, 25 bp, Artificial Sequence
  Synthetic
cctttgtgatgtattagtaaatcct

SEQ ID NO: 28345 - DNA, 20 bp, Artificial Sequence
  Synthetic
caggaggcccaataggatct

SEQ ID NO: 28346 - DNA, 20 bp, Artificial Sequence
  Synthetic
cagatccttctgttacagca

SEQ ID NO: 28347 - DNA, 21 bp, Artificial Sequence
  Synthetic
tcaataatacctgtgtcaccg

SEQ ID NO: 28348 - DNA, 21 bp, Artificial Sequence
  Synthetic
cgtattcatcagtaggcagta

SEQ ID NO: 28349 - DNA, 18 bp, Artificial Sequence
  Synthetic
taaaggaggacatgcacc

SEQ ID NO: 28350 - DNA, 20 bp, Artificial Sequence
  Synthetic
tgagaggaaccttgcataat

SEQ ID NO: 28351 - DNA, 18 bp, Artificial Sequence
  Synthetic
ttaaaccccccgtctacg

SEQ ID NO: 28352 - DNA, 18 bp, Artificial Sequence
  Synthetic
tacacctctcccggttag

SEQ ID NO: 28353 - DNA, 25 bp, Artificial Sequence
  Synthetic
gcaataatagtaaatctaacacctg

SEQ ID NO: 28354 - DNA, 22 bp, Artificial Sequence
  Synthetic
tagctcttccattgtatccaaa

SEQ ID NO: 28355 - DNA, 23 bp, Artificial Sequence
  Synthetic
tagcttcatcttctcctaatcca

SEQ ID NO: 28356 - DNA, 22 bp, Artificial Sequence
  Synthetic
aaaatcacaatgttgctgcata

SEQ ID NO: 28357 - DNA, 19 bp, Artificial Sequence
  Synthetic
gctttggaagtgtagtcgt

SEQ ID NO: 28358 - DNA, 19 bp, Artificial Sequence
  Synthetic
actctgtcggtcgacttcg

SEQ ID NO: 28359 - DNA, 22 bp, Artificial Sequence
  Synthetic
tctgcagcacttatatctgaaa

SEQ ID NO: 28360 - DNA, 22 bp, Artificial Sequence
  Synthetic
tcaatattttgtgttggctgtt

SEQ ID NO: 28361 - DNA, 23 bp, Artificial Sequence
  Synthetic
ctttctgaccaatagttagtcca

SEQ ID NO: 28362 - DNA, 20 bp, Artificial Sequence
  Synthetic
cttgcagctatttctggaat

SEQ ID NO: 28363 - DNA, 18 bp, Artificial Sequence
  Synthetic
gagtacacgagcaacagg

SEQ ID NO: 28364 - DNA, 20 bp, Artificial Sequence
  Synthetic
ccacctctaccaatttcaag

SEQ ID NO: 28365 - DNA, 18 bp, Artificial Sequence
  Synthetic
ggatccttttgctggagc

SEQ ID NO: 28366 - DNA, 18 bp, Artificial Sequence
  Synthetic
ttgcctgtttcccctttg

SEQ ID NO: 28367 - DNA, 20 bp, Artificial Sequence
  Synthetic
attgatggcctggaactgac

SEQ ID NO: 28368 - DNA, 20 bp, Artificial Sequence
  Synthetic
ggcaaaggaggaccaggttc

SEQ ID NO: 28369 - DNA, 21 bp, Artificial Sequence
  Synthetic
tgatagaattccaggaggttt

SEQ ID NO: 28370 - DNA, 16 bp, Artificial Sequence
  Synthetic
aagtttgggggcgccc

SEQ ID NO: 28371 - DNA, 19 bp, Artificial Sequence
  Synthetic
ggtggagtgttgggcttag

SEQ ID NO: 28372 - DNA, 19 bp, Artificial Sequence
  Synthetic
cacttcggtctcccctagg

SEQ ID NO: 28373 - DNA, 16 bp, Artificial Sequence
  Synthetic
gcaggcaaggcgagca

SEQ ID NO: 28374 - DNA, 18 bp, Artificial Sequence
  Synthetic
catctacgaggccatcaa

SEQ ID NO: 28375 - DNA, 16 bp, Artificial Sequence
  Synthetic
aaacccgatggccccg

SEQ ID NO: 28376 - DNA, 16 bp, Artificial Sequence
  Synthetic
tggctcccgcgcatac

SEQ ID NO: 28377 - DNA, 20 bp, Artificial Sequence
  Synthetic
catgatcagccacgaacgaa

SEQ ID NO: 28378 - DNA, 18 bp, Artificial Sequence
  Synthetic
aaaacacggccaagggag

SEQ ID NO: 28379 - DNA, 20 bp, Artificial Sequence
  Synthetic
agaagcccagttatccaccc

SEQ ID NO: 28380 - DNA, 20 bp, Artificial Sequence
  Synthetic
agggactggctgtctcctac

SEQ ID NO: 28381 - DNA, 18 bp, Artificial Sequence
  Synthetic
ctggtcggcacacatccg

SEQ ID NO: 28382 - DNA, 17 bp, Artificial Sequence
  Synthetic
acaatttctggcggcgg

SEQ ID NO: 28383 - DNA, 18 bp, Artificial Sequence
  Synthetic
cgctggaagagcaggtcc

SEQ ID NO: 28384 - DNA, 20 bp, Artificial Sequence
  Synthetic
gctccgagaacaggaagaca

SEQ ID NO: 28385 - DNA, 20 bp, Artificial Sequence
  Synthetic
aaacaagggaagagcgggag

SEQ ID NO: 28386 - DNA, 18 bp, Artificial Sequence
  Synthetic
ggatgtgaatgcccccgg

SEQ ID NO: 28387 - DNA, 20 bp, Artificial Sequence
  Synthetic
tccggaacagatcacagtca

SEQ ID NO: 28388 - DNA, 16 bp, Artificial Sequence
  Synthetic
tggaggctgtgctccc

SEQ ID NO: 28389 - DNA, 18 bp, Artificial Sequence
  Synthetic
aagaggtagcgccccagg

SEQ ID NO: 28390 - DNA, 16 bp, Artificial Sequence
  Synthetic
cctcggcgcacaggtt

SEQ ID NO: 28391 - DNA, 16 bp, Artificial Sequence
  Synthetic
tcaccgactgccccct

SEQ ID NO: 28392 - DNA, 17 bp, Artificial Sequence
  Synthetic
acttccaatcccccggg

SEQ ID NO: 28393 - DNA, 20 bp, Artificial Sequence
  Synthetic
caccacagctatgatgccag

SEQ ID NO: 28394 - DNA, 18 bp, Artificial Sequence
  Synthetic
cttctgcttctgcctggc

SEQ ID NO: 28395 - DNA, 18 bp, Artificial Sequence
  Synthetic
accggtcttcctctgcca

SEQ ID NO: 28396 - DNA, 17 bp, Artificial Sequence
  Synthetic
ttgagaccctggcgcac

SEQ ID NO: 28397 - DNA, 18 bp, Artificial Sequence
  Synthetic
acagggggatgccagagg

SEQ ID NO: 28398 - DNA, 20 bp, Artificial Sequence
  Synthetic
tggcctcaaacactgacatt

SEQ ID NO: 28399 - DNA, 16 bp, Artificial Sequence
  Synthetic
agagtgctccggctgc

SEQ ID NO: 28400 - DNA, 20 bp, Artificial Sequence
  Synthetic
catcatcgatcccggctaca

SEQ ID NO: 28401 - DNA, 20 bp, Artificial Sequence
  Synthetic
tcattacctctcgctgtcga

SEQ ID NO: 28402 - DNA, 18 bp, Artificial Sequence
  Synthetic
ggccccactgtatccacc

SEQ ID NO: 28403 - DNA, 19 bp, Artificial Sequence
  Synthetic
atggtttttgtctgatggc

SEQ ID NO: 28404 - DNA, 19 bp, Artificial Sequence
  Synthetic
tgtgcgtagtgttgctgtg

SEQ ID NO: 28405 - DNA, 19 bp, Artificial Sequence
  Synthetic
ggatggacgaggagctcat

SEQ ID NO: 28406 - DNA, 19 bp, Artificial Sequence
  Synthetic
caagagctggtgggagagg

SEQ ID NO: 28407 - DNA, 16 bp, Artificial Sequence
  Synthetic
caccgtgggccccttt

SEQ ID NO: 28408 - DNA, 20 bp, Artificial Sequence
  Synthetic
tcttttcaccacgtccacga

SEQ ID NO: 28409 - DNA, 18 bp, Artificial Sequence
  Synthetic
aaagcagcagcctcagga

SEQ ID NO: 28410 - DNA, 20 bp, Artificial Sequence
  Synthetic
ccaaatactggccggtactc

SEQ ID NO: 28411 - DNA, 17 bp, Artificial Sequence
  Synthetic
tcacgggagccacaacc

SEQ ID NO: 28412 - DNA, 17 bp, Artificial Sequence
  Synthetic
tcagggacgttggtggc

SEQ ID NO: 28413 - DNA, 17 bp, Artificial Sequence
  Synthetic
tggcccgcagacacatt

SEQ ID NO: 28414 - DNA, 18 bp, Artificial Sequence
  Synthetic
actcgggggcctctacac

SEQ ID NO: 28415 - DNA, 16 bp, Artificial Sequence
  Synthetic
tcttgtccgccgccag

SEQ ID NO: 28416 - DNA, 18 bp, Artificial Sequence
  Synthetic
cctggtgcctgaagaccc

SEQ ID NO: 28417 - DNA, 18 bp, Artificial Sequence
  Synthetic
ctatcctgctgcagggcg

SEQ ID NO: 28418 - DNA, 20 bp, Artificial Sequence
  Synthetic
ccacccgctgtatgaggaag

SEQ ID NO: 28419 - DNA, 18 bp, Artificial Sequence
  Synthetic
cccctcctcgtgcaccta

SEQ ID NO: 28420 - DNA, 19 bp, Artificial Sequence
  Synthetic
tgtgatggatccagcgagt

SEQ ID NO: 28421 - DNA, 18 bp, Artificial Sequence
  Synthetic
gccggatcaacgtacacg

SEQ ID NO: 28422 - DNA, 16 bp, Artificial Sequence
  Synthetic
tgggggtgcagggtga

SEQ ID NO: 28423 - DNA, 20 bp, Artificial Sequence
  Synthetic
aggatgtgttggcctttagg

SEQ ID NO: 28424 - DNA, 20 bp, Artificial Sequence
  Synthetic
cattcatgacctgccccact

SEQ ID NO: 28425 - DNA, 20 bp, Artificial Sequence
  Synthetic
gaagccgtctctctgagatg

SEQ ID NO: 28426 - DNA, 18 bp, Artificial Sequence
  Synthetic
gtgctgctccaatgtccg

SEQ ID NO: 28427 - DNA, 17 bp, Artificial Sequence
  Synthetic
atgggcaggctctcacg

SEQ ID NO: 28428 - DNA, 18 bp, Artificial Sequence
  Synthetic
gcacagtcacggggatct

SEQ ID NO: 28429 - DNA, 22 bp, Artificial Sequence
  Synthetic
atcttgagctccaactactttg

SEQ ID NO: 28430 - DNA, 17 bp, Artificial Sequence
  Synthetic
tccagcccctgcatacc

SEQ ID NO: 28431 - DNA, 17 bp, Artificial Sequence
  Synthetic
agttcggggcctgtgtc

SEQ ID NO: 28432 - DNA, 16 bp, Artificial Sequence
  Synthetic
tggatcgcgagggagc

SEQ ID NO: 28433 - DNA, 18 bp, Artificial Sequence
  Synthetic
cacagacttggccttggg

SEQ ID NO: 28434 - DNA, 19 bp, Artificial Sequence
  Synthetic
acaagggtgggctaactct

SEQ ID NO: 28435 - DNA, 18 bp, Artificial Sequence
  Synthetic
tggctctgaccagcaaga

SEQ ID NO: 28436 - DNA, 19 bp, Artificial Sequence
  Synthetic
acccagatgcctcacctgg

SEQ ID NO: 28437 - DNA, 20 bp, Artificial Sequence
  Synthetic
caggcacatctacagcatca

SEQ ID NO: 28438 - DNA, 17 bp, Artificial Sequence
  Synthetic
aggggtggtggatgtgc

SEQ ID NO: 28439 - DNA, 17 bp, Artificial Sequence
  Synthetic
accttcatcacggggcc

SEQ ID NO: 28440 - DNA, 16 bp, Artificial Sequence
  Synthetic
cccgcatgcgcaacca

SEQ ID NO: 28441 - DNA, 18 bp, Artificial Sequence
  Synthetic
tggttctgcccaaccacg

SEQ ID NO: 28442 - DNA, 19 bp, Artificial Sequence
  Synthetic
cggactcgggagccttaat

SEQ ID NO: 28443 - DNA, 20 bp, Artificial Sequence
  Synthetic
ggcaataaccgaggccttca

SEQ ID NO: 28444 - DNA, 19 bp, Artificial Sequence
  Synthetic
ctcttagggaggtggccac

SEQ ID NO: 28445 - DNA, 16 bp, Artificial Sequence
  Synthetic
cacaagagcgccgcct

SEQ ID NO: 28446 - DNA, 18 bp, Artificial Sequence
  Synthetic
aggaagctgtacgcggag

SEQ ID NO: 28447 - DNA, 16 bp, Artificial Sequence
  Synthetic
tgaggaccccggtcga

SEQ ID NO: 28448 - DNA, 16 bp, Artificial Sequence
  Synthetic
aacaccccccgatgcc

SEQ ID NO: 28449 - DNA, 22 bp, Artificial Sequence
  Synthetic
gtattagttgctctgtaactgg

SEQ ID NO: 28450 - DNA, 20 bp, Artificial Sequence
  Synthetic
accacagtatgaaaccaccc

SEQ ID NO: 28451 - DNA, 18 bp, Artificial Sequence
  Synthetic
ttttacaccctccgcaac

SEQ ID NO: 28452 - DNA, 20 bp, Artificial Sequence
  Synthetic
atatgtcacttgcgtttccc

SEQ ID NO: 28453 - DNA, 25 bp, Artificial Sequence
  Synthetic
cacttctaaatgatatccattgtga

SEQ ID NO: 28454 - DNA, 19 bp, Artificial Sequence
  Synthetic
attttgcatcagctaacgg

SEQ ID NO: 28455 - DNA, 18 bp, Artificial Sequence
  Synthetic
aataccaagcacaggcac

SEQ ID NO: 28456 - DNA, 22 bp, Artificial Sequence
  Synthetic
acacattgtcttttcctctttg

SEQ ID NO: 28457 - DNA, 18 bp, Artificial Sequence
  Synthetic
ggtttcgttggtgcccag

SEQ ID NO: 28458 - DNA, 18 bp, Artificial Sequence
  Synthetic
gtacccttaacgttccgc

SEQ ID NO: 28459 - DNA, 24 bp, Artificial Sequence
  Synthetic
cacaacaggatacatatatgcaat

SEQ ID NO: 28460 - DNA, 24 bp, Artificial Sequence
  Synthetic
aaataatacctcagttccatacac

SEQ ID NO: 28461 - DNA, 22 bp, Artificial Sequence
  Synthetic
caaatttatttgggtcgggtag

SEQ ID NO: 28462 - DNA, 24 bp, Artificial Sequence
  Synthetic
gcaaccaataatacatagttgtgt

SEQ ID NO: 28463 - DNA, 19 bp, Artificial Sequence
  Synthetic
ttaaaacattgctctcggc

SEQ ID NO: 28464 - DNA, 21 bp, Artificial Sequence
  Synthetic
gttacaaaaagcagattgccc

SEQ ID NO: 28465 - DNA, 18 bp, Artificial Sequence
  Synthetic
ttttctgcaggaggagga

SEQ ID NO: 28466 - DNA, 18 bp, Artificial Sequence
  Synthetic
aacggcggccattttagg

SEQ ID NO: 28467 - DNA, 18 bp, Artificial Sequence
  Synthetic
tacactgctgttgccaaa

SEQ ID NO: 28468 - DNA, 20 bp, Artificial Sequence
  Synthetic
tgttaaggaaatgcaagcac

SEQ ID NO: 28469 - DNA, 18 bp, Artificial Sequence
  Synthetic
tgcattacaggtaccgca

SEQ ID NO: 28470 - DNA, 18 bp, Artificial Sequence
  Synthetic
tacagcttccagtctcgg

SEQ ID NO: 28471 - DNA, 24 bp, Artificial Sequence
  Synthetic
cgaccgtttataaaaatacaaagc

SEQ ID NO: 28472 - DNA, 20 bp, Artificial Sequence
  Synthetic
tgtgcaataggtttccaatc

SEQ ID NO: 28473 - DNA, 21 bp, Artificial Sequence
  Synthetic
tgtgtatggaaaggctttagc

SEQ ID NO: 28474 - DNA, 19 bp, Artificial Sequence
  Synthetic
atgtcctgttcccacctcc

SEQ ID NO: 28475 - DNA, 18 bp, Artificial Sequence
  Synthetic
aggcctaacgactggaat

SEQ ID NO: 28476 - DNA, 22 bp, Artificial Sequence
  Synthetic
tttcaataactacagcatttgc

SEQ ID NO: 28477 - DNA, 21 bp, Artificial Sequence
  Synthetic
agcatatctgaagtgtcatgt

SEQ ID NO: 28478 - DNA, 18 bp, Artificial Sequence
  Synthetic
ctactggctttgcaggag

SEQ ID NO: 28479 - DNA, 20 bp, Artificial Sequence
  Synthetic
ttaacctcatcactgcaagg

SEQ ID NO: 28480 - DNA, 18 bp, Artificial Sequence
  Synthetic
tttagcagccctgtttga

SEQ ID NO: 28481 - DNA, 19 bp, Artificial Sequence
  Synthetic
acaacttgtagctccttgt

SEQ ID NO: 28482 - DNA, 18 bp, Artificial Sequence
  Synthetic
cgcatcaggctgatccag

SEQ ID NO: 28483 - DNA, 18 bp, Artificial Sequence
  Synthetic
cttcaccgtcggccatag

SEQ ID NO: 28484 - DNA, 20 bp, Artificial Sequence
  Synthetic
ggccaacggactagctagat

SEQ ID NO: 28485 - DNA, 18 bp, Artificial Sequence
  Synthetic
gtgctgtaactgcacccg

SEQ ID NO: 28486 - DNA, 21 bp, Artificial Sequence
  Synthetic
atctcactagcattaggacca

SEQ ID NO: 28487 - DNA, 20 bp, Artificial Sequence
  Synthetic
actgaaactggcattcttct

SEQ ID NO: 28488 - DNA, 18 bp, Artificial Sequence
  Synthetic
accgtactatgggtctcc

SEQ ID NO: 28489 - DNA, 22 bp, Artificial Sequence
  Synthetic
ggtatctatatagctccagcac

SEQ ID NO: 28490 - DNA, 18 bp, Artificial Sequence
  Synthetic
attgtcctcctggtcgtc

SEQ ID NO: 28491 - DNA, 18 bp, Artificial Sequence
  Synthetic
gttacacgtgtcccttcg

SEQ ID NO: 28492 - DNA, 20 bp, Artificial Sequence
  Synthetic
gctgtcagggttacactggt

SEQ ID NO: 28493 - DNA, 18 bp, Artificial Sequence
  Synthetic
atcatgccacagggttac

SEQ ID NO: 28494 - DNA, 22 bp, Artificial Sequence
  Synthetic
gtatgtatatgatcaggaggcc

SEQ ID NO: 28495 - DNA, 20 bp, Artificial Sequence
  Synthetic
aagacacacgaaaagcaaca

SEQ ID NO: 28496 - DNA, 16 bp, Artificial Sequence
  Synthetic
taacgacaggggggcg

SEQ ID NO: 28497 - DNA, 20 bp, Artificial Sequence
  Synthetic
atccaaaaagtcaggatccg

SEQ ID NO: 28498 - DNA, 20 bp, Artificial Sequence
  Synthetic
acttattgggatcaggcaaa

SEQ ID NO: 28499 - DNA, 20 bp, Artificial Sequence
  Synthetic
agacatattgcatggggtac

SEQ ID NO: 28500 - DNA, 18 bp, Artificial Sequence
  Synthetic
gaattgcgtcgcccatag

SEQ ID NO: 28501 - DNA, 24 bp, Artificial Sequence
  Synthetic
gcatgtactctttaaaattggaag

SEQ ID NO: 28502 - DNA, 22 bp, Artificial Sequence
  Synthetic
cacacaaacatgcataaggaaa

SEQ ID NO: 28503 - DNA, 19 bp, Artificial Sequence
  Synthetic
gcgcgaaacagctaacagt

SEQ ID NO: 28504 - DNA, 18 bp, Artificial Sequence
  Synthetic
tactcaccggttccgcag

SEQ ID NO: 28505 - DNA, 18 bp, Artificial Sequence
  Synthetic
tttagggatgggctggcg

SEQ ID NO: 28506 - DNA, 20 bp, Artificial Sequence
  Synthetic
cgggtaagttccctgttgca

SEQ ID NO: 28507 - DNA, 16 bp, Artificial Sequence
  Synthetic
gtcgatgtgcgtccgc

SEQ ID NO: 28508 - DNA, 20 bp, Artificial Sequence
  Synthetic
ggccaacagaaggatgacaa

SEQ ID NO: 28509 - DNA, 20 bp, Artificial Sequence
  Synthetic
tgccagcaatagggtctcat

SEQ ID NO: 28510 - DNA, 20 bp, Artificial Sequence
  Synthetic
ccgcatttgaggtaagtggt

SEQ ID NO: 28511 - DNA, 20 bp, Artificial Sequence
  Synthetic
acgatgttttggtggaggtg

SEQ ID NO: 28512 - DNA, 20 bp, Artificial Sequence
  Synthetic
gcacagatgcgtcataagca

SEQ ID NO: 28513 - DNA, 19 bp, Artificial Sequence
  Synthetic
gcacatcctcagtagagcg

SEQ ID NO: 28514 - DNA, 18 bp, Artificial Sequence
  Synthetic
gtgtctgctgggcgtaag

SEQ ID NO: 28515 - DNA, 17 bp, Artificial Sequence
  Synthetic
cgtgcacggctccaaag

SEQ ID NO: 28516 - DNA, 20 bp, Artificial Sequence
  Synthetic
cagcatatgcgacaggaact

SEQ ID NO: 28517 - DNA, 20 bp, Artificial Sequence
  Synthetic
gcacagttagtctgacccca

SEQ ID NO: 28518 - DNA, 19 bp, Artificial Sequence
  Synthetic
tacgttgcagtcgatcacg

SEQ ID NO: 28519 - DNA, 20 bp, Artificial Sequence
  Synthetic
ctgcctcccaaaactcaaga

SEQ ID NO: 28520 - DNA, 18 bp, Artificial Sequence
  Synthetic
cctgccaagacccatgtg

SEQ ID NO: 28521 - DNA, 20 bp, Artificial Sequence
  Synthetic
tgttgatagtcctgcgaggt

SEQ ID NO: 28522 - DNA, 18 bp, Artificial Sequence
  Synthetic
cagaatggccgcgcagat

SEQ ID NO: 28523 - DNA, 18 bp, Artificial Sequence
  Synthetic
acctccgcgtactctgag

SEQ ID NO: 28524 - DNA, 17 bp, Artificial Sequence
  Synthetic
tgccgatagctggctcg

SEQ ID NO: 28525 - DNA, 20 bp, Artificial Sequence
  Synthetic
cggttggtaatctggccttt

SEQ ID NO: 28526 - DNA, 18 bp, Artificial Sequence
  Synthetic
agaccaggaccccgagtc

SEQ ID NO: 28527 - DNA, 20 bp, Artificial Sequence
  Synthetic
agatcttgcagaatggggtg

SEQ ID NO: 28528 - DNA, 18 bp, Artificial Sequence
  Synthetic
ggtccttcttttccgccc

SEQ ID NO: 28529 - DNA, 20 bp, Artificial Sequence
  Synthetic
ggtcccctggctttctgaga

SEQ ID NO: 28530 - DNA, 20 bp, Artificial Sequence
  Synthetic
tggatgatgtttcccagcca

SEQ ID NO: 28531 - DNA, 17 bp, Artificial Sequence
  Synthetic
acgggagatgagggacg

SEQ ID NO: 28532 - DNA, 18 bp, Artificial Sequence
  Synthetic
gttccagcaccgttttgc

SEQ ID NO: 28533 - DNA, 20 bp, Artificial Sequence
  Synthetic
caaagtccacgccaaaatgg

SEQ ID NO: 28534 - DNA, 18 bp, Artificial Sequence
  Synthetic
cggcttcgtcttcctgtc

SEQ ID NO: 28535 - DNA, 18 bp, Artificial Sequence
  Synthetic
cgtcatgccgcctgaaac

SEQ ID NO: 28536 - DNA, 16 bp, Artificial Sequence
  Synthetic
tcagtgccaccccgtc

SEQ ID NO: 28537 - DNA, 17 bp, Artificial Sequence
  Synthetic
agccccagtagcgttgg

SEQ ID NO: 28538 - DNA, 19 bp, Artificial Sequence
  Synthetic
agtttggtgaagaagcgcg

SEQ ID NO: 28539 - DNA, 16 bp, Artificial Sequence
  Synthetic
tcgttggcgagtgcgg

SEQ ID NO: 28540 - DNA, 18 bp, Artificial Sequence
  Synthetic
tatcgcaagccgctttcg

SEQ ID NO: 28541 - DNA, 16 bp, Artificial Sequence
  Synthetic
ctatcgcgccgccaac

SEQ ID NO: 28542 - DNA, 16 bp, Artificial Sequence
  Synthetic
cggtgtggcaggcgta

SEQ ID NO: 28543 - DNA, 16 bp, Artificial Sequence
  Synthetic
ttaccgccgaccgcac

SEQ ID NO: 28544 - DNA, 18 bp, Artificial Sequence
  Synthetic
ggcacgaacgcttggaag

SEQ ID NO: 28545 - DNA, 17 bp, Artificial Sequence
  Synthetic
taaggaagcgcgcgtgg

SEQ ID NO: 28546 - DNA, 17 bp, Artificial Sequence
  Synthetic
tacgtccgccagttcgc

SEQ ID NO: 28547 - DNA, 19 bp, Artificial Sequence
  Synthetic
cgtgcgtgatttgtccgaa

SEQ ID NO: 28548 - DNA, 20 bp, Artificial Sequence
  Synthetic
gctggagaatgtacaaggcc

SEQ ID NO: 28549 - DNA, 16 bp, Artificial Sequence
  Synthetic
gcaaggactggcaccg

SEQ ID NO: 28550 - DNA, 20 bp, Artificial Sequence
  Synthetic
caaaaaccatgtgtcgtggc

SEQ ID NO: 28551 - DNA, 19 bp, Artificial Sequence
  Synthetic
gaatggtttgccgaacgcg

SEQ ID NO: 28552 - DNA, 18 bp, Artificial Sequence
  Synthetic
cgacatcgggctgttgtc

SEQ ID NO: 28553 - DNA, 17 bp, Artificial Sequence
  Synthetic
tcgtcagcctgtgtccg

SEQ ID NO: 28554 - DNA, 19 bp, Artificial Sequence
  Synthetic
caaaccgaagatgccgtct

SEQ ID NO: 28555 - DNA, 16 bp, Artificial Sequence
  Synthetic
tttctcgcgctcgccc

SEQ ID NO: 28556 - DNA, 20 bp, Artificial Sequence
  Synthetic
gcgaagtgttttatgcgtgg

SEQ ID NO: 28557 - DNA, 17 bp, Artificial Sequence
  Synthetic
ttgcctccgccgaactc

SEQ ID NO: 28558 - DNA, 18 bp, Artificial Sequence
  Synthetic
atatgcggcgaaacgtgc

SEQ ID NO: 28559 - DNA, 18 bp, Artificial Sequence
  Synthetic
ggcagtcatcgtcgcttc

SEQ ID NO: 28560 - DNA, 18 bp, Artificial Sequence
  Synthetic
tcaacgtcaacgatgccg

SEQ ID NO: 28561 - DNA, 18 bp, Artificial Sequence
  Synthetic
tgccgaaaacgccgattt

SEQ ID NO: 28562 - DNA, 18 bp, Artificial Sequence
  Synthetic
caccgttgccgtgcattc

SEQ ID NO: 28563 - DNA, 19 bp, Artificial Sequence
  Synthetic
cgtgttggaagtgaacccg

SEQ ID NO: 28564 - DNA, 18 bp, Artificial Sequence
  Synthetic
gtgtccaccgacttcgac

SEQ ID NO: 28565 - DNA, 20 bp, Artificial Sequence
  Synthetic
aagcctgcacgactatttgg

SEQ ID NO: 28566 - DNA, 18 bp, Artificial Sequence
  Synthetic
acagcgttcagacggcat

SEQ ID NO: 28567 - DNA, 16 bp, Artificial Sequence
  Synthetic
tgtccggactcgccac

SEQ ID NO: 28568 - DNA, 17 bp, Artificial Sequence
  Synthetic
ttccgctgttgccggta

SEQ ID NO: 28569 - DNA, 20 bp, Artificial Sequence
  Synthetic
agagtttgtgcagcatacgg

SEQ ID NO: 28570 - DNA, 16 bp, Artificial Sequence
  Synthetic
cctacccagccggcaa

SEQ ID NO: 28571 - DNA, 18 bp, Artificial Sequence
  Synthetic
tttttggttcaggcggcg

SEQ ID NO: 28572 - DNA, 16 bp, Artificial Sequence
  Synthetic
acccaggcggcatcga

SEQ ID NO: 28573 - DNA, 18 bp, Artificial Sequence
  Synthetic
ttgatggctttgtcgcgc

SEQ ID NO: 28574 - DNA, 18 bp, Artificial Sequence
  Synthetic
cttccgcctgcaaggacg

SEQ ID NO: 28575 - DNA, 19 bp, Artificial Sequence
  Synthetic
ggaaaaatacggcggtccc

SEQ ID NO: 28576 - DNA, 17 bp, Artificial Sequence
  Synthetic
attcgttaccgccgtgc

SEQ ID NO: 28577 - DNA, 18 bp, Artificial Sequence
  Synthetic
aacacatgaaccgccgca

SEQ ID NO: 28578 - DNA, 17 bp, Artificial Sequence
  Synthetic
ggcggcgtgttgattgc

SEQ ID NO: 28579 - DNA, 17 bp, Artificial Sequence
  Synthetic
ccgttgcgcatcgtagc

SEQ ID NO: 28580 - DNA, 16 bp, Artificial Sequence
  Synthetic
ttcgcgcccgaccaac

SEQ ID NO: 28581 - DNA, 17 bp, Artificial Sequence
  Synthetic
cgcaaaaccggccatcc

SEQ ID NO: 28582 - DNA, 19 bp, Artificial Sequence
  Synthetic
ctatcaaggcggctgctcc

SEQ ID NO: 28583 - DNA, 19 bp, Artificial Sequence
  Synthetic
gaacacgcccccttcagac

SEQ ID NO: 28584 - DNA, 16 bp, Artificial Sequence
  Synthetic
ttgccgtaccgtccgg

SEQ ID NO: 28585 - DNA, 17 bp, Artificial Sequence
  Synthetic
cctcctgctgccggaaa

SEQ ID NO: 28586 - DNA, 19 bp, Artificial Sequence
  Synthetic
cttttcgtccgcgcaactc

SEQ ID NO: 28587 - DNA, 19 bp, Artificial Sequence
  Synthetic
tgctgtcgtggtatttccc

SEQ ID NO: 28588 - DNA, 19 bp, Artificial Sequence
  Synthetic
cggcagcagcttttggatt

SEQ ID NO: 28589 - DNA, 18 bp, Artificial Sequence
  Synthetic
cgaactcaaaatgcccgc

SEQ ID NO: 28590 - DNA, 16 bp, Artificial Sequence
  Synthetic
aaggcaaaggcgtgcg

SEQ ID NO: 28591 - DNA, 17 bp, Artificial Sequence
  Synthetic
gcgcatggctcaacctc

SEQ ID NO: 28592 - DNA, 18 bp, Artificial Sequence
  Synthetic
ccggtaaagcctgctacg

SEQ ID NO: 28593 - DNA, 16 bp, Artificial Sequence
  Synthetic
aacgcttcgggcctgc

SEQ ID NO: 28594 - DNA, 16 bp, Artificial Sequence
  Synthetic
atcacgccgcacatcg

SEQ ID NO: 28595 - DNA, 19 bp, Artificial Sequence
  Synthetic
gatgctcgaccacagcctg

SEQ ID NO: 28596 - DNA, 17 bp, Artificial Sequence
  Synthetic
accgtacccgcgttacc

SEQ ID NO: 28597 - DNA, 18 bp, Artificial Sequence
  Synthetic
cccaacgcatcgaagacg

SEQ ID NO: 28598 - DNA, 19 bp, Artificial Sequence
  Synthetic
aaggcggtagaggtcggta

SEQ ID NO: 28599 - DNA, 20 bp, Artificial Sequence
  Synthetic
cgtgccgtctgaaagttgat

SEQ ID NO: 28600 - DNA, 16 bp, Artificial Sequence
  Synthetic
aagcccatgcgctcgg

SEQ ID NO: 28601 - DNA, 20 bp, Artificial Sequence
  Synthetic
acccaaataaccttccctgc

SEQ ID NO: 28602 - DNA, 17 bp, Artificial Sequence
  Synthetic
aaaccgtcctgcgcgac

SEQ ID NO: 28603 - DNA, 20 bp, Artificial Sequence
  Synthetic
ggcgacaacttcaaagccta

SEQ ID NO: 28604 - DNA, 19 bp, Artificial Sequence
  Synthetic
ggcatcgccatgaaagacg

SEQ ID NO: 28605 - DNA, 18 bp, Artificial Sequence
  Synthetic
ccagatgtcgaagtcgcc

SEQ ID NO: 28606 - DNA, 19 bp, Artificial Sequence
  Synthetic
tcccttttccaacgtatcc

SEQ ID NO: 28607 - DNA, 16 bp, Artificial Sequence
  Synthetic
ttaccaatgcgccgcc

SEQ ID NO: 28608 - DNA, 18 bp, Artificial Sequence
  Synthetic
tccattgctgctgccaaa

SEQ ID NO: 28609 - DNA, 16 bp, Artificial Sequence
  Synthetic
tcgaagccgccgacct

SEQ ID NO: 28610 - DNA, 18 bp, Artificial Sequence
  Synthetic
cccatctccgacacgacc

SEQ ID NO: 28611 - DNA, 17 bp, Artificial Sequence
  Synthetic
tcttcctgctcgccagc

SEQ ID NO: 28612 - DNA, 18 bp, Artificial Sequence
  Synthetic
gccccgttaccgacaagt

SEQ ID NO: 28613 - DNA, 20 bp, Artificial Sequence
  Synthetic
actgctgtctttaggcatcg

SEQ ID NO: 28614 - DNA, 19 bp, Artificial Sequence
  Synthetic
atcaatccgggcaattccg

SEQ ID NO: 28615 - DNA, 19 bp, Artificial Sequence
  Synthetic
aatcgccgttctgctttcg

SEQ ID NO: 28616 - DNA, 16 bp, Artificial Sequence
  Synthetic
tcgcgacggcaagcag

SEQ ID NO: 28617 - DNA, 16 bp, Artificial Sequence
  Synthetic
ccggcaatctgcacgg

SEQ ID NO: 28618 - DNA, 16 bp, Artificial Sequence
  Synthetic
gccttgaccaccgcct

SEQ ID NO: 28619 - DNA, 19 bp, Artificial Sequence
  Synthetic
cggtaaaacgccgtgttcg

SEQ ID NO: 28620 - DNA, 19 bp, Artificial Sequence
  Synthetic
tgttttcgacattcgccgg

SEQ ID NO: 28621 - DNA, 16 bp, Artificial Sequence
  Synthetic
ctttgccgaccaccgc

SEQ ID NO: 28622 - DNA, 19 bp, Artificial Sequence
  Synthetic
tgcggatttccttcagcct

SEQ ID NO: 28623 - DNA, 17 bp, Artificial Sequence
  Synthetic
tagagcgtttgggcggc

SEQ ID NO: 28624 - DNA, 17 bp, Artificial Sequence
  Synthetic
acgacctgctccttgcc

SEQ ID NO: 28625 - DNA, 18 bp, Artificial Sequence
  Synthetic
aatccccgaattcgcacc

SEQ ID NO: 28626 - DNA, 16 bp, Artificial Sequence
  Synthetic
ttcgtccgcagcctcg

SEQ ID NO: 28627 - DNA, 18 bp, Artificial Sequence
  Synthetic
acggcggacaatacagca

SEQ ID NO: 28628 - DNA, 19 bp, Artificial Sequence
  Synthetic
caacggacaaaccactgcc

SEQ ID NO: 28629 - DNA, 15 bp, Artificial Sequence
  Synthetic
attgcaccgccgcag

SEQ ID NO: 28630 - DNA, 20 bp, Artificial Sequence
  Synthetic
gcacgcaccaaaaaacctca

SEQ ID NO: 28631 - DNA, 19 bp, Artificial Sequence
  Synthetic
cctcacgacagaaaccgac

SEQ ID NO: 28632 - DNA, 16 bp, Artificial Sequence
  Synthetic
gcatcccggcatcagc

SEQ ID NO: 28633 - DNA, 20 bp, Artificial Sequence
  Synthetic
actcttggcacgcatcaatg

SEQ ID NO: 28634 - DNA, 18 bp, Artificial Sequence
  Synthetic
agaggcttcagacggcat

SEQ ID NO: 28635 - DNA, 20 bp, Artificial Sequence
  Synthetic
atacttccgccgaaaccctt

SEQ ID NO: 28636 - DNA, 18 bp, Artificial Sequence
  Synthetic
gttcaaagccgtcctgcc

SEQ ID NO: 28637 - DNA, 19 bp, Artificial Sequence
  Synthetic
tgaacaccttcttccggca

SEQ ID NO: 28638 - DNA, 20 bp, Artificial Sequence
  Synthetic
atggtcatgaaacgcaaagc

SEQ ID NO: 28639 - DNA, 19 bp, Artificial Sequence
  Synthetic
ttgcgcctttttttgggca

SEQ ID NO: 28640 - DNA, 18 bp, Artificial Sequence
  Synthetic
aaaacgccattcgaaacg

SEQ ID NO: 28641 - DNA, 19 bp, Artificial Sequence
  Synthetic
tctacatcctgcaagcccg

SEQ ID NO: 28642 - DNA, 20 bp, Artificial Sequence
  Synthetic
actcgttcccaaactcggat

SEQ ID NO: 28643 - DNA, 17 bp, Artificial Sequence
  Synthetic
cggttcgcaagccatcg

SEQ ID NO: 28644 - DNA, 20 bp, Artificial Sequence
  Synthetic
caccatcctgcacatcatcg

SEQ ID NO: 28645 - DNA, 16 bp, Artificial Sequence
  Synthetic
tcccgtcatcgcctcc

SEQ ID NO: 28646 - DNA, 19 bp, Artificial Sequence
  Synthetic
ggtcttccccgacctgaac

SEQ ID NO: 28647 - DNA, 16 bp, Artificial Sequence
  Synthetic
tcccttgacgcggcag

SEQ ID NO: 28648 - DNA, 18 bp, Artificial Sequence
  Synthetic
ttccaagccgttgacgca

SEQ ID NO: 28649 - DNA, 20 bp, Artificial Sequence
  Synthetic
accgtttaccgcaatatcgc

SEQ ID NO: 28650 - DNA, 18 bp, Artificial Sequence
  Synthetic
ggcattaccgccgcattc

SEQ ID NO: 28651 - DNA, 19 bp, Artificial Sequence
  Synthetic
cagccaacctcctagagcc

SEQ ID NO: 28652 - DNA, 19 bp, Artificial Sequence
  Synthetic
atgctcgcctacgtcgaaa

SEQ ID NO: 28653 - DNA, 20 bp, Artificial Sequence
  Synthetic
tcatacggcatcgtcgaaac

SEQ ID NO: 28654 - DNA, 16 bp, Artificial Sequence
  Synthetic
acgtcttccgggccga

SEQ ID NO: 28655 - DNA, 19 bp, Artificial Sequence
  Synthetic
cgacaatttctcctgccgc

SEQ ID NO: 28656 - DNA, 20 bp, Artificial Sequence
  Synthetic
aactctggttcggctacacc

SEQ ID NO: 28657 - DNA, 17 bp, Artificial Sequence
  Synthetic
gccccctccgtcaactt

SEQ ID NO: 28658 - DNA, 16 bp, Artificial Sequence
  Synthetic
acgtcctctcccgcct

SEQ ID NO: 28659 - DNA, 20 bp, Artificial Sequence
  Synthetic
ttcccacttcacaacacccg

SEQ ID NO: 28660 - DNA, 19 bp, Artificial Sequence
  Synthetic
accaagcccaagccctaat

SEQ ID NO: 28661 - DNA, 17 bp, Artificial Sequence
  Synthetic
tcgggcatcagcaggac

SEQ ID NO: 28662 - DNA, 18 bp, Artificial Sequence
  Synthetic
tcaccgacctcctcaacc

SEQ ID NO: 28663 - DNA, 19 bp, Artificial Sequence
  Synthetic
cattcgcacaaagcatggg

SEQ ID NO: 28664 - DNA, 16 bp, Artificial Sequence
  Synthetic
tttccaaccgctgccg

SEQ ID NO: 28665 - DNA, 17 bp, Artificial Sequence
  Synthetic
atcatgcggcgacatgg

SEQ ID NO: 28666 - DNA, 18 bp, Artificial Sequence
  Synthetic
tttccctgatcgtgctgc

SEQ ID NO: 28667 - DNA, 15 bp, Artificial Sequence
  Synthetic
aaacgccgcgcacac

SEQ ID NO: 28668 - DNA, 16 bp, Artificial Sequence
  Synthetic
cagcaacgccctgcct

SEQ ID NO: 28669 - DNA, 16 bp, Artificial Sequence
  Synthetic
tatccacaccggcggc

SEQ ID NO: 28670 - DNA, 16 bp, Artificial Sequence
  Synthetic
ctcctgcatacgcgcg

SEQ ID NO: 28671 - DNA, 16 bp, Artificial Sequence
  Synthetic
ttcgggcgtggcttgg

SEQ ID NO: 28672 - DNA, 16 bp, Artificial Sequence
  Synthetic
gtgttgcggggtcacg

SEQ ID NO: 28673 - DNA, 20 bp, Artificial Sequence
  Synthetic
gcgttttctttggcggattt

SEQ ID NO: 28674 - DNA, 17 bp, Artificial Sequence
  Synthetic
gcgcaccaccttttccg

SEQ ID NO: 28675 - DNA, 20 bp, Artificial Sequence
  Synthetic
gttgtttcaacacgacgcgg

SEQ ID NO: 28676 - DNA, 16 bp, Artificial Sequence
  Synthetic
agccgtgggtgcttgc

SEQ ID NO: 28677 - DNA, 20 bp, Artificial Sequence
  Synthetic
ttgccttccgtgatccttac

SEQ ID NO: 28678 - DNA, 18 bp, Artificial Sequence
  Synthetic
gcaacggaaagccaaacg

SEQ ID NO: 28679 - DNA, 18 bp, Artificial Sequence
  Synthetic
cggcgcataccagctttc

SEQ ID NO: 28680 - DNA, 18 bp, Artificial Sequence
  Synthetic
cgatgccggggtaatcca

SEQ ID NO: 28681 - DNA, 20 bp, Artificial Sequence
  Synthetic
cataacggggcattaaacct

SEQ ID NO: 28682 - DNA, 19 bp, Artificial Sequence
  Synthetic
tccaacgtaccgatgattg

SEQ ID NO: 28683 - DNA, 17 bp, Artificial Sequence
  Synthetic
gcaaccaccatcagccc

SEQ ID NO: 28684 - DNA, 16 bp, Artificial Sequence
  Synthetic
gtgtcgccgcacggat

SEQ ID NO: 28685 - DNA, 20 bp, Artificial Sequence
  Synthetic
gcttgtcgatttcctgacgt

SEQ ID NO: 28686 - DNA, 20 bp, Artificial Sequence
  Synthetic
ttcttcgccttcttcctcca

SEQ ID NO: 28687 - DNA, 18 bp, Artificial Sequence
  Synthetic
ggcggacgacggaaatcc

SEQ ID NO: 28688 - DNA, 17 bp, Artificial Sequence
  Synthetic
ctgcaaaacgccttggc

SEQ ID NO: 28689 - DNA, 17 bp, Artificial Sequence
  Synthetic
gccggataaagggcgac

SEQ ID NO: 28690 - DNA, 19 bp, Artificial Sequence
  Synthetic
ccgcctttctcggtgtctg

SEQ ID NO: 28691 - DNA, 18 bp, Artificial Sequence
  Synthetic
cgcctacctgttcggtct

SEQ ID NO: 28692 - DNA, 20 bp, Artificial Sequence
  Synthetic
acaatacagcctgatgacgc

SEQ ID NO: 28693 - DNA, 19 bp, Artificial Sequence
  Synthetic
ggcaaccactttaaacgcc

SEQ ID NO: 28694 - DNA, 17 bp, Artificial Sequence
  Synthetic
gcccgaacacaaaccgc

SEQ ID NO: 28695 - DNA, 21 bp, Artificial Sequence
  Synthetic
cttgggcaatcaattctttca

SEQ ID NO: 28696 - DNA, 19 bp, Artificial Sequence
  Synthetic
caatcggagtaagcggaaa

SEQ ID NO: 28697 - DNA, 22 bp, Artificial Sequence
  Synthetic
acatcgttactccaaaaacgta

SEQ ID NO: 28698 - DNA, 17 bp, Artificial Sequence
  Synthetic
caatgcgttgcgtccga

SEQ ID NO: 28699 - DNA, 18 bp, Artificial Sequence
  Synthetic
tcatctactgcaccggcg

SEQ ID NO: 28700 - DNA, 19 bp, Artificial Sequence
  Synthetic
tgtctgcctccccgataat

SEQ ID NO: 28701 - DNA, 20 bp, Artificial Sequence
  Synthetic
cgtcttgccataggtacggc

SEQ ID NO: 28702 - DNA, 18 bp, Artificial Sequence
  Synthetic
ttaccaggcatccaaacg

SEQ ID NO: 28703 - DNA, 17 bp, Artificial Sequence
  Synthetic
ttgccgcattgcccgac

SEQ ID NO: 28704 - DNA, 22 bp, Artificial Sequence
  Synthetic
gcgttttcggtatatatgcaaa

SEQ ID NO: 28705 - DNA, 20 bp, Artificial Sequence
  Synthetic
cgaatccccaaaccgcatta

SEQ ID NO: 28706 - DNA, 20 bp, Artificial Sequence
  Synthetic
gcatagtgcttgcattgagc

SEQ ID NO: 28707 - DNA, 18 bp, Artificial Sequence
  Synthetic
tcaattcccgaagctcgc

SEQ ID NO: 28708 - DNA, 18 bp, Artificial Sequence
  Synthetic
tggcacaaacagttgtcg

SEQ ID NO: 28709 - DNA, 20 bp, Artificial Sequence
  Synthetic
ttctcctgcaaggcattcat

SEQ ID NO: 28710 - DNA, 19 bp, Artificial Sequence
  Synthetic
agggacggtgcttctatgg

SEQ ID NO: 28711 - DNA, 20 bp, Artificial Sequence
  Synthetic
tcgaaggcgtaacgaagttg

SEQ ID NO: 28712 - DNA, 19 bp, Artificial Sequence
  Synthetic
actgtgcggtttcgtcaaa

SEQ ID NO: 28713 - DNA, 16 bp, Artificial Sequence
  Synthetic
gccgtgatactgccgc

SEQ ID NO: 28714 - DNA, 19 bp, Artificial Sequence
  Synthetic
ggatttgggctttcatcaa

SEQ ID NO: 28715 - DNA, 16 bp, Artificial Sequence
  Synthetic
accggtcggattgcgc

SEQ ID NO: 28716 - DNA, 16 bp, Artificial Sequence
  Synthetic
gcgatggacgaagccg

SEQ ID NO: 28717 - DNA, 16 bp, Artificial Sequence
  Synthetic
cgccgacaaccccctt

SEQ ID NO: 28718 - DNA, 18 bp, Artificial Sequence
  Synthetic
cgacagcatatgcgtcgc

SEQ ID NO: 28719 - DNA, 17 bp, Artificial Sequence
  Synthetic
atccaacgcggcctgac

SEQ ID NO: 28720 - DNA, 18 bp, Artificial Sequence
  Synthetic
cgccctgcttgtaccgat

SEQ ID NO: 28721 - DNA, 20 bp, Artificial Sequence
  Synthetic
gcgctgttgattttccttgc

SEQ ID NO: 28722 - DNA, 19 bp, Artificial Sequence
  Synthetic
ccatcaatgcgacaaagcg

SEQ ID NO: 28723 - DNA, 18 bp, Artificial Sequence
  Synthetic
gctcgaaggcgacctcat

SEQ ID NO: 28724 - DNA, 15 bp, Artificial Sequence
  Synthetic
acgaaaccgccgcac

SEQ ID NO: 28725 - DNA, 20 bp, Artificial Sequence
  Synthetic
atcacaggcctaggttacct

SEQ ID NO: 28726 - DNA, 16 bp, Artificial Sequence
  Synthetic
aaccccgtcgtcagcg

SEQ ID NO: 28727 - DNA, 19 bp, Artificial Sequence
  Synthetic
tacaacactttcggcctgc

SEQ ID NO: 28728 - DNA, 18 bp, Artificial Sequence
  Synthetic
ccgcttctgcatcttccg

SEQ ID NO: 28729 - DNA, 19 bp, Artificial Sequence
  Synthetic
ggccttcgacgtttttcac

SEQ ID NO: 28730 - DNA, 15 bp, Artificial Sequence
  Synthetic
agcaaatcggcggcg

SEQ ID NO: 28731 - DNA, 20 bp, Artificial Sequence
  Synthetic
gcatcgagaaacagctccct

SEQ ID NO: 28732 - DNA, 17 bp, Artificial Sequence
  Synthetic
acttcgcgcaatacggc

SEQ ID NO: 28733 - DNA, 20 bp, Artificial Sequence
  Synthetic
ggcgcaatacttggtcaaac

SEQ ID NO: 28734 - DNA, 17 bp, Artificial Sequence
  Synthetic
caccgttgccgaaaccg

SEQ ID NO: 28735 - DNA, 18 bp, Artificial Sequence
  Synthetic
gcgttgccgaaaacaccc

SEQ ID NO: 28736 - DNA, 18 bp, Artificial Sequence
  Synthetic
ggattgacggcgaaccag

SEQ ID NO: 28737 - DNA, 18 bp, Artificial Sequence
  Synthetic
caaacggctgagccttgc

SEQ ID NO: 28738 - DNA, 16 bp, Artificial Sequence
  Synthetic
tggagcgtcccgaacc

SEQ ID NO: 28739 - DNA, 20 bp, Artificial Sequence
  Synthetic
cacgcttttttgtgtttgcc

SEQ ID NO: 28740 - DNA, 17 bp, Artificial Sequence
  Synthetic
tacggacgcggcgaaac

SEQ ID NO: 28741 - DNA, 18 bp, Artificial Sequence
  Synthetic
tcacccaaatcggcttgg

SEQ ID NO: 28742 - DNA, 16 bp, Artificial Sequence
  Synthetic
ccgcgcccctgaactt

SEQ ID NO: 28743 - DNA, 18 bp, Artificial Sequence
  Synthetic
ggcgacttcgggggattt

SEQ ID NO: 28744 - DNA, 16 bp, Artificial Sequence
  Synthetic
tctgccgcaaagccgc

SEQ ID NO: 28745 - DNA, 18 bp, Artificial Sequence
  Synthetic
aaaccatacgcccaagac

SEQ ID NO: 28746 - DNA, 15 bp, Artificial Sequence
  Synthetic
aacgccagcgcatcg

SEQ ID NO: 28747 - DNA, 20 bp, Artificial Sequence
  Synthetic
gaaggaattgtcgggcgaat

SEQ ID NO: 28748 - DNA, 18 bp, Artificial Sequence
  Synthetic
tggctggtgaaacccctg

SEQ ID NO: 28749 - DNA, 23 bp, Artificial Sequence
  Synthetic
taattaatccgcttatccttgat

SEQ ID NO: 28750 - DNA, 17 bp, Artificial Sequence
  Synthetic
caggaacgcgccgtcaa

SEQ ID NO: 28751 - DNA, 18 bp, Artificial Sequence
  Synthetic
accaagaaagcagcgacg

SEQ ID NO: 28752 - DNA, 18 bp, Artificial Sequence
  Synthetic
ttgagcgccgagatttgg

SEQ ID NO: 28753 - DNA, 17 bp, Artificial Sequence
  Synthetic
tggcggagaacatcggc

SEQ ID NO: 28754 - DNA, 19 bp, Artificial Sequence
  Synthetic
aaaccggtttccttgtccc

SEQ ID NO: 28755 - DNA, 19 bp, Artificial Sequence
  Synthetic
agccttttgtccaaaccgc

SEQ ID NO: 28756 - DNA, 16 bp, Artificial Sequence
  Synthetic
ccttatacgccgccgc

SEQ ID NO: 28757 - DNA, 20 bp, Artificial Sequence
  Synthetic
cctgtcgttgtgataggcaa

SEQ ID NO: 28758 - DNA, 19 bp, Artificial Sequence
  Synthetic
gccaagcccaaatccgtct

SEQ ID NO: 28759 - DNA, 19 bp, Artificial Sequence
  Synthetic
gcagggaaacgtctctgcc

SEQ ID NO: 28760 - DNA, 19 bp, Artificial Sequence
  Synthetic
atacaggcttgcagaactt

SEQ ID NO: 28761 - DNA, 19 bp, Artificial Sequence
  Synthetic
tccgggattcgaccgtgtt

SEQ ID NO: 28762 - DNA, 19 bp, Artificial Sequence
  Synthetic
caggcattacgcgcaacaa

SEQ ID NO: 28763 - DNA, 16 bp, Artificial Sequence
  Synthetic
cttgccggcaaccagc

SEQ ID NO: 28764 - DNA, 19 bp, Artificial Sequence
  Synthetic
acgcctgtcttgactttcg

SEQ ID NO: 28765 - DNA, 16 bp, Artificial Sequence
  Synthetic
tcagaaccggccgcac

SEQ ID NO: 28766 - DNA, 16 bp, Artificial Sequence
  Synthetic
aagcgataccggggcg

SEQ ID NO: 28767 - DNA, 18 bp, Artificial Sequence
  Synthetic
acacgatgcggtctttgc

SEQ ID NO: 28768 - DNA, 18 bp, Artificial Sequence
  Synthetic
atatcgcggcggtttcag

SEQ ID NO: 28769 - DNA, 18 bp, Artificial Sequence
  Synthetic
caatcaccgcgccgaaac

SEQ ID NO: 28770 - DNA, 16 bp, Artificial Sequence
  Synthetic
ttcaccgcaccgacgg

SEQ ID NO: 28771 - DNA, 18 bp, Artificial Sequence
  Synthetic
cgcccgtttaccgtgaat

SEQ ID NO: 28772 - DNA, 16 bp, Artificial Sequence
  Synthetic
gggtagggcaggcgaa

SEQ ID NO: 28773 - DNA, 16 bp, Artificial Sequence
  Synthetic
cgcccttcagttcggc

SEQ ID NO: 28774 - DNA, 18 bp, Artificial Sequence
  Synthetic
ccgccactttgccgtttg

SEQ ID NO: 28775 - DNA, 16 bp, Artificial Sequence
  Synthetic
ccgccttgccgttgac

SEQ ID NO: 28776 - DNA, 18 bp, Artificial Sequence
  Synthetic
gcttacaaccgcgcaacc

SEQ ID NO: 28777 - DNA, 18 bp, Artificial Sequence
  Synthetic
tgtccgaccttttggcgg

SEQ ID NO: 28778 - DNA, 20 bp, Artificial Sequence
  Synthetic
tgccgacaacgaagaaaacg

SEQ ID NO: 28779 - DNA, 16 bp, Artificial Sequence
  Synthetic
cggcggacgatttgcg

SEQ ID NO: 28780 - DNA, 16 bp, Artificial Sequence
  Synthetic
acaacgacggccagcc

SEQ ID NO: 28781 - DNA, 16 bp, Artificial Sequence
  Synthetic
tcgggtctttggccgc

SEQ ID NO: 28782 - DNA, 18 bp, Artificial Sequence
  Synthetic
cgcgtttgccctcgttct

SEQ ID NO: 28783 - DNA, 16 bp, Artificial Sequence
  Synthetic
atgtcccagccgcctg

SEQ ID NO: 28784 - DNA, 16 bp, Artificial Sequence
  Synthetic
tccccctgcccggttt

SEQ ID NO: 28785 - DNA, 16 bp, Artificial Sequence
  Synthetic
gcctggcgggttttgc

SEQ ID NO: 28786 - DNA, 16 bp, Artificial Sequence
  Synthetic
tgctcagcacggggac

SEQ ID NO: 28787 - DNA, 21 bp, Artificial Sequence
  Synthetic
attttcaaatggtagggaagg

SEQ ID NO: 28788 - DNA, 23 bp, Artificial Sequence
  Synthetic
accttgatttctttggaaatctc

SEQ ID NO: 28789 - DNA, 18 bp, Artificial Sequence
  Synthetic
cgcccaaatgctcaacca

SEQ ID NO: 28790 - DNA, 20 bp, Artificial Sequence
  Synthetic
tttacctccgaatgcgtctc

SEQ ID NO: 28791 - DNA, 19 bp, Artificial Sequence
  Synthetic
cgggcggcttgattttcct

SEQ ID NO: 28792 - DNA, 19 bp, Artificial Sequence
  Synthetic
gccgaatttctgcccttcg

SEQ ID NO: 28793 - DNA, 16 bp, Artificial Sequence
  Synthetic
tgctcgggcggtatcc

SEQ ID NO: 28794 - DNA, 16 bp, Artificial Sequence
  Synthetic
aactgttccccgccgc

SEQ ID NO: 28795 - DNA, 18 bp, Artificial Sequence
  Synthetic
tccgacgtgtatcagggc

SEQ ID NO: 28796 - DNA, 18 bp, Artificial Sequence
  Synthetic
gagaccgacaaaaatgcc

SEQ ID NO: 28797 - DNA, 20 bp, Artificial Sequence
  Synthetic
gatcggtgaagtctgccttg

SEQ ID NO: 28798 - DNA, 16 bp, Artificial Sequence
  Synthetic
cgacttggcttgggcg

SEQ ID NO: 28799 - DNA, 20 bp, Artificial Sequence
  Synthetic
cgcagcagttctttaccgta

SEQ ID NO: 28800 - DNA, 16 bp, Artificial Sequence
  Synthetic
atgcagcacgacagcg

SEQ ID NO: 28801 - DNA, 18 bp, Artificial Sequence
  Synthetic
cgtaaatggcggacacgg

SEQ ID NO: 28802 - DNA, 16 bp, Artificial Sequence
  Synthetic
ttcggcggggtacacg

SEQ ID NO: 28803 - DNA, 19 bp, Artificial Sequence
  Synthetic
ttgtcggcgtacaggatgg

SEQ ID NO: 28804 - DNA, 16 bp, Artificial Sequence
  Synthetic
accgtggcgatggtcg

SEQ ID NO: 28805 - DNA, 16 bp, Artificial Sequence
  Synthetic
gattgcctgcccgtgc

SEQ ID NO: 28806 - DNA, 18 bp, Artificial Sequence
  Synthetic
tatcgaaagcggcagcgg

SEQ ID NO: 28807 - DNA, 18 bp, Artificial Sequence
  Synthetic
ttcagaggaccgttcggc

SEQ ID NO: 28808 - DNA, 16 bp, Artificial Sequence
  Synthetic
tgtcgagctgggtcgg

SEQ ID NO: 28809 - DNA, 18 bp, Artificial Sequence
  Synthetic
tggacggtatggacgggc

SEQ ID NO: 28810 - DNA, 17 bp, Artificial Sequence
  Synthetic
actccgtcggcgaatgg

SEQ ID NO: 28811 - DNA, 19 bp, Artificial Sequence
  Synthetic
gatttccccaacagccacg

SEQ ID NO: 28812 - DNA, 18 bp, Artificial Sequence
  Synthetic
catgccaacgctatctgg

SEQ ID NO: 28813 - DNA, 18 bp, Artificial Sequence
  Synthetic
caagaaatgaacccgggt

SEQ ID NO: 28814 - DNA, 19 bp, Artificial Sequence
  Synthetic
gcaagaaaccgtccgtacg

SEQ ID NO: 28815 - DNA, 18 bp, Artificial Sequence
  Synthetic
aactacctcaacgccgca

SEQ ID NO: 28816 - DNA, 18 bp, Artificial Sequence
  Synthetic
acaccgttcggatgttcg

SEQ ID NO: 28817 - DNA, 16 bp, Artificial Sequence
  Synthetic
acgcctcgacgccatc

SEQ ID NO: 28818 - DNA, 16 bp, Artificial Sequence
  Synthetic
accgaagtcgccctgc

SEQ ID NO: 28819 - DNA, 20 bp, Artificial Sequence
  Synthetic
gctttatgtgcctgtttcgc

SEQ ID NO: 28820 - DNA, 19 bp, Artificial Sequence
  Synthetic
caggatttggtgtcggagc

SEQ ID NO: 28821 - DNA, 16 bp, Artificial Sequence
  Synthetic
tcaacctgcgccaacg

SEQ ID NO: 28822 - DNA, 16 bp, Artificial Sequence
  Synthetic
cagcaaccgcctgacc

SEQ ID NO: 28823 - DNA, 16 bp, Artificial Sequence
  Synthetic
gccgatgcgcgtttgc

SEQ ID NO: 28824 - DNA, 17 bp, Artificial Sequence
  Synthetic
cgaacacgagccgcttg

SEQ ID NO: 28825 - DNA, 18 bp, Artificial Sequence
  Synthetic
ccgtatccagcggatccg

SEQ ID NO: 28826 - DNA, 16 bp, Artificial Sequence
  Synthetic
ggcataccggcgtgct

SEQ ID NO: 28827 - DNA, 20 bp, Artificial Sequence
  Synthetic
gccagaatgaacaatctgat

SEQ ID NO: 28828 - DNA, 16 bp, Artificial Sequence
  Synthetic
tttcgggtggcgcagg

SEQ ID NO: 28829 - DNA, 16 bp, Artificial Sequence
  Synthetic
gatggcgtgtgcggtc

SEQ ID NO: 28830 - DNA, 16 bp, Artificial Sequence
  Synthetic
tttgcacggaggctgc

SEQ ID NO: 28831 - DNA, 16 bp, Artificial Sequence
  Synthetic
tcccgtttcggcgtgc

SEQ ID NO: 28832 - DNA, 16 bp, Artificial Sequence
  Synthetic
gaaactcgctgcccgc

SEQ ID NO: 28833 - DNA, 20 bp, Artificial Sequence
  Synthetic
cgtgaaatcggtttcgtgtc

SEQ ID NO: 28834 - DNA, 17 bp, Artificial Sequence
  Synthetic
accaggccagcaggatg

SEQ ID NO: 28835 - DNA, 20 bp, Artificial Sequence
  Synthetic
aggtcgagtgctttgacaaa

SEQ ID NO: 28836 - DNA, 18 bp, Artificial Sequence
  Synthetic
ttccaaatcggcatcggg

SEQ ID NO: 28837 - DNA, 20 bp, Artificial Sequence
  Synthetic
ggggccgaatacttcttctc

SEQ ID NO: 28838 - DNA, 18 bp, Artificial Sequence
  Synthetic
ttgccaacctcaaaccgc

SEQ ID NO: 28839 - DNA, 18 bp, Artificial Sequence
  Synthetic
cacgctgacggacaaagc

SEQ ID NO: 28840 - DNA, 18 bp, Artificial Sequence
  Synthetic
caacgccgaaatcgtcgc

SEQ ID NO: 28841 - DNA, 22 bp, Artificial Sequence
  Synthetic
cagacccttgttttttattccc

SEQ ID NO: 28842 - DNA, 18 bp, Artificial Sequence
  Synthetic
atcggctctccatcgacc

SEQ ID NO: 28843 - DNA, 18 bp, Artificial Sequence
  Synthetic
tcttcacgcgaacatgcc

SEQ ID NO: 28844 - DNA, 20 bp, Artificial Sequence
  Synthetic
tcgaaccgcaagttacttgg

SEQ ID NO: 28845 - DNA, 18 bp, Artificial Sequence
  Synthetic
tatggggcccgaacaagg

SEQ ID NO: 28846 - DNA, 17 bp, Artificial Sequence
  Synthetic
atgccgacagtttgccg

SEQ ID NO: 28847 - DNA, 17 bp, Artificial Sequence
  Synthetic
tgtgcggatgcggttga

SEQ ID NO: 28848 - DNA, 19 bp, Artificial Sequence
  Synthetic
ctgttcgatcagccagacg

SEQ ID NO: 28849 - DNA, 17 bp, Artificial Sequence
  Synthetic
acagcagcatcgcgatg

SEQ ID NO: 28850 - DNA, 18 bp, Artificial Sequence
  Synthetic
aacacggcggaaacaggc

SEQ ID NO: 28851 - DNA, 18 bp, Artificial Sequence
  Synthetic
cacggatttgtgcagggc

SEQ ID NO: 28852 - DNA, 20 bp, Artificial Sequence
  Synthetic
ttccttcatcagcttggtcg

SEQ ID NO: 28853 - DNA, 20 bp, Artificial Sequence
  Synthetic
acgaacccttcagcgtgatg

SEQ ID NO: 28854 - DNA, 16 bp, Artificial Sequence
  Synthetic
cggcgtactcgtccgt

SEQ ID NO: 28855 - DNA, 18 bp, Artificial Sequence
  Synthetic
ttgctgaccatcgtgaat

SEQ ID NO: 28856 - DNA, 19 bp, Artificial Sequence
  Synthetic
tgttcgttgctttgggatt

SEQ ID NO: 28857 - DNA, 20 bp, Artificial Sequence
  Synthetic
tgtaatcgccgaaacggtct

SEQ ID NO: 28858 - DNA, 20 bp, Artificial Sequence
  Synthetic
tgttggactactatccgcgt

SEQ ID NO: 28859 - DNA, 19 bp, Artificial Sequence
  Synthetic
atacagttgggcggtcaac

SEQ ID NO: 28860 - DNA, 17 bp, Artificial Sequence
  Synthetic
cgcaacagcggcattcc

SEQ ID NO: 28861 - DNA, 18 bp, Artificial Sequence
  Synthetic
gcttcgactccgttaccg

SEQ ID NO: 28862 - DNA, 17 bp, Artificial Sequence
  Synthetic
actgaccccgcctttgg

SEQ ID NO: 28863 - DNA, 20 bp, Artificial Sequence
  Synthetic
gtggttaaagtgtcagccgt

SEQ ID NO: 28864 - DNA, 16 bp, Artificial Sequence
  Synthetic
tttctgccccgccctc

SEQ ID NO: 28865 - DNA, 20 bp, Artificial Sequence
  Synthetic
ttggaggcgatgatgaacag

SEQ ID NO: 28866 - DNA, 18 bp, Artificial Sequence
  Synthetic
cttcgtcgggggttttgc

SEQ ID NO: 28867 - DNA, 18 bp, Artificial Sequence
  Synthetic
gcaatccgaccgaaaccg

SEQ ID NO: 28868 - DNA, 18 bp, Artificial Sequence
  Synthetic
ctgtgcatcaaagccgcc

SEQ ID NO: 28869 - DNA, 16 bp, Artificial Sequence
  Synthetic
tccgagcacacccacc

SEQ ID NO: 28870 - DNA, 16 bp, Artificial Sequence
  Synthetic
ctcatcaggcgcgcct

SEQ ID NO: 28871 - DNA, 16 bp, Artificial Sequence
  Synthetic
aagatctgccccccgg

SEQ ID NO: 28872 - DNA, 19 bp, Artificial Sequence
  Synthetic
agtcggtcaggaacacgtc

SEQ ID NO: 28873 - DNA, 18 bp, Artificial Sequence
  Synthetic
aacgtccacccgaccaaa

SEQ ID NO: 28874 - DNA, 18 bp, Artificial Sequence
  Synthetic
ccgactttcgccaaaggc

SEQ ID NO: 28875 - DNA, 20 bp, Artificial Sequence
  Synthetic
agatacggcatatcgcaagg

SEQ ID NO: 28876 - DNA, 20 bp, Artificial Sequence
  Synthetic
acaactgttgcagctcgata

SEQ ID NO: 28877 - DNA, 17 bp, Artificial Sequence
  Synthetic
cgaagccgccaatcagg

SEQ ID NO: 28878 - DNA, 17 bp, Artificial Sequence
  Synthetic
tcccgtccgcatccttc

SEQ ID NO: 28879 - DNA, 18 bp, Artificial Sequence
  Synthetic
tttcgacccgagcattcg

SEQ ID NO: 28880 - DNA, 19 bp, Artificial Sequence
  Synthetic
acttggtcagtttgccttt

SEQ ID NO: 28881 - DNA, 19 bp, Artificial Sequence
  Synthetic
ggatcatgcctttacccgg

SEQ ID NO: 28882 - DNA, 18 bp, Artificial Sequence
  Synthetic
gacggaagagcaggttgc

SEQ ID NO: 28883 - DNA, 24 bp, Artificial Sequence
  Synthetic
ttgtagtatcagaggataaagtgt

SEQ ID NO: 28884 - DNA, 19 bp, Artificial Sequence
  Synthetic
atgcggatatgacctcagt

SEQ ID NO: 28885 - DNA, 20 bp, Artificial Sequence
  Synthetic
cgaatttcctgatgcaaagt

SEQ ID NO: 28886 - DNA, 23 bp, Artificial Sequence
  Synthetic
ggtatttttgtgcgatagacatc

SEQ ID NO: 28887 - DNA, 21 bp, Artificial Sequence
  Synthetic
aagcagatgaagtagtgattg

SEQ ID NO: 28888 - DNA, 18 bp, Artificial Sequence
  Synthetic
gcaatctcggtgctgaat

SEQ ID NO: 28889 - DNA, 18 bp, Artificial Sequence
  Synthetic
cttgacccagagcagttg

SEQ ID NO: 28890 - DNA, 22 bp, Artificial Sequence
  Synthetic
catcaaaaagaggtatcggaaa

SEQ ID NO: 28891 - DNA, 16 bp, Artificial Sequence
  Synthetic
caggttggccgccaag

SEQ ID NO: 28892 - DNA, 15 bp, Artificial Sequence
  Synthetic
attggcgcgcgtctg

SEQ ID NO: 28893 - DNA, 18 bp, Artificial Sequence
  Synthetic
tcgaacccggaccgatac

SEQ ID NO: 28894 - DNA, 16 bp, Artificial Sequence
  Synthetic
accgccgagcatgacg

SEQ ID NO: 28895 - DNA, 18 bp, Artificial Sequence
  Synthetic
ttcgatgccttcggggac

SEQ ID NO: 28896 - DNA, 17 bp, Artificial Sequence
  Synthetic
acacttcggcggtcagc

SEQ ID NO: 28897 - DNA, 15 bp, Artificial Sequence
  Synthetic
tcaggcgcgcgcaat

SEQ ID NO: 28898 - DNA, 18 bp, Artificial Sequence
  Synthetic
ccgccgattcgatcatgg

SEQ ID NO: 28899 - DNA, 19 bp, Artificial Sequence
  Synthetic
acaattctttgcggcctgc

SEQ ID NO: 28900 - DNA, 16 bp, Artificial Sequence
  Synthetic
taccttcgacggcggc

SEQ ID NO: 28901 - DNA, 16 bp, Artificial Sequence
  Synthetic
ttcgcccaccacccga

SEQ ID NO: 28902 - DNA, 16 bp, Artificial Sequence
  Synthetic
tactcggcgtggcagg

SEQ ID NO: 28903 - DNA, 20 bp, Artificial Sequence
  Synthetic
cgggtgtacagttcggtcag

SEQ ID NO: 28904 - DNA, 17 bp, Artificial Sequence
  Synthetic
gtcggcaccgtcttacg

SEQ ID NO: 28905 - DNA, 20 bp, Artificial Sequence
  Synthetic
ggacagatgacggaagagga

SEQ ID NO: 28906 - DNA, 20 bp, Artificial Sequence
  Synthetic
accatcacccaaatgctcaa

SEQ ID NO: 28907 - DNA, 18 bp, Artificial Sequence
  Synthetic
acgttacccccttgtcgc

SEQ ID NO: 28908 - DNA, 17 bp, Artificial Sequence
  Synthetic
acgccaggccaccaaag

SEQ ID NO: 28909 - DNA, 20 bp, Artificial Sequence
  Synthetic
ggtcgatttcgttcaacagc

SEQ ID NO: 28910 - DNA, 16 bp, Artificial Sequence
  Synthetic
acgtgttcgggcgtgc

SEQ ID NO: 28911 - DNA, 19 bp, Artificial Sequence
  Synthetic
ggaaatcggggtgcgaaca

SEQ ID NO: 28912 - DNA, 18 bp, Artificial Sequence
  Synthetic
acttgcgtccgaactgcc

SEQ ID NO: 28913 - DNA, 18 bp, Artificial Sequence
  Synthetic
tatcccgtgcagcccaat

SEQ ID NO: 28914 - DNA, 17 bp, Artificial Sequence
  Synthetic
tcgaagcgggttttgcc

SEQ ID NO: 28915 - DNA, 16 bp, Artificial Sequence
  Synthetic
tacggcttcggggtcg

SEQ ID NO: 28916 - DNA, 16 bp, Artificial Sequence
  Synthetic
ccgtcctgccgggtat

SEQ ID NO: 28917 - DNA, 18 bp, Artificial Sequence
  Synthetic
gaggttgagcagccaacg

SEQ ID NO: 28918 - DNA, 20 bp, Artificial Sequence
  Synthetic
gacattggaacttcctgcgg

SEQ ID NO: 28919 - DNA, 18 bp, Artificial Sequence
  Synthetic
gagggcggtttcgtcagt

SEQ ID NO: 28920 - DNA, 17 bp, Artificial Sequence
  Synthetic
gttcggcaggcaggttt

SEQ ID NO: 28921 - DNA, 18 bp, Artificial Sequence
  Synthetic
ccatacccaatacgccgg

SEQ ID NO: 28922 - DNA, 20 bp, Artificial Sequence
  Synthetic
cgtcttcgggattagccaat

SEQ ID NO: 28923 - DNA, 20 bp, Artificial Sequence
  Synthetic
tggtcattttgctggaagag

SEQ ID NO: 28924 - DNA, 19 bp, Artificial Sequence
  Synthetic
ggtttgtttgctgccgagg

SEQ ID NO: 28925 - DNA, 22 bp, Artificial Sequence
  Synthetic
tttcaaaagcagattggacaaa

SEQ ID NO: 28926 - DNA, 18 bp, Artificial Sequence
  Synthetic
aattgcgcgcttgcttca

SEQ ID NO: 28927 - DNA, 18 bp, Artificial Sequence
  Synthetic
atacttcggggttgcggg

SEQ ID NO: 28928 - DNA, 17 bp, Artificial Sequence
  Synthetic
gcaatcggcggattcgg

SEQ ID NO: 28929 - DNA, 20 bp, Artificial Sequence
  Synthetic
cctttatgcacgccaccttt

SEQ ID NO: 28930 - DNA, 19 bp, Artificial Sequence
  Synthetic
ggggaagtagaacacggct

SEQ ID NO: 28931 - DNA, 20 bp, Artificial Sequence
  Synthetic
gcggaattgctgaaacagga

SEQ ID NO: 28932 - DNA, 20 bp, Artificial Sequence
  Synthetic
ccgatatgaagcggcggata

SEQ ID NO: 28933 - DNA, 16 bp, Artificial Sequence
  Synthetic
tggcgagggtcatcgc

SEQ ID NO: 28934 - DNA, 16 bp, Artificial Sequence
  Synthetic
gcacgacctccggcaa

SEQ ID NO: 28935 - DNA, 17 bp, Artificial Sequence
  Synthetic
ccgaaatgggcgtcgtc

SEQ ID NO: 28936 - DNA, 18 bp, Artificial Sequence
  Synthetic
gacctggacatcctcgcc

SEQ ID NO: 28937 - DNA, 20 bp, Artificial Sequence
  Synthetic
cctgttcaaccccttcgtcc

SEQ ID NO: 28938 - DNA, 16 bp, Artificial Sequence
  Synthetic
tcggcttcggcgcaag

SEQ ID NO: 28939 - DNA, 19 bp, Artificial Sequence
  Synthetic
aatcggcaggggaaatgtg

SEQ ID NO: 28940 - DNA, 19 bp, Artificial Sequence
  Synthetic
ccatcgtgaccaaactgac

SEQ ID NO: 28941 - DNA, 16 bp, Artificial Sequence
  Synthetic
cgcgtgggctgtatgc

SEQ ID NO: 28942 - DNA, 16 bp, Artificial Sequence
  Synthetic
taccgaagccctgcgc

SEQ ID NO: 28943 - DNA, 19 bp, Artificial Sequence
  Synthetic
gttttcgggaatcagggcg

SEQ ID NO: 28944 - DNA, 17 bp, Artificial Sequence
  Synthetic
agatgcctgcgccgtag

SEQ ID NO: 28945 - DNA, 20 bp, Artificial Sequence
  Synthetic
gacaccagcatgtcgcaatg

SEQ ID NO: 28946 - DNA, 20 bp, Artificial Sequence
  Synthetic
ggctttgaaatggcggtaca

SEQ ID NO: 28947 - DNA, 17 bp, Artificial Sequence
  Synthetic
gccggtcgttgagttcg

SEQ ID NO: 28948 - DNA, 19 bp, Artificial Sequence
  Synthetic
ttcgcgttgttgtaggttt

SEQ ID NO: 28949 - DNA, 16 bp, Artificial Sequence
  Synthetic
aaagcccgcgccgaag

SEQ ID NO: 28950 - DNA, 18 bp, Artificial Sequence
  Synthetic
gaaagttacgaggccgcc

SEQ ID NO: 28951 - DNA, 16 bp, Artificial Sequence
  Synthetic
aaagcctcgaccgccc

SEQ ID NO: 28952 - DNA, 20 bp, Artificial Sequence
  Synthetic
cgatgtaaacctcgggcagc

SEQ ID NO: 28953 - DNA, 18 bp, Artificial Sequence
  Synthetic
atttctggtggcggcttg

SEQ ID NO: 28954 - DNA, 19 bp, Artificial Sequence
  Synthetic
ggcttggaggaattcgtgc

SEQ ID NO: 28955 - DNA, 19 bp, Artificial Sequence
  Synthetic
agcccgtcaaagagtttgg

SEQ ID NO: 28956 - DNA, 20 bp, Artificial Sequence
  Synthetic
cgttctaggttcgggtatgc

SEQ ID NO: 28957 - DNA, 19 bp, Artificial Sequence
  Synthetic
gcgaaatactgtcgccgat

SEQ ID NO: 28958 - DNA, 19 bp, Artificial Sequence
  Synthetic
ggtgagttttgccagttgc

SEQ ID NO: 28959 - DNA, 17 bp, Artificial Sequence
  Synthetic
aaggcagggcgatcagc

SEQ ID NO: 28960 - DNA, 20 bp, Artificial Sequence
  Synthetic
gtccacggcttgaatatcga

SEQ ID NO: 28961 - DNA, 24 bp, Artificial Sequence
  Synthetic
ggataaaaatatgacgacacaaga

SEQ ID NO: 28962 - DNA, 20 bp, Artificial Sequence
  Synthetic
gtggaaaaacggtggacaga

SEQ ID NO: 28963 - DNA, 20 bp, Artificial Sequence
  Synthetic
tgctgattatctgccgtaaa

SEQ ID NO: 28964 - DNA, 20 bp, Artificial Sequence
  Synthetic
atttgttttgccgtgatgtg

SEQ ID NO: 28965 - DNA, 20 bp, Artificial Sequence
  Synthetic
tttcggattctttcgccagt

SEQ ID NO: 28966 - DNA, 18 bp, Artificial Sequence
  Synthetic
atgattttcaggctgcct

SEQ ID NO: 28967 - DNA, 19 bp, Artificial Sequence
  Synthetic
aaaccattctgtgcgctcg

SEQ ID NO: 28968 - DNA, 18 bp, Artificial Sequence
  Synthetic
tgattatttacgcggcgg

SEQ ID NO: 28969 - DNA, 18 bp, Artificial Sequence
  Synthetic
ctgcccattgtgcatagg

SEQ ID NO: 28970 - DNA, 18 bp, Artificial Sequence
  Synthetic
gataccgcaatggctttg

SEQ ID NO: 28971 - DNA, 18 bp, Artificial Sequence
  Synthetic
aacagccgaagccgtaag

SEQ ID NO: 28972 - DNA, 18 bp, Artificial Sequence
  Synthetic
gttggctatgactgcccg

SEQ ID NO: 28973 - DNA, 22 bp, Artificial Sequence
  Synthetic
gattagacccaacatgagtttg

SEQ ID NO: 28974 - DNA, 22 bp, Artificial Sequence
  Synthetic
atatattatgctgacgcccaaa

SEQ ID NO: 28975 - DNA, 15 bp, Artificial Sequence
  Synthetic
aatgcctgcgtcgcg

SEQ ID NO: 28976 - DNA, 17 bp, Artificial Sequence
  Synthetic
gccctgcaacactacgc

SEQ ID NO: 28977 - DNA, 18 bp, Artificial Sequence
  Synthetic
ggataaaaccgcctacgc

SEQ ID NO: 28978 - DNA, 18 bp, Artificial Sequence
  Synthetic
gatatgtcgggcggcatc

SEQ ID NO: 28979 - DNA, 15 bp, Artificial Sequence
  Synthetic
tgcgcgtcggcttga

SEQ ID NO: 28980 - DNA, 18 bp, Artificial Sequence
  Synthetic
ctcttccagcctgccctc

SEQ ID NO: 28981 - DNA, 18 bp, Artificial Sequence
  Synthetic
catcacgcccaacctgac

SEQ ID NO: 28982 - DNA, 19 bp, Artificial Sequence
  Synthetic
tgcatcaaaagtcctgcgg

SEQ ID NO: 28983 - DNA, 18 bp, Artificial Sequence
  Synthetic
acgttttttgctggcatc

SEQ ID NO: 28984 - DNA, 19 bp, Artificial Sequence
  Synthetic
gcgccggtttacaatcctt

SEQ ID NO: 28985 - DNA, 20 bp, Artificial Sequence
  Synthetic
aacagtatgcccaactgcaa

SEQ ID NO: 28986 - DNA, 18 bp, Artificial Sequence
  Synthetic
aatcgcccaagtgagctg

SEQ ID NO: 28987 - DNA, 19 bp, Artificial Sequence
  Synthetic
aaagtcgccgaacggaaag

SEQ ID NO: 28988 - DNA, 18 bp, Artificial Sequence
  Synthetic
tccagctcgaccatcagg

SEQ ID NO: 28989 - DNA, 20 bp, Artificial Sequence
  Synthetic
gatagtttgggtactgccgc

SEQ ID NO: 28990 - DNA, 18 bp, Artificial Sequence
  Synthetic
gcgtgatgtcgaaaccga

SEQ ID NO: 28991 - DNA, 19 bp, Artificial Sequence
  Synthetic
tgtaaacggcaggtgcatc

SEQ ID NO: 28992 - DNA, 19 bp, Artificial Sequence
  Synthetic
caaccgaaccgtcattccc

SEQ ID NO: 28993 - DNA, 16 bp, Artificial Sequence
  Synthetic
acgcggatgtcgaggc

SEQ ID NO: 28994 - DNA, 18 bp, Artificial Sequence
  Synthetic
cggcatccaaagtgtcgg

SEQ ID NO: 28995 - DNA, 20 bp, Artificial Sequence
  Synthetic
taaagagttgccgtcgatgg

SEQ ID NO: 28996 - DNA, 18 bp, Artificial Sequence
  Synthetic
gctgcggcaaagttgttg

SEQ ID NO: 28997 - DNA, 18 bp, Artificial Sequence
  Synthetic
tgtggaaacgctcgtcgg

SEQ ID NO: 28998 - DNA, 17 bp, Artificial Sequence
  Synthetic
gacaacacggcggaagg

SEQ ID NO: 28999 - DNA, 19 bp, Artificial Sequence
  Synthetic
ggcagtgacgacgatgacc

SEQ ID NO: 29000 - DNA, 20 bp, Artificial Sequence
  Synthetic
ggagaagtttaaccgccagg

SEQ ID NO: 29001 - DNA, 20 bp, Artificial Sequence
  Synthetic
cggctttttgtggatgatgg

SEQ ID NO: 29002 - DNA, 16 bp, Artificial Sequence
  Synthetic
gcgaggcggagaagct

SEQ ID NO: 29003 - DNA, 15 bp, Artificial Sequence
  Synthetic
aacggttggcgcgtg

SEQ ID NO: 29004 - DNA, 16 bp, Artificial Sequence
  Synthetic
cggcggcgttttggac

SEQ ID NO: 29005 - DNA, 16 bp, Artificial Sequence
  Synthetic
aggcggactggcggaa

SEQ ID NO: 29006 - DNA, 18 bp, Artificial Sequence
  Synthetic
ggaaacgtgcgcctgttg

SEQ ID NO: 29007 - DNA, 17 bp, Artificial Sequence
  Synthetic
ggattatgcgccgggag

SEQ ID NO: 29008 - DNA, 19 bp, Artificial Sequence
  Synthetic
ggaatcggccggtgagttt

SEQ ID NO: 29009 - DNA, 20 bp, Artificial Sequence
  Synthetic
cggcaaggcttatttgtcca

SEQ ID NO: 29010 - DNA, 16 bp, Artificial Sequence
  Synthetic
ttcggggcgcaacacc

SEQ ID NO: 29011 - DNA, 20 bp, Artificial Sequence
  Synthetic
ttgggatttcatcggacagg

SEQ ID NO: 29012 - DNA, 16 bp, Artificial Sequence
  Synthetic
cggaaaaacgcgcggc

SEQ ID NO: 29013 - DNA, 18 bp, Artificial Sequence
  Synthetic
acgaaatggcggcatacg

SEQ ID NO: 29014 - DNA, 19 bp, Artificial Sequence
  Synthetic
ccgaaagctccttgtccgc

SEQ ID NO: 29015 - DNA, 20 bp, Artificial Sequence
  Synthetic
ggtccagttgaagcagctga

SEQ ID NO: 29016 - DNA, 20 bp, Artificial Sequence
  Synthetic
cctgacgcagatagacgatg

SEQ ID NO: 29017 - DNA, 18 bp, Artificial Sequence
  Synthetic
caagtaatcccgcgtccc

SEQ ID NO: 29018 - DNA, 18 bp, Artificial Sequence
  Synthetic
tcctccgcgatatagggt

SEQ ID NO: 29019 - DNA, 18 bp, Artificial Sequence
  Synthetic
gccgacttggaagccttg

SEQ ID NO: 29020 - DNA, 18 bp, Artificial Sequence
  Synthetic
tgccgaacggacaaaacc

SEQ ID NO: 29021 - DNA, 19 bp, Artificial Sequence
  Synthetic
ttgaggaagacggttgcga

SEQ ID NO: 29022 - DNA, 16 bp, Artificial Sequence
  Synthetic
tgtggatgacggcggg

SEQ ID NO: 29023 - DNA, 16 bp, Artificial Sequence
  Synthetic
accgcccaagccttgc

SEQ ID NO: 29024 - DNA, 16 bp, Artificial Sequence
  Synthetic
tccgacaagcagcccg

SEQ ID NO: 29025 - DNA, 16 bp, Artificial Sequence
  Synthetic
ttggggcgcaattcgg

SEQ ID NO: 29026 - DNA, 17 bp, Artificial Sequence
  Synthetic
tccgccgaaacagcttg

SEQ ID NO: 29027 - DNA, 19 bp, Artificial Sequence
  Synthetic
gcggttgttggtggtttgc

SEQ ID NO: 29028 - DNA, 18 bp, Artificial Sequence
  Synthetic
aaagagcagacggagaag

SEQ ID NO: 29029 - DNA, 19 bp, Artificial Sequence
  Synthetic
cgtgagacagtttggtccc

SEQ ID NO: 29030 - DNA, 17 bp, Artificial Sequence
  Synthetic
ccgcacggttaccaacc

SEQ ID NO: 29031 - DNA, 20 bp, Artificial Sequence
  Synthetic
gcgattgacgtgattgtcga

SEQ ID NO: 29032 - DNA, 20 bp, Artificial Sequence
  Synthetic
gttgaggttggacacggtaa

SEQ ID NO: 29033 - DNA, 20 bp, Artificial Sequence
  Synthetic
gcatcgttgaccaattcagg

SEQ ID NO: 29034 - DNA, 20 bp, Artificial Sequence
  Synthetic
cgataggtgttgaagcccat

SEQ ID NO: 29035 - DNA, 20 bp, Artificial Sequence
  Synthetic
aggtcggacatatgcacgtc

SEQ ID NO: 29036 - DNA, 19 bp, Artificial Sequence
  Synthetic
cccaatgtcagcgtgttcg

SEQ ID NO: 29037 - DNA, 16 bp, Artificial Sequence
  Synthetic
atgccgccgatggagc

SEQ ID NO: 29038 - DNA, 16 bp, Artificial Sequence
  Synthetic
tgcgttcgagcgaggc

SEQ ID NO: 29039 - DNA, 17 bp, Artificial Sequence
  Synthetic
tttggcgatgtggacgg

SEQ ID NO: 29040 - DNA, 20 bp, Artificial Sequence
  Synthetic
gcccaatagctgaatacggt

SEQ ID NO: 29041 - DNA, 16 bp, Artificial Sequence
  Synthetic
cttgtccgccgtcgtc

SEQ ID NO: 29042 - DNA, 18 bp, Artificial Sequence
  Synthetic
ctgcaggtagcggctgag

SEQ ID NO: 29043 - DNA, 17 bp, Artificial Sequence
  Synthetic
gcgcagggtcatggctt

SEQ ID NO: 29044 - DNA, 22 bp, Artificial Sequence
  Synthetic
aaggtttagatcagttttcgga

SEQ ID NO: 29045 - DNA, 19 bp, Artificial Sequence
  Synthetic
ccaaatattgcacgcccca

SEQ ID NO: 29046 - DNA, 18 bp, Artificial Sequence
  Synthetic
taaagctgcggcccattt

SEQ ID NO: 29047 - DNA, 16 bp, Artificial Sequence
  Synthetic
tgagggtggcgagcag

SEQ ID NO: 29048 - DNA, 19 bp, Artificial Sequence
  Synthetic
agacttcgcaggggacgta

SEQ ID NO: 29049 - DNA, 19 bp, Artificial Sequence
  Synthetic
gccgatgaggttttcgagg

SEQ ID NO: 29050 - DNA, 18 bp, Artificial Sequence
  Synthetic
tgacgaatggcaaaccgc

SEQ ID NO: 29051 - DNA, 18 bp, Artificial Sequence
  Synthetic
cgaatgccccgaaatgct

SEQ ID NO: 29052 - DNA, 19 bp, Artificial Sequence
  Synthetic
tcgtcccctatgctttggc

SEQ ID NO: 29053 - DNA, 18 bp, Artificial Sequence
  Synthetic
atcgtcaaaccgctcgac

SEQ ID NO: 29054 - DNA, 20 bp, Artificial Sequence
  Synthetic
atgcgctcttctctgctttg

SEQ ID NO: 29055 - DNA, 19 bp, Artificial Sequence
  Synthetic
agcgggtcaatacggtcag

SEQ ID NO: 29056 - DNA, 19 bp, Artificial Sequence
  Synthetic
tttgactttggcggcatcg

SEQ ID NO: 29057 - DNA, 17 bp, Artificial Sequence
  Synthetic
tcgggcatatcgagcgg

SEQ ID NO: 29058 - DNA, 16 bp, Artificial Sequence
  Synthetic
ttccatacgcgcgccg

SEQ ID NO: 29059 - DNA, 19 bp, Artificial Sequence
  Synthetic
gccgatgtcttccttacgc

SEQ ID NO: 29060 - DNA, 18 bp, Artificial Sequence
  Synthetic
ttcgtcgtgttcggcctg

SEQ ID NO: 29061 - DNA, 18 bp, Artificial Sequence
  Synthetic
ccattcccgcatcagggc

SEQ ID NO: 29062 - DNA, 20 bp, Artificial Sequence
  Synthetic
ggttgttcgggtaggcgata

SEQ ID NO: 29063 - DNA, 16 bp, Artificial Sequence
  Synthetic
agggcttcgtcgagcg

SEQ ID NO: 29064 - DNA, 20 bp, Artificial Sequence
  Synthetic
tgccgtaaacttttgctcct

SEQ ID NO: 29065 - DNA, 20 bp, Artificial Sequence
  Synthetic
acgttttgggttatgaggat

SEQ ID NO: 29066 - DNA, 17 bp, Artificial Sequence
  Synthetic
aggacagggtgtgccag

SEQ ID NO: 29067 - DNA, 17 bp, Artificial Sequence
  Synthetic
ttacggtttcgcgcagg

SEQ ID NO: 29068 - DNA, 15 bp, Artificial Sequence
  Synthetic
cgctgcacgggcttt

SEQ ID NO: 29069 - DNA, 19 bp, Artificial Sequence
  Synthetic
ccgatcatcgtgatgtcgg

SEQ ID NO: 29070 - DNA, 20 bp, Artificial Sequence
  Synthetic
ggttgagcacgatttggttc

SEQ ID NO: 29071 - DNA, 20 bp, Artificial Sequence
  Synthetic
gtagggcaggtaaacgtcga

SEQ ID NO: 29072 - DNA, 18 bp, Artificial Sequence
  Synthetic
taaagatggtcgggttgc

SEQ ID NO: 29073 - DNA, 19 bp, Artificial Sequence
  Synthetic
atcatccttgcaacaggtc

SEQ ID NO: 29074 - DNA, 18 bp, Artificial Sequence
  Synthetic
atcccgttcaagttgccg

SEQ ID NO: 29075 - DNA, 25 bp, Artificial Sequence
  Synthetic
taaaaaactgagcttcgagaattac

SEQ ID NO: 29076 - DNA, 18 bp, Artificial Sequence
  Synthetic
cctgacgaagcgacaacg

SEQ ID NO: 29077 - DNA, 20 bp, Artificial Sequence
  Synthetic
ttgggcttcgtattgttggt

SEQ ID NO: 29078 - DNA, 17 bp, Artificial Sequence
  Synthetic
atgttgggcggcgttcc

SEQ ID NO: 29079 - DNA, 18 bp, Artificial Sequence
  Synthetic
cggaatgggagcagatgc

SEQ ID NO: 29080 - DNA, 16 bp, Artificial Sequence
  Synthetic
ttcggcgggtgagagc

SEQ ID NO: 29081 - DNA, 20 bp, Artificial Sequence
  Synthetic
gctttcagttttgccgcttc

SEQ ID NO: 29082 - DNA, 16 bp, Artificial Sequence
  Synthetic
ggtgcggcaggtttcg

SEQ ID NO: 29083 - DNA, 16 bp, Artificial Sequence
  Synthetic
accctgaccctgctcg

SEQ ID NO: 29084 - DNA, 18 bp, Artificial Sequence
  Synthetic
gcaaaacctcgctcctgc

SEQ ID NO: 29085 - DNA, 20 bp, Artificial Sequence
  Synthetic
cgccgaaaatcgtcttgaac

SEQ ID NO: 29086 - DNA, 17 bp, Artificial Sequence
  Synthetic
acgtggtttcggggcaa

SEQ ID NO: 29087 - DNA, 19 bp, Artificial Sequence
  Synthetic
gggtttcagcctgtcatcg

SEQ ID NO: 29088 - DNA, 18 bp, Artificial Sequence
  Synthetic
accgattacgcccatccc

SEQ ID NO: 29089 - DNA, 16 bp, Artificial Sequence
  Synthetic
ttcgccgcccgatacg

SEQ ID NO: 29090 - DNA, 19 bp, Artificial Sequence
  Synthetic
ttttgacggcagggagcaa

SEQ ID NO: 29091 - DNA, 19 bp, Artificial Sequence
  Synthetic
aagtggtacgtgagctggg

SEQ ID NO: 29092 - DNA, 20 bp, Artificial Sequence
  Synthetic
tcagaagttgaagcaggtaa

SEQ ID NO: 29093 - DNA, 20 bp, Artificial Sequence
  Synthetic
cggatattgtggaacgggaa

SEQ ID NO: 29094 - DNA, 20 bp, Artificial Sequence
  Synthetic
atgcgttcgacaccaatgtt

SEQ ID NO: 29095 - DNA, 19 bp, Artificial Sequence
  Synthetic
cgcctctcccttgtccaac

SEQ ID NO: 29096 - DNA, 18 bp, Artificial Sequence
  Synthetic
tacaaaacaaccgccgcc

SEQ ID NO: 29097 - DNA, 19 bp, Artificial Sequence
  Synthetic
aagcgatgtacgaacccga

SEQ ID NO: 29098 - DNA, 19 bp, Artificial Sequence
  Synthetic
tccatttgtcggtactgcc

SEQ ID NO: 29099 - DNA, 18 bp, Artificial Sequence
  Synthetic
tcgggcaaatcgagttcg

SEQ ID NO: 29100 - DNA, 20 bp, Artificial Sequence
  Synthetic
ccacaaagaaacgctcggat

SEQ ID NO: 29101 - DNA, 19 bp, Artificial Sequence
  Synthetic
aatcggcaggatggatgca

SEQ ID NO: 29102 - DNA, 16 bp, Artificial Sequence
  Synthetic
tgcacttcgcggcgaa

SEQ ID NO: 29103 - DNA, 16 bp, Artificial Sequence
  Synthetic
gcggttgacgaagggc

SEQ ID NO: 29104 - DNA, 20 bp, Artificial Sequence
  Synthetic
cgcttcaggaacagcttctg

SEQ ID NO: 29105 - DNA, 20 bp, Artificial Sequence
  Synthetic
ggtttggacgtttaccgcag

SEQ ID NO: 29106 - DNA, 20 bp, Artificial Sequence
  Synthetic
gaactcttcctcgtcgaagg

SEQ ID NO: 29107 - DNA, 16 bp, Artificial Sequence
  Synthetic
aaagccgtgctgctgc

SEQ ID NO: 29108 - DNA, 18 bp, Artificial Sequence
  Synthetic
agccggtcaaagaacgtc

SEQ ID NO: 29109 - DNA, 19 bp, Artificial Sequence
  Synthetic
cgtgaaaactgtggcgttg

SEQ ID NO: 29110 - DNA, 17 bp, Artificial Sequence
  Synthetic
tgaatcgggcggacacc

SEQ ID NO: 29111 - DNA, 17 bp, Artificial Sequence
  Synthetic
gtccgcacgcttatccc

SEQ ID NO: 29112 - DNA, 20 bp, Artificial Sequence
  Synthetic
agcaaaatcagcacggaaac

SEQ ID NO: 29113 - DNA, 17 bp, Artificial Sequence
  Synthetic
gcggctttggcttccgt

SEQ ID NO: 29114 - DNA, 20 bp, Artificial Sequence
  Synthetic
ccgcattttggacacatgga

SEQ ID NO: 29115 - DNA, 16 bp, Artificial Sequence
  Synthetic
gtttgccgggcagacg

SEQ ID NO: 29116 - DNA, 19 bp, Artificial Sequence
  Synthetic
ggtttggaatgggtgcgtt

SEQ ID NO: 29117 - DNA, 17 bp, Artificial Sequence
  Synthetic
ccgttcctgcccgctat

SEQ ID NO: 29118 - DNA, 17 bp, Artificial Sequence
  Synthetic
ccacgccgtaatacgcg

SEQ ID NO: 29119 - DNA, 18 bp, Artificial Sequence
  Synthetic
tgcagggcgtattgttgc

SEQ ID NO: 29120 - DNA, 16 bp, Artificial Sequence
  Synthetic
tcggtttcccagccgc

SEQ ID NO: 29121 - DNA, 18 bp, Artificial Sequence
  Synthetic
tccgcatccgcacatcaa

SEQ ID NO: 29122 - DNA, 20 bp, Artificial Sequence
  Synthetic
cgaagtattgctcgaccgtc

SEQ ID NO: 29123 - DNA, 16 bp, Artificial Sequence
  Synthetic
tcctgcccacgcttgc

SEQ ID NO: 29124 - DNA, 19 bp, Artificial Sequence
  Synthetic
tttccaccgggcaggctat

SEQ ID NO: 29125 - DNA, 20 bp, Artificial Sequence
  Synthetic
tcgccgcagttgaaaatcga

SEQ ID NO: 29126 - DNA, 18 bp, Artificial Sequence
  Synthetic
atatcggcttggcggttg

SEQ ID NO: 29127 - DNA, 19 bp, Artificial Sequence
  Synthetic
gaaccccatatcggcgaag

SEQ ID NO: 29128 - DNA, 20 bp, Artificial Sequence
  Synthetic
gttgggtttgaacgacggag

SEQ ID NO: 29129 - DNA, 20 bp, Artificial Sequence
  Synthetic
gaaaccgaattggcgcaatt

SEQ ID NO: 29130 - DNA, 17 bp, Artificial Sequence
  Synthetic
ttcggacgttttgccgc

SEQ ID NO: 29131 - DNA, 19 bp, Artificial Sequence
  Synthetic
cgatttgaacgtccgctgg

SEQ ID NO: 29132 - DNA, 19 bp, Artificial Sequence
  Synthetic
gcacaagctgtccgaacat

SEQ ID NO: 29133 - DNA, 19 bp, Artificial Sequence
  Synthetic
tggaacttgggtgtcgttg

SEQ ID NO: 29134 - DNA, 20 bp, Artificial Sequence
  Synthetic
tacgaccatccgttccaatg

SEQ ID NO: 29135 - DNA, 18 bp, Artificial Sequence
  Synthetic
taatgccttcgaatgccc

SEQ ID NO: 29136 - DNA, 18 bp, Artificial Sequence
  Synthetic
tttgggcgtgagtttggc

SEQ ID NO: 29137 - DNA, 17 bp, Artificial Sequence
  Synthetic
cttccaagtcgcgggac

SEQ ID NO: 29138 - DNA, 20 bp, Artificial Sequence
  Synthetic
cgtttccttcctgaccaacc

SEQ ID NO: 29139 - DNA, 19 bp, Artificial Sequence
  Synthetic
acttgtccgccctgaaagg

SEQ ID NO: 29140 - DNA, 19 bp, Artificial Sequence
  Synthetic
ccttcggcaaacagggttt

SEQ ID NO: 29141 - DNA, 18 bp, Artificial Sequence
  Synthetic
atcccatttggcgcaacc

SEQ ID NO: 29142 - DNA, 17 bp, Artificial Sequence
  Synthetic
cgaaacgctggtgtccg

SEQ ID NO: 29143 - DNA, 18 bp, Artificial Sequence
  Synthetic
tgatgacggttgccaacc

SEQ ID NO: 29144 - DNA, 17 bp, Artificial Sequence
  Synthetic
gcgcaagagctgttggg

SEQ ID NO: 29145 - DNA, 20 bp, Artificial Sequence
  Synthetic
cattttttccagcagggcga

SEQ ID NO: 29146 - DNA, 19 bp, Artificial Sequence
  Synthetic
ctgatgtgggacagctcgg

SEQ ID NO: 29147 - DNA, 19 bp, Artificial Sequence
  Synthetic
cgagccggcttatgaggat

SEQ ID NO: 29148 - DNA, 18 bp, Artificial Sequence
  Synthetic
cacgggtttggcgggtac

SEQ ID NO: 29149 - DNA, 19 bp, Artificial Sequence
  Synthetic
agggtaatcaggtgcaggg

SEQ ID NO: 29150 - DNA, 16 bp, Artificial Sequence
  Synthetic
aaaccctcgccccgct

SEQ ID NO: 29151 - DNA, 19 bp, Artificial Sequence
  Synthetic
gaaatcaacctcacgccgc

SEQ ID NO: 29152 - DNA, 20 bp, Artificial Sequence
  Synthetic
aggatttgggtttggcaagt

SEQ ID NO: 29153 - DNA, 19 bp, Artificial Sequence
  Synthetic
tgaccatggaaatggcgga

SEQ ID NO: 29154 - DNA, 16 bp, Artificial Sequence
  Synthetic
ccggcggcgaaaaagc

SEQ ID NO: 29155 - DNA, 18 bp, Artificial Sequence
  Synthetic
caaaccaagctgccgcag

SEQ ID NO: 29156 - DNA, 15 bp, Artificial Sequence
  Synthetic
tctggcgcgcaccaa

SEQ ID NO: 29157 - DNA, 16 bp, Artificial Sequence
  Synthetic
tgccgaacgcctgcac

SEQ ID NO: 29158 - DNA, 20 bp, Artificial Sequence
  Synthetic
gcctgaagcagcaacacatt

SEQ ID NO: 29159 - DNA, 19 bp, Artificial Sequence
  Synthetic
cgtctgcccgaattggaag

SEQ ID NO: 29160 - DNA, 18 bp, Artificial Sequence
  Synthetic
cgttttgtgcggcaaccg

SEQ ID NO: 29161 - DNA, 16 bp, Artificial Sequence
  Synthetic
attgcccatcgcgccg

SEQ ID NO: 29162 - DNA, 16 bp, Artificial Sequence
  Synthetic
gtcggcaagcgggttg

SEQ ID NO: 29163 - DNA, 19 bp, Artificial Sequence
  Synthetic
tcgtcaaaggggacaaacg

SEQ ID NO: 29164 - DNA, 17 bp, Artificial Sequence
  Synthetic
tcggaagggatgccgac

SEQ ID NO: 29165 - DNA, 18 bp, Artificial Sequence
  Synthetic
tgtccgtagtcgcattgc

SEQ ID NO: 29166 - DNA, 16 bp, Artificial Sequence
  Synthetic
ttcggtcagcggctcg

SEQ ID NO: 29167 - DNA, 20 bp, Artificial Sequence
  Synthetic
acggtttatcctcctcacga

SEQ ID NO: 29168 - DNA, 18 bp, Artificial Sequence
  Synthetic
gtctcgacctcaacggcg

SEQ ID NO: 29169 - DNA, 18 bp, Artificial Sequence
  Synthetic
aaattcaccgccgaagcc

SEQ ID NO: 29170 - DNA, 18 bp, Artificial Sequence
  Synthetic
tgaaacacgccaatccgt

SEQ ID NO: 29171 - DNA, 18 bp, Artificial Sequence
  Synthetic
gctgcacactggaagacg

SEQ ID NO: 29172 - DNA, 19 bp, Artificial Sequence
  Synthetic
acagcgtcttccccgaaat

SEQ ID NO: 29173 - DNA, 19 bp, Artificial Sequence
  Synthetic
gtgtataacgtgccgctcg

SEQ ID NO: 29174 - DNA, 18 bp, Artificial Sequence
  Synthetic
gcgacggtgcgaacgata

SEQ ID NO: 29175 - DNA, 18 bp, Artificial Sequence
  Synthetic
gttcaggaaaggcattgc

SEQ ID NO: 29176 - DNA, 19 bp, Artificial Sequence
  Synthetic
agatgctttgatgtcggtt

SEQ ID NO: 29177 - DNA, 19 bp, Artificial Sequence
  Synthetic
tttctatccgccgtttgtc

SEQ ID NO: 29178 - DNA, 20 bp, Artificial Sequence
  Synthetic
tttcaaggatttccaaacgg

SEQ ID NO: 29179 - DNA, 18 bp, Artificial Sequence
  Synthetic
tgttccaatgcttcggag

SEQ ID NO: 29180 - DNA, 20 bp, Artificial Sequence
  Synthetic
cttcggtatctgcaatcggc

SEQ ID NO: 29181 - DNA, 21 bp, Artificial Sequence
  Synthetic
gaaaataggtaattgccaccg

SEQ ID NO: 29182 - DNA, 19 bp, Artificial Sequence
  Synthetic
cgtctgaaacaaccaacca

SEQ ID NO: 29183 - DNA, 24 bp, Artificial Sequence
  Synthetic
gttaaatattgctgataagtgcca

SEQ ID NO: 29184 - DNA, 19 bp, Artificial Sequence
  Synthetic
catcacatcggcaatcagt

SEQ ID NO: 29185 - DNA, 23 bp, Artificial Sequence
  Synthetic
tgacagaaagtgtgtaaaaactc

SEQ ID NO: 29186 - DNA, 19 bp, Artificial Sequence
  Synthetic
ctgccataaataaaccgcg

SEQ ID NO: 29187 - DNA, 18 bp, Artificial Sequence
  Synthetic
ttaacgggcaactttcct

SEQ ID NO: 29188 - DNA, 18 bp, Artificial Sequence
  Synthetic
ccctggttttggcactgc

SEQ ID NO: 29189 - DNA, 18 bp, Artificial Sequence
  Synthetic
tacgccgccgttccaaat

SEQ ID NO: 29190 - DNA, 20 bp, Artificial Sequence
  Synthetic
aaaggatgatgattgggagg

SEQ ID NO: 29191 - DNA, 19 bp, Artificial Sequence
  Synthetic
gcttcctcgttcggtatgg

SEQ ID NO: 29192 - DNA, 17 bp, Artificial Sequence
  Synthetic
gctttccagcgtcaggc

SEQ ID NO: 29193 - DNA, 17 bp, Artificial Sequence
  Synthetic
tggtcgcgcctttggtg

SEQ ID NO: 29194 - DNA, 18 bp, Artificial Sequence
  Synthetic
tagcgttggacacccgag

SEQ ID NO: 29195 - DNA, 16 bp, Artificial Sequence
  Synthetic
tacctgctcggctcgc

SEQ ID NO: 29196 - DNA, 16 bp, Artificial Sequence
  Synthetic
tcgccaaagccgtcgg

SEQ ID NO: 29197 - DNA, 16 bp, Artificial Sequence
  Synthetic
atgatgtcggcgcgcc

SEQ ID NO: 29198 - DNA, 17 bp, Artificial Sequence
  Synthetic
ttcgtccctgccagcgt

SEQ ID NO: 29199 - DNA, 16 bp, Artificial Sequence
  Synthetic
ctcgccgtcgaacgtc

SEQ ID NO: 29200 - DNA, 20 bp, Artificial Sequence
  Synthetic
gggattgtcgtccaatttgc

SEQ ID NO: 29201 - DNA, 17 bp, Artificial Sequence
  Synthetic
ctggtgttgttggcggg

SEQ ID NO: 29202 - DNA, 18 bp, Artificial Sequence
  Synthetic
gcgtgatgtcgaaaccga

SEQ ID NO: 29203 - DNA, 16 bp, Artificial Sequence
  Synthetic
ccgcgcctgtaaacgg

SEQ ID NO: 29204 - DNA, 17 bp, Artificial Sequence
  Synthetic
cagacggcatcggtgtc

SEQ ID NO: 29205 - DNA, 20 bp, Artificial Sequence
  Synthetic
ctgactttgggcatgatggc

SEQ ID NO: 29206 - DNA, 18 bp, Artificial Sequence
  Synthetic
cctgatgctgcccgaaga

SEQ ID NO: 29207 - DNA, 16 bp, Artificial Sequence
  Synthetic
tgcatcccgttcgccc

SEQ ID NO: 29208 - DNA, 16 bp, Artificial Sequence
  Synthetic
tcgcctcggtcgccat

SEQ ID NO: 29209 - DNA, 19 bp, Artificial Sequence
  Synthetic
tcagcgacgtatccgaagc

SEQ ID NO: 29210 - DNA, 20 bp, Artificial Sequence
  Synthetic
cgatgtccacctacatccgc

SEQ ID NO: 29211 - DNA, 17 bp, Artificial Sequence
  Synthetic
cacgcgcgttttgccac

SEQ ID NO: 29212 - DNA, 20 bp, Artificial Sequence
  Synthetic
ctgccacagacatcgtgttg

SEQ ID NO: 29213 - DNA, 17 bp, Artificial Sequence
  Synthetic
gatacctgcgtcggcac

SEQ ID NO: 29214 - DNA, 18 bp, Artificial Sequence
  Synthetic
cacaggaagcctaccgcc

SEQ ID NO: 29215 - DNA, 20 bp, Artificial Sequence
  Synthetic
tgaagcgatccaaaaaggct

SEQ ID NO: 29216 - DNA, 20 bp, Artificial Sequence
  Synthetic
cgggtagtggcatttttgga

SEQ ID NO: 29217 - DNA, 17 bp, Artificial Sequence
  Synthetic
aggacttcacgcccctg

SEQ ID NO: 29218 - DNA, 20 bp, Artificial Sequence
  Synthetic
tcgatattctggcgctcagt

SEQ ID NO: 29219 - DNA, 17 bp, Artificial Sequence
  Synthetic
gatgttcggcccgtgga

SEQ ID NO: 29220 - DNA, 16 bp, Artificial Sequence
  Synthetic
cggccgccacaatgtc

SEQ ID NO: 29221 - DNA, 17 bp, Artificial Sequence
  Synthetic
gtattcggttgcggcgg

SEQ ID NO: 29222 - DNA, 19 bp, Artificial Sequence
  Synthetic
cattggaagaaaccgcgca

SEQ ID NO: 29223 - DNA, 18 bp, Artificial Sequence
  Synthetic
cgcacgggggaaatcctc

SEQ ID NO: 29224 - DNA, 20 bp, Artificial Sequence
  Synthetic
ttgggtttggaaaactttgt

SEQ ID NO: 29225 - DNA, 19 bp, Artificial Sequence
  Synthetic
gtggggcaaagtgtctctt

SEQ ID NO: 29226 - DNA, 19 bp, Artificial Sequence
  Synthetic
gagcagtcggatgcggaaa

SEQ ID NO: 29227 - DNA, 18 bp, Artificial Sequence
  Synthetic
gggaatggaagcaggttt

SEQ ID NO: 29228 - DNA, 17 bp, Artificial Sequence
  Synthetic
aagtccccagcctgtcc

SEQ ID NO: 29229 - DNA, 17 bp, Artificial Sequence
  Synthetic
agttcgcccatcacgcg

SEQ ID NO: 29230 - DNA, 18 bp, Artificial Sequence
  Synthetic
ttgcgtcttgaggcaggg

SEQ ID NO: 29231 - DNA, 17 bp, Artificial Sequence
  Synthetic
agggcggaagtcgggat

SEQ ID NO: 29232 - DNA, 16 bp, Artificial Sequence
  Synthetic
gcgttttgtccgccgg

SEQ ID NO: 29233 - DNA, 19 bp, Artificial Sequence
  Synthetic
gacgtggttcacaccggtg

SEQ ID NO: 29234 - DNA, 19 bp, Artificial Sequence
  Synthetic
aatcagaagcggtagcgca

SEQ ID NO: 29235 - DNA, 17 bp, Artificial Sequence
  Synthetic
tatagccgcccacgcct

SEQ ID NO: 29236 - DNA, 19 bp, Artificial Sequence
  Synthetic
gggatactgcaccagcgtc

SEQ ID NO: 29237 - DNA, 20 bp, Artificial Sequence
  Synthetic
cgccaaacttttcctcgtca

SEQ ID NO: 29238 - DNA, 16 bp, Artificial Sequence
  Synthetic
tcgaacgccacgccct

SEQ ID NO: 29239 - DNA, 17 bp, Artificial Sequence
  Synthetic
tggcttggcgcgtgatg

SEQ ID NO: 29240 - DNA, 19 bp, Artificial Sequence
  Synthetic
aacccgaagttacccgcaa

SEQ ID NO: 29241 - DNA, 16 bp, Artificial Sequence
  Synthetic
cgtcttccaacgcgcg

SEQ ID NO: 29242 - DNA, 19 bp, Artificial Sequence
  Synthetic
ggaacgtgaaacgggtgtc

SEQ ID NO: 29243 - DNA, 16 bp, Artificial Sequence
  Synthetic
tgtcggtatggcggcg

SEQ ID NO: 29244 - DNA, 18 bp, Artificial Sequence
  Synthetic
agccgcacattatccaag

SEQ ID NO: 29245 - DNA, 15 bp, Artificial Sequence
  Synthetic
ttcggcggcggtttg

SEQ ID NO: 29246 - DNA, 17 bp, Artificial Sequence
  Synthetic
gcatattgcccggccct

SEQ ID NO: 29247 - DNA, 20 bp, Artificial Sequence
  Synthetic
gtccgttgtttttcgtcagg

SEQ ID NO: 29248 - DNA, 20 bp, Artificial Sequence
  Synthetic
tcaaacgactgagccggata

SEQ ID NO: 29249 - DNA, 18 bp, Artificial Sequence
  Synthetic
ttggccaaaccgataccg

SEQ ID NO: 29250 - DNA, 16 bp, Artificial Sequence
  Synthetic
gcaggcagcgtgatgc

SEQ ID NO: 29251 - DNA, 16 bp, Artificial Sequence
  Synthetic
tgcaagggcagggtcg

SEQ ID NO: 29252 - DNA, 18 bp, Artificial Sequence
  Synthetic
caggttcacgctgatgcc

SEQ ID NO: 29253 - DNA, 16 bp, Artificial Sequence
  Synthetic
gcctttgagccggtcg

SEQ ID NO: 29254 - DNA, 19 bp, Artificial Sequence
  Synthetic
caggctgtcaacgtagagc

SEQ ID NO: 29255 - DNA, 18 bp, Artificial Sequence
  Synthetic
acgacggcgagctggtat

SEQ ID NO: 29256 - DNA, 19 bp, Artificial Sequence
  Synthetic
cgaccatttctgcccttgc

SEQ ID NO: 29257 - DNA, 18 bp, Artificial Sequence
  Synthetic
tgatgcgcgaatgggaca

SEQ ID NO: 29258 - DNA, 16 bp, Artificial Sequence
  Synthetic
tcgccctgcaactggg

SEQ ID NO: 29259 - DNA, 18 bp, Artificial Sequence
  Synthetic
gggcattcaggcggacaa

SEQ ID NO: 29260 - DNA, 18 bp, Artificial Sequence
  Synthetic
ccggcagggaagttaagc

SEQ ID NO: 29261 - DNA, 18 bp, Artificial Sequence
  Synthetic
gttcccagcatctcgcac

SEQ ID NO: 29262 - DNA, 20 bp, Artificial Sequence
  Synthetic
ttccgtcgtagtagctttcg

SEQ ID NO: 29263 - DNA, 16 bp, Artificial Sequence
  Synthetic
ttcggacggcatcgcg

SEQ ID NO: 29264 - DNA, 18 bp, Artificial Sequence
  Synthetic
atcccgttcaagttgccg

SEQ ID NO: 29265 - DNA, 16 bp, Artificial Sequence
  Synthetic
tgcccaggctttggcg

SEQ ID NO: 29266 - DNA, 16 bp, Artificial Sequence
  Synthetic
taccggccgccttcag

SEQ ID NO: 29267 - DNA, 19 bp, Artificial Sequence
  Synthetic
ctgaaccttggttttgcct

SEQ ID NO: 29268 - DNA, 18 bp, Artificial Sequence
  Synthetic
tcaggcggctttcctgta

SEQ ID NO: 29269 - DNA, 19 bp, Artificial Sequence
  Synthetic
cggttacggtaatgctgcc

SEQ ID NO: 29270 - DNA, 18 bp, Artificial Sequence
  Synthetic
tgtattcgcgtacctgcg

SEQ ID NO: 29271 - DNA, 19 bp, Artificial Sequence
  Synthetic
acgcacaactgggatacgg

SEQ ID NO: 29272 - DNA, 18 bp, Artificial Sequence
  Synthetic
ccgatgccgacatgatgc

SEQ ID NO: 29273 - DNA, 20 bp, Artificial Sequence
  Synthetic
gttcatcggtcaatccacca

SEQ ID NO: 29274 - DNA, 20 bp, Artificial Sequence
  Synthetic
cggcaaaaacgtccacttga

SEQ ID NO: 29275 - DNA, 16 bp, Artificial Sequence
  Synthetic
cgatacggaagcggcg

SEQ ID NO: 29276 - DNA, 19 bp, Artificial Sequence
  Synthetic
ggcggatttggaagggaaa

SEQ ID NO: 29277 - DNA, 16 bp, Artificial Sequence
  Synthetic
gcgtccgcatcgatgc

SEQ ID NO: 29278 - DNA, 23 bp, Artificial Sequence
  Synthetic
ctgttctactttcaatttttcgc

SEQ ID NO: 29279 - DNA, 18 bp, Artificial Sequence
  Synthetic
cgatgtcttgaccgcgct

SEQ ID NO: 29280 - DNA, 18 bp, Artificial Sequence
  Synthetic
catcgagccgctggtcta

SEQ ID NO: 29281 - DNA, 19 bp, Artificial Sequence
  Synthetic
tccgcataagctcggaagc

SEQ ID NO: 29282 - DNA, 16 bp, Artificial Sequence
  Synthetic
cgtggcgatgtccagc

SEQ ID NO: 29283 - DNA, 19 bp, Artificial Sequence
  Synthetic
ttgatggagcaaaggttgt

SEQ ID NO: 29284 - DNA, 20 bp, Artificial Sequence
  Synthetic
gtaggtcactgccaaacacc

SEQ ID NO: 29285 - DNA, 19 bp, Artificial Sequence
  Synthetic
gcacagtcggacatagacg

SEQ ID NO: 29286 - DNA, 18 bp, Artificial Sequence
  Synthetic
aaatcgtgttccgccgcc

SEQ ID NO: 29287 - DNA, 18 bp, Artificial Sequence
  Synthetic
gaaatcggtcagctgccg

SEQ ID NO: 29288 - DNA, 16 bp, Artificial Sequence
  Synthetic
ttcgggcagccacagc

SEQ ID NO: 29289 - DNA, 19 bp, Artificial Sequence
  Synthetic
tttgcgcgaggaaaacagg

SEQ ID NO: 29290 - DNA, 16 bp, Artificial Sequence
  Synthetic
tcggtgcggatgaggc

SEQ ID NO: 29291 - DNA, 21 bp, Artificial Sequence
  Synthetic
ccatagagctttctacggttt

SEQ ID NO: 29292 - DNA, 17 bp, Artificial Sequence
  Synthetic
cgtgttgggtttcgccg

SEQ ID NO: 29293 - DNA, 20 bp, Artificial Sequence
  Synthetic
caccagcgaagacatcaaca

SEQ ID NO: 29294 - DNA, 16 bp, Artificial Sequence
  Synthetic
gtcatttcgggcggcg

SEQ ID NO: 29295 - DNA, 16 bp, Artificial Sequence
  Synthetic
atggcggcgacttggg

SEQ ID NO: 29296 - DNA, 17 bp, Artificial Sequence
  Synthetic
ccgttgcgccaataccg

SEQ ID NO: 29297 - DNA, 20 bp, Artificial Sequence
  Synthetic
cacaaaatcccgccctcaaa

SEQ ID NO: 29298 - DNA, 16 bp, Artificial Sequence
  Synthetic
ccgcattgctggcagc

SEQ ID NO: 29299 - DNA, 19 bp, Artificial Sequence
  Synthetic
ggcgaaaccctgacctaca

SEQ ID NO: 29300 - DNA, 16 bp, Artificial Sequence
  Synthetic
ttgcggcggaagaggc

SEQ ID NO: 29301 - DNA, 18 bp, Artificial Sequence
  Synthetic
tagtagtcgtgccggtcg

SEQ ID NO: 29302 - DNA, 20 bp, Artificial Sequence
  Synthetic
cggattaaccctttgctcgg

SEQ ID NO: 29303 - DNA, 16 bp, Artificial Sequence
  Synthetic
gcccaagccgtgtacg

SEQ ID NO: 29304 - DNA, 16 bp, Artificial Sequence
  Synthetic
cagccgtagcgttgcg

SEQ ID NO: 29305 - DNA, 18 bp, Artificial Sequence
  Synthetic
gcatcggcaggcggattt

SEQ ID NO: 29306 - DNA, 19 bp, Artificial Sequence
  Synthetic
gatgacgcttttgccgttt

SEQ ID NO: 29307 - DNA, 20 bp, Artificial Sequence
  Synthetic
ccaagaccatacgttcggcg

SEQ ID NO: 29308 - DNA, 16 bp, Artificial Sequence
  Synthetic
agggtttgcaggcgca

SEQ ID NO: 29309 - DNA, 18 bp, Artificial Sequence
  Synthetic
cggagagggtcagcgaag

SEQ ID NO: 29310 - DNA, 19 bp, Artificial Sequence
  Synthetic
tggggttgggtgtggaaat

SEQ ID NO: 29311 - DNA, 20 bp, Artificial Sequence
  Synthetic
acaacttgttcggcgttgac

SEQ ID NO: 29312 - DNA, 20 bp, Artificial Sequence
  Synthetic
ccttcctcacgaccagactg

SEQ ID NO: 29313 - DNA, 19 bp, Artificial Sequence
  Synthetic
acgggtttcatcctgttgg

SEQ ID NO: 29314 - DNA, 17 bp, Artificial Sequence
  Synthetic
ctgctgtcgctgctggt

SEQ ID NO: 29315 - DNA, 18 bp, Artificial Sequence
  Synthetic
cggcgtggaatggtcttt

SEQ ID NO: 29316 - DNA, 20 bp, Artificial Sequence
  Synthetic
ggtgaaaatggaagcggtca

SEQ ID NO: 29317 - DNA, 20 bp, Artificial Sequence
  Synthetic
taccgttaccgccaaaaacc

SEQ ID NO: 29318 - DNA, 18 bp, Artificial Sequence
  Synthetic
gaaagacgcgctggatgc

SEQ ID NO: 29319 - DNA, 17 bp, Artificial Sequence
  Synthetic
cgatgccgaagccgtca

SEQ ID NO: 29320 - DNA, 19 bp, Artificial Sequence
  Synthetic
tcgacaaatcaagcctcgg

SEQ ID NO: 29321 - DNA, 20 bp, Artificial Sequence
  Synthetic
cttgagtccttgaaccagcg

SEQ ID NO: 29322 - DNA, 19 bp, Artificial Sequence
  Synthetic
ggggttttgaaggcggttt

SEQ ID NO: 29323 - DNA, 17 bp, Artificial Sequence
  Synthetic
caggacaagcagggctg

SEQ ID NO: 29324 - DNA, 16 bp, Artificial Sequence
  Synthetic
tggattcccgcctgcg

SEQ ID NO: 29325 - DNA, 18 bp, Artificial Sequence
  Synthetic
ggtaacttggtgcagggc

SEQ ID NO: 29326 - DNA, 16 bp, Artificial Sequence
  Synthetic
tggtcttcgggcgagg

SEQ ID NO: 29327 - DNA, 20 bp, Artificial Sequence
  Synthetic
atttccaccggattcaccaa

SEQ ID NO: 29328 - DNA, 16 bp, Artificial Sequence
  Synthetic
agcgccgatgcctacg

SEQ ID NO: 29329 - DNA, 16 bp, Artificial Sequence
  Synthetic
ctgcaacttcgccccg

SEQ ID NO: 29330 - DNA, 17 bp, Artificial Sequence
  Synthetic
aatcgccgccgtcaaag

SEQ ID NO: 29331 - DNA, 18 bp, Artificial Sequence
  Synthetic
tcgcggtagatggtcagc

SEQ ID NO: 29332 - DNA, 17 bp, Artificial Sequence
  Synthetic
ggcgtgggggttgaact

SEQ ID NO: 29333 - DNA, 18 bp, Artificial Sequence
  Synthetic
ccacttgtttgggcgtgc

SEQ ID NO: 29334 - DNA, 19 bp, Artificial Sequence
  Synthetic
ggatgacttcgtcgagcga

SEQ ID NO: 29335 - DNA, 16 bp, Artificial Sequence
  Synthetic
aaaccgtccgccacgc

SEQ ID NO: 29336 - DNA, 17 bp, Artificial Sequence
  Synthetic
gtttgccgtatcgggcg

SEQ ID NO: 29337 - DNA, 15 bp, Artificial Sequence
  Synthetic
ttgcggacgcgcgtt

SEQ ID NO: 29338 - DNA, 15 bp, Artificial Sequence
  Synthetic
tgcacgttccgcgct

SEQ ID NO: 29339 - DNA, 18 bp, Artificial Sequence
  Synthetic
gtgcctgttcccgatgga

SEQ ID NO: 29340 - DNA, 20 bp, Artificial Sequence
  Synthetic
gagatacggtgcggattccg

SEQ ID NO: 29341 - DNA, 18 bp, Artificial Sequence
  Synthetic
tcgatgccgcggattacg

SEQ ID NO: 29342 - DNA, 20 bp, Artificial Sequence
  Synthetic
aggacgacgttcacatccaa

SEQ ID NO: 29343 - DNA, 20 bp, Artificial Sequence
  Synthetic
gttttccgctgtctgaacgg

SEQ ID NO: 29344 - DNA, 20 bp, Artificial Sequence
  Synthetic
tcataaatcagtgcgtcgcc

SEQ ID NO: 29345 - DNA, 18 bp, Artificial Sequence
  Synthetic
gcccatgccttcaatgcg

SEQ ID NO: 29346 - DNA, 16 bp, Artificial Sequence
  Synthetic
acagcttcgggcaggg

SEQ ID NO: 29347 - DNA, 16 bp, Artificial Sequence
  Synthetic
caaacgtccgccgagc

SEQ ID NO: 29348 - DNA, 20 bp, Artificial Sequence
  Synthetic
gaggttttcagacggcatcg

SEQ ID NO: 29349 - DNA, 19 bp, Artificial Sequence
  Synthetic
ccggcgtttatcaggtctt

SEQ ID NO: 29350 - DNA, 20 bp, Artificial Sequence
  Synthetic
gacatgagtgcgaacatcct

SEQ ID NO: 29351 - DNA, 20 bp, Artificial Sequence
  Synthetic
agcatgaaacgccacatcag

SEQ ID NO: 29352 - DNA, 19 bp, Artificial Sequence
  Synthetic
catcatggaggggctgatg

SEQ ID NO: 29353 - DNA, 16 bp, Artificial Sequence
  Synthetic
gttgatgagggcggcg

SEQ ID NO: 29354 - DNA, 17 bp, Artificial Sequence
  Synthetic
gttcgtgggcatccagc

SEQ ID NO: 29355 - DNA, 17 bp, Artificial Sequence
  Synthetic
tcagcatgggcatcggc

SEQ ID NO: 29356 - DNA, 16 bp, Artificial Sequence
  Synthetic
tgcgccttcccagctc

SEQ ID NO: 29357 - DNA, 18 bp, Artificial Sequence
  Synthetic
agaaaccggtggcgtaca

SEQ ID NO: 29358 - DNA, 18 bp, Artificial Sequence
  Synthetic
aggtgtttgccgctttcg

SEQ ID NO: 29359 - DNA, 19 bp, Artificial Sequence
  Synthetic
gccgtatttggtggccatg

SEQ ID NO: 29360 - DNA, 20 bp, Artificial Sequence
  Synthetic
gcggtaaatcaagccctgtt

SEQ ID NO: 29361 - DNA, 20 bp, Artificial Sequence
  Synthetic
cgatcaaatcctgcaacacg

SEQ ID NO: 29362 - DNA, 19 bp, Artificial Sequence
  Synthetic
ttgcaggggtaaatatccc

SEQ ID NO: 29363 - DNA, 21 bp, Artificial Sequence
  Synthetic
tgtctaagttgcatactcctg

SEQ ID NO: 29364 - DNA, 20 bp, Artificial Sequence
  Synthetic
atgcaaccaaatgacgttta

SEQ ID NO: 29365 - DNA, 19 bp, Artificial Sequence
  Synthetic
aatccccaagcaatcaatg

SEQ ID NO: 29366 - DNA, 16 bp, Artificial Sequence
  Synthetic
atcggcgtgcctgtcg

SEQ ID NO: 29367 - DNA, 19 bp, Artificial Sequence
  Synthetic
actttattgcgacccacgg

SEQ ID NO: 29368 - DNA, 19 bp, Artificial Sequence
  Synthetic
ctgcaccacttggttgacg

SEQ ID NO: 29369 - DNA, 19 bp, Artificial Sequence
  Synthetic
tggaaaacacccgcttcaa

SEQ ID NO: 29370 - DNA, 19 bp, Artificial Sequence
  Synthetic
caggttacgctggtggtcg

SEQ ID NO: 29371 - DNA, 17 bp, Artificial Sequence
  Synthetic
gtatcggcgcggcttct

SEQ ID NO: 29372 - DNA, 18 bp, Artificial Sequence
  Synthetic
cccgaagacaacggcaac

SEQ ID NO: 29373 - DNA, 18 bp, Artificial Sequence
  Synthetic
cggtgtcttccggcattt

SEQ ID NO: 29374 - DNA, 20 bp, Artificial Sequence
  Synthetic
caggtcttggaaatcggggt

SEQ ID NO: 29375 - DNA, 17 bp, Artificial Sequence
  Synthetic
tctttttccgcagccgc

SEQ ID NO: 29376 - DNA, 16 bp, Artificial Sequence
  Synthetic
tggtcgccggaatgca

SEQ ID NO: 29377 - DNA, 16 bp, Artificial Sequence
  Synthetic
gtctgccgcccattcg

SEQ ID NO: 29378 - DNA, 19 bp, Artificial Sequence
  Synthetic
tgaccttttctcaggagca

SEQ ID NO: 29379 - DNA, 18 bp, Artificial Sequence
  Synthetic
tccatcaggacggcttgg

SEQ ID NO: 29380 - DNA, 16 bp, Artificial Sequence
  Synthetic
tgtttccctgcgcggc

SEQ ID NO: 29381 - DNA, 16 bp, Artificial Sequence
  Synthetic
gctcatcgccatcggc

SEQ ID NO: 29382 - DNA, 17 bp, Artificial Sequence
  Synthetic
cttttggacgacggcgc

SEQ ID NO: 29383 - DNA, 19 bp, Artificial Sequence
  Synthetic
ggtattgccgtgccgtatt

SEQ ID NO: 29384 - DNA, 19 bp, Artificial Sequence
  Synthetic
atttgcattgcgaactgcc

SEQ ID NO: 29385 - DNA, 23 bp, Artificial Sequence
  Synthetic
gcatatctgaaaagtgtattccg

SEQ ID NO: 29386 - DNA, 20 bp, Artificial Sequence
  Synthetic
cgtgcaaaaatatccgcacc

SEQ ID NO: 29387 - DNA, 17 bp, Artificial Sequence
  Synthetic
acggcggtcagcgattc

SEQ ID NO: 29388 - DNA, 16 bp, Artificial Sequence
  Synthetic
ggtgttggcgtggagc

SEQ ID NO: 29389 - DNA, 20 bp, Artificial Sequence
  Synthetic
cggttgtccaaatcgaccag

SEQ ID NO: 29390 - DNA, 19 bp, Artificial Sequence
  Synthetic
gagtgcttcgtaggcgttg

SEQ ID NO: 29391 - DNA, 17 bp, Artificial Sequence
  Synthetic
gctgtgtcggagttggc

SEQ ID NO: 29392 - DNA, 18 bp, Artificial Sequence
  Synthetic
gcttcgacgatggtgcag

SEQ ID NO: 29393 - DNA, 20 bp, Artificial Sequence
  Synthetic
ccagagtttggtttcgacgg

SEQ ID NO: 29394 - DNA, 20 bp, Artificial Sequence
  Synthetic
aaggtggaactgtgcggtaa

SEQ ID NO: 29395 - DNA, 17 bp, Artificial Sequence
  Synthetic
agttgccgggcgatgag

SEQ ID NO: 29396 - DNA, 20 bp, Artificial Sequence
  Synthetic
cgcaggcagtacaaatggta

SEQ ID NO: 29397 - DNA, 20 bp, Artificial Sequence
  Synthetic
attcttgtttgccgccttcg

SEQ ID NO: 29398 - DNA, 16 bp, Artificial Sequence
  Synthetic
atcgccaccatcgggc

SEQ ID NO: 29399 - DNA, 17 bp, Artificial Sequence
  Synthetic
accggcggctttaagca

SEQ ID NO: 29400 - DNA, 19 bp, Artificial Sequence
  Synthetic
cactacttctcgctgcacg

SEQ ID NO: 29401 - DNA, 18 bp, Artificial Sequence
  Synthetic
tctaccacggcgcagaag

SEQ ID NO: 29402 - DNA, 19 bp, Artificial Sequence
  Synthetic
gtctgttcgagttggcaca

SEQ ID NO: 29403 - DNA, 18 bp, Artificial Sequence
  Synthetic
acagtatctggcgcgcct

SEQ ID NO: 29404 - DNA, 21 bp, Artificial Sequence
  Synthetic
cataagccgcaatatcaagtt

SEQ ID NO: 29405 - DNA, 18 bp, Artificial Sequence
  Synthetic
tttcaacagatacgccgc

SEQ ID NO: 29406 - DNA, 20 bp, Artificial Sequence
  Synthetic
tgataaaccaaatctgcggt

SEQ ID NO: 29407 - DNA, 20 bp, Artificial Sequence
  Synthetic
tgaagtaaaggctgcaattg

SEQ ID NO: 29408 - DNA, 19 bp, Artificial Sequence
  Synthetic
gtaaaaacctgccccaccc

SEQ ID NO: 29409 - DNA, 17 bp, Artificial Sequence
  Synthetic
gaagggacggcggaact

SEQ ID NO: 29410 - DNA, 19 bp, Artificial Sequence
  Synthetic
cgatttgggcatcggcaac

SEQ ID NO: 29411 - DNA, 16 bp, Artificial Sequence
  Synthetic
cctacgggcacaacgc

SEQ ID NO: 29412 - DNA, 20 bp, Artificial Sequence
  Synthetic
agacatccgttcgctcgatt

SEQ ID NO: 29413 - DNA, 20 bp, Artificial Sequence
  Synthetic
gtgttcgacaccgtcaacat

SEQ ID NO: 29414 - DNA, 20 bp, Artificial Sequence
  Synthetic
gcagtatgtttcctcggctg

SEQ ID NO: 29415 - DNA, 18 bp, Artificial Sequence
  Synthetic
cgacggcaaaatcgggac

SEQ ID NO: 29416 - DNA, 16 bp, Artificial Sequence
  Synthetic
ggtatgtgcgcgaccg

SEQ ID NO: 29417 - DNA, 16 bp, Artificial Sequence
  Synthetic
cttctccggcggttgc

SEQ ID NO: 29418 - DNA, 19 bp, Artificial Sequence
  Synthetic
cttgtagctgcaatgaacg

SEQ ID NO: 29419 - DNA, 18 bp, Artificial Sequence
  Synthetic
agtctgccaccctatccg

SEQ ID NO: 29420 - DNA, 20 bp, Artificial Sequence
  Synthetic
ctctatgatggcgggcatag

SEQ ID NO: 29421 - DNA, 17 bp, Artificial Sequence
  Synthetic
caacacaccgacagccc

SEQ ID NO: 29422 - DNA, 16 bp, Artificial Sequence
  Synthetic
gcgcgcaaaccgatga

SEQ ID NO: 29423 - DNA, 17 bp, Artificial Sequence
  Synthetic
cgacggcggcaaaatcg

SEQ ID NO: 29424 - DNA, 18 bp, Artificial Sequence
  Synthetic
attgttttggggcgcggt

SEQ ID NO: 29425 - DNA, 18 bp, Artificial Sequence
  Synthetic
atgcagggtggtgaaggg

SEQ ID NO: 29426 - DNA, 18 bp, Artificial Sequence
  Synthetic
gcgggattgacggtttcg

SEQ ID NO: 29427 - DNA, 20 bp, Artificial Sequence
  Synthetic
caagttcgggcgtaaccatc

SEQ ID NO: 29428 - DNA, 17 bp, Artificial Sequence
  Synthetic
gcccgccaaagttaccg

SEQ ID NO: 29429 - DNA, 20 bp, Artificial Sequence
  Synthetic
cggcctgttccaaaacgatt

SEQ ID NO: 29430 - DNA, 16 bp, Artificial Sequence
  Synthetic
aattgctgctggcgcg

SEQ ID NO: 29431 - DNA, 18 bp, Artificial Sequence
  Synthetic
cagccgccaatagccgtc

SEQ ID NO: 29432 - DNA, 20 bp, Artificial Sequence
  Synthetic
tgatttgcgtttccaaaccc

SEQ ID NO: 29433 - DNA, 18 bp, Artificial Sequence
  Synthetic
acttgagccggctgttcc

SEQ ID NO: 29434 - DNA, 18 bp, Artificial Sequence
  Synthetic
aaccgtcatacgcgacac

SEQ ID NO: 29435 - DNA, 16 bp, Artificial Sequence
  Synthetic
cccgaatccgcgctca

SEQ ID NO: 29436 - DNA, 16 bp, Artificial Sequence
  Synthetic
cgggcttgggtttgcc

SEQ ID NO: 29437 - DNA, 17 bp, Artificial Sequence
  Synthetic
cgccggtttgcgtttgg

SEQ ID NO: 29438 - DNA, 20 bp, Artificial Sequence
  Synthetic
agacctgcaagcccaatacg

SEQ ID NO: 29439 - DNA, 17 bp, Artificial Sequence
  Synthetic
tgggcaggcagagcatt

SEQ ID NO: 29440 - DNA, 16 bp, Artificial Sequence
  Synthetic
gcccgccgtttcagac

SEQ ID NO: 29441 - DNA, 18 bp, Artificial Sequence
  Synthetic
ctccttcatcttccgccg

SEQ ID NO: 29442 - DNA, 20 bp, Artificial Sequence
  Synthetic
tgtttggcgatgacggtaac

SEQ ID NO: 29443 - DNA, 18 bp, Artificial Sequence
  Synthetic
ccggattcaggcacaggg

SEQ ID NO: 29444 - DNA, 18 bp, Artificial Sequence
  Synthetic
ggtcgactttgccggaac

SEQ ID NO: 29445 - DNA, 20 bp, Artificial Sequence
  Synthetic
agtggaaaaggacgaaccga

SEQ ID NO: 29446 - DNA, 16 bp, Artificial Sequence
  Synthetic
tatggtcgtgccgccc

SEQ ID NO: 29447 - DNA, 18 bp, Artificial Sequence
  Synthetic
catcgtcggctgcacaca

SEQ ID NO: 29448 - DNA, 15 bp, Artificial Sequence
  Synthetic
atggcgcggcggtaa

SEQ ID NO: 29449 - DNA, 20 bp, Artificial Sequence
  Synthetic
cagtttggcatcagggtctt

SEQ ID NO: 29450 - DNA, 18 bp, Artificial Sequence
  Synthetic
cattttgccccgatgcgg

SEQ ID NO: 29451 - DNA, 19 bp, Artificial Sequence
  Synthetic
tgcttctcaatccggcaac

SEQ ID NO: 29452 - DNA, 16 bp, Artificial Sequence
  Synthetic
aacccaagccgacgcg

SEQ ID NO: 29453 - DNA, 20 bp, Artificial Sequence
  Synthetic
gccaaacgggttttccttac

SEQ ID NO: 29454 - DNA, 19 bp, Artificial Sequence
  Synthetic
cctttatatacgcggccgg

SEQ ID NO: 29455 - DNA, 19 bp, Artificial Sequence
  Synthetic
atggcgtagaacggtgtga

SEQ ID NO: 29456 - DNA, 25 bp, Artificial Sequence
  Synthetic
gtttcagaccttttcctaattcaat

SEQ ID NO: 29457 - DNA, 16 bp, Artificial Sequence
  Synthetic
tttcctgccctgccgc

SEQ ID NO: 29458 - DNA, 16 bp, Artificial Sequence
  Synthetic
tcaggtgggcgcaacc

SEQ ID NO: 29459 - DNA, 16 bp, Artificial Sequence
  Synthetic
actgggaggcaggctg

SEQ ID NO: 29460 - DNA, 20 bp, Artificial Sequence
  Synthetic
gcttaagcggaattggtcgc

SEQ ID NO: 29461 - DNA, 20 bp, Artificial Sequence
  Synthetic
gcgtgaaaacggttcggtaa

SEQ ID NO: 29462 - DNA, 17 bp, Artificial Sequence
  Synthetic
cgaacgcctgcacgaag

SEQ ID NO: 29463 - DNA, 16 bp, Artificial Sequence
  Synthetic
cggcctcaaacgcctc

SEQ ID NO: 29464 - DNA, 18 bp, Artificial Sequence
  Synthetic
agcccttgtccgcatcag

SEQ ID NO: 29465 - DNA, 16 bp, Artificial Sequence
  Synthetic
gccgcacctgtccatg

SEQ ID NO: 29466 - DNA, 16 bp, Artificial Sequence
  Synthetic
gcggcagccaaaaccc

SEQ ID NO: 29467 - DNA, 16 bp, Artificial Sequence
  Synthetic
ccgccgttgtgcgaaa

SEQ ID NO: 29468 - DNA, 25 bp, Artificial Sequence
  Synthetic
gataataaaaattctggcaaccatc

SEQ ID NO: 29469 - DNA, 17 bp, Artificial Sequence
  Synthetic
aatcccgaacccgaccc

SEQ ID NO: 29470 - DNA, 15 bp, Artificial Sequence
  Synthetic
aacgacgccggcaac

SEQ ID NO: 29471 - DNA, 18 bp, Artificial Sequence
  Synthetic
gttttcctggatggcggc

SEQ ID NO: 29472 - DNA, 16 bp, Artificial Sequence
  Synthetic
actgacccgccgcttc

SEQ ID NO: 29473 - DNA, 18 bp, Artificial Sequence
  Synthetic
gcccttaccgcccatcaa

SEQ ID NO: 29474 - DNA, 20 bp, Artificial Sequence
  Synthetic
atcctcaactggtcgctcaa

SEQ ID NO: 29475 - DNA, 19 bp, Artificial Sequence
  Synthetic
cagcaccacaaaccagacc

SEQ ID NO: 29476 - DNA, 19 bp, Artificial Sequence
  Synthetic
ttggaaaaacaccgcccga

SEQ ID NO: 29477 - DNA, 17 bp, Artificial Sequence
  Synthetic
tcttccaaccctccgcc

SEQ ID NO: 29478 - DNA, 16 bp, Artificial Sequence
  Synthetic
aagctcgccgttgccg

SEQ ID NO: 29479 - DNA, 20 bp, Artificial Sequence
  Synthetic
cttgggctacctgcaccata

SEQ ID NO: 29480 - DNA, 16 bp, Artificial Sequence
  Synthetic
catcttcgtcggcggc

SEQ ID NO: 29481 - DNA, 20 bp, Artificial Sequence
  Synthetic
caccggtatggaaacactgc

SEQ ID NO: 29482 - DNA, 20 bp, Artificial Sequence
  Synthetic
atggttgccgagattgtcct

SEQ ID NO: 29483 - DNA, 17 bp, Artificial Sequence
  Synthetic
caacaggcgcaaaacgg

SEQ ID NO: 29484 - DNA, 16 bp, Artificial Sequence
  Synthetic
ctgcggcaagaccacc

SEQ ID NO: 29485 - DNA, 20 bp, Artificial Sequence
  Synthetic
gttggaaaaaaccgtggacg

SEQ ID NO: 29486 - DNA, 19 bp, Artificial Sequence
  Synthetic
tgattttgggtctgccgac

SEQ ID NO: 29487 - DNA, 20 bp, Artificial Sequence
  Synthetic
gtcatgctgcccatcgtatt

SEQ ID NO: 29488 - DNA, 17 bp, Artificial Sequence
  Synthetic
ccgccgccaaagtcaga

SEQ ID NO: 29489 - DNA, 16 bp, Artificial Sequence
  Synthetic
acggcattcacgcccg

SEQ ID NO: 29490 - DNA, 18 bp, Artificial Sequence
  Synthetic
ggcaataagacgggacat

SEQ ID NO: 29491 - DNA, 16 bp, Artificial Sequence
  Synthetic
tgctgctggggcggta

SEQ ID NO: 29492 - DNA, 20 bp, Artificial Sequence
  Synthetic
ccccattttggagacaccct

SEQ ID NO: 29493 - DNA, 19 bp, Artificial Sequence
  Synthetic
gaacactggagcttcagcg

SEQ ID NO: 29494 - DNA, 19 bp, Artificial Sequence
  Synthetic
tcatgcagtcggtcgtcag

SEQ ID NO: 29495 - DNA, 16 bp, Artificial Sequence
  Synthetic
accggctcgaaccagc

SEQ ID NO: 29496 - DNA, 18 bp, Artificial Sequence
  Synthetic
ggtaaacacgacgcaggc

SEQ ID NO: 29497 - DNA, 16 bp, Artificial Sequence
  Synthetic
ttccctctgaccggcc

SEQ ID NO: 29498 - DNA, 15 bp, Artificial Sequence
  Synthetic
gcgcagtgccgaaca

SEQ ID NO: 29499 - DNA, 17 bp, Artificial Sequence
  Synthetic
catcggcaactcggcac

SEQ ID NO: 29500 - DNA, 16 bp, Artificial Sequence
  Synthetic
aagcggcatccgggac

SEQ ID NO: 29501 - DNA, 20 bp, Artificial Sequence
  Synthetic
gatccgaaatacaccaccgc

SEQ ID NO: 29502 - DNA, 18 bp, Artificial Sequence
  Synthetic
ccgcatccgtttgaagcc

SEQ ID NO: 29503 - DNA, 20 bp, Artificial Sequence
  Synthetic
gctttatacgggcagcatcg

SEQ ID NO: 29504 - DNA, 18 bp, Artificial Sequence
  Synthetic
accgaaccgatgaaaggc

SEQ ID NO: 29505 - DNA, 16 bp, Artificial Sequence
  Synthetic
tttgccgactgcgccg

SEQ ID NO: 29506 - DNA, 16 bp, Artificial Sequence
  Synthetic
gcgctacggcaaccct

SEQ ID NO: 29507 - DNA, 16 bp, Artificial Sequence
  Synthetic
tctgcggcggttttgc

SEQ ID NO: 29508 - DNA, 18 bp, Artificial Sequence
  Synthetic
cggcggtatagacggcag

SEQ ID NO: 29509 - DNA, 17 bp, Artificial Sequence
  Synthetic
gggtgcgtggcttttcg

SEQ ID NO: 29510 - DNA, 16 bp, Artificial Sequence
  Synthetic
gctcaggcggaatggc

SEQ ID NO: 29511 - DNA, 17 bp, Artificial Sequence
  Synthetic
gcaacgatgcctggagg

SEQ ID NO: 29512 - DNA, 20 bp, Artificial Sequence
  Synthetic
ttgccggtgctttgaatcag

SEQ ID NO: 29513 - DNA, 18 bp, Artificial Sequence
  Synthetic
tcggcgacaacctcttga

SEQ ID NO: 29514 - DNA, 16 bp, Artificial Sequence
  Synthetic
cattcgaccagcgcgg

SEQ ID NO: 29515 - DNA, 19 bp, Artificial Sequence
  Synthetic
caaaatacccaaggcggcg

SEQ ID NO: 29516 - DNA, 18 bp, Artificial Sequence
  Synthetic
ttcgtcctgttgcagcag

SEQ ID NO: 29517 - DNA, 17 bp, Artificial Sequence
  Synthetic
ccccaaacggtgcagtc

SEQ ID NO: 29518 - DNA, 17 bp, Artificial Sequence
  Synthetic
agccgactgttcctgcc

SEQ ID NO: 29519 - DNA, 18 bp, Artificial Sequence
  Synthetic
ccgaccgcttcatctgcg

SEQ ID NO: 29520 - DNA, 19 bp, Artificial Sequence
  Synthetic
cggggcattaccgtcaact

SEQ ID NO: 29521 - DNA, 17 bp, Artificial Sequence
  Synthetic
gcccatcggatcgaacg

SEQ ID NO: 29522 - DNA, 20 bp, Artificial Sequence
  Synthetic
caaatgtacgcccccatcaa

SEQ ID NO: 29523 - DNA, 19 bp, Artificial Sequence
  Synthetic
gccctgattgccattttcg

SEQ ID NO: 29524 - DNA, 17 bp, Artificial Sequence
  Synthetic
actcgcccggacaagtc

SEQ ID NO: 29525 - DNA, 19 bp, Artificial Sequence
  Synthetic
gtccgccggaaattcgaca

SEQ ID NO: 29526 - DNA, 18 bp, Artificial Sequence
  Synthetic
ccatatctcgcacacagc

SEQ ID NO: 29527 - DNA, 21 bp, Artificial Sequence
  Synthetic
aatggcaaaagatgtagcaag

SEQ ID NO: 29528 - DNA, 22 bp, Artificial Sequence
  Synthetic
ctgaacattatggttttcagct

SEQ ID NO: 29529 - DNA, 25 bp, Artificial Sequence
  Synthetic
cccattgaatcattttagaaagttc

SEQ ID NO: 29530 - DNA, 20 bp, Artificial Sequence
  Synthetic
gcaaattgatcagagcttgt

SEQ ID NO: 29531 - DNA, 19 bp, Artificial Sequence
  Synthetic
cagacctcctagaagagct

SEQ ID NO: 29532 - DNA, 21 bp, Artificial Sequence
  Synthetic
gtgtttcttcttgtgtaaccc

SEQ ID NO: 29533 - DNA, 18 bp, Artificial Sequence
  Synthetic
acactgcgtctattgtgg

SEQ ID NO: 29534 - DNA, 18 bp, Artificial Sequence
  Synthetic
gtgtcaaaggcgggattt

SEQ ID NO: 29535 - DNA, 22 bp, Artificial Sequence
  Synthetic
tctgttacaggatgatacacta

SEQ ID NO: 29536 - DNA, 19 bp, Artificial Sequence
  Synthetic
cgatccagtaaagggtgac

SEQ ID NO: 29537 - DNA, 18 bp, Artificial Sequence
  Synthetic
gaggagtaccatcagctg

SEQ ID NO: 29538 - DNA, 24 bp, Artificial Sequence
  Synthetic
tatctgtaagtatcttccaaaccc

SEQ ID NO: 29539 - DNA, 22 bp, Artificial Sequence
  Synthetic
aggaaacagaatgattcaacat

SEQ ID NO: 29540 - DNA, 25 bp, Artificial Sequence
  Synthetic
gaaaatctgaatacatgaagcatac

SEQ ID NO: 29541 - DNA, 21 bp, Artificial Sequence
  Synthetic
tggatgtgtgtattctcagat

SEQ ID NO: 29542 - DNA, 18 bp, Artificial Sequence
  Synthetic
tattccctccccttcgtg

SEQ ID NO: 29543 - DNA, 22 bp, Artificial Sequence
  Synthetic
tgtctctacagttgtcaaagtc

SEQ ID NO: 29544 - DNA, 25 bp, Artificial Sequence
  Synthetic
atacccccttcattatatattctgt

SEQ ID NO: 29545 - DNA, 19 bp, Artificial Sequence
  Synthetic
aggacacagtacttctccc

SEQ ID NO: 29546 - DNA, 18 bp, Artificial Sequence
  Synthetic
ctgcagaccttcccaatg

SEQ ID NO: 29547 - DNA, 16 bp, Artificial Sequence
  Synthetic
ctagccccgctgctct

SEQ ID NO: 29548 - DNA, 16 bp, Artificial Sequence
  Synthetic
tcccgccattcctggg

SEQ ID NO: 29549 - DNA, 18 bp, Artificial Sequence
  Synthetic
tttcctcttcgggtcggc

SEQ ID NO: 29550 - DNA, 17 bp, Artificial Sequence
  Synthetic
aagaatagccggcccgc

SEQ ID NO: 29551 - DNA, 18 bp, Artificial Sequence
  Synthetic
aaggatggagagggggct

SEQ ID NO: 29552 - DNA, 19 bp, Artificial Sequence
  Synthetic
acacactgtacctgcaaat

SEQ ID NO: 29553 - DNA, 19 bp, Artificial Sequence
  Synthetic
gccctgctatttcgtgaaa

SEQ ID NO: 29554 - DNA, 18 bp, Artificial Sequence
  Synthetic
tcttgtccagcttgtctg

SEQ ID NO: 29555 - DNA, 22 bp, Artificial Sequence
  Synthetic
attgtctgtttcatcatctgat

SEQ ID NO: 29556 - DNA, 19 bp, Artificial Sequence
  Synthetic
tgtattctgctgactgtcg

SEQ ID NO: 29557 - DNA, 18 bp, Artificial Sequence
  Synthetic
tattttctcctggcacgc

SEQ ID NO: 29558 - DNA, 22 bp, Artificial Sequence
  Synthetic
aacaatgtttaggttctgtcat

SEQ ID NO: 29559 - DNA, 18 bp, Artificial Sequence
  Synthetic
accacacacatgtacagc

SEQ ID NO: 29560 - DNA, 19 bp, Artificial Sequence
  Synthetic
ggcctccacttgtactgtg

SEQ ID NO: 29561 - DNA, 18 bp, Artificial Sequence
  Synthetic
gatgtccaacacagcagg

SEQ ID NO: 29562 - DNA, 21 bp, Artificial Sequence
  Synthetic
ttccactacgtgttttcatag

SEQ ID NO: 29563 - DNA, 24 bp, Artificial Sequence
  Synthetic
gtaacattggtagtggaagtatta

SEQ ID NO: 29564 - DNA, 18 bp, Artificial Sequence
  Synthetic
ttgacaacccgagacaca

SEQ ID NO: 29565 - DNA, 19 bp, Artificial Sequence
  Synthetic
acttcaacaccaacacagg

SEQ ID NO: 29566 - DNA, 21 bp, Artificial Sequence
  Synthetic
gtatcaatcatatcgccatcc

SEQ ID NO: 29567 - DNA, 18 bp, Artificial Sequence
  Synthetic
agaagatgtagggggctc

SEQ ID NO: 29568 - DNA, 21 bp, Artificial Sequence
  Synthetic
aacacataaccatgcatacat

SEQ ID NO: 29569 - DNA, 18 bp, Artificial Sequence
  Synthetic
gggccatccaagtcaagc

SEQ ID NO: 29570 - DNA, 18 bp, Artificial Sequence
  Synthetic
gcgcaggtacaggacttg

SEQ ID NO: 29571 - DNA, 20 bp, Artificial Sequence
  Synthetic
caggccaaagatagcagaca

SEQ ID NO: 29572 - DNA, 18 bp, Artificial Sequence
  Synthetic
cacaggtcacaagagcgc

SEQ ID NO: 29573 - DNA, 18 bp, Artificial Sequence
  Synthetic
atagtgcagtacgatggc

SEQ ID NO: 29574 - DNA, 19 bp, Artificial Sequence
  Synthetic
cctgtggctaggtctttca

SEQ ID NO: 29575 - DNA, 20 bp, Artificial Sequence
  Synthetic
tgagcaaagaagccaaaacg

SEQ ID NO: 29576 - DNA, 25 bp, Artificial Sequence
  Synthetic
cactaagaggaaaaacttaagaaca

SEQ ID NO: 29577 - DNA, 19 bp, Artificial Sequence
  Synthetic
tgccacgttcagagagaca

SEQ ID NO: 29578 - DNA, 18 bp, Artificial Sequence
  Synthetic
accaatgaccccagtcgt

SEQ ID NO: 29579 - DNA, 18 bp, Artificial Sequence
  Synthetic
tcgcgtgcatgtactttg

SEQ ID NO: 29580 - DNA, 23 bp, Artificial Sequence
  Synthetic
tcttcagattttcctccttaatc

SEQ ID NO: 29581 - DNA, 18 bp, Artificial Sequence
  Synthetic
atgaaggttcggggttga

SEQ ID NO: 29582 - DNA, 21 bp, Artificial Sequence
  Synthetic
ggattgtcaggtaaagtgact

SEQ ID NO: 29583 - DNA, 20 bp, Artificial Sequence
  Synthetic
ccctgctgttgtcaaagcaa

SEQ ID NO: 29584 - DNA, 22 bp, Artificial Sequence
  Synthetic
tgtgatctcccattttctcata

SEQ ID NO: 29585 - DNA, 20 bp, Artificial Sequence
  Synthetic
tgcacatccaattgcagtga

SEQ ID NO: 29586 - DNA, 18 bp, Artificial Sequence
  Synthetic
ttctaagctccgcatccc

SEQ ID NO: 29587 - DNA, 20 bp, Artificial Sequence
  Synthetic
agacctcctcctttggaact

SEQ ID NO: 29588 - DNA, 20 bp, Artificial Sequence
  Synthetic
gtcctccagcgtataactgc

SEQ ID NO: 29589 - DNA, 19 bp, Artificial Sequence
  Synthetic
tcttgtggtgcacccatca

SEQ ID NO: 29590 - DNA, 20 bp, Artificial Sequence
  Synthetic
gatctcagcgttggtgtagc

SEQ ID NO: 29591 - DNA, 21 bp, Artificial Sequence
  Synthetic
acttctgcaatcttctctgtg

SEQ ID NO: 29592 - DNA, 18 bp, Artificial Sequence
  Synthetic
tcctcacccacccgagac

SEQ ID NO: 29593 - DNA, 25 bp, Artificial Sequence
  Synthetic
gatacactatctctgttatgtttct

SEQ ID NO: 29594 - DNA, 19 bp, Artificial Sequence
  Synthetic
ccaagggcaaattggtaac

SEQ ID NO: 29595 - DNA, 21 bp, Artificial Sequence
  Synthetic
aatactatctacaagcctccc

SEQ ID NO: 29596 - DNA, 21 bp, Artificial Sequence
  Synthetic
tgtttatatctacgatgggcc

SEQ ID NO: 29597 - DNA, 21 bp, Artificial Sequence
  Synthetic
tcaatgactttgaaggtttca

SEQ ID NO: 29598 - DNA, 18 bp, Artificial Sequence
  Synthetic
tgatatcaggttgtgccc

SEQ ID NO: 29599 - DNA, 19 bp, Artificial Sequence
  Synthetic
ttagttaggtctgccatgg

SEQ ID NO: 29600 - DNA, 22 bp, Artificial Sequence
  Synthetic
gctctgatattgctttattgca

SEQ ID NO: 29601 - DNA, 24 bp, Artificial Sequence
  Synthetic
cacagcttttctattactacatct

SEQ ID NO: 29602 - DNA, 23 bp, Artificial Sequence
  Synthetic
caatagatacagcattaccatct

SEQ ID NO: 29603 - DNA, 20 bp, Artificial Sequence
  Synthetic
cctgatggggctgatgatga

SEQ ID NO: 29604 - DNA, 25 bp, Artificial Sequence
  Synthetic
gaccttttaaaattaggatgaatgg

SEQ ID NO: 29605 - DNA, 18 bp, Artificial Sequence
  Synthetic
tgggccttgtaactgatg

SEQ ID NO: 29606 - DNA, 25 bp, Artificial Sequence
  Synthetic
ttccaagtctactaaatctgactaa

SEQ ID NO: 29607 - DNA, 19 bp, Artificial Sequence
  Synthetic
tctgaacctgtttgggatc

SEQ ID NO: 29608 - DNA, 18 bp, Artificial Sequence
  Synthetic
tgctcccgttttgtgaaa

SEQ ID NO: 29609 - DNA, 18 bp, Artificial Sequence
  Synthetic
agccagtaacaaaagcgg

SEQ ID NO: 29610 - DNA, 22 bp, Artificial Sequence
  Synthetic
aactaaaaagtgtcctgagttc

SEQ ID NO: 29611 - DNA, 25 bp, Artificial Sequence
  Synthetic
gtgtcgtttcttatgtacaaatttg

SEQ ID NO: 29612 - DNA, 21 bp, Artificial Sequence
  Synthetic
attgcactacacaattaccac

SEQ ID NO: 29613 - DNA, 21 bp, Artificial Sequence
  Synthetic
gccttttgagttgaatcccta

SEQ ID NO: 29614 - DNA, 18 bp, Artificial Sequence
  Synthetic
ctcgaaacagcctttccc

SEQ ID NO: 29615 - DNA, 20 bp, Artificial Sequence
  Synthetic
cactactcggctagcagtct

SEQ ID NO: 29616 - DNA, 16 bp, Artificial Sequence
  Synthetic
tccacggggttgcgac

SEQ ID NO: 29617 - DNA, 16 bp, Artificial Sequence
  Synthetic
aaggcagcccctcctg

SEQ ID NO: 29618 - DNA, 18 bp, Artificial Sequence
  Synthetic
tacgaactgcaactgccg

SEQ ID NO: 29619 - DNA, 18 bp, Artificial Sequence
  Synthetic
actggaccgcagacatcc

SEQ ID NO: 29620 - DNA, 19 bp, Artificial Sequence
  Synthetic
acccacatctggtgtaggt

SEQ ID NO: 29621 - DNA, 20 bp, Artificial Sequence
  Synthetic
gccgtagaggtattgggtgt

SEQ ID NO: 29622 - DNA, 20 bp, Artificial Sequence
  Synthetic
acggactaagagtagtggcc

SEQ ID NO: 29623 - DNA, 20 bp, Artificial Sequence
  Synthetic
cccagtatcccgaagaggat

SEQ ID NO: 29624 - DNA, 20 bp, Artificial Sequence
  Synthetic
gctgataccggaagaacagc

SEQ ID NO: 29625 - DNA, 20 bp, Artificial Sequence
  Synthetic
cccaccaggtctttgtctac

SEQ ID NO: 29626 - DNA, 20 bp, Artificial Sequence
  Synthetic
gtggtctccaggttttcgac

SEQ ID NO: 29627 - DNA, 18 bp, Artificial Sequence
  Synthetic
cgtcggcgaagaacttgc

SEQ ID NO: 29628 - DNA, 18 bp, Artificial Sequence
  Synthetic
gtcatgagcgcgtcagtg

SEQ ID NO: 29629 - DNA, 20 bp, Artificial Sequence
  Synthetic
actcacagagcaccacagag

SEQ ID NO: 29630 - DNA, 18 bp, Artificial Sequence
  Synthetic
gtctgcggacatgcaagc

SEQ ID NO: 29631 - DNA, 16 bp, Artificial Sequence
  Synthetic
aacgacgaacgcggtg

SEQ ID NO: 29632 - DNA, 18 bp, Artificial Sequence
  Synthetic
atgattgccccgggaagc

SEQ ID NO: 29633 - DNA, 18 bp, Artificial Sequence
  Synthetic
cagatatcgtcgctccgc

SEQ ID NO: 29634 - DNA, 20 bp, Artificial Sequence
  Synthetic
ccacggagaaagtaacctcc

SEQ ID NO: 29635 - DNA, 20 bp, Artificial Sequence
  Synthetic
catgcactgtctccatagca

SEQ ID NO: 29636 - DNA, 18 bp, Artificial Sequence
  Synthetic
cggccatgacttgggaca

SEQ ID NO: 29637 - DNA, 20 bp, Artificial Sequence
  Synthetic
tggcgtaataaggtgttgct

SEQ ID NO: 29638 - DNA, 20 bp, Artificial Sequence
  Synthetic
tcggcaatggggtatcagag

SEQ ID NO: 29639 - DNA, 20 bp, Artificial Sequence
  Synthetic
ggagtacctggtcatagcct

SEQ ID NO: 29640 - DNA, 20 bp, Artificial Sequence
  Synthetic
agatccagcggagtaacaga

SEQ ID NO: 29641 - DNA, 18 bp, Artificial Sequence
  Synthetic
ggacaagtccagccggtc

SEQ ID NO: 29642 - DNA, 19 bp, Artificial Sequence
  Synthetic
tgatgatcgactgcaacac

SEQ ID NO: 29643 - DNA, 19 bp, Artificial Sequence
  Synthetic
ggccgtgattggtgcttaa

SEQ ID NO: 29644 - DNA, 19 bp, Artificial Sequence
  Synthetic
gagatgcaacagggtacac

SEQ ID NO: 29645 - DNA, 21 bp, Artificial Sequence
  Synthetic
cgactcagtatctcaaggaga

SEQ ID NO: 29646 - DNA, 18 bp, Artificial Sequence
  Synthetic
tttgctgcatcaagtgtg

SEQ ID NO: 29647 - DNA, 21 bp, Artificial Sequence
  Synthetic
taggcctgagtttttcaacag

SEQ ID NO: 29648 - DNA, 18 bp, Artificial Sequence
  Synthetic
gagtagttgcagctgctc

SEQ ID NO: 29649 - DNA, 20 bp, Artificial Sequence
  Synthetic
tcttctccaaaggttacacc

SEQ ID NO: 29650 - DNA, 18 bp, Artificial Sequence
  Synthetic
caccaaattccagaggga

SEQ ID NO: 29651 - DNA, 18 bp, Artificial Sequence
  Synthetic
ccttttgcatggcaccat

SEQ ID NO: 29652 - DNA, 19 bp, Artificial Sequence
  Synthetic
ccatgacaacctgctcata

SEQ ID NO: 29653 - DNA, 19 bp, Artificial Sequence
  Synthetic
gagagcatctcagtagtgc

SEQ ID NO: 29654 - DNA, 19 bp, Artificial Sequence
  Synthetic
tagtcaacgatgccctctt

SEQ ID NO: 29655 - DNA, 22 bp, Artificial Sequence
  Synthetic
ctgaataggaccaatctctgta

SEQ ID NO: 29656 - DNA, 19 bp, Artificial Sequence
  Synthetic
accaccaacttgaggaaat

SEQ ID NO: 29657 - DNA, 20 bp, Artificial Sequence
  Synthetic
cacacacatggaatggaaac

SEQ ID NO: 29658 - DNA, 22 bp, Artificial Sequence
  Synthetic
attttggttcaatctctgtgta

SEQ ID NO: 29659 - DNA, 21 bp, Artificial Sequence
  Synthetic
ggttaatgtgccaaacaattg

SEQ ID NO: 29660 - DNA, 23 bp, Artificial Sequence
  Synthetic
tcttaatggtaatgcttgtgttt

SEQ ID NO: 29661 - DNA, 19 bp, Artificial Sequence
  Synthetic
gaaatcgtcacctgaatgg

SEQ ID NO: 29662 - DNA, 19 bp, Artificial Sequence
  Synthetic
ttgcgcttatagcacatca

SEQ ID NO: 29663 - DNA, 21 bp, Artificial Sequence
  Synthetic
ggatgtctctcataggtcttt

SEQ ID NO: 29664 - DNA, 21 bp, Artificial Sequence
  Synthetic
acacgaatgtagaaaggacac

SEQ ID NO: 29665 - DNA, 21 bp, Artificial Sequence
  Synthetic
tgtctagttgtagcacaagtt

SEQ ID NO: 29666 - DNA, 20 bp, Artificial Sequence
  Synthetic
tgatagcagctactacaggg

SEQ ID NO: 29667 - DNA, 18 bp, Artificial Sequence
  Synthetic
ctaacagaaccctccagg

SEQ ID NO: 29668 - DNA, 19 bp, Artificial Sequence
  Synthetic
actcaccaaaaacacgtct

SEQ ID NO: 29669 - DNA, 23 bp, Artificial Sequence
  Synthetic
ccactgaaatacttgtacttgtt

SEQ ID NO: 29670 - DNA, 21 bp, Artificial Sequence
  Synthetic
gttccacaggttacttgtacc

SEQ ID NO: 29671 - DNA, 20 bp, Artificial Sequence
  Synthetic
cactgataaacaccagatgg

SEQ ID NO: 29672 - DNA, 19 bp, Artificial Sequence
  Synthetic
ctttcaaagcagcacacat

SEQ ID NO: 29673 - DNA, 18 bp, Artificial Sequence
  Synthetic
caagcagcatagcacatg

SEQ ID NO: 29674 - DNA, 19 bp, Artificial Sequence
  Synthetic
ctgtaaggtgttgccagta

SEQ ID NO: 29675 - DNA, 19 bp, Artificial Sequence
  Synthetic
taccacagatgtgcacttt

SEQ ID NO: 29676 - DNA, 19 bp, Artificial Sequence
  Synthetic
aagcggcatatgatggtaa

SEQ ID NO: 29677 - DNA, 21 bp, Artificial Sequence
  Synthetic
cgcattgttgataatgttgtt

SEQ ID NO: 29678 - DNA, 23 bp, Artificial Sequence
  Synthetic
gaattgttatagtaggcaagtgc

SEQ ID NO: 29679 - DNA, 24 bp, Artificial Sequence
  Synthetic
taggtaatccttatatgctttagc

SEQ ID NO: 29680 - DNA, 18 bp, Artificial Sequence
  Synthetic
gactgcatcaagggttcg

SEQ ID NO: 29681 - DNA, 22 bp, Artificial Sequence
  Synthetic
ttaccctcatcaaaatgacgta

SEQ ID NO: 29682 - DNA, 18 bp, Artificial Sequence
  Synthetic
caataggaactccgcagc

SEQ ID NO: 29683 - DNA, 20 bp, Artificial Sequence
  Synthetic
caacaaaaggaacaccatct

SEQ ID NO: 29684 - DNA, 23 bp, Artificial Sequence
  Synthetic
gaagtgttttagttcaacagaac

SEQ ID NO: 29685 - DNA, 20 bp, Artificial Sequence
  Synthetic
ccgtaaaacttgcttgttcc

SEQ ID NO: 29686 - DNA, 19 bp, Artificial Sequence
  Synthetic
atgatgttccacctggttt

SEQ ID NO: 29687 - DNA, 22 bp, Artificial Sequence
  Synthetic
actgccttaaagttcttaatgc

SEQ ID NO: 29688 - DNA, 25 bp, Artificial Sequence
  Synthetic
gtgttatcattagttagcattacgg

SEQ ID NO: 29689 - DNA, 23 bp, Artificial Sequence
  Synthetic
gcaataatagctcatacctccta

SEQ ID NO: 29690 - DNA, 19 bp, Artificial Sequence
  Synthetic
aacctcccatgaaagatgc

SEQ ID NO: 29691 - DNA, 18 bp, Artificial Sequence
  Synthetic
cttaccagtaccaggtgg

SEQ ID NO: 29692 - DNA, 19 bp, Artificial Sequence
  Synthetic
cctttagtcagcaatgtgc

SEQ ID NO: 29693 - DNA, 24 bp, Artificial Sequence
  Synthetic
gagataaaaacagcttttctccaa

SEQ ID NO: 29694 - DNA, 23 bp, Artificial Sequence
  Synthetic
atgaagaccagtaatgatcttac

SEQ ID NO: 29695 - DNA, 21 bp, Artificial Sequence
  Synthetic
cctgtagaaaatcctagctgg

SEQ ID NO: 29696 - DNA, 21 bp, Artificial Sequence
  Synthetic
tgaagtagaaaagcaagttgc

SEQ ID NO: 29697 - DNA, 19 bp, Artificial Sequence
  Synthetic
attctacttcagcctgagg

SEQ ID NO: 29698 - DNA, 21 bp, Artificial Sequence
  Synthetic
gtaaaagaaaggcaattgctt

SEQ ID NO: 29699 - DNA, 21 bp, Artificial Sequence
  Synthetic
acctttgtgtaaacagcatta

SEQ ID NO: 29700 - DNA, 23 bp, Artificial Sequence
  Synthetic
tgttattaaaacaccattacggg

SEQ ID NO: 29701 - DNA, 19 bp, Artificial Sequence
  Synthetic
aatgaagaccgccaagttg

SEQ ID NO: 29702 - DNA, 18 bp, Artificial Sequence
  Synthetic
gttaggcatcgcaacacc

SEQ ID NO: 29703 - DNA, 22 bp, Artificial Sequence
  Synthetic
ctagggtcatacatatcgctaa

SEQ ID NO: 29704 - DNA, 22 bp, Artificial Sequence
  Synthetic
ggaagacaactggataggattt

SEQ ID NO: 29705 - DNA, 25 bp, Artificial Sequence
  Synthetic
ctcgtaagtgtttaaaattacctga

SEQ ID NO: 29706 - DNA, 19 bp, Artificial Sequence
  Synthetic
cagagcatttgagttcagc

SEQ ID NO: 29707 - DNA, 20 bp, Artificial Sequence
  Synthetic
gcaataacaccagtttgtcc

SEQ ID NO: 29708 - DNA, 21 bp, Artificial Sequence
  Synthetic
ccggtgcatttaaaagttcaa

SEQ ID NO: 29709 - DNA, 21 bp, Artificial Sequence
  Synthetic
cagtagaatatatgcgccaag

SEQ ID NO: 29710 - DNA, 19 bp, Artificial Sequence
  Synthetic
gtagaatctccgcagatgt

SEQ ID NO: 29711 - DNA, 18 bp, Artificial Sequence
  Synthetic
atcagtgagcagaggtgg

SEQ ID NO: 29712 - DNA, 23 bp, Artificial Sequence
  Synthetic
gctaagttgtttaacaagtgtgt

SEQ ID NO: 29713 - DNA, 19 bp, Artificial Sequence
  Synthetic
gagggaagtatgctttgcc

SEQ ID NO: 29714 - DNA, 22 bp, Artificial Sequence
  Synthetic
ttttgaatgttgacgacagaag

SEQ ID NO: 29715 - DNA, 22 bp, Artificial Sequence
  Synthetic
taatttgacacccttgagaact

SEQ ID NO: 29716 - DNA, 20 bp, Artificial Sequence
  Synthetic
atcaaggcatagaggtacaa

SEQ ID NO: 29717 - DNA, 22 bp, Artificial Sequence
  Synthetic
tgtagcattttcaataccagtg

SEQ ID NO: 29718 - DNA, 21 bp, Artificial Sequence
  Synthetic
cacgttaacaatattgcagca

SEQ ID NO: 29719 - DNA, 22 bp, Artificial Sequence
  Synthetic
attaattctgtagacagcagca

SEQ ID NO: 29720 - DNA, 20 bp, Artificial Sequence
  Synthetic
gcaaaacctgaatcagtgcc

SEQ ID NO: 29721 - DNA, 18 bp, Artificial Sequence
  Synthetic
ttgccctcgtatgttcct

SEQ ID NO: 29722 - DNA, 20 bp, Artificial Sequence
  Synthetic
acctttcctagagcacaaag

SEQ ID NO: 29723 - DNA, 19 bp, Artificial Sequence
  Synthetic
ctccttgccatgctgagtg

SEQ ID NO: 29724 - DNA, 20 bp, Artificial Sequence
  Synthetic
tctgcgtagaagccttttgg

SEQ ID NO: 29725 - DNA, 20 bp, Artificial Sequence
  Synthetic
tgagtgacgttgtactgttt

SEQ ID NO: 29726 - DNA, 23 bp, Artificial Sequence
  Synthetic
cagtctttttctttttgtccttt

SEQ ID NO: 29727 - DNA, 18 bp, Artificial Sequence
  Synthetic
taccctcgatcgtactcc

SEQ ID NO: 29728 - DNA, 19 bp, Artificial Sequence
  Synthetic
catatcctcattgaccggg

SEQ ID NO: 29729 - DNA, 20 bp, Artificial Sequence
  Synthetic
aaggttagccacattcaggg

SEQ ID NO: 29730 - DNA, 24 bp, Artificial Sequence
  Synthetic
gctgcgtctttaaaataattgatg

SEQ ID NO: 29731 - DNA, 19 bp, Artificial Sequence
  Synthetic
acaccataagcaacaactg

SEQ ID NO: 29732 - DNA, 23 bp, Artificial Sequence
  Synthetic
ctgatgaaacttgctagaattac

SEQ ID NO: 29733 - DNA, 24 bp, Artificial Sequence
  Synthetic
gtaaaataagggtagctgaattgt

SEQ ID NO: 29734 - DNA, 18 bp, Artificial Sequence
  Synthetic
aaacgctgatggggattg

SEQ ID NO: 29735 - DNA, 18 bp, Artificial Sequence
  Synthetic
aaagcgcagactaccagt

SEQ ID NO: 29736 - DNA, 22 bp, Artificial Sequence
  Synthetic
ggtgtagtgaatctaaaatggc

SEQ ID NO: 29737 - DNA, 18 bp, Artificial Sequence
  Synthetic
tttccgcagcatccaatg

SEQ ID NO: 29738 - DNA, 22 bp, Artificial Sequence
  Synthetic
gctcataaaagggattgtgaat

SEQ ID NO: 29739 - DNA, 18 bp, Artificial Sequence
  Synthetic
atctgagttgtggcctca

SEQ ID NO: 29740 - DNA, 21 bp, Artificial Sequence
  Synthetic
ccaatcatgtgcagtaactct

SEQ ID NO: 29741 - DNA, 19 bp, Artificial Sequence
  Synthetic
cgaagcctacaccaaagac

SEQ ID NO: 29742 - DNA, 22 bp, Artificial Sequence
  Synthetic
cacgcttcagtaaatttcttga

SEQ ID NO: 29743 - DNA, 21 bp, Artificial Sequence
  Synthetic
cttcaccactaggattttgca

SEQ ID NO: 29744 - DNA, 23 bp, Artificial Sequence
  Synthetic
tttgccatctaaaagatactctt

SEQ ID NO: 29745 - DNA, 18 bp, Artificial Sequence
  Synthetic
caaactcttcctctgggc

SEQ ID NO: 29746 - DNA, 23 bp, Artificial Sequence
  Synthetic
tctgatgtctttaaacttctcat

SEQ ID NO: 29747 - DNA, 23 bp, Artificial Sequence
  Synthetic
aaataagatttgagaagcattgc

SEQ ID NO: 29748 - DNA, 21 bp, Artificial Sequence
  Synthetic
attctccatctagcatgagag

SEQ ID NO: 29749 - DNA, 20 bp, Artificial Sequence
  Synthetic
ggtttttggtccatctgatg

SEQ ID NO: 29750 - DNA, 19 bp, Artificial Sequence
  Synthetic
cacccagaacaaagcaaat

SEQ ID NO: 29751 - DNA, 20 bp, Artificial Sequence
  Synthetic
aaaatggaaagcacttctgc

SEQ ID NO: 29752 - DNA, 22 bp, Artificial Sequence
  Synthetic
tgtttgctcagatttaacatct

SEQ ID NO: 29753 - DNA, 25 bp, Artificial Sequence
  Synthetic
gcaaacctaaattagaatatccttc

SEQ ID NO: 29754 - DNA, 18 bp, Artificial Sequence
  Synthetic
tatgtggtgttcgaggtg

SEQ ID NO: 29755 - DNA, 20 bp, Artificial Sequence
  Synthetic
tgggtaaagtcacagtttct

SEQ ID NO: 29756 - DNA, 18 bp, Artificial Sequence
  Synthetic
ttctccccctactcctgg

SEQ ID NO: 29757 - DNA, 18 bp, Artificial Sequence
  Synthetic
tacatctgggtcaaaggc

SEQ ID NO: 29758 - DNA, 25 bp, Artificial Sequence
  Synthetic
ctcaactggtaaattatttggtagt

SEQ ID NO: 29759 - DNA, 20 bp, Artificial Sequence
  Synthetic
cctgtagaaccaacacctaa

SEQ ID NO: 29760 - DNA, 23 bp, Artificial Sequence
  Synthetic
gtctctagtatcatccacctttc

SEQ ID NO: 29761 - DNA, 19 bp, Artificial Sequence
  Synthetic
ggcacatagttgccaaaga

SEQ ID NO: 29762 - DNA, 18 bp, Artificial Sequence
  Synthetic
gttgtccagatgtccagc

SEQ ID NO: 29763 - DNA, 19 bp, Artificial Sequence
  Synthetic
gatttgttggctcctcctc

SEQ ID NO: 29764 - DNA, 23 bp, Artificial Sequence
  Synthetic
tgctttgttcaaataagtcatct

SEQ ID NO: 29765 - DNA, 20 bp, Artificial Sequence
  Synthetic
tcaattccactgtcctgaaa

SEQ ID NO: 29766 - DNA, 23 bp, Artificial Sequence
  Synthetic
ctttctacttagttcccaatgtt

SEQ ID NO: 29767 - DNA, 19 bp, Artificial Sequence
  Synthetic
cggtgaggattctctatgc

SEQ ID NO: 29768 - DNA, 20 bp, Artificial Sequence
  Synthetic
attgtgcgacggaactgatc

SEQ ID NO: 29769 - DNA, 20 bp, Artificial Sequence
  Synthetic
tccagtgtctgtaatgggaa

SEQ ID NO: 29770 - DNA, 21 bp, Artificial Sequence
  Synthetic
aatgtatatgtcacgtcatcg

SEQ ID NO: 29771 - DNA, 19 bp, Artificial Sequence
  Synthetic
caggctgtaaatacgaccg

SEQ ID NO: 29772 - DNA, 23 bp, Artificial Sequence
  Synthetic
gttttttatccattccaaagcag

SEQ ID NO: 29773 - DNA, 20 bp, Artificial Sequence
  Synthetic
tcagggtttaggtacatgac

SEQ ID NO: 29774 - DNA, 21 bp, Artificial Sequence
  Synthetic
caatgttgttttgcagctctt

SEQ ID NO: 29775 - DNA, 19 bp, Artificial Sequence
  Synthetic
ccaattccaccaaccattc

SEQ ID NO: 29776 - DNA, 18 bp, Artificial Sequence
  Synthetic
atgtgagtgagaccagca

SEQ ID NO: 29777 - DNA, 18 bp, Artificial Sequence
  Synthetic
catatccactggccacgg

SEQ ID NO: 29778 - DNA, 21 bp, Artificial Sequence
  Synthetic
ccattgtttccatgttctcat

SEQ ID NO: 29779 - DNA, 23 bp, Artificial Sequence
  Synthetic
caatcattaggtcttcttcgaaa

SEQ ID NO: 29780 - DNA, 25 bp, Artificial Sequence
  Synthetic
gcatttggattttctaatagtacag

SEQ ID NO: 29781 - DNA, 20 bp, Artificial Sequence
  Synthetic
atttctttgacggtaacacc

SEQ ID NO: 29782 - DNA, 21 bp, Artificial Sequence
  Synthetic
tattgaaaacaacctccgtct

SEQ ID NO: 29783 - DNA, 20 bp, Artificial Sequence
  Synthetic
gactttcatggttgcagtac

SEQ ID NO: 29784 - DNA, 22 bp, Artificial Sequence
  Synthetic
aggtgtaatcaattctgtcaat

SEQ ID NO: 29785 - DNA, 22 bp, Artificial Sequence
  Synthetic
acctttaacaacttttgcttca

SEQ ID NO: 29786 - DNA, 22 bp, Artificial Sequence
  Synthetic
tgctgtaaaataggttccaagg

SEQ ID NO: 29787 - DNA, 23 bp, Artificial Sequence
  Synthetic
ataaaagtacttcctatctgtgc

SEQ ID NO: 29788 - DNA, 22 bp, Artificial Sequence
  Synthetic
ctctgtcaagagttaacgaaat

SEQ ID NO: 29789 - DNA, 21 bp, Artificial Sequence
  Synthetic
cgtaaaatggaaactgaagca

SEQ ID NO: 29790 - DNA, 21 bp, Artificial Sequence
  Synthetic
gtttgagaggtaagataaggc

SEQ ID NO: 29791 - DNA, 18 bp, Artificial Sequence
  Synthetic
gacggtttagtggaggtc

SEQ ID NO: 29792 - DNA, 25 bp, Artificial Sequence
  Synthetic
gattttattaacacccactacacta

SEQ ID NO: 29793 - DNA, 18 bp, Artificial Sequence
  Synthetic
gggcgtctagttggacta

SEQ ID NO: 29794 - DNA, 20 bp, Artificial Sequence
  Synthetic
gcatgtaacacattcccaaa

SEQ ID NO: 29795 - DNA, 19 bp, Artificial Sequence
  Synthetic
ttcggctgttatacccatg

SEQ ID NO: 29796 - DNA, 18 bp, Artificial Sequence
  Synthetic
ataaaattgccgctgctc

SEQ ID NO: 29797 - DNA, 24 bp, Artificial Sequence
  Synthetic
catttctgctaataaggtgactaa

SEQ ID NO: 29798 - DNA, 18 bp, Artificial Sequence
  Synthetic
tttttccaacaccgcgat

SEQ ID NO: 29799 - DNA, 19 bp, Artificial Sequence
  Synthetic
atttgcttttcggtgatgc

SEQ ID NO: 29800 - DNA, 22 bp, Artificial Sequence
  Synthetic
accaatacatacaaagaccaaa

SEQ ID NO: 29801 - DNA, 25 bp, Artificial Sequence
  Synthetic
cagttataattacatgcttaaaggc

SEQ ID NO: 29802 - DNA, 20 bp, Artificial Sequence
  Synthetic
tgttaataacgccaatagcc

SEQ ID NO: 29803 - DNA, 20 bp, Artificial Sequence
  Synthetic
gccttattttttgcagcaag

SEQ ID NO: 29804 - DNA, 25 bp, Artificial Sequence
  Synthetic
cgccattagtcaaaatataatccaa

SEQ ID NO: 29805 - DNA, 25 bp, Artificial Sequence
  Synthetic
caacttctttaaaatctacttcacc

SEQ ID NO: 29806 - DNA, 20 bp, Artificial Sequence
  Synthetic
ctgaactcacccttgtcaaa

SEQ ID NO: 29807 - DNA, 18 bp, Artificial Sequence
  Synthetic
tttggcatcttgacctgc

SEQ ID NO: 29808 - DNA, 21 bp, Artificial Sequence
  Synthetic
acagattgtttgaaagactgg

SEQ ID NO: 29809 - DNA, 20 bp, Artificial Sequence
  Synthetic
aaaagtggtgtcatcaaaca

SEQ ID NO: 29810 - DNA, 22 bp, Artificial Sequence
  Synthetic
agtgtcaccgtattttacagta

SEQ ID NO: 29811 - DNA, 20 bp, Artificial Sequence
  Synthetic
gttgggacatcagatggtgt

SEQ ID NO: 29812 - DNA, 18 bp, Artificial Sequence
  Synthetic
cctggacggtaaccacta

SEQ ID NO: 29813 - DNA, 19 bp, Artificial Sequence
  Synthetic
aaaaactcacgcctaaacg

SEQ ID NO: 29814 - DNA, 20 bp, Artificial Sequence
  Synthetic
cgaataaggaaaacagctgc

SEQ ID NO: 29815 - DNA, 19 bp, Artificial Sequence
  Synthetic
gactgtttaccgagcgtat

SEQ ID NO: 29816 - DNA, 21 bp, Artificial Sequence
  Synthetic
ccacctgaatatcagtgactt

SEQ ID NO: 29817 - DNA, 20 bp, Artificial Sequence
  Synthetic
tgttttatggttgctgtagc

SEQ ID NO: 29818 - DNA, 18 bp, Artificial Sequence
  Synthetic
tcaacaggtaccccaagg

SEQ ID NO: 29819 - DNA, 21 bp, Artificial Sequence
  Synthetic
aagaatatggccgttgacaaa

SEQ ID NO: 29820 - DNA, 18 bp, Artificial Sequence
  Synthetic
aaaatcagccgccttagt

SEQ ID NO: 29821 - DNA, 21 bp, Artificial Sequence
  Synthetic
aattgccaacaaatctctgta

SEQ ID NO: 29822 - DNA, 18 bp, Artificial Sequence
  Synthetic
atctggtagggccgtaaa

SEQ ID NO: 29823 - DNA, 21 bp, Artificial Sequence
  Synthetic
tctcacaagtacctcaatcag

SEQ ID NO: 29824 - DNA, 21 bp, Artificial Sequence
  Synthetic
tcacttcacaggattcgtaaa

SEQ ID NO: 29825 - DNA, 18 bp, Artificial Sequence
  Synthetic
ttcaatactggccaggct

SEQ ID NO: 29826 - DNA, 20 bp, Artificial Sequence
  Synthetic
cctacagtagaaccaggaaa

SEQ ID NO: 29827 - DNA, 18 bp, Artificial Sequence
  Synthetic
tcgagtttgatgccacag

SEQ ID NO: 29828 - DNA, 24 bp, Artificial Sequence
  Synthetic
agacgtattcttaactgtcttgaa

SEQ ID NO: 29829 - DNA, 22 bp, Artificial Sequence
  Synthetic
accagtctgtaaactagacaaa

SEQ ID NO: 29830 - DNA, 20 bp, Artificial Sequence
  Synthetic
acaggtgcttctaaggtaac

SEQ ID NO: 29831 - DNA, 23 bp, Artificial Sequence
  Synthetic
agttctaattgtgagaactgttt

SEQ ID NO: 29832 - DNA, 23 bp, Artificial Sequence
  Synthetic
ttgaaaacatcactcaattgtca

SEQ ID NO: 29833 - DNA, 18 bp, Artificial Sequence
  Synthetic
aaagcccgagataatgcc

SEQ ID NO: 29834 - DNA, 19 bp, Artificial Sequence
  Synthetic
gcatcctcatgaagtgtca

SEQ ID NO: 29835 - DNA, 19 bp, Artificial Sequence
  Synthetic
acgtcctgaaaaggcaata

SEQ ID NO: 29836 - DNA, 23 bp, Artificial Sequence
  Synthetic
cgacaacaaaatctttaagcaat

SEQ ID NO: 29837 - DNA, 18 bp, Artificial Sequence
  Synthetic
caagattgctgacggctt

SEQ ID NO: 29838 - DNA, 23 bp, Artificial Sequence
  Synthetic
aatttcctctattccatttttcg

SEQ ID NO: 29839 - DNA, 23 bp, Artificial Sequence
  Synthetic
ttaaaaccactttttcttgctca

SEQ ID NO: 29840 - DNA, 20 bp, Artificial Sequence
  Synthetic
tcaagtctccattgctgttt

SEQ ID NO: 29841 - DNA, 21 bp, Artificial Sequence
  Synthetic
ccataagcttttccagacaaa

SEQ ID NO: 29842 - DNA, 24 bp, Artificial Sequence
  Synthetic
tgtaaatcataaattctcgttggg

SEQ ID NO: 29843 - DNA, 25 bp, Artificial Sequence
  Synthetic
ccataaatatcaagatctgtctgtt

SEQ ID NO: 29844 - DNA, 23 bp, Artificial Sequence
  Synthetic
gaccatttttaattttgccaaag

SEQ ID NO: 29845 - DNA, 23 bp, Artificial Sequence
  Synthetic
aacattttcaaatatagtggcgg

SEQ ID NO: 29846 - DNA, 18 bp, Artificial Sequence
  Synthetic
atcaatacggccatagcg

SEQ ID NO: 29847 - DNA, 20 bp, Artificial Sequence
  Synthetic
agcttggtcaaaaaacttgg

SEQ ID NO: 29848 - DNA, 18 bp, Artificial Sequence
  Synthetic
cgaattcttggcacagct

SEQ ID NO: 29849 - DNA, 20 bp, Artificial Sequence
  Synthetic
gccgtaaactcctctttagg

SEQ ID NO: 29850 - DNA, 22 bp, Artificial Sequence
  Synthetic
ctttccttatataagcctctgg

SEQ ID NO: 29851 - DNA, 18 bp, Artificial Sequence
  Synthetic
ttcatcggtagcgcttac

SEQ ID NO: 29852 - DNA, 23 bp, Artificial Sequence
  Synthetic
tcaacccaaatattgttttttgg

SEQ ID NO: 29853 - DNA, 22 bp, Artificial Sequence
  Synthetic
tctgttcttctttaaaggctcc

SEQ ID NO: 29854 - DNA, 18 bp, Artificial Sequence
  Synthetic
atcggtgggttttccttt

SEQ ID NO: 29855 - DNA, 25 bp, Artificial Sequence
  Synthetic
ctccaaatagcaagatatcaatgtc

SEQ ID NO: 29856 - DNA, 20 bp, Artificial Sequence
  Synthetic
caaaacaagccaaggcatat

SEQ ID NO: 29857 - DNA, 20 bp, Artificial Sequence
  Synthetic
agccatatccctagctgaaa

SEQ ID NO: 29858 - DNA, 23 bp, Artificial Sequence
  Synthetic
tctgccacattaatcataaaacc

SEQ ID NO: 29859 - DNA, 25 bp, Artificial Sequence
  Synthetic
gttaccaactttattagaacctgta

SEQ ID NO: 29860 - DNA, 20 bp, Artificial Sequence
  Synthetic
tctgtcttgacaatgggtat

SEQ ID NO: 29861 - DNA, 20 bp, Artificial Sequence
  Synthetic
ggggtctgtgtcttgtttgt

SEQ ID NO: 29862 - DNA, 18 bp, Artificial Sequence
  Synthetic
gtgtaaaaaatgcggccg

SEQ ID NO: 29863 - DNA, 23 bp, Artificial Sequence
  Synthetic
aacattgttacacatatgggata

SEQ ID NO: 29864 - DNA, 20 bp, Artificial Sequence
  Synthetic
caaagtcaagagcaagactc

SEQ ID NO: 29865 - DNA, 18 bp, Artificial Sequence
  Synthetic
gtggtggttcaggtacag

SEQ ID NO: 29866 - DNA, 22 bp, Artificial Sequence
  Synthetic
tgagcttagagaggaagacttt

SEQ ID NO: 29867 - DNA, 23 bp, Artificial Sequence
  Synthetic
ctaaaagataagcgtcaagaagg

SEQ ID NO: 29868 - DNA, 20 bp, Artificial Sequence
  Synthetic
tgttctggtgaaggaatgtt

SEQ ID NO: 29869 - DNA, 20 bp, Artificial Sequence
  Synthetic
acaaacaggtctcttgagaa

SEQ ID NO: 29870 - DNA, 23 bp, Artificial Sequence
  Synthetic
cttatgaagaccaactgactttc

SEQ ID NO: 29871 - DNA, 18 bp, Artificial Sequence
  Synthetic
acgtgaccatcccagaaa

SEQ ID NO: 29872 - DNA, 19 bp, Artificial Sequence
  Synthetic
aaccaaaccatcgaagttg

SEQ ID NO: 29873 - DNA, 18 bp, Artificial Sequence
  Synthetic
tcaatgtcggcaaccatg

SEQ ID NO: 29874 - DNA, 22 bp, Artificial Sequence
  Synthetic
cttacagctcgtagacctatag

SEQ ID NO: 29875 - DNA, 19 bp, Artificial Sequence
  Synthetic
cggtatgtctattgcagct

SEQ ID NO: 29876 - DNA, 22 bp, Artificial Sequence
  Synthetic
ctacggtactatatggggctaa

SEQ ID NO: 29877 - DNA, 18 bp, Artificial Sequence
  Synthetic
atgggagcacagattgtc

SEQ ID NO: 29878 - DNA, 19 bp, Artificial Sequence
  Synthetic
ctgctcaggttaagtcagc

SEQ ID NO: 29879 - DNA, 24 bp, Artificial Sequence
  Synthetic
tcaagaggatattttagaagcttg

SEQ ID NO: 29880 - DNA, 18 bp, Artificial Sequence
  Synthetic
gcaacgattactgacgct

SEQ ID NO: 29881 - DNA, 21 bp, Artificial Sequence
  Synthetic
gcatgctccatataaggctat

SEQ ID NO: 29882 - DNA, 20 bp, Artificial Sequence
  Synthetic
atcaatcatttggtggcaaa

SEQ ID NO: 29883 - DNA, 22 bp, Artificial Sequence
  Synthetic
gatcaatcactcttacccattt

SEQ ID NO: 29884 - DNA, 21 bp, Artificial Sequence
  Synthetic
agtacattgtgacagaacacc

SEQ ID NO: 29885 - DNA, 21 bp, Artificial Sequence
  Synthetic
aacctgtttattggtcatggt

SEQ ID NO: 29886 - DNA, 19 bp, Artificial Sequence
  Synthetic
ccttatgtacctggttggg

SEQ ID NO: 29887 - DNA, 18 bp, Artificial Sequence
  Synthetic
cacgagctttcgtccttt

SEQ ID NO: 29888 - DNA, 22 bp, Artificial Sequence
  Synthetic
ttgatgaaagcaataaggagtt

SEQ ID NO: 29889 - DNA, 21 bp, Artificial Sequence
  Synthetic
agacttcttctcagtgtcatt

SEQ ID NO: 29890 - DNA, 18 bp, Artificial Sequence
  Synthetic
gataagcgtgaggtcggt

SEQ ID NO: 29891 - DNA, 22 bp, Artificial Sequence
  Synthetic
tgggttatgaaaatagcacatt

SEQ ID NO: 29892 - DNA, 19 bp, Artificial Sequence
  Synthetic
ctgggttcagaacgtcgtg

SEQ ID NO: 29893 - DNA, 20 bp, Artificial Sequence
  Synthetic
ggttccctcagattggttgg

SEQ ID NO: 29894 - DNA, 20 bp, Artificial Sequence
  Synthetic
gcctcaggtgatcgagagaa

SEQ ID NO: 29895 - DNA, 20 bp, Artificial Sequence
  Synthetic
gccaacaggttgatattcct

SEQ ID NO: 29896 - DNA, 22 bp, Artificial Sequence
  Synthetic
gacaactaggatgttagcttag

SEQ ID NO: 29897 - DNA, 20 bp, Artificial Sequence
  Synthetic
ggaccatctcccaaccctaa

SEQ ID NO: 29898 - DNA, 20 bp, Artificial Sequence
  Synthetic
gatgattggggtgaagtcgt

SEQ ID NO: 29899 - DNA, 20 bp, Artificial Sequence
  Synthetic
gacggactttctgaagaaga

SEQ ID NO: 29900 - DNA, 20 bp, Artificial Sequence
  Synthetic
tcactaaattgatcgaccgc

SEQ ID NO: 29901 - DNA, 18 bp, Artificial Sequence
  Synthetic
tttgacgatctcactcgc

SEQ ID NO: 29902 - DNA, 21 bp, Artificial Sequence
  Synthetic
ggataagactgacaaggatga

SEQ ID NO: 29903 - DNA, 19 bp, Artificial Sequence
  Synthetic
aactcagcagtagcagttc

SEQ ID NO: 29904 - DNA, 18 bp, Artificial Sequence
  Synthetic
gaacatccagccgatagc

SEQ ID NO: 29905 - DNA, 18 bp, Artificial Sequence
  Synthetic
gagctcatgcagaaatgc

SEQ ID NO: 29906 - DNA, 22 bp, Artificial Sequence
  Synthetic
tgtgtcagttttaactcacaaa

SEQ ID NO: 29907 - DNA, 20 bp, Artificial Sequence
  Synthetic
gttcagcttagcaaccatga

SEQ ID NO: 29908 - DNA, 19 bp, Artificial Sequence
  Synthetic
aactcatgaaccagtaggg

SEQ ID NO: 29909 - DNA, 22 bp, Artificial Sequence
  Synthetic
tcaatgcattgatgattctgag

SEQ ID NO: 29910 - DNA, 18 bp, Artificial Sequence
  Synthetic
tatagccagacttgcggt

SEQ ID NO: 29911 - DNA, 22 bp, Artificial Sequence
  Synthetic
tttggagtgtcataactttcca

SEQ ID NO: 29912 - DNA, 20 bp, Artificial Sequence
  Synthetic
actcaacttgaaagcctaga

SEQ ID NO: 29913 - DNA, 23 bp, Artificial Sequence
  Synthetic
agtcttctagatttttggtcatt

SEQ ID NO: 29914 - DNA, 25 bp, Artificial Sequence
  Synthetic
ccgtaatgttttctactttcaaaga

SEQ ID NO: 29915 - DNA, 21 bp, Artificial Sequence
  Synthetic
catctgataacccaacctcac

SEQ ID NO: 29916 - DNA, 19 bp, Artificial Sequence
  Synthetic
tcataggctttgggttctt

SEQ ID NO: 29917 - DNA, 19 bp, Artificial Sequence
  Synthetic
caaaaccgtcaaagcgata

SEQ ID NO: 29918 - DNA, 21 bp, Artificial Sequence
  Synthetic
tctttaagggttgctagcttt

SEQ ID NO: 29919 - DNA, 20 bp, Artificial Sequence
  Synthetic
tgtcaatcgtgtctttgttg

SEQ ID NO: 29920 - DNA, 18 bp, Artificial Sequence
  Synthetic
gaacatggctatgcggtg

SEQ ID NO: 29921 - DNA, 18 bp, Artificial Sequence
  Synthetic
gttgggattcgggattgg

SEQ ID NO: 29922 - DNA, 23 bp, Artificial Sequence
  Synthetic
tcggtatagataaagtccacgta

SEQ ID NO: 29923 - DNA, 20 bp, Artificial Sequence
  Synthetic
gaaaacagcctgatagtctg

SEQ ID NO: 29924 - DNA, 24 bp, Artificial Sequence
  Synthetic
gcaaaacatataccttacacaaag

SEQ ID NO: 29925 - DNA, 22 bp, Artificial Sequence
  Synthetic
tacgctcaaaatggtatttcag

SEQ ID NO: 29926 - DNA, 24 bp, Artificial Sequence
  Synthetic
ctaacgtatatggctatacactag

SEQ ID NO: 29927 - DNA, 23 bp, Artificial Sequence
  Synthetic
ctatggtaaaacatttgggttag

SEQ ID NO: 29928 - DNA, 18 bp, Artificial Sequence
  Synthetic
acggtagctctgctcaag

SEQ ID NO: 29929 - DNA, 20 bp, Artificial Sequence
  Synthetic
agaggggagaagagctcaac

SEQ ID NO: 29930 - DNA, 17 bp, Artificial Sequence
  Synthetic
cataatgccggcagcgt

SEQ ID NO: 29931 - DNA, 20 bp, Artificial Sequence
  Synthetic
tatgtgactatcaggcgccc

SEQ ID NO: 29932 - DNA, 16 bp, Artificial Sequence
  Synthetic
atgcccgcccgcacta

SEQ ID NO: 29933 - DNA, 19 bp, Artificial Sequence
  Synthetic
tatgccttgcgtccgaatc

SEQ ID NO: 29934 - DNA, 19 bp, Artificial Sequence
  Synthetic
acatcctttacgcacagcc

SEQ ID NO: 29935 - DNA, 17 bp, Artificial Sequence
  Synthetic
cagccagttttgcgccg

SEQ ID NO: 29936 - DNA, 16 bp, Artificial Sequence
  Synthetic
agaagcccgcagaccc

SEQ ID NO: 29937 - DNA, 19 bp, Artificial Sequence
  Synthetic
gtcgaaggcctctggaaag

SEQ ID NO: 29938 - DNA, 20 bp, Artificial Sequence
  Synthetic
cttcgggagggacttggtat

SEQ ID NO: 29939 - DNA, 19 bp, Artificial Sequence
  Synthetic
aatcaccagcctcttgccc

SEQ ID NO: 29940 - DNA, 18 bp, Artificial Sequence
  Synthetic
ttcgaggtggtcatcccg

SEQ ID NO: 29941 - DNA, 20 bp, Artificial Sequence
  Synthetic
gggtgtaaagcttaccctgc

SEQ ID NO: 29942 - DNA, 18 bp, Artificial Sequence
  Synthetic
agttgagaaccgcagtgc

SEQ ID NO: 29943 - DNA, 18 bp, Artificial Sequence
  Synthetic
tagcagtgtaccgggctc

SEQ ID NO: 29944 - DNA, 18 bp, Artificial Sequence
  Synthetic
gagagcctccccaggaac

SEQ ID NO: 29945 - DNA, 20 bp, Artificial Sequence
  Synthetic
ggccaggtgtactccttcag

SEQ ID NO: 29946 - DNA, 17 bp, Artificial Sequence
  Synthetic
tcgggtacgacggcaac

SEQ ID NO: 29947 - DNA, 16 bp, Artificial Sequence
  Synthetic
acgacgagctctgcgg

SEQ ID NO: 29948 - DNA, 18 bp, Artificial Sequence
  Synthetic
ttgatcttgtgcggggct

SEQ ID NO: 29949 - DNA, 20 bp, Artificial Sequence
  Synthetic
aatgattgtcgcctcctcag

SEQ ID NO: 29950 - DNA, 24 bp, Artificial Sequence
  Synthetic
agcatagtagtataggtagaaaca

SEQ ID NO: 29951 - DNA, 24 bp, Artificial Sequence
  Synthetic
ggaacaccacttaaatatcaatgt

SEQ ID NO: 29952 - DNA, 25 bp, Artificial Sequence
  Synthetic
gggtctatcagaaaaaggtaaaatt

SEQ ID NO: 29953 - DNA, 20 bp, Artificial Sequence
  Synthetic
aaagtttcttagcaggtgtg

SEQ ID NO: 29954 - DNA, 22 bp, Artificial Sequence
  Synthetic
accaaggtttattgtttgtcaa

SEQ ID NO: 29955 - DNA, 22 bp, Artificial Sequence
  Synthetic
atcaccagtaaaaacaggatca

SEQ ID NO: 29956 - DNA, 23 bp, Artificial Sequence
  Synthetic
ggttattactctgcaagatagca

SEQ ID NO: 29957 - DNA, 24 bp, Artificial Sequence
  Synthetic
accactaataactacatatggaac

SEQ ID NO: 29958 - DNA, 24 bp, Artificial Sequence
  Synthetic
cattactaataggccattgtgaaa

SEQ ID NO: 29959 - DNA, 21 bp, Artificial Sequence
  Synthetic
aagcatcaatgtcaataggtg

SEQ ID NO: 29960 - DNA, 18 bp, Artificial Sequence
  Synthetic
aatagcacgtgcaacacc

SEQ ID NO: 29961 - DNA, 23 bp, Artificial Sequence
  Synthetic
aagtcaaacttgaaagaagcttt

SEQ ID NO: 29962 - DNA, 21 bp, Artificial Sequence
  Synthetic
gctttacatccaaagaagcaa

SEQ ID NO: 29963 - DNA, 21 bp, Artificial Sequence
  Synthetic
caacacgtccattaacaaact

SEQ ID NO: 29964 - DNA, 24 bp, Artificial Sequence
  Synthetic
gagtctttcctaccaaatatacat

SEQ ID NO: 29965 - DNA, 24 bp, Artificial Sequence
  Synthetic
gatgaactaaagattgagagtaca

SEQ ID NO: 29966 - DNA, 20 bp, Artificial Sequence
  Synthetic
tctctcaacacaaccagatg

SEQ ID NO: 29967 - DNA, 20 bp, Artificial Sequence
  Synthetic
accttaatacgcaacacaga

SEQ ID NO: 29968 - DNA, 19 bp, Artificial Sequence
  Synthetic
gcagcatacaaaaaggcaa

SEQ ID NO: 29969 - DNA, 20 bp, Artificial Sequence
  Synthetic
gtcaccaccaataccaagta

SEQ ID NO: 29970 - DNA, 19 bp, Artificial Sequence
  Synthetic
tgagtagcagcttgttcag

SEQ ID NO: 29971 - DNA, 22 bp, Artificial Sequence
  Synthetic
gcttaagtttaccaggcataat

SEQ ID NO: 29972 - DNA, 20 bp, Artificial Sequence
  Synthetic
tgcaccatgtttaacagctt

SEQ ID NO: 29973 - DNA, 25 bp, Artificial Sequence
  Synthetic
cttgctcgtttaaataagaaatgtc

SEQ ID NO: 29974 - DNA, 22 bp, Artificial Sequence
  Synthetic
gcatagaccaagtccatcatag

SEQ ID NO: 29975 - DNA, 25 bp, Artificial Sequence
  Synthetic
cttggttatctaatgttaaaacacc

SEQ ID NO: 29976 - DNA, 18 bp, Artificial Sequence
  Synthetic
ttgatcaacgagtgctgg

SEQ ID NO: 29977 - DNA, 23 bp, Artificial Sequence
  Synthetic
atgtttttgatggtattgtcttg

SEQ ID NO: 29978 - DNA, 19 bp, Artificial Sequence
  Synthetic
tcgtaccacctggcttaaa

SEQ ID NO: 29979 - DNA, 23 bp, Artificial Sequence
  Synthetic
tgtcttaacaacatcatcaacaa

SEQ ID NO: 29980 - DNA, 20 bp, Artificial Sequence
  Synthetic
acatgatcatatgcgcattt

SEQ ID NO: 29981 - DNA, 20 bp, Artificial Sequence
  Synthetic
ggaggaccctgtattgtagt

SEQ ID NO: 29982 - DNA, 20 bp, Artificial Sequence
  Synthetic
gacacacaaccttcagtttg

SEQ ID NO: 29983 - DNA, 18 bp, Artificial Sequence
  Synthetic
taacagcatcaccagagg

SEQ ID NO: 29984 - DNA, 23 bp, Artificial Sequence
  Synthetic
acacaattgaaaattctggatac

SEQ ID NO: 29985 - DNA, 21 bp, Artificial Sequence
  Synthetic
acaacaccgagatttttgaga

SEQ ID NO: 29986 - DNA, 19 bp, Artificial Sequence
  Synthetic
ggcatagcataaccacact

SEQ ID NO: 29987 - DNA, 23 bp, Artificial Sequence
  Synthetic
tgcatcactaacataatcattga

SEQ ID NO: 29988 - DNA, 18 bp, Artificial Sequence
  Synthetic
agaaaccattggctgagt

SEQ ID NO: 29989 - DNA, 18 bp, Artificial Sequence
  Synthetic
acacggccattatgtgtg

SEQ ID NO: 29990 - DNA, 23 bp, Artificial Sequence
  Synthetic
ggcattaaaataaacaaaaccag

SEQ ID NO: 29991 - DNA, 23 bp, Artificial Sequence
  Synthetic
ccattaatataaaactggccagt

SEQ ID NO: 29992 - DNA, 19 bp, Artificial Sequence
  Synthetic
caccaaaagatgcagttgc

SEQ ID NO: 29993 - DNA, 23 bp, Artificial Sequence
  Synthetic
gtaactgtagtaagttttgcaag

SEQ ID NO: 29994 - DNA, 25 bp, Artificial Sequence
  Synthetic
tagaaagacctttagtacaagactt

SEQ ID NO: 29995 - DNA, 21 bp, Artificial Sequence
  Synthetic
aaacaaatgcattcaaagctg

SEQ ID NO: 29996 - DNA, 21 bp, Artificial Sequence
  Synthetic
gcacaaaatcagacaaaacag

SEQ ID NO: 29997 - DNA, 18 bp, Artificial Sequence
  Synthetic
ccacaatcacaacagcct

SEQ ID NO: 29998 - DNA, 21 bp, Artificial Sequence
  Synthetic
gcaacacaactataaaaagcg

SEQ ID NO: 29999 - DNA, 18 bp, Artificial Sequence
  Synthetic
actgacccacttgaacac

SEQ ID NO: 30000 - DNA, 19 bp, Artificial Sequence
  Synthetic
aagattcctgggaatgacc

SEQ ID NO: 30001 - DNA, 19 bp, Artificial Sequence
  Synthetic
gagcgatcctcaaactcaa

SEQ ID NO: 30002 - DNA, 19 bp, Artificial Sequence
  Synthetic
ttatcagccctgggttgag

SEQ ID NO: 30003 - DNA, 24 bp, Artificial Sequence
  Synthetic
aggttcttattatccttagctaca

SEQ ID NO: 30004 - DNA, 20 bp, Artificial Sequence
  Synthetic
ttttcagcaacactcagttt

SEQ ID NO: 30005 - DNA, 20 bp, Artificial Sequence
  Synthetic
gattcttgcttgtggaacaa

SEQ ID NO: 30006 - DNA, 23 bp, Artificial Sequence
  Synthetic
gcaataattcttttacactgtca

SEQ ID NO: 30007 - DNA, 20 bp, Artificial Sequence
  Synthetic
gggactttcggaatctaact

SEQ ID NO: 30008 - DNA, 19 bp, Artificial Sequence
  Synthetic
ctttgccttctcctgtgag

SEQ ID NO: 30009 - DNA, 21 bp, Artificial Sequence
  Synthetic
catcgtccccattttgataat

SEQ ID NO: 30010 - DNA, 19 bp, Artificial Sequence
  Synthetic
tctttgtcggacctgcgag

SEQ ID NO: 30011 - DNA, 23 bp, Artificial Sequence
  Synthetic
acttccattaattttaagaccca

SEQ ID NO: 30012 - DNA, 18 bp, Artificial Sequence
  Synthetic
ttcttcctccagagcctc

SEQ ID NO: 30013 - DNA, 22 bp, Artificial Sequence
  Synthetic
agattctccttcatttgttgaa

SEQ ID NO: 30014 - DNA, 18 bp, Artificial Sequence
  Synthetic
tcagcaattggtgtgctg

SEQ ID NO: 30015 - DNA, 19 bp, Artificial Sequence
  Synthetic
tgaacttttgccaaggcgg

SEQ ID NO: 30016 - DNA, 24 bp, Artificial Sequence
  Synthetic
ggtgtttctaaagagataacttct

SEQ ID NO: 30017 - DNA, 25 bp, Artificial Sequence
  Synthetic
cacttttggtatagttacagtttga

SEQ ID NO: 30018 - DNA, 18 bp, Artificial Sequence
  Synthetic
agtgttcacctgaagcag

SEQ ID NO: 30019 - DNA, 18 bp, Artificial Sequence
  Synthetic
atacatttgctcgcgacg

SEQ ID NO: 30020 - DNA, 22 bp, Artificial Sequence
  Synthetic
tcctctggtattatctccaact

SEQ ID NO: 30021 - DNA, 18 bp, Artificial Sequence
  Synthetic
cgggtgcggtgttaatag

SEQ ID NO: 30022 - DNA, 18 bp, Artificial Sequence
  Synthetic
gttttaggtgcttggcag

SEQ ID NO: 30023 - DNA, 21 bp, Artificial Sequence
  Synthetic
tccatcagtacctttgtgatc

SEQ ID NO: 30024 - DNA, 20 bp, Artificial Sequence
  Synthetic
ttgtgaaggactctgaaagt

SEQ ID NO: 30025 - DNA, 18 bp, Artificial Sequence
  Synthetic
gaagtaccaagtcgcctc

SEQ ID NO: 30026 - DNA, 25 bp, Artificial Sequence
  Synthetic
atctgtatgttcattatcataagcc

SEQ ID NO: 30027 - DNA, 25 bp, Artificial Sequence
  Synthetic
tgatataggattaccatctaatgca

SEQ ID NO: 30028 - DNA, 18 bp, Artificial Sequence
  Synthetic
agctgccagtgtaggtat

SEQ ID NO: 30029 - DNA, 18 bp, Artificial Sequence
  Synthetic
atcctccaactcgaacac

SEQ ID NO: 30030 - DNA, 22 bp, Artificial Sequence
  Synthetic
cttaatgaaggtgaatcaacac

SEQ ID NO: 30031 - DNA, 19 bp, Artificial Sequence
  Synthetic
aaatcgagtaggacgttcc

SEQ ID NO: 30032 - DNA, 21 bp, Artificial Sequence
  Synthetic
ttcacatccaaccataaacac

SEQ ID NO: 30033 - DNA, 25 bp, Artificial Sequence
  Synthetic
ccttctggaaaaaaagaataaggaa

SEQ ID NO: 30034 - DNA, 18 bp, Artificial Sequence
  Synthetic
gttttgaccttgggcctg

SEQ ID NO: 30035 - DNA, 18 bp, Artificial Sequence
  Synthetic
cagaaaatcagcagctgc

SEQ ID NO: 30036 - DNA, 18 bp, Artificial Sequence
  Synthetic
ctgtgtaggcggtcttga

SEQ ID NO: 30037 - DNA, 18 bp, Artificial Sequence
  Synthetic
tggggttggagggtaatc

SEQ ID NO: 30038 - DNA, 18 bp, Artificial Sequence
  Synthetic
caacaagccctccattct

SEQ ID NO: 30039 - DNA, 24 bp, Artificial Sequence
  Synthetic
tactcaagagataaagttcttccg

SEQ ID NO: 30040 - DNA, 18 bp, Artificial Sequence
  Synthetic
taagaaccctgaacctgc

SEQ ID NO: 30041 - DNA, 20 bp, Artificial Sequence
  Synthetic
tccaaggcatctcttcatag

SEQ ID NO: 30042 - DNA, 19 bp, Artificial Sequence
  Synthetic
tgatccaacctcagctgta

SEQ ID NO: 30043 - DNA, 18 bp, Artificial Sequence
  Synthetic
tcaccaggaaccatagca

SEQ ID NO: 30044 - DNA, 25 bp, Artificial Sequence
  Synthetic
ctccaaatctgtaaatctagctaaa

SEQ ID NO: 30045 - DNA, 20 bp, Artificial Sequence
  Synthetic
gttgaccaactgagtctgaa

SEQ ID NO: 30046 - DNA, 21 bp, Artificial Sequence
  Synthetic
tgcactcctgtaatatccatt

SEQ ID NO: 30047 - DNA, 21 bp, Artificial Sequence
  Synthetic
aggagcaaaacattccaagtt

SEQ ID NO: 30048 - DNA, 21 bp, Artificial Sequence
  Synthetic
tgatgtatgtctggattctcc

SEQ ID NO: 30049 - DNA, 18 bp, Artificial Sequence
  Synthetic
acctactggagtgaacca

SEQ ID NO: 30050 - DNA, 18 bp, Artificial Sequence
  Synthetic
gggggtggaagtacttca

SEQ ID NO: 30051 - DNA, 22 bp, Artificial Sequence
  Synthetic
caatctaatcagtctcccagta

SEQ ID NO: 30052 - DNA, 19 bp, Artificial Sequence
  Synthetic
cctacccttctcctcaaga

SEQ ID NO: 30053 - DNA, 18 bp, Artificial Sequence
  Synthetic
ttgcgggagaaatgctta

SEQ ID NO: 30054 - DNA, 18 bp, Artificial Sequence
  Synthetic
acaagcagccaatcatct

SEQ ID NO: 30055 - DNA, 23 bp, Artificial Sequence
  Synthetic
tttggaacatttcttgagtaacc

SEQ ID NO: 30056 - DNA, 22 bp, Artificial Sequence
  Synthetic
ctaactgagtcttacccactat

SEQ ID NO: 30057 - DNA, 23 bp, Artificial Sequence
  Synthetic
agaacaattttccatcatgacag

SEQ ID NO: 30058 - DNA, 22 bp, Artificial Sequence
  Synthetic
catctccgaatcttatcattgt

SEQ ID NO: 30059 - DNA, 21 bp, Artificial Sequence
  Synthetic
acttcaatttggtcattcgtg

SEQ ID NO: 30060 - DNA, 18 bp, Artificial Sequence
  Synthetic
ttaaactccagtgtgccg

SEQ ID NO: 30061 - DNA, 22 bp, Artificial Sequence
  Synthetic
gagactgtgattcttcctgatg

SEQ ID NO: 30062 - DNA, 19 bp, Artificial Sequence
  Synthetic
ttgtcattgggaatgcttc

SEQ ID NO: 30063 - DNA, 18 bp, Artificial Sequence
  Synthetic
tgtcctgttccctcagaa

SEQ ID NO: 30064 - DNA, 23 bp, Artificial Sequence
  Synthetic
agtttgttcatttctgagtcagt

SEQ ID NO: 30065 - DNA, 18 bp, Artificial Sequence
  Synthetic
caggcccacatgatgaac

SEQ ID NO: 30066 - DNA, 19 bp, Artificial Sequence
  Synthetic
acaggctaacaacaggtct

SEQ ID NO: 30067 - DNA, 23 bp, Artificial Sequence
  Synthetic
aaataatctaacagtcgcaaaca

SEQ ID NO: 30068 - DNA, 19 bp, Artificial Sequence
  Synthetic
tccacctctgctactgtag

SEQ ID NO: 30069 - DNA, 23 bp, Artificial Sequence
  Synthetic
ttcttcaaacagcttttccaaat

SEQ ID NO: 30070 - DNA, 20 bp, Artificial Sequence
  Synthetic
gtcctgttccataaatagcc

SEQ ID NO: 30071 - DNA, 22 bp, Artificial Sequence
  Synthetic
gtaacagttgcttacatccttc

SEQ ID NO: 30072 - DNA, 21 bp, Artificial Sequence
  Synthetic
ttccctctgatcttctgaaac

SEQ ID NO: 30073 - DNA, 21 bp, Artificial Sequence
  Synthetic
cctttgcctgtactaataccc

SEQ ID NO: 30074 - DNA, 18 bp, Artificial Sequence
  Synthetic
cctcagcaatggtctcaa

SEQ ID NO: 30075 - DNA, 18 bp, Artificial Sequence
  Synthetic
agcatccccagaatgttc

SEQ ID NO: 30076 - DNA, 18 bp, Artificial Sequence
  Synthetic
gtaggagtccgtgctttg

SEQ ID NO: 30077 - DNA, 18 bp, Artificial Sequence
  Synthetic
aacagcccataccaaacg

SEQ ID NO: 30078 - DNA, 23 bp, Artificial Sequence
  Synthetic
catgtccccatcttcaataatag

SEQ ID NO: 30079 - DNA, 25 bp, Artificial Sequence
  Synthetic
cagcctttaaataataatggttgtc

SEQ ID NO: 30080 - DNA, 25 bp, Artificial Sequence
  Synthetic
tttctattattattggttcacacgg

SEQ ID NO: 30081 - DNA, 22 bp, Artificial Sequence
  Synthetic
aattgataacacttgccaggat

SEQ ID NO: 30082 - DNA, 20 bp, Artificial Sequence
  Synthetic
accaatactgtccataagcc

SEQ ID NO: 30083 - DNA, 20 bp, Artificial Sequence
  Synthetic
tatgtctatgacgggcctat

SEQ ID NO: 30084 - DNA, 21 bp, Artificial Sequence
  Synthetic
cgatttggaattaggtgtgga

SEQ ID NO: 30085 - DNA, 19 bp, Artificial Sequence
  Synthetic
taggatcacgagccaaggg

SEQ ID NO: 30086 - DNA, 16 bp, Artificial Sequence
  Synthetic
tgggcgcgtctctctg

SEQ ID NO: 30087 - DNA, 16 bp, Artificial Sequence
  Synthetic
atgcgccacacggagg

SEQ ID NO: 30088 - DNA, 17 bp, Artificial Sequence
  Synthetic
aactgtgccctgttgcg

SEQ ID NO: 30089 - DNA, 17 bp, Artificial Sequence
  Synthetic
ctggtccggcagctcta

SEQ ID NO: 30090 - DNA, 18 bp, Artificial Sequence
  Synthetic
tacaccctctctcgcgcc

SEQ ID NO: 30091 - DNA, 19 bp, Artificial Sequence
  Synthetic
tgacgacgtcctggctttc

SEQ ID NO: 30092 - DNA, 17 bp, Artificial Sequence
  Synthetic
tgctggtcggagagtgc

SEQ ID NO: 30093 - DNA, 23 bp, Artificial Sequence
  Synthetic
atacttacttgagtgatggagtt

SEQ ID NO: 30094 - DNA, 24 bp, Artificial Sequence
  Synthetic
agacctattctttgtattgggaaa

SEQ ID NO: 30095 - DNA, 20 bp, Artificial Sequence
  Synthetic
tgttgttcaacattcgcaag

SEQ ID NO: 30096 - DNA, 21 bp, Artificial Sequence
  Synthetic
accggcttaactatacagttt

SEQ ID NO: 30097 - DNA, 18 bp, Artificial Sequence
  Synthetic
tctcggcagtttgtttca

SEQ ID NO: 30098 - DNA, 19 bp, Artificial Sequence
  Synthetic
gtgactatgagcagaccga

SEQ ID NO: 30099 - DNA, 23 bp, Artificial Sequence
  Synthetic
aagttaacctgtgtttttaacga

SEQ ID NO: 30100 - DNA, 20 bp, Artificial Sequence
  Synthetic
tcaacgcctggaaaaaaatt

SEQ ID NO: 30101 - DNA, 18 bp, Artificial Sequence
  Synthetic
ttggagaccgttgaacat

SEQ ID NO: 30102 - DNA, 21 bp, Artificial Sequence
  Synthetic
actcagaatacggtagcattt

SEQ ID NO: 30103 - DNA, 18 bp, Artificial Sequence
  Synthetic
taacgtagtgttgccgga

SEQ ID NO: 30104 - DNA, 19 bp, Artificial Sequence
  Synthetic
ttaactttttcaccacgcc

SEQ ID NO: 30105 - DNA, 21 bp, Artificial Sequence
  Synthetic
agtgcaagttaagcagtttac

SEQ ID NO: 30106 - DNA, 19 bp, Artificial Sequence
  Synthetic
taaaaaaacggccaacctc

SEQ ID NO: 30107 - DNA, 20 bp, Artificial Sequence
  Synthetic
tgtttgagctgaagatggtg

SEQ ID NO: 30108 - DNA, 21 bp, Artificial Sequence
  Synthetic
aggtgttttcggttttcttac

SEQ ID NO: 30109 - DNA, 21 bp, Artificial Sequence
  Synthetic
gtaagataacaggtaccgtgt

SEQ ID NO: 30110 - DNA, 23 bp, Artificial Sequence
  Synthetic
aatacctgtttataaactccgaa

SEQ ID NO: 30111 - DNA, 19 bp, Artificial Sequence
  Synthetic
tgaaatgctacacggacac

SEQ ID NO: 30112 - DNA, 20 bp, Artificial Sequence
  Synthetic
gcccgtctttagaaagagcg

SEQ ID NO: 30113 - DNA, 20 bp, Artificial Sequence
  Synthetic
tggagagaaacgcgaaggga

SEQ ID NO: 30114 - DNA, 16 bp, Artificial Sequence
  Synthetic
tctgacacaggccgcc

SEQ ID NO: 30115 - DNA, 20 bp, Artificial Sequence
  Synthetic
gacagatcttgccggtatcg

SEQ ID NO: 30116 - DNA, 19 bp, Artificial Sequence
  Synthetic
caccctgtgtgtgactgtc

SEQ ID NO: 30117 - DNA, 19 bp, Artificial Sequence
  Synthetic
agttccatgctattcccca

SEQ ID NO: 30118 - DNA, 22 bp, Artificial Sequence
  Synthetic
tgtctatgtaacttctcatccc

SEQ ID NO: 30119 - DNA, 20 bp, Artificial Sequence
  Synthetic
tcttggactttccttcagtc

SEQ ID NO: 30120 - DNA, 25 bp, Artificial Sequence
  Synthetic
actctacatttattgggtattttgg

SEQ ID NO: 30121 - DNA, 22 bp, Artificial Sequence
  Synthetic
tggattttgtttgtaccattca

SEQ ID NO: 30122 - DNA, 22 bp, Artificial Sequence
  Synthetic
cataatgcatcaaacatttggt

SEQ ID NO: 30123 - DNA, 22 bp, Artificial Sequence
  Synthetic
gcaatgttacatttacccaaat

SEQ ID NO: 30124 - DNA, 21 bp, Artificial Sequence
  Synthetic
ggggaatatctcaaacctttc

SEQ ID NO: 30125 - DNA, 20 bp, Artificial Sequence
  Synthetic
tattgctatttccggcttga

SEQ ID NO: 30126 - DNA, 23 bp, Artificial Sequence
  Synthetic
atgtatattctgaaatgggaggc

SEQ ID NO: 30127 - DNA, 24 bp, Artificial Sequence
  Synthetic
ctttgttagtaatctcgtcaatgg

SEQ ID NO: 30128 - DNA, 19 bp, Artificial Sequence
  Synthetic
ggagatagagccggccttg

SEQ ID NO: 30129 - DNA, 19 bp, Artificial Sequence
  Synthetic
tctgtcgctgcgttccatg

SEQ ID NO: 30130 - DNA, 17 bp, Artificial Sequence
  Synthetic
agagcaggagcaggctc

SEQ ID NO: 30131 - DNA, 19 bp, Artificial Sequence
  Synthetic
gatctggccctcaggtgac

SEQ ID NO: 30132 - DNA, 16 bp, Artificial Sequence
  Synthetic
ggcgttcgggggactt

SEQ ID NO: 30133 - DNA, 20 bp, Artificial Sequence
  Synthetic
cacgtcgaacagatgtctga

SEQ ID NO: 30134 - DNA, 18 bp, Artificial Sequence
  Synthetic
gacgatcacccaagccgt

SEQ ID NO: 30135 - DNA, 18 bp, Artificial Sequence
  Synthetic
ctctcgtgccgttgcctt

SEQ ID NO: 30136 - DNA, 19 bp, Artificial Sequence
  Synthetic
gtttaacggcgtgttcgac

SEQ ID NO: 30137 - DNA, 18 bp, Artificial Sequence
  Synthetic
cgtgggggcagaactgag

SEQ ID NO: 30138 - DNA, 18 bp, Artificial Sequence
  Synthetic
gtaagatacggcgtcctg

SEQ ID NO: 30139 - DNA, 23 bp, Artificial Sequence
  Synthetic
gcttatgctatatgaacagactg

SEQ ID NO: 30140 - DNA, 19 bp, Artificial Sequence
  Synthetic
tgtttaagggggttcgttt

SEQ ID NO: 30141 - DNA, 18 bp, Artificial Sequence
  Synthetic
aatcttacttgtcgggcg

SEQ ID NO: 30142 - DNA, 19 bp, Artificial Sequence
  Synthetic
ggtctcgacttcgtgaatg

SEQ ID NO: 30143 - DNA, 20 bp, Artificial Sequence
  Synthetic
tctcgttttttgctgtgaaa

SEQ ID NO: 30144 - DNA, 18 bp, Artificial Sequence
  Synthetic
tatcgtcctccgcaagtt

SEQ ID NO: 30145 - DNA, 20 bp, Artificial Sequence
  Synthetic
ctgtaacagggagaagtttg

SEQ ID NO: 30146 - DNA, 22 bp, Artificial Sequence
  Synthetic
tttcatttgctcttccatatgt

SEQ ID NO: 30147 - DNA, 19 bp, Artificial Sequence
  Synthetic
ttacttgtccaaaggtcga

SEQ ID NO: 30148 - DNA, 18 bp, Artificial Sequence
  Synthetic
atccaaccgcagattgtc

SEQ ID NO: 30149 - DNA, 19 bp, Artificial Sequence
  Synthetic
taattcggtttttaggcgc

SEQ ID NO: 30150 - DNA, 23 bp, Artificial Sequence
  Synthetic
aagttttgtagatatgggcttag

SEQ ID NO: 30151 - DNA, 18 bp, Artificial Sequence
  Synthetic
tagtcgttggtgtcccat

SEQ ID NO: 30152 - DNA, 25 bp, Artificial Sequence
  Synthetic
cttttttaatgaagctgaacaactc

SEQ ID NO: 30153 - DNA, 20 bp, Artificial Sequence
  Synthetic
ttttcagttcaaacgcagac

SEQ ID NO: 30154 - DNA, 25 bp, Artificial Sequence
  Synthetic
cgttagtaaatataacagtaggaga

SEQ ID NO: 30155 - DNA, 22 bp, Artificial Sequence
  Synthetic
caaagatctacactctttgctc

SEQ ID NO: 30156 - DNA, 22 bp, Artificial Sequence
  Synthetic
aataaacttatgctgaaccgag

SEQ ID NO: 30157 - DNA, 18 bp, Artificial Sequence
  Synthetic
taacgacgttgtccacca

SEQ ID NO: 30158 - DNA, 18 bp, Artificial Sequence
  Synthetic
tagagccggccttggaac

SEQ ID NO: 30159 - DNA, 18 bp, Artificial Sequence
  Synthetic
cgtcactcgaggaaacgc

SEQ ID NO: 30160 - DNA, 18 bp, Artificial Sequence
  Synthetic
ggtgactccgcagactgg

SEQ ID NO: 30161 - DNA, 16 bp, Artificial Sequence
  Synthetic
agggtgacgacggacc

SEQ ID NO: 30162 - DNA, 17 bp, Artificial Sequence
  Synthetic
tcgttccgcacatacgc

SEQ ID NO: 30163 - DNA, 18 bp, Artificial Sequence
  Synthetic
atacaactggcaagtgca

SEQ ID NO: 30164 - DNA, 24 bp, Artificial Sequence
  Synthetic
cgatattcttccctcatagacttt

SEQ ID NO: 30165 - DNA, 20 bp, Artificial Sequence
  Synthetic
tgtttcccaacaagagtggc

SEQ ID NO: 30166 - DNA, 21 bp, Artificial Sequence
  Synthetic
agcccttagtagtatcaaggt

SEQ ID NO: 30167 - DNA, 21 bp, Artificial Sequence
  Synthetic
aatttctgtcccaattgctct

SEQ ID NO: 30168 - DNA, 20 bp, Artificial Sequence
  Synthetic
ttgcactggtcacataattc

SEQ ID NO: 30169 - DNA, 20 bp, Artificial Sequence
  Synthetic
caatgtggttggttttttcc

SEQ ID NO: 30170 - DNA, 22 bp, Artificial Sequence
  Synthetic
cagtgacaaaatacacaatgtg

SEQ ID NO: 30171 - DNA, 23 bp, Artificial Sequence
  Synthetic
catcttctgaaactacatcacct

SEQ ID NO: 30172 - DNA, 22 bp, Artificial Sequence
  Synthetic
cactccaaaaagttccttaaac

SEQ ID NO: 30173 - DNA, 24 bp, Artificial Sequence
  Synthetic
gaactttgtaatttaggtggttgt

SEQ ID NO: 30174 - DNA, 25 bp, Artificial Sequence
  Synthetic
cacaatctctaacatatttagcttg

SEQ ID NO: 30175 - DNA, 19 bp, Artificial Sequence
  Synthetic
gcccatttgtcttgctgta

SEQ ID NO: 30176 - DNA, 21 bp, Artificial Sequence
  Synthetic
ttctactgtctttcctccttt

SEQ ID NO: 30177 - DNA, 24 bp, Artificial Sequence
  Synthetic
cttccagttgtattataggtgtag

SEQ ID NO: 30178 - DNA, 20 bp, Artificial Sequence
  Synthetic
gatacgaccactagcctcta

SEQ ID NO: 30179 - DNA, 22 bp, Artificial Sequence
  Synthetic
tctgaaatagtatgcaggattc

SEQ ID NO: 30180 - DNA, 25 bp, Artificial Sequence
  Synthetic
ggtttcagaattaaataaagacgtg

SEQ ID NO: 30181 - DNA, 25 bp, Artificial Sequence
  Synthetic
tcactttttaattctagtacaggac

SEQ ID NO: 30182 - DNA, 23 bp, Artificial Sequence
  Synthetic
acaacacatacatacattccaga

SEQ ID NO: 30183 - DNA, 24 bp, Artificial Sequence
  Synthetic
ccaaactgctattagctaaatgtt

SEQ ID NO: 30184 - DNA, 18 bp, Artificial Sequence
  Synthetic
gaacacacagccaagttg

SEQ ID NO: 30185 - DNA, 22 bp, Artificial Sequence
  Synthetic
cgtttcttatagtcacagtgta

SEQ ID NO: 30186 - DNA, 18 bp, Artificial Sequence
  Synthetic
tgttgttcgtcccgtcta

SEQ ID NO: 30187 - DNA, 19 bp, Artificial Sequence
  Synthetic
ccggcacttctgtatcaat

SEQ ID NO: 30188 - DNA, 20 bp, Artificial Sequence
  Synthetic
tacaatatagcttggcctgc

SEQ ID NO: 30189 - DNA, 22 bp, Artificial Sequence
  Synthetic
tgtgcattactgtctacatctg

SEQ ID NO: 30190 - DNA, 24 bp, Artificial Sequence
  Synthetic
acaattatgttttggtgtaccttg

SEQ ID NO: 30191 - DNA, 18 bp, Artificial Sequence
  Synthetic
gaattttctcctggcacg

SEQ ID NO: 30192 - DNA, 18 bp, Artificial Sequence
  Synthetic
tcccatatgcacttccca

SEQ ID NO: 30193 - DNA, 19 bp, Artificial Sequence
  Synthetic
ttccttgcgacacactctg

SEQ ID NO: 30194 - DNA, 20 bp, Artificial Sequence
  Synthetic
gtaccagtgatacactaggg

SEQ ID NO: 30195 - DNA, 18 bp, Artificial Sequence
  Synthetic
aaacacagaggcagactg

SEQ ID NO: 30196 - DNA, 18 bp, Artificial Sequence
  Synthetic
attgcctgtaccctgaac

SEQ ID NO: 30197 - DNA, 18 bp, Artificial Sequence
  Synthetic
gcctactaaaacgcacac

SEQ ID NO: 30198 - DNA, 20 bp, Artificial Sequence
  Synthetic
taggaggcagataaaccttg

SEQ ID NO: 30199 - DNA, 18 bp, Artificial Sequence
  Synthetic
gtgggtcctgcttttcag

SEQ ID NO: 30200 - DNA, 18 bp, Artificial Sequence
  Synthetic
agaacgtatgctgcaagc

SEQ ID NO: 30201 - DNA, 19 bp, Artificial Sequence
  Synthetic
gcatatcaacatcaaccgg

SEQ ID NO: 30202 - DNA, 20 bp, Artificial Sequence
  Synthetic
ggactcaaagtgagcacacg

SEQ ID NO: 30203 - DNA, 21 bp, Artificial Sequence
  Synthetic
gcatttgctacatcttgagat

SEQ ID NO: 30204 - DNA, 18 bp, Artificial Sequence
  Synthetic
taccagggtagtgcacaa

SEQ ID NO: 30205 - DNA, 19 bp, Artificial Sequence
  Synthetic
aaactaaatcgcagactgc

SEQ ID NO: 30206 - DNA, 25 bp, Artificial Sequence
  Synthetic
catggagtatttattatctgcagtt

SEQ ID NO: 30207 - DNA, 22 bp, Artificial Sequence
  Synthetic
ggttatttctgagtcaaacctg

SEQ ID NO: 30208 - DNA, 21 bp, Artificial Sequence
  Synthetic
ttgtctccatcatatccatca

SEQ ID NO: 30209 - DNA, 25 bp, Artificial Sequence
  Synthetic
gttctttaacactatctacaaaacc

SEQ ID NO: 30210 - DNA, 23 bp, Artificial Sequence
  Synthetic
atttcttaagccatgaatcagac

SEQ ID NO: 30211 - DNA, 18 bp, Artificial Sequence
  Synthetic
tatagctggtggtggtgg

SEQ ID NO: 30212 - DNA, 19 bp, Artificial Sequence
  Synthetic
aatagttgtaccactcccg

SEQ ID NO: 30213 - DNA, 19 bp, Artificial Sequence
  Synthetic
ctctccaagtacctctcac

SEQ ID NO: 30214 - DNA, 25 bp, Artificial Sequence
  Synthetic
ccacagttacttgattattgtacaa

SEQ ID NO: 30215 - DNA, 23 bp, Artificial Sequence
  Synthetic
tctctactctttgcactcttaaa

SEQ ID NO: 30216 - DNA, 20 bp, Artificial Sequence
  Synthetic
accctctgttttacaacgat

SEQ ID NO: 30217 - DNA, 23 bp, Artificial Sequence
  Synthetic
tgttaggaaactgtatacattgt

SEQ ID NO: 30218 - DNA, 23 bp, Artificial Sequence
  Synthetic
ttaaaacagtattttggctctgt

SEQ ID NO: 30219 - DNA, 18 bp, Artificial Sequence
  Synthetic
tccgtcgtttggctcctc

SEQ ID NO: 30220 - DNA, 18 bp, Artificial Sequence
  Synthetic
gcccatgtatcaccttct

SEQ ID NO: 30221 - DNA, 20 bp, Artificial Sequence
  Synthetic
ccacatctaaagcaaaccgt

SEQ ID NO: 30222 - DNA, 18 bp, Artificial Sequence
  Synthetic
aattgtagctcgctcacc

SEQ ID NO: 30223 - DNA, 20 bp, Artificial Sequence
  Synthetic
acagccatctgcaaaaaatt

SEQ ID NO: 30224 - DNA, 22 bp, Artificial Sequence
  Synthetic
tgaacacttgattctgtttagg

SEQ ID NO: 30225 - DNA, 18 bp, Artificial Sequence
  Synthetic
tctttgcaaccaaaacgg

SEQ ID NO: 30226 - DNA, 18 bp, Artificial Sequence
  Synthetic
aatcgtctgcccaaagac

SEQ ID NO: 30227 - DNA, 20 bp, Artificial Sequence
  Synthetic
cacacgagactcttcacacc

SEQ ID NO: 30228 - DNA, 18 bp, Artificial Sequence
  Synthetic
tgagttttcatgcgagcc

SEQ ID NO: 30229 - DNA, 25 bp, Artificial Sequence
  Synthetic
cagtatagagtttagtgtatcttgt

SEQ ID NO: 30230 - DNA, 22 bp, Artificial Sequence
  Synthetic
gaattttgtggcattacattgg

SEQ ID NO: 30231 - DNA, 25 bp, Artificial Sequence
  Synthetic
ggtacacaattaatgtatggtacaa

SEQ ID NO: 30232 - DNA, 22 bp, Artificial Sequence
  Synthetic
gacactaaagtctggtagaaga

SEQ ID NO: 30233 - DNA, 24 bp, Artificial Sequence
  Synthetic
ctgtactaaagctatcacaaacac

SEQ ID NO: 30234 - DNA, 18 bp, Artificial Sequence
  Synthetic
atggtggttgaagatgcc

SEQ ID NO: 30235 - DNA, 19 bp, Artificial Sequence
  Synthetic
ccaggtggtacaaacatga

SEQ ID NO: 30236 - DNA, 21 bp, Artificial Sequence
  Synthetic
gtgtcttccatagctctgaag

SEQ ID NO: 30237 - DNA, 18 bp, Artificial Sequence
  Synthetic
taagtgcgcattcctgta

SEQ ID NO: 30238 - DNA, 20 bp, Artificial Sequence
  Synthetic
acaatgtccttcaccaatca

SEQ ID NO: 30239 - DNA, 22 bp, Artificial Sequence
  Synthetic
gccatttaactacctttgaagt

SEQ ID NO: 30240 - DNA, 18 bp, Artificial Sequence
  Synthetic
atgccaatccactcaagg

SEQ ID NO: 30241 - DNA, 20 bp, Artificial Sequence
  Synthetic
gacaccatctgacagaacat

SEQ ID NO: 30242 - DNA, 20 bp, Artificial Sequence
  Synthetic
gtggtggcttactacagttc

SEQ ID NO: 30243 - DNA, 19 bp, Artificial Sequence
  Synthetic
tcaattgagccatggactg

SEQ ID NO: 30244 - DNA, 23 bp, Artificial Sequence
  Synthetic
gtaatgatatggcagtttcttct

SEQ ID NO: 30245 - DNA, 25 bp, Artificial Sequence
  Synthetic
tcagcaaaatatttcctaagtagtg

SEQ ID NO: 30246 - DNA, 19 bp, Artificial Sequence
  Synthetic
gttctgggttgatgtcaag

SEQ ID NO: 30247 - DNA, 19 bp, Artificial Sequence
  Synthetic
tccacaatcctggtcttac

SEQ ID NO: 30248 - DNA, 18 bp, Artificial Sequence
  Synthetic
cgctttaaaccacactgg

SEQ ID NO: 30249 - DNA, 19 bp, Artificial Sequence
  Synthetic
acaaacacaacgaatggac

SEQ ID NO: 30250 - DNA, 20 bp, Artificial Sequence
  Synthetic
ttctcttgtctgctgtgatt

SEQ ID NO: 30251 - DNA, 23 bp, Artificial Sequence
  Synthetic
catgttttaacctttcaaccttc

SEQ ID NO: 30252 - DNA, 19 bp, Artificial Sequence
  Synthetic
gaaatctggttttgcggac

SEQ ID NO: 30253 - DNA, 23 bp, Artificial Sequence
  Synthetic
cttactatcaactgaatcagcct

SEQ ID NO: 30254 - DNA, 21 bp, Artificial Sequence
  Synthetic
catccccatgacattgtcaat

SEQ ID NO: 30255 - DNA, 18 bp, Artificial Sequence
  Synthetic
caggaccgttgatttccc

SEQ ID NO: 30256 - DNA, 19 bp, Artificial Sequence
  Synthetic
ttacttgcaaccgcccaaa

SEQ ID NO: 30257 - DNA, 19 bp, Artificial Sequence
  Synthetic
ggcactcaagagtagtctc

SEQ ID NO: 30258 - DNA, 18 bp, Artificial Sequence
  Synthetic
taggtataggcggcagag

SEQ ID NO: 30259 - DNA, 23 bp, Artificial Sequence
  Synthetic
cttactgtaaataaagctgaagc

SEQ ID NO: 30260 - DNA, 19 bp, Artificial Sequence
  Synthetic
ccttgcatgcgtcacacat

SEQ ID NO: 30261 - DNA, 24 bp, Artificial Sequence
  Synthetic
tttcaaattcctcgctataatcct

SEQ ID NO: 30262 - DNA, 20 bp, Artificial Sequence
  Synthetic
gcctccctcatttcttcctc

SEQ ID NO: 30263 - DNA, 19 bp, Artificial Sequence
  Synthetic
aggctgacttgtccagagt

SEQ ID NO: 30264 - DNA, 20 bp, Artificial Sequence
  Synthetic
gtgcagccctttaccacatt

SEQ ID NO: 30265 - DNA, 18 bp, Artificial Sequence
  Synthetic
gctgcatcctggtgtgtc

SEQ ID NO: 30266 - DNA, 16 bp, Artificial Sequence
  Synthetic
tgtcatggcggctgcg

SEQ ID NO: 30267 - DNA, 20 bp, Artificial Sequence
  Synthetic
cccctgctatgactggatca

SEQ ID NO: 30268 - DNA, 20 bp, Artificial Sequence
  Synthetic
gcattcccttccaagttgca

SEQ ID NO: 30269 - DNA, 19 bp, Artificial Sequence
  Synthetic
gacggcagttgcatctcct

SEQ ID NO: 30270 - DNA, 17 bp, Artificial Sequence
  Synthetic
aggacatgacgctggcc

SEQ ID NO: 30271 - DNA, 16 bp, Artificial Sequence
  Synthetic
tgcgagaccgtctgcg

SEQ ID NO: 30272 - DNA, 19 bp, Artificial Sequence
  Synthetic
gaccccctggtggaaaacg

SEQ ID NO: 30273 - DNA, 19 bp, Artificial Sequence
  Synthetic
tgccaccaagcttgacaat

SEQ ID NO: 30274 - DNA, 17 bp, Artificial Sequence
  Synthetic
actaacgagcccctgcg

SEQ ID NO: 30275 - DNA, 16 bp, Artificial Sequence
  Synthetic
ctttcgcgccgagcag

SEQ ID NO: 30276 - DNA, 18 bp, Artificial Sequence
  Synthetic
tgcgacgactcggacttt

SEQ ID NO: 30277 - DNA, 18 bp, Artificial Sequence
  Synthetic
ttcaggagtgggcactgg

SEQ ID NO: 30278 - DNA, 20 bp, Artificial Sequence
  Synthetic
gcggctctttgttacctacg

SEQ ID NO: 30279 - DNA, 18 bp, Artificial Sequence
  Synthetic
tctccgtcctcgaggagc

SEQ ID NO: 30280 - DNA, 19 bp, Artificial Sequence
  Synthetic
ctaccaggacaactcgggc

SEQ ID NO: 30281 - DNA, 15 bp, Artificial Sequence
  Synthetic
tgcgccgctggatca

SEQ ID NO: 30282 - DNA, 18 bp, Artificial Sequence
  Synthetic
caccgaaaccatgcgtcg

SEQ ID NO: 30283 - DNA, 20 bp, Artificial Sequence
  Synthetic
cgcaattctaacagcgtcca

SEQ ID NO: 30284 - DNA, 20 bp, Artificial Sequence
  Synthetic
tgttgacatggacgacttcc

SEQ ID NO: 30285 - DNA, 16 bp, Artificial Sequence
  Synthetic
tctggaaccgcgtccg

SEQ ID NO: 30286 - DNA, 16 bp, Artificial Sequence
  Synthetic
ggcggctatcgggctt

SEQ ID NO: 30287 - DNA, 16 bp, Artificial Sequence
  Synthetic
ttgtacagcgccggcg

SEQ ID NO: 30288 - DNA, 16 bp, Artificial Sequence
  Synthetic
tgcacgatggcctccg

SEQ ID NO: 30289 - DNA, 17 bp, Artificial Sequence
  Synthetic
acggccttgtggatgcg

SEQ ID NO: 30290 - DNA, 16 bp, Artificial Sequence
  Synthetic
gttgcatcgcggcctc

SEQ ID NO: 30291 - DNA, 16 bp, Artificial Sequence
  Synthetic
tgaaccgctcgcgctg

SEQ ID NO: 30292 - DNA, 18 bp, Artificial Sequence
  Synthetic
gtgaagggtgcgatcagc

SEQ ID NO: 30293 - DNA, 16 bp, Artificial Sequence
  Synthetic
gccccctcctgcatca

SEQ ID NO: 30294 - DNA, 19 bp, Artificial Sequence
  Synthetic
cccacagaaacccgtcgtt

SEQ ID NO: 30295 - DNA, 18 bp, Artificial Sequence
  Synthetic
tcccgcccaagtccaaca

SEQ ID NO: 30296 - DNA, 19 bp, Artificial Sequence
  Synthetic
aatgctgtttctgccctcc

SEQ ID NO: 30297 - DNA, 18 bp, Artificial Sequence
  Synthetic
ggctctcggtgaagtcca

SEQ ID NO: 30298 - DNA, 21 bp, Artificial Sequence
  Synthetic
caatctctagctccttctcag

SEQ ID NO: 30299 - DNA, 20 bp, Artificial Sequence
  Synthetic
ggcgagatcgttgtaaaagc

SEQ ID NO: 30300 - DNA, 20 bp, Artificial Sequence
  Synthetic
tgttattgctgggcgagatg

SEQ ID NO: 30301 - DNA, 16 bp, Artificial Sequence
  Synthetic
tagtcgcgcgcgtcag

SEQ ID NO: 30302 - DNA, 19 bp, Artificial Sequence
  Synthetic
gatcagggacgaggaggac

SEQ ID NO: 30303 - DNA, 20 bp, Artificial Sequence
  Synthetic
atagctacgcttgctcctga

SEQ ID NO: 30304 - DNA, 16 bp, Artificial Sequence
  Synthetic
tccacggtctgcacgc

SEQ ID NO: 30305 - DNA, 20 bp, Artificial Sequence
  Synthetic
tggaaggatgcaacacgtag

SEQ ID NO: 30306 - DNA, 17 bp, Artificial Sequence
  Synthetic
aggaacccgccactcag

SEQ ID NO: 30307 - DNA, 18 bp, Artificial Sequence
  Synthetic
taggtccggagcgttgag

SEQ ID NO: 30308 - DNA, 18 bp, Artificial Sequence
  Synthetic
aagggcctcctcgtacga

SEQ ID NO: 30309 - DNA, 19 bp, Artificial Sequence
  Synthetic
cttaatagcatcggcggcg

SEQ ID NO: 30310 - DNA, 18 bp, Artificial Sequence
  Synthetic
gatccacgggcacaaagc

SEQ ID NO: 30311 - DNA, 21 bp, Artificial Sequence
  Synthetic
ttcgtttgcatagataggctc

SEQ ID NO: 30312 - DNA, 19 bp, Artificial Sequence
  Synthetic
ttccacaccgtgattctca

SEQ ID NO: 30313 - DNA, 20 bp, Artificial Sequence
  Synthetic
cgccaatgttaacgtaagcg

SEQ ID NO: 30314 - DNA, 16 bp, Artificial Sequence
  Synthetic
tgtgcgccatggggaa

SEQ ID NO: 30315 - DNA, 19 bp, Artificial Sequence
  Synthetic
gccctggtagccaatgttg

SEQ ID NO: 30316 - DNA, 16 bp, Artificial Sequence
  Synthetic
tgggtgacggagggca

SEQ ID NO: 30317 - DNA, 15 bp, Artificial Sequence
  Synthetic
tcgcgcacaatggcc

SEQ ID NO: 30318 - DNA, 18 bp, Artificial Sequence
  Synthetic
tgctcgaggctgagacag

SEQ ID NO: 30319 - DNA, 19 bp, Artificial Sequence
  Synthetic
agcgaaagtagggggagtg

SEQ ID NO: 30320 - DNA, 18 bp, Artificial Sequence
  Synthetic
cggtcccaactgcgattt

SEQ ID NO: 30321 - DNA, 18 bp, Artificial Sequence
  Synthetic
ttagcgggaaaagctgcg

SEQ ID NO: 30322 - DNA, 17 bp, Artificial Sequence
  Synthetic
aactgggagtgcaccgg

SEQ ID NO: 30323 - DNA, 18 bp, Artificial Sequence
  Synthetic
tctgaacgtgtgcaaccc

SEQ ID NO: 30324 - DNA, 16 bp, Artificial Sequence
  Synthetic
aaaggagcccctcgcc

SEQ ID NO: 30325 - DNA, 19 bp, Artificial Sequence
  Synthetic
agcagcacatcctcctgtc

SEQ ID NO: 30326 - DNA, 18 bp, Artificial Sequence
  Synthetic
gatccatgatgcgacgca

SEQ ID NO: 30327 - DNA, 17 bp, Artificial Sequence
  Synthetic
agcacagtctgccccag

SEQ ID NO: 30328 - DNA, 19 bp, Artificial Sequence
  Synthetic
ctcataaagtcgggcagcc

SEQ ID NO: 30329 - DNA, 16 bp, Artificial Sequence
  Synthetic
ggagctgggggttgca

SEQ ID NO: 30330 - DNA, 20 bp, Artificial Sequence
  Synthetic
ccaggtagacccctttaccc

SEQ ID NO: 30331 - DNA, 18 bp, Artificial Sequence
  Synthetic
tgtgggccctccatgatc

SEQ ID NO: 30332 - DNA, 20 bp, Artificial Sequence
  Synthetic
gctgcagctgatcttcgttt

SEQ ID NO: 30333 - DNA, 20 bp, Artificial Sequence
  Synthetic
agttgtatgcctttgcctcg

SEQ ID NO: 30334 - DNA, 18 bp, Artificial Sequence
  Synthetic
ttcagtcgtagccgtcga

SEQ ID NO: 30335 - DNA, 19 bp, Artificial Sequence
  Synthetic
aaagttcacctgttcctgg

SEQ ID NO: 30336 - DNA, 24 bp, Artificial Sequence
  Synthetic
tactgtacatataacactcctctc

SEQ ID NO: 30337 - DNA, 21 bp, Artificial Sequence
  Synthetic
agcaatttttccttctgctca

SEQ ID NO: 30338 - DNA, 23 bp, Artificial Sequence
  Synthetic
tctacttttcccttactgtcatg

SEQ ID NO: 30339 - DNA, 18 bp, Artificial Sequence
  Synthetic
ttgccatttggaggtcca

SEQ ID NO: 30340 - DNA, 18 bp, Artificial Sequence
  Synthetic
atcactcccaccacgatt

SEQ ID NO: 30341 - DNA, 18 bp, Artificial Sequence
  Synthetic
ggctgaggattcccgatt

SEQ ID NO: 30342 - DNA, 20 bp, Artificial Sequence
  Synthetic
tgtattcgggactgtggtga

SEQ ID NO: 30343 - DNA, 18 bp, Artificial Sequence
  Synthetic
aactgatttctgcgggga

SEQ ID NO: 30344 - DNA, 20 bp, Artificial Sequence
  Synthetic
gcaaagggtcttaaggaggg

SEQ ID NO: 30345 - DNA, 22 bp, Artificial Sequence
  Synthetic
caaaggtggttcagtattaact

SEQ ID NO: 30346 - DNA, 21 bp, Artificial Sequence
  Synthetic
atcctgatcaattctgcaatt

SEQ ID NO: 30347 - DNA, 21 bp, Artificial Sequence
  Synthetic
gtattcacatccagtttcctg

SEQ ID NO: 30348 - DNA, 18 bp, Artificial Sequence
  Synthetic
aatcaccgacccccgttt

SEQ ID NO: 30349 - DNA, 20 bp, Artificial Sequence
  Synthetic
cagtgtgtttataaggggca

SEQ ID NO: 30350 - DNA, 25 bp, Artificial Sequence
  Synthetic
gcagattatcataatgtaagttctg

SEQ ID NO: 30351 - DNA, 19 bp, Artificial Sequence
  Synthetic
cctgcgtgacttgcacttt

SEQ ID NO: 30352 - DNA, 22 bp, Artificial Sequence
  Synthetic
gtttctattatgaaggtttgcc

SEQ ID NO: 30353 - DNA, 20 bp, Artificial Sequence
  Synthetic
tctactaaccatgcttcagc

SEQ ID NO: 30354 - DNA, 20 bp, Artificial Sequence
  Synthetic
tgtactcgttcctactggat

SEQ ID NO: 30355 - DNA, 18 bp, Artificial Sequence
  Synthetic
ggaagtgtgtttgcgaaa

SEQ ID NO: 30356 - DNA, 19 bp, Artificial Sequence
  Synthetic
gggcctaatgtgaagacag

SEQ ID NO: 30357 - DNA, 25 bp, Artificial Sequence
  Synthetic
gcttctaatctattgaagaatcctt

SEQ ID NO: 30358 - DNA, 22 bp, Artificial Sequence
  Synthetic
ccatgtccaaatatgttcttcc

SEQ ID NO: 30359 - DNA, 18 bp, Artificial Sequence
  Synthetic
tcttctgcaccacgaatc

SEQ ID NO: 30360 - DNA, 24 bp, Artificial Sequence
  Synthetic
cttctattgtccaagtatcctgtt

SEQ ID NO: 30361 - DNA, 18 bp, Artificial Sequence
  Synthetic
tatcgtcggctttgcatg

SEQ ID NO: 30362 - DNA, 20 bp, Artificial Sequence
  Synthetic
tgcccatattctcaggtaga

SEQ ID NO: 30363 - DNA, 18 bp, Artificial Sequence
  Synthetic
ttacgcttgatggtcgtc

SEQ ID NO: 30364 - DNA, 21 bp, Artificial Sequence
  Synthetic
tggactttttgtgttgttgtt

SEQ ID NO: 30365 - DNA, 21 bp, Artificial Sequence
  Synthetic
ctctcttatcaagtcaggctt

SEQ ID NO: 30366 - DNA, 23 bp, Artificial Sequence
  Synthetic
atctcctaccttgactattctga

SEQ ID NO: 30367 - DNA, 23 bp, Artificial Sequence
  Synthetic
ctagagctactttattggcatta

SEQ ID NO: 30368 - DNA, 18 bp, Artificial Sequence
  Synthetic
aacggggaggattccttt

SEQ ID NO: 30369 - DNA, 18 bp, Artificial Sequence
  Synthetic
ttggaacacagcatcgac

SEQ ID NO: 30370 - DNA, 23 bp, Artificial Sequence
  Synthetic
ttgcttttgttcttgtttgtgat

SEQ ID NO: 30371 - DNA, 18 bp, Artificial Sequence
  Synthetic
tcagctaatgcaatgccc

SEQ ID NO: 30372 - DNA, 25 bp, Artificial Sequence
  Synthetic
cctggtatttctgataaaattggta

SEQ ID NO: 30373 - DNA, 23 bp, Artificial Sequence
  Synthetic
cccttttattggcatatagttct

SEQ ID NO: 30374 - DNA, 24 bp, Artificial Sequence
  Synthetic
ccaatatgaactatttgttttccc

SEQ ID NO: 30375 - DNA, 25 bp, Artificial Sequence
  Synthetic
gataatgaaggtagtctaacacatc

SEQ ID NO: 30376 - DNA, 19 bp, Artificial Sequence
  Synthetic
ccttcactcgagtagtctg

SEQ ID NO: 30377 - DNA, 23 bp, Artificial Sequence
  Synthetic
tgattaacattggtacatctgtt

SEQ ID NO: 30378 - DNA, 18 bp, Artificial Sequence
  Synthetic
gacaggacttcatgaggc

SEQ ID NO: 30379 - DNA, 25 bp, Artificial Sequence
  Synthetic
gagtgatacatgatgtagtagtgta

SEQ ID NO: 30380 - DNA, 24 bp, Artificial Sequence
  Synthetic
tcagagactgaaaaaatggatctt

SEQ ID NO: 30381 - DNA, 24 bp, Artificial Sequence
  Synthetic
agtgataaaggttctagtagtgat

SEQ ID NO: 30382 - DNA, 20 bp, Artificial Sequence
  Synthetic
atcttggaacacctgagaca

SEQ ID NO: 30383 - DNA, 22 bp, Artificial Sequence
  Synthetic
gtgatttcttcatagacgtgag

SEQ ID NO: 30384 - DNA, 21 bp, Artificial Sequence
  Synthetic
acctgctttgatgaatctctt

SEQ ID NO: 30385 - DNA, 23 bp, Artificial Sequence
  Synthetic
tttacatatttctgagccttcaa

SEQ ID NO: 30386 - DNA, 22 bp, Artificial Sequence
  Synthetic
gtagcagtatctctcaatctgt

SEQ ID NO: 30387 - DNA, 24 bp, Artificial Sequence
  Synthetic
ccagaatcgtttgaatattttagg

SEQ ID NO: 30388 - DNA, 18 bp, Artificial Sequence
  Synthetic
cccttaacccccagaagg

SEQ ID NO: 30389 - DNA, 19 bp, Artificial Sequence
  Synthetic
gttcatgcagggtcctaat

SEQ ID NO: 30390 - DNA, 21 bp, Artificial Sequence
  Synthetic
attgatgtgttctgttgactg

SEQ ID NO: 30391 - DNA, 18 bp, Artificial Sequence
  Synthetic
tatagtgttggctagcgc

SEQ ID NO: 30392 - DNA, 25 bp, Artificial Sequence
  Synthetic
ttatcagatagcttctcttgttcaa

SEQ ID NO: 30393 - DNA, 21 bp, Artificial Sequence
  Synthetic
ctcattccatttggtgttgtc

SEQ ID NO: 30394 - DNA, 25 bp, Artificial Sequence
  Synthetic
ggttgattcattaaagtatttcagg

SEQ ID NO: 30395 - DNA, 19 bp, Artificial Sequence
  Synthetic
cctgcttgtattccctcat

SEQ ID NO: 30396 - DNA, 18 bp, Artificial Sequence
  Synthetic
gttgaagagccatttggg

SEQ ID NO: 30397 - DNA, 21 bp, Artificial Sequence
  Synthetic
cattaccacagcattgtttac

SEQ ID NO: 30398 - DNA, 18 bp, Artificial Sequence
  Synthetic
aatccgagccctagacac

SEQ ID NO: 30399 - DNA, 23 bp, Artificial Sequence
  Synthetic
agcaattcttctgttgttaattc

SEQ ID NO: 30400 - DNA, 19 bp, Artificial Sequence
  Synthetic
gcctgtacctgatgctcct

SEQ ID NO: 30401 - DNA, 18 bp, Artificial Sequence
  Synthetic
tgcaccaccagcctaact

SEQ ID NO: 30402 - DNA, 18 bp, Artificial Sequence
  Synthetic
tttacagcctctgccaca

SEQ ID NO: 30403 - DNA, 18 bp, Artificial Sequence
  Synthetic
gtttcgccatacacctcg

SEQ ID NO: 30404 - DNA, 23 bp, Artificial Sequence
  Synthetic
atgcttacacattgtaattgcat

SEQ ID NO: 30405 - DNA, 19 bp, Artificial Sequence
  Synthetic
accaaaaatggctgcttga

SEQ ID NO: 30406 - DNA, 21 bp, Artificial Sequence
  Synthetic
taacattgcattttccaaacg

SEQ ID NO: 30407 - DNA, 22 bp, Artificial Sequence
  Synthetic
caaatttaactgttagtctgcg

SEQ ID NO: 30408 - DNA, 19 bp, Artificial Sequence
  Synthetic
acatatgagcagcagtgta

SEQ ID NO: 30409 - DNA, 18 bp, Artificial Sequence
  Synthetic
tagagggatcggcagcac

SEQ ID NO: 30410 - DNA, 20 bp, Artificial Sequence
  Synthetic
tgtgcattgggatttcctca

SEQ ID NO: 30411 - DNA, 20 bp, Artificial Sequence
  Synthetic
gccctgtactgtaagtgtgg

SEQ ID NO: 30412 - DNA, 18 bp, Artificial Sequence
  Synthetic
tataccttgccgtcacca

SEQ ID NO: 30413 - DNA, 20 bp, Artificial Sequence
  Synthetic
attagggtcaggaagctgta

SEQ ID NO: 30414 - DNA, 20 bp, Artificial Sequence
  Synthetic
taataagagtcaggcagtgc

SEQ ID NO: 30415 - DNA, 18 bp, Artificial Sequence
  Synthetic
gggggatgtagcagtaca

SEQ ID NO: 30416 - DNA, 21 bp, Artificial Sequence
  Synthetic
gtggaaaacttgtctcgtaaa

SEQ ID NO: 30417 - DNA, 18 bp, Artificial Sequence
  Synthetic
tcatacaaaccaggcacc

SEQ ID NO: 30418 - DNA, 20 bp, Artificial Sequence
  Synthetic
caacaaaaaaggcgggagac

SEQ ID NO: 30419 - DNA, 20 bp, Artificial Sequence
  Synthetic
agtttcctggctagaaaagt

SEQ ID NO: 30420 - DNA, 18 bp, Artificial Sequence
  Synthetic
gggtttggacaggacttt

SEQ ID NO: 30421 - DNA, 19 bp, Artificial Sequence
  Synthetic
ggctgttcacagttggtat

SEQ ID NO: 30422 - DNA, 16 bp, Artificial Sequence
  Synthetic
atgggggatgcggagg

SEQ ID NO: 30423 - DNA, 18 bp, Artificial Sequence
  Synthetic
taggggccaatgggaggc

SEQ ID NO: 30424 - DNA, 19 bp, Artificial Sequence
  Synthetic
ttgactttcaaacaacccg

SEQ ID NO: 30425 - DNA, 19 bp, Artificial Sequence
  Synthetic
ttctaagtaagcgccccaa

SEQ ID NO: 30426 - DNA, 16 bp, Artificial Sequence
  Synthetic
acccgctgaacccacc

SEQ ID NO: 30427 - DNA, 16 bp, Artificial Sequence
  Synthetic
attcagcggccccgtg

SEQ ID NO: 30428 - DNA, 20 bp, Artificial Sequence
  Synthetic
gccccaccttatcgttcaag

SEQ ID NO: 30429 - DNA, 18 bp, Artificial Sequence
  Synthetic
ccgccttctgccatggta

SEQ ID NO: 30430 - DNA, 19 bp, Artificial Sequence
  Synthetic
gccccccttggtagatgtt

SEQ ID NO: 30431 - DNA, 18 bp, Artificial Sequence
  Synthetic
gtttcgggcgaacgtgag

SEQ ID NO: 30432 - DNA, 20 bp, Artificial Sequence
  Synthetic
ctacggatcatgctctcacc

SEQ ID NO: 30433 - DNA, 18 bp, Artificial Sequence
  Synthetic
caggagaacgcattcggc

SEQ ID NO: 30434 - DNA, 18 bp, Artificial Sequence
  Synthetic
ccgttcccttttcagcgc

SEQ ID NO: 30435 - DNA, 20 bp, Artificial Sequence
  Synthetic
gtacttatggcagcctttgt

SEQ ID NO: 30436 - DNA, 16 bp, Artificial Sequence
  Synthetic
gtccggacggccttga

SEQ ID NO: 30437 - DNA, 20 bp, Artificial Sequence
  Synthetic
ggtcacatctcacgcatacg

SEQ ID NO: 30438 - DNA, 16 bp, Artificial Sequence
  Synthetic
atacccccacacggcg

SEQ ID NO: 30439 - DNA, 17 bp, Artificial Sequence
  Synthetic
tgcaggagtggacgctg

SEQ ID NO: 30440 - DNA, 20 bp, Artificial Sequence
  Synthetic
cgttgaatctctacacggca

SEQ ID NO: 30441 - DNA, 18 bp, Artificial Sequence
  Synthetic
cgctggcaattgacctgc

SEQ ID NO: 30442 - DNA, 16 bp, Artificial Sequence
  Synthetic
ggctcctcagggtgct

SEQ ID NO: 30443 - DNA, 18 bp, Artificial Sequence
  Synthetic
gcccccagttggattccg

SEQ ID NO: 30444 - DNA, 18 bp, Artificial Sequence
  Synthetic
cgtccccgtggatacctg

SEQ ID NO: 30445 - DNA, 20 bp, Artificial Sequence
  Synthetic
ccgctattacaatgttggcg

SEQ ID NO: 30446 - DNA, 20 bp, Artificial Sequence
  Synthetic
cggaattggagtctccggat

SEQ ID NO: 30447 - DNA, 20 bp, Artificial Sequence
  Synthetic
cggactggtccatgtgttcc

SEQ ID NO: 30448 - DNA, 20 bp, Artificial Sequence
  Synthetic
attccaagcaggggtttagc

SEQ ID NO: 30449 - DNA, 20 bp, Artificial Sequence
  Synthetic
gctttggagaacccctttgg

SEQ ID NO: 30450 - DNA, 19 bp, Artificial Sequence
  Synthetic
gggcgccattactcgaatg

SEQ ID NO: 30451 - DNA, 17 bp, Artificial Sequence
  Synthetic
tgcagtgtcccaacccg

SEQ ID NO: 30452 - DNA, 17 bp, Artificial Sequence
  Synthetic
acgccatgcttgggtca

SEQ ID NO: 30453 - DNA, 19 bp, Artificial Sequence
  Synthetic
cagtcgaacagggtgttgg

SEQ ID NO: 30454 - DNA, 19 bp, Artificial Sequence
  Synthetic
gagcagcagcaggatgagc

SEQ ID NO: 30455 - DNA, 20 bp, Artificial Sequence
  Synthetic
agtcctactttaccggtggc

SEQ ID NO: 30456 - DNA, 20 bp, Artificial Sequence
  Synthetic
aacccgctcgaacttatggt

SEQ ID NO: 30457 - DNA, 20 bp, Artificial Sequence
  Synthetic
tggaggtccttcccttcaac

SEQ ID NO: 30458 - DNA, 16 bp, Artificial Sequence
  Synthetic
taactggcgccgtggc

SEQ ID NO: 30459 - DNA, 16 bp, Artificial Sequence
  Synthetic
aacaggctggcgtggg

SEQ ID NO: 30460 - DNA, 16 bp, Artificial Sequence
  Synthetic
tgagcccacggacgga

SEQ ID NO: 30461 - DNA, 21 bp, Artificial Sequence
  Synthetic
atatgtcagcctctgataacg

SEQ ID NO: 30462 - DNA, 16 bp, Artificial Sequence
  Synthetic
tcctcctcggtcccgt

SEQ ID NO: 30463 - DNA, 20 bp, Artificial Sequence
  Synthetic
cctgactgtggagtgtgtac

SEQ ID NO: 30464 - DNA, 23 bp, Artificial Sequence
  Synthetic
ggtcatatgcatactgtaccata

SEQ ID NO: 30465 - DNA, 19 bp, Artificial Sequence
  Synthetic
taggaactgcaacaagctc

SEQ ID NO: 30466 - DNA, 23 bp, Artificial Sequence
  Synthetic
gcaaaaggaaatggattcttaaa

SEQ ID NO: 30467 - DNA, 19 bp, Artificial Sequence
  Synthetic
catgcctccgtgctatagg

SEQ ID NO: 30468 - DNA, 16 bp, Artificial Sequence
  Synthetic
caacgcttgggtgggc

SEQ ID NO: 30469 - DNA, 23 bp, Artificial Sequence
  Synthetic
ttgaaatgtattggaccatatgt

SEQ ID NO: 30470 - DNA, 22 bp, Artificial Sequence
  Synthetic
gcagcaaatacaaaaaaaacac

SEQ ID NO: 30471 - DNA, 20 bp, Artificial Sequence
  Synthetic
tggctcagtgtatagtgggt

SEQ ID NO: 30472 - DNA, 18 bp, Artificial Sequence
  Synthetic
tagatgcggaggtggcag

SEQ ID NO: 30473 - DNA, 18 bp, Artificial Sequence
  Synthetic
cccacagtgagaagccta

SEQ ID NO: 30474 - DNA, 18 bp, Artificial Sequence
  Synthetic
atttgttccctacgcagc

SEQ ID NO: 30475 - DNA, 18 bp, Artificial Sequence
  Synthetic
ctgtaaactggcagacgg

SEQ ID NO: 30476 - DNA, 18 bp, Artificial Sequence
  Synthetic
ttaagctgggttggcaac

SEQ ID NO: 30477 - DNA, 22 bp, Artificial Sequence
  Synthetic
ggactcaaagctaatactgaat

SEQ ID NO: 30478 - DNA, 23 bp, Artificial Sequence
  Synthetic
ccaaatgattctttaaactttgc

SEQ ID NO: 30479 - DNA, 22 bp, Artificial Sequence
  Synthetic
aactgaaatgtcattaccatct

SEQ ID NO: 30480 - DNA, 21 bp, Artificial Sequence
  Synthetic
ttttctctgccaaattcagaa

SEQ ID NO: 30481 - DNA, 20 bp, Artificial Sequence
  Synthetic
ccgatatctgcgttttccgt

SEQ ID NO: 30482 - DNA, 18 bp, Artificial Sequence
  Synthetic
cacttccacctcccaaag

SEQ ID NO: 30483 - DNA, 19 bp, Artificial Sequence
  Synthetic
gctgcacttctagtactgc

SEQ ID NO: 30484 - DNA, 22 bp, Artificial Sequence
  Synthetic
tagttcctaatctgctaagcct

SEQ ID NO: 30485 - DNA, 21 bp, Artificial Sequence
  Synthetic
tcattggaagcaaaatcatct

SEQ ID NO: 30486 - DNA, 20 bp, Artificial Sequence
  Synthetic
agccttagtcctactgtcag

SEQ ID NO: 30487 - DNA, 23 bp, Artificial Sequence
  Synthetic
ctactattaaaagctgggtttgt

SEQ ID NO: 30488 - DNA, 21 bp, Artificial Sequence
  Synthetic
tcaaaatatcaggccacttac

SEQ ID NO: 30489 - DNA, 20 bp, Artificial Sequence
  Synthetic
gtaagggcgatttaggatca

SEQ ID NO: 30490 - DNA, 25 bp, Artificial Sequence
  Synthetic
ggttattcctttgtttaacaatcct

SEQ ID NO: 30491 - DNA, 18 bp, Artificial Sequence
  Synthetic
caaaagcagggtggagtg

SEQ ID NO: 30492 - DNA, 20 bp, Artificial Sequence
  Synthetic
ggagaattacccctcattct

SEQ ID NO: 30493 - DNA, 20 bp, Artificial Sequence
  Synthetic
ttcacagtcctcagttaact

SEQ ID NO: 30494 - DNA, 19 bp, Artificial Sequence
  Synthetic
gtaaaagcaagcgacatgc

SEQ ID NO: 30495 - DNA, 23 bp, Artificial Sequence
  Synthetic
tctgaatcttctgtaaatccatt

SEQ ID NO: 30496 - DNA, 19 bp, Artificial Sequence
  Synthetic
tgtaagtcgcgagagaccc

SEQ ID NO: 30497 - DNA, 20 bp, Artificial Sequence
  Synthetic
acgtcttttattggcttgca

SEQ ID NO: 30498 - DNA, 18 bp, Artificial Sequence
  Synthetic
ctacagtgccacctagtg

SEQ ID NO: 30499 - DNA, 18 bp, Artificial Sequence
  Synthetic
gctatcagcagtaccacc

SEQ ID NO: 30500 - DNA, 23 bp, Artificial Sequence
  Synthetic
tcttctaattcaaattcactcct

SEQ ID NO: 30501 - DNA, 25 bp, Artificial Sequence
  Synthetic
ggcctatttaaaattcttacatcag

SEQ ID NO: 30502 - DNA, 25 bp, Artificial Sequence
  Synthetic
cgttttctttttcgagaatacaaac

SEQ ID NO: 30503 - DNA, 24 bp, Artificial Sequence
  Synthetic
tctaaataccctgaattgattacc

SEQ ID NO: 30504 - DNA, 22 bp, Artificial Sequence
  Synthetic
caattgattttgtttgggatca

SEQ ID NO: 30505 - DNA, 18 bp, Artificial Sequence
  Synthetic
atttgcaccctgagctct

SEQ ID NO: 30506 - DNA, 22 bp, Artificial Sequence
  Synthetic
gatatgttttgaagtgccaaat

SEQ ID NO: 30507 - DNA, 25 bp, Artificial Sequence
  Synthetic
gatgaaaattttagcaatacatccg

SEQ ID NO: 30508 - DNA, 19 bp, Artificial Sequence
  Synthetic
agcaaagtgtctgcattct

SEQ ID NO: 30509 - DNA, 24 bp, Artificial Sequence
  Synthetic
gcttctccatattttattttgacc

SEQ ID NO: 30510 - DNA, 19 bp, Artificial Sequence
  Synthetic
gtctctacaggcacattct

SEQ ID NO: 30511 - DNA, 18 bp, Artificial Sequence
  Synthetic
tcgttcgggagtaccatc

SEQ ID NO: 30512 - DNA, 18 bp, Artificial Sequence
  Synthetic
tatcaacgcctgtgacag

SEQ ID NO: 30513 - DNA, 22 bp, Artificial Sequence
  Synthetic
tcctgtctgtattctttccaag

SEQ ID NO: 30514 - DNA, 18 bp, Artificial Sequence
  Synthetic
gcctccaactcttgttca

SEQ ID NO: 30515 - DNA, 18 bp, Artificial Sequence
  Synthetic
tcgctacacccttctttg

SEQ ID NO: 30516 - DNA, 20 bp, Artificial Sequence
  Synthetic
gtgggctaagttgttgaact

SEQ ID NO: 30517 - DNA, 23 bp, Artificial Sequence
  Synthetic
cactatttgccattttagcataa

SEQ ID NO: 30518 - DNA, 19 bp, Artificial Sequence
  Synthetic
attgaaacgagcgttgagt

SEQ ID NO: 30519 - DNA, 20 bp, Artificial Sequence
  Synthetic
ggagacttttgcaagctttg

SEQ ID NO: 30520 - DNA, 19 bp, Artificial Sequence
  Synthetic
gttgttaatgcggacttca

SEQ ID NO: 30521 - DNA, 17 bp, Artificial Sequence
  Synthetic
ctgtggctgtggctgtg

SEQ ID NO: 30522 - DNA, 19 bp, Artificial Sequence
  Synthetic
tacttctccctcccctccc

SEQ ID NO: 30523 - DNA, 23 bp, Artificial Sequence
  Synthetic
cgcttcttatctctgtatctgta

SEQ ID NO: 30524 - DNA, 20 bp, Artificial Sequence
  Synthetic
ctacagcttgtgtgatgttg

SEQ ID NO: 30525 - DNA, 19 bp, Artificial Sequence
  Synthetic
gtaaagagggcggcttaat

SEQ ID NO: 30526 - DNA, 22 bp, Artificial Sequence
  Synthetic
ggcagttcctgaacatttaaat

SEQ ID NO: 30527 - DNA, 23 bp, Artificial Sequence
  Synthetic
gaattattacagttggcaaatcg

SEQ ID NO: 30528 - DNA, 23 bp, Artificial Sequence
  Synthetic
caaaatatggatgtcctacagtt

SEQ ID NO: 30529 - DNA, 24 bp, Artificial Sequence
  Synthetic
tcctgtctatcatctttagaagtt

SEQ ID NO: 30530 - DNA, 20 bp, Artificial Sequence
  Synthetic
acggtagggaaatagatgga

SEQ ID NO: 30531 - DNA, 18 bp, Artificial Sequence
  Synthetic
gttgtagcccagcttgaa

SEQ ID NO: 30532 - DNA, 21 bp, Artificial Sequence
  Synthetic
ctccttcttccgtaaaagctc

SEQ ID NO: 30533 - DNA, 22 bp, Artificial Sequence
  Synthetic
cttcttgcattgatttcctttc

SEQ ID NO: 30534 - DNA, 21 bp, Artificial Sequence
  Synthetic
tgctcattacaaaagccttct

SEQ ID NO: 30535 - DNA, 18 bp, Artificial Sequence
  Synthetic
accacagaaagcctgact

SEQ ID NO: 30536 - DNA, 20 bp, Artificial Sequence
  Synthetic
ttttgctgctgattgttctg

SEQ ID NO: 30537 - DNA, 18 bp, Artificial Sequence
  Synthetic
aaacagtttctgggtggc

SEQ ID NO: 30538 - DNA, 18 bp, Artificial Sequence
  Synthetic
cctcttgggtgtcagaaa

SEQ ID NO: 30539 - DNA, 20 bp, Artificial Sequence
  Synthetic
acaaacacattgacatcagc

SEQ ID NO: 30540 - DNA, 20 bp, Artificial Sequence
  Synthetic
cctccatttgaccttgtgct

SEQ ID NO: 30541 - DNA, 23 bp, Artificial Sequence
  Synthetic
gaaggtccaataggtatagtagg

SEQ ID NO: 30542 - DNA, 20 bp, Artificial Sequence
  Synthetic
tgtagcaaaattaactgccc

SEQ ID NO: 30543 - DNA, 22 bp, Artificial Sequence
  Synthetic
cctaaatttaagtctggtggtg

SEQ ID NO: 30544 - DNA, 21 bp, Artificial Sequence
  Synthetic
ctgacaaatcaactgtccaaa

SEQ ID NO: 30545 - DNA, 18 bp, Artificial Sequence
  Synthetic
tgaaaattctcccggcag

SEQ ID NO: 30546 - DNA, 24 bp, Artificial Sequence
  Synthetic
ggctgttaatatactttcgcttta

SEQ ID NO: 30547 - DNA, 22 bp, Artificial Sequence
  Synthetic
tttagcaagaataacagctctt

SEQ ID NO: 30548 - DNA, 23 bp, Artificial Sequence
  Synthetic
tctgctaataatgcatagtgaaa

SEQ ID NO: 30549 - DNA, 22 bp, Artificial Sequence
  Synthetic
gaacctttcactaagaggacat

SEQ ID NO: 30550 - DNA, 20 bp, Artificial Sequence
  Synthetic
cttggttttggaagggattc

SEQ ID NO: 30551 - DNA, 21 bp, Artificial Sequence
  Synthetic
ggcaaagtttgtacatcaagt

SEQ ID NO: 30552 - DNA, 18 bp, Artificial Sequence
  Synthetic
tgcatagaagccctttgg

SEQ ID NO: 30553 - DNA, 25 bp, Artificial Sequence
  Synthetic
cctacaataaatatctgagtttgct

SEQ ID NO: 30554 - DNA, 23 bp, Artificial Sequence
  Synthetic
gcaaagaaaaacaattcattacc

SEQ ID NO: 30555 - DNA, 19 bp, Artificial Sequence
  Synthetic
ggtggaggaacaaaagcta

SEQ ID NO: 30556 - DNA, 22 bp, Artificial Sequence
  Synthetic
atgtttggaatgatactgacag

SEQ ID NO: 30557 - DNA, 24 bp, Artificial Sequence
  Synthetic
aatcttaaacacattccataaccg

SEQ ID NO: 30558 - DNA, 19 bp, Artificial Sequence
  Synthetic
aatagtaggttcctggccc

SEQ ID NO: 30559 - DNA, 18 bp, Artificial Sequence
  Synthetic
tagtgggatctgccatgg

SEQ ID NO: 30560 - DNA, 20 bp, Artificial Sequence
  Synthetic
ggcccttgtattactctgta

SEQ ID NO: 30561 - DNA, 20 bp, Artificial Sequence
  Synthetic
ctaacgccaattctgcatat

SEQ ID NO: 30562 - DNA, 20 bp, Artificial Sequence
  Synthetic
gggctcgaggtactagcaac

SEQ ID NO: 30563 - DNA, 25 bp, Artificial Sequence
  Synthetic
agctagcatatttctgattacatct

SEQ ID NO: 30564 - DNA, 22 bp, Artificial Sequence
  Synthetic
ggtggtcctatagggtctatag

SEQ ID NO: 30565 - DNA, 23 bp, Artificial Sequence
  Synthetic
taatgtgaaccaattgatatggt

SEQ ID NO: 30566 - DNA, 18 bp, Artificial Sequence
  Synthetic
agttgttggcacctgttg

SEQ ID NO: 30567 - DNA, 18 bp, Artificial Sequence
  Synthetic
aatctcctggctgtttgg

SEQ ID NO: 30568 - DNA, 21 bp, Artificial Sequence
  Synthetic
tctagcccaaaaatgtctagc

SEQ ID NO: 30569 - DNA, 23 bp, Artificial Sequence
  Synthetic
tcacagttttctttcttacagta

SEQ ID NO: 30570 - DNA, 21 bp, Artificial Sequence
  Synthetic
aaaagagtaaagccgtccaaa

SEQ ID NO: 30571 - DNA, 19 bp, Artificial Sequence
  Synthetic
accgttttcgttgcaagta

SEQ ID NO: 30572 - DNA, 20 bp, Artificial Sequence
  Synthetic
tctcccaattccatcaatca

SEQ ID NO: 30573 - DNA, 20 bp, Artificial Sequence
  Synthetic
cctctttttcgaagtcgtac

SEQ ID NO: 30574 - DNA, 22 bp, Artificial Sequence
  Synthetic
tgttctcatttgaagcaatttg

SEQ ID NO: 30575 - DNA, 18 bp, Artificial Sequence
  Synthetic
ggttttgcaccttccatc

SEQ ID NO: 30576 - DNA, 21 bp, Artificial Sequence
  Synthetic
cgatgtttcttgtacctcaca

SEQ ID NO: 30577 - DNA, 18 bp, Artificial Sequence
  Synthetic
ttgtctagcttgctgtgg

SEQ ID NO: 30578 - DNA, 18 bp, Artificial Sequence
  Synthetic
ttttactccttcccggca

SEQ ID NO: 30579 - DNA, 19 bp, Artificial Sequence
  Synthetic
aacacagctttgcctgtac

SEQ ID NO: 30580 - DNA, 23 bp, Artificial Sequence
  Synthetic
ctgtgcattactatctacatctg

SEQ ID NO: 30581 - DNA, 19 bp, Artificial Sequence
  Synthetic
actttcctgtgtttggtgg

SEQ ID NO: 30582 - DNA, 19 bp, Artificial Sequence
  Synthetic
cgacaacagtttcaacagg

SEQ ID NO: 30583 - DNA, 20 bp, Artificial Sequence
  Synthetic
aacaggtagaaaacaacgag

SEQ ID NO: 30584 - DNA, 19 bp, Artificial Sequence
  Synthetic
acgtttgatacagctgagt

SEQ ID NO: 30585 - DNA, 24 bp, Artificial Sequence
  Synthetic
tcataactatgtacaccagatgtg

SEQ ID NO: 30586 - DNA, 20 bp, Artificial Sequence
  Synthetic
caagcctactaaaacgcaca

SEQ ID NO: 30587 - DNA, 18 bp, Artificial Sequence
  Synthetic
ggtgtaggaggcaggtaa

SEQ ID NO: 30588 - DNA, 19 bp, Artificial Sequence
  Synthetic
acttattgggatcgggcaa

SEQ ID NO: 30589 - DNA, 23 bp, Artificial Sequence
  Synthetic
acatactgtttaatttggcttga

SEQ ID NO: 30590 - DNA, 19 bp, Artificial Sequence
  Synthetic
ttagctagtgggtcctctt

SEQ ID NO: 30591 - DNA, 25 bp, Artificial Sequence
  Synthetic
catacaaaaacatacattcatgcac

SEQ ID NO: 30592 - DNA, 21 bp, Artificial Sequence
  Synthetic
gcataaaatggacactactgt

SEQ ID NO: 30593 - DNA, 20 bp, Artificial Sequence
  Synthetic
agacacatagttggctacca

SEQ ID NO: 30594 - DNA, 22 bp, Artificial Sequence
  Synthetic
acagtccaattctatttcatgt

SEQ ID NO: 30595 - DNA, 19 bp, Artificial Sequence
  Synthetic
attctgtaccaggcttgct

SEQ ID NO: 30596 - DNA, 19 bp, Artificial Sequence
  Synthetic
attgcatcccctgttttcc

SEQ ID NO: 30597 - DNA, 23 bp, Artificial Sequence
  Synthetic
cctcagatgctaataatgcatat

SEQ ID NO: 30598 - DNA, 24 bp, Artificial Sequence
  Synthetic
gatgttattagtaatggaggacat

SEQ ID NO: 30599 - DNA, 18 bp, Artificial Sequence
  Synthetic
tgcacagtgtctccatca

SEQ ID NO: 30600 - DNA, 23 bp, Artificial Sequence
  Synthetic
ttctgtgttatagcttgattcat

SEQ ID NO: 30601 - DNA, 19 bp, Artificial Sequence
  Synthetic
cacatatcctgtacgaccc

SEQ ID NO: 30602 - DNA, 22 bp, Artificial Sequence
  Synthetic
cagatacttgtgtagtgtcact

SEQ ID NO: 30603 - DNA, 22 bp, Artificial Sequence
  Synthetic
cacttctagtaaacatagtggc

SEQ ID NO: 30604 - DNA, 23 bp, Artificial Sequence
  Synthetic
gttacatactcttcagtgcttac

SEQ ID NO: 30605 - DNA, 21 bp, Artificial Sequence
  Synthetic
gtggtgttctttaattcaagc

SEQ ID NO: 30606 - DNA, 18 bp, Artificial Sequence
  Synthetic
cacaactggatggcgatg

SEQ ID NO: 30607 - DNA, 18 bp, Artificial Sequence
  Synthetic
aatccaagttgcctgcag

SEQ ID NO: 30608 - DNA, 18 bp, Artificial Sequence
  Synthetic
atcgcagagcttcccatt

SEQ ID NO: 30609 - DNA, 20 bp, Artificial Sequence
  Synthetic
aaatggtttgttctgctcaa

SEQ ID NO: 30610 - DNA, 20 bp, Artificial Sequence
  Synthetic
tgatgttccaacggaaatgt

SEQ ID NO: 30611 - DNA, 21 bp, Artificial Sequence
  Synthetic
tggcatactagagtttatcgc

SEQ ID NO: 30612 - DNA, 21 bp, Artificial Sequence
  Synthetic
gtgactccatctattgccttt

SEQ ID NO: 30613 - DNA, 20 bp, Artificial Sequence
  Synthetic
cctttgcattatccctaagc

SEQ ID NO: 30614 - DNA, 21 bp, Artificial Sequence
  Synthetic
aaagatagaccagctaccatg

SEQ ID NO: 30615 - DNA, 19 bp, Artificial Sequence
  Synthetic
cgtccaattccaccaatca

SEQ ID NO: 30616 - DNA, 18 bp, Artificial Sequence
  Synthetic
ccattattagcttggcgc

SEQ ID NO: 30617 - DNA, 23 bp, Artificial Sequence
  Synthetic
aattcttgtttttcgtccattct

SEQ ID NO: 30618 - DNA, 21 bp, Artificial Sequence
  Synthetic
acttgattccatagtctccat

SEQ ID NO: 30619 - DNA, 18 bp, Artificial Sequence
  Synthetic
aggttttgtgacactgcc

SEQ ID NO: 30620 - DNA, 20 bp, Artificial Sequence
  Synthetic
cctagtccactgtcctcaaa

SEQ ID NO: 30621 - DNA, 23 bp, Artificial Sequence
  Synthetic
gtacatgcaatacattacacaat

SEQ ID NO: 30622 - DNA, 24 bp, Artificial Sequence
  Synthetic
agtccattcctcatatatacatcc

SEQ ID NO: 30623 - DNA, 18 bp, Artificial Sequence
  Synthetic
catctatgtctgtgcggc

SEQ ID NO: 30624 - DNA, 18 bp, Artificial Sequence
  Synthetic
ctgcagatacctgtccac

SEQ ID NO: 30625 - DNA, 23 bp, Artificial Sequence
  Synthetic
gtttcattctatacctccaacat

SEQ ID NO: 30626 - DNA, 24 bp, Artificial Sequence
  Synthetic
tgtctaaaggtatagattcaccta

SEQ ID NO: 30627 - DNA, 18 bp, Artificial Sequence
  Synthetic
gggccaacaagtgtatga

SEQ ID NO: 30628 - DNA, 23 bp, Artificial Sequence
  Synthetic
ctgcaaaacattaaaaaccagac

SEQ ID NO: 30629 - DNA, 18 bp, Artificial Sequence
  Synthetic
gacaggtgcctttaggag

SEQ ID NO: 30630 - DNA, 24 bp, Artificial Sequence
  Synthetic
cataatacagcattattagcaccc

SEQ ID NO: 30631 - DNA, 18 bp, Artificial Sequence
  Synthetic
aaaagcgcctaccaagag

SEQ ID NO: 30632 - DNA, 18 bp, Artificial Sequence
  Synthetic
actgtaaaagcaccgctc

SEQ ID NO: 30633 - DNA, 20 bp, Artificial Sequence
  Synthetic
aaatggagtctggaacactg

SEQ ID NO: 30634 - DNA, 20 bp, Artificial Sequence
  Synthetic
atctacatctgcatgcattg

SEQ ID NO: 30635 - DNA, 19 bp, Artificial Sequence
  Synthetic
tggggctttatgttttgca

SEQ ID NO: 30636 - DNA, 21 bp, Artificial Sequence
  Synthetic
tggtgaattttgtaagcttct

SEQ ID NO: 30637 - DNA, 16 bp, Artificial Sequence
  Synthetic
actggagtctgcggcg

SEQ ID NO: 30638 - DNA, 20 bp, Artificial Sequence
  Synthetic
ttgcaatcaatggatcccga

SEQ ID NO: 30639 - DNA, 21 bp, Artificial Sequence
  Synthetic
tgctaggattcatagtgcaat

SEQ ID NO: 30640 - DNA, 19 bp, Artificial Sequence
  Synthetic
cttgctctacatgcctttg

SEQ ID NO: 30641 - DNA, 18 bp, Artificial Sequence
  Synthetic
ttctggtttgcatggtcc

SEQ ID NO: 30642 - DNA, 25 bp, Artificial Sequence
  Synthetic
gttgagcttctaatattaattgtgc

SEQ ID NO: 30643 - DNA, 21 bp, Artificial Sequence
  Synthetic
ggatccatagcaacatctact

SEQ ID NO: 30644 - DNA, 23 bp, Artificial Sequence
  Synthetic
cgttattagcaccttgtgaatta

SEQ ID NO: 30645 - DNA, 19 bp, Artificial Sequence
  Synthetic
catcggtccttacacgttt

SEQ ID NO: 30646 - DNA, 18 bp, Artificial Sequence
  Synthetic
aaaacatggaagggctgc

SEQ ID NO: 30647 - DNA, 24 bp, Artificial Sequence
  Synthetic
gatgaaactattacttcctcactt

SEQ ID NO: 30648 - DNA, 22 bp, Artificial Sequence
  Synthetic
tgcttgatctacaataaaccat

SEQ ID NO: 30649 - DNA, 21 bp, Artificial Sequence
  Synthetic
ttgctgtttctttcagaactt

SEQ ID NO: 30650 - DNA, 23 bp, Artificial Sequence
  Synthetic
gtctgactcaatatgtttcagaa

SEQ ID NO: 30651 - DNA, 20 bp, Artificial Sequence
  Synthetic
cgtcttcgtcgaagtggaat

SEQ ID NO: 30652 - DNA, 23 bp, Artificial Sequence
  Synthetic
attttccagaagcatttgttagc

SEQ ID NO: 30653 - DNA, 20 bp, Artificial Sequence
  Synthetic
attacagtagtctcagctgg

SEQ ID NO: 30654 - DNA, 22 bp, Artificial Sequence
  Synthetic
agaagatttaggcctaacatct

SEQ ID NO: 30655 - DNA, 18 bp, Artificial Sequence
  Synthetic
cttgttgaacccgccttc

SEQ ID NO: 30656 - DNA, 22 bp, Artificial Sequence
  Synthetic
tcataataaaagtgcactgcct

SEQ ID NO: 30657 - DNA, 18 bp, Artificial Sequence
  Synthetic
atactctggccacaggtt

SEQ ID NO: 30658 - DNA, 22 bp, Artificial Sequence
  Synthetic
cacctttctcaattaaagcaaa

SEQ ID NO: 30659 - DNA, 22 bp, Artificial Sequence
  Synthetic
cctttctaacttgtactccttc

SEQ ID NO: 30660 - DNA, 19 bp, Artificial Sequence
  Synthetic
gtttccccagcatattcca

SEQ ID NO: 30661 - DNA, 17 bp, Artificial Sequence
  Synthetic
tcggctagcagtctcgc

SEQ ID NO: 30662 - DNA, 18 bp, Artificial Sequence
  Synthetic
accctgtgaagaggcagc

SEQ ID NO: 30663 - DNA, 18 bp, Artificial Sequence
  Synthetic
aggagcaaccaggcaagt

SEQ ID NO: 30664 - DNA, 18 bp, Artificial Sequence
  Synthetic
gtagctgacgccaccact

SEQ ID NO: 30665 - DNA, 20 bp, Artificial Sequence
  Synthetic
ccaaagtaagcgaggccaaa

SEQ ID NO: 30666 - DNA, 19 bp, Artificial Sequence
  Synthetic
caataccacacggcgatgg

SEQ ID NO: 30667 - DNA, 19 bp, Artificial Sequence
  Synthetic
caagcggagtatgtggcac

SEQ ID NO: 30668 - DNA, 19 bp, Artificial Sequence
  Synthetic
ggtgcaggtggatcagtcc

SEQ ID NO: 30669 - DNA, 19 bp, Artificial Sequence
  Synthetic
acgtcaccagagggacaac

SEQ ID NO: 30670 - DNA, 20 bp, Artificial Sequence
  Synthetic
tgtcaaagacaaggcctgga

SEQ ID NO: 30671 - DNA, 18 bp, Artificial Sequence
  Synthetic
ccgagccgagctgagaca

SEQ ID NO: 30672 - DNA, 18 bp, Artificial Sequence
  Synthetic
tctggaggacaggcccac

SEQ ID NO: 30673 - DNA, 20 bp, Artificial Sequence
  Synthetic
gcatcttctcgatgggaaca

SEQ ID NO: 30674 - DNA, 20 bp, Artificial Sequence
  Synthetic
tggcatggcattcatcacat

SEQ ID NO: 30675 - DNA, 20 bp, Artificial Sequence
  Synthetic
gggatcaccgaaacatccaa

SEQ ID NO: 30676 - DNA, 18 bp, Artificial Sequence
  Synthetic
cgaacataccggatggcc

SEQ ID NO: 30677 - DNA, 18 bp, Artificial Sequence
  Synthetic
tatccaagacggcgaggg

SEQ ID NO: 30678 - DNA, 19 bp, Artificial Sequence
  Synthetic
gccaacactacccactgcc

SEQ ID NO: 30679 - DNA, 18 bp, Artificial Sequence
  Synthetic
atgtagtgggtcggcgac

SEQ ID NO: 30680 - DNA, 18 bp, Artificial Sequence
  Synthetic
gtttcggcaggtcttggg

SEQ ID NO: 30681 - DNA, 18 bp, Artificial Sequence
  Synthetic
cttcccggatcatgggct

SEQ ID NO: 30682 - DNA, 18 bp, Artificial Sequence
  Synthetic
acctctcagcgagttccg

SEQ ID NO: 30683 - DNA, 18 bp, Artificial Sequence
  Synthetic
tagctggctttttcccgc

SEQ ID NO: 30684 - DNA, 19 bp, Artificial Sequence
  Synthetic
aaccgaccctctgaccttt

SEQ ID NO: 30685 - DNA, 18 bp, Artificial Sequence
  Synthetic
ggtcataagcgggctggg

SEQ ID NO: 30686 - DNA, 16 bp, Artificial Sequence
  Synthetic
atgggctctgggcgtg

SEQ ID NO: 30687 - DNA, 22 bp, Artificial Sequence
  Synthetic
ttccatggttttatttcaggat

SEQ ID NO: 30688 - DNA, 18 bp, Artificial Sequence
  Synthetic
gtagtcgtctgggtgatc

SEQ ID NO: 30689 - DNA, 19 bp, Artificial Sequence
  Synthetic
ggtaatggcccatttgttg

SEQ ID NO: 30690 - DNA, 24 bp, Artificial Sequence
  Synthetic
gctccatttaaatcattcaaccta

SEQ ID NO: 30691 - DNA, 18 bp, Artificial Sequence
  Synthetic
tgtctcctgtcacagtca

SEQ ID NO: 30692 - DNA, 18 bp, Artificial Sequence
  Synthetic
tcttcccttccactttgg

SEQ ID NO: 30693 - DNA, 20 bp, Artificial Sequence
  Synthetic
tgcttctttgataccctcaa

SEQ ID NO: 30694 - DNA, 20 bp, Artificial Sequence
  Synthetic
tcgtgcatccattcttaatc

SEQ ID NO: 30695 - DNA, 18 bp, Artificial Sequence
  Synthetic
gatgtccttggcatgagt

SEQ ID NO: 30696 - DNA, 23 bp, Artificial Sequence
  Synthetic
ggcaaaatcttaactttctcaaa

SEQ ID NO: 30697 - DNA, 20 bp, Artificial Sequence
  Synthetic
ggaaacataggttcccacat

SEQ ID NO: 30698 - DNA, 21 bp, Artificial Sequence
  Synthetic
ggacattgtgaaaaggtagtg

SEQ ID NO: 30699 - DNA, 21 bp, Artificial Sequence
  Synthetic
ccttttgagtggattctttgt

SEQ ID NO: 30700 - DNA, 25 bp, Artificial Sequence
  Synthetic
caagttttctcactatacattcatg

SEQ ID NO: 30701 - DNA, 25 bp, Artificial Sequence
  Synthetic
gcacatcataattaggagtatcaat

SEQ ID NO: 30702 - DNA, 18 bp, Artificial Sequence
  Synthetic
gccacctctggtagaaga

SEQ ID NO: 30703 - DNA, 22 bp, Artificial Sequence
  Synthetic
actgtagttaatcacaccattt

SEQ ID NO: 30704 - DNA, 20 bp, Artificial Sequence
  Synthetic
tgatgtgtcttttgccatct

SEQ ID NO: 30705 - DNA, 24 bp, Artificial Sequence
  Synthetic
ccccatctttttttgtaactatag

SEQ ID NO: 30706 - DNA, 19 bp, Artificial Sequence
  Synthetic
cagcttgcttctttcatcc

SEQ ID NO: 30707 - DNA, 21 bp, Artificial Sequence
  Synthetic
ttttctaggtaagctccaaga

SEQ ID NO: 30708 - DNA, 18 bp, Artificial Sequence
  Synthetic
tggttgattttgcctggc

SEQ ID NO: 30709 - DNA, 18 bp, Artificial Sequence
  Synthetic
actttgtggtttgccgag

SEQ ID NO: 30710 - DNA, 18 bp, Artificial Sequence
  Synthetic
tttttgtgggcttggtgg

SEQ ID NO: 30711 - DNA, 25 bp, Artificial Sequence
  Synthetic
ctttttaatgactactggtttgttg

SEQ ID NO: 30712 - DNA, 19 bp, Artificial Sequence
  Synthetic
gcactaagatagcctttgc

SEQ ID NO: 30713 - DNA, 18 bp, Artificial Sequence
  Synthetic
tgctacagctttgcttgt

SEQ ID NO: 30714 - DNA, 25 bp, Artificial Sequence
  Synthetic
gagatttacttcacttggtaatgtt

SEQ ID NO: 30715 - DNA, 21 bp, Artificial Sequence
  Synthetic
gagtttcgatgaagttcagat

SEQ ID NO: 30716 - DNA, 21 bp, Artificial Sequence
  Synthetic
cttatcttgggtgaatttggc

SEQ ID NO: 30717 - DNA, 25 bp, Artificial Sequence
  Synthetic
catatcttgtaagactttcaggaaa

SEQ ID NO: 30718 - DNA, 25 bp, Artificial Sequence
  Synthetic
gttagttatagattttgtaccggat

SEQ ID NO: 30719 - DNA, 24 bp, Artificial Sequence
  Synthetic
ccatacttttctgttaatatgcga

SEQ ID NO: 30720 - DNA, 18 bp, Artificial Sequence
  Synthetic
caggcattgagcgggttt

SEQ ID NO: 30721 - DNA, 16 bp, Artificial Sequence
  Synthetic
gctgagcccaggtcct

SEQ ID NO: 30722 - DNA, 18 bp, Artificial Sequence
  Synthetic
gcagggccagaaggaaga

SEQ ID NO: 30723 - DNA, 20 bp, Artificial Sequence
  Synthetic
tcccgacaagcagatcgata

SEQ ID NO: 30724 - DNA, 18 bp, Artificial Sequence
  Synthetic
aggaccttcgcccagttc

SEQ ID NO: 30725 - DNA, 18 bp, Artificial Sequence
  Synthetic
tctttgcgggcacaatgc

SEQ ID NO: 30726 - DNA, 18 bp, Artificial Sequence
  Synthetic
ggcttccggatgtttgcg

SEQ ID NO: 30727 - DNA, 16 bp, Artificial Sequence
  Synthetic
gccggtggacaaggct

SEQ ID NO: 30728 - DNA, 15 bp, Artificial Sequence
  Synthetic
tgcccgctgaggcaa

SEQ ID NO: 30729 - DNA, 20 bp, Artificial Sequence
  Synthetic
gccatttgcacgtaatgacc

SEQ ID NO: 30730 - DNA, 18 bp, Artificial Sequence
  Synthetic
atctcctggcccctacgg

SEQ ID NO: 30731 - DNA, 19 bp, Artificial Sequence
  Synthetic
ggtgtcaatgagcgggaac

SEQ ID NO: 30732 - DNA, 16 bp, Artificial Sequence
  Synthetic
gctctggggcactgct

SEQ ID NO: 30733 - DNA, 18 bp, Artificial Sequence
  Synthetic
caaggacagtgccgatgc

SEQ ID NO: 30734 - DNA, 19 bp, Artificial Sequence
  Synthetic
tcgacacgacgacaacatc

SEQ ID NO: 30735 - DNA, 20 bp, Artificial Sequence
  Synthetic
gttcatgtacgctcgtagcc

SEQ ID NO: 30736 - DNA, 16 bp, Artificial Sequence
  Synthetic
gccagagcagccagga

SEQ ID NO: 30737 - DNA, 18 bp, Artificial Sequence
  Synthetic
acatgtgcttcgcccaaa

SEQ ID NO: 30738 - DNA, 20 bp, Artificial Sequence
  Synthetic
gccataccctgcaagaatgt

SEQ ID NO: 30739 - DNA, 20 bp, Artificial Sequence
  Synthetic
actccgagcttatccactga

SEQ ID NO: 30740 - DNA, 18 bp, Artificial Sequence
  Synthetic
tgcagacaccctccacag

SEQ ID NO: 30741 - DNA, 20 bp, Artificial Sequence
  Synthetic
cgcctctgctgttatatggg

SEQ ID NO: 30742 - DNA, 16 bp, Artificial Sequence
  Synthetic
ttgtagtccggccgcg

SEQ ID NO: 30743 - DNA, 18 bp, Artificial Sequence
  Synthetic
atccggatccccaggctc

SEQ ID NO: 30744 - DNA, 20 bp, Artificial Sequence
  Synthetic
agcttcctctacggatagca

SEQ ID NO: 30745 - DNA, 19 bp, Artificial Sequence
  Synthetic
aattcaacccgctgtcctg

SEQ ID NO: 30746 - DNA, 20 bp, Artificial Sequence
  Synthetic
agcaagtgagggtgttacca

SEQ ID NO: 30747 - DNA, 20 bp, Artificial Sequence
  Synthetic
agtatcatcctcgcccacag

SEQ ID NO: 30748 - DNA, 18 bp, Artificial Sequence
  Synthetic
ccacatatggcagccctg

SEQ ID NO: 30749 - DNA, 23 bp, Artificial Sequence
  Synthetic
tcatcaataaagtggaaatctga

SEQ ID NO: 30750 - DNA, 23 bp, Artificial Sequence
  Synthetic
tcagattttatcttgttggcttt

SEQ ID NO: 30751 - DNA, 21 bp, Artificial Sequence
  Synthetic
catctttgcaatcctcaaagt

SEQ ID NO: 30752 - DNA, 20 bp, Artificial Sequence
  Synthetic
gcattcaacaaagctgtgtt

SEQ ID NO: 30753 - DNA, 18 bp, Artificial Sequence
  Synthetic
ccttgacacttggcctat

SEQ ID NO: 30754 - DNA, 21 bp, Artificial Sequence
  Synthetic
ttgaaaacagatttagccagt

SEQ ID NO: 30755 - DNA, 18 bp, Artificial Sequence
  Synthetic
ggtctctagccggtcaaa

SEQ ID NO: 30756 - DNA, 22 bp, Artificial Sequence
  Synthetic
tcttcgaacttttgacctaatt

SEQ ID NO: 30757 - DNA, 18 bp, Artificial Sequence
  Synthetic
acaccgtcttcttgcaaa

SEQ ID NO: 30758 - DNA, 21 bp, Artificial Sequence
  Synthetic
cactggcttaacaccttaaat

SEQ ID NO: 30759 - DNA, 24 bp, Artificial Sequence
  Synthetic
acactattatcaataaagtccacc

SEQ ID NO: 30760 - DNA, 20 bp, Artificial Sequence
  Synthetic
acgtcagtatggccatttgg

SEQ ID NO: 30761 - DNA, 18 bp, Artificial Sequence
  Synthetic
gccatctgtcgtctgtac

SEQ ID NO: 30762 - DNA, 18 bp, Artificial Sequence
  Synthetic
ctccaggcgtatgcattt

SEQ ID NO: 30763 - DNA, 23 bp, Artificial Sequence
  Synthetic
acatattgcattgtgttatcctg

SEQ ID NO: 30764 - DNA, 21 bp, Artificial Sequence
  Synthetic
gtactagatacagatgcagga

SEQ ID NO: 30765 - DNA, 21 bp, Artificial Sequence
  Synthetic
gctggtctatgtaaagcaaat

SEQ ID NO: 30766 - DNA, 23 bp, Artificial Sequence
  Synthetic
agaaaatatgggaaacgtttacg

SEQ ID NO: 30767 - DNA, 23 bp, Artificial Sequence
  Synthetic
gccctatttaacatatgcctaac

SEQ ID NO: 30768 - DNA, 20 bp, Artificial Sequence
  Synthetic
gcacacaatgttaggttagt

SEQ ID NO: 30769 - DNA, 18 bp, Artificial Sequence
  Synthetic
tccttttcctttgcaggg

SEQ ID NO: 30770 - DNA, 20 bp, Artificial Sequence
  Synthetic
agtctaggtaggctccaagg

SEQ ID NO: 30771 - DNA, 16 bp, Artificial Sequence
  Synthetic
gtgatgagcggccagc

SEQ ID NO: 30772 - DNA, 16 bp, Artificial Sequence
  Synthetic
ttggggggctgtaggc

SEQ ID NO: 30773 - DNA, 20 bp, Artificial Sequence
  Synthetic
tcggcctctgatataaggct

SEQ ID NO: 30774 - DNA, 20 bp, Artificial Sequence
  Synthetic
cagcccattgtcaagagcta

SEQ ID NO: 30775 - DNA, 20 bp, Artificial Sequence
  Synthetic
cgcttccagtgagttggatc

SEQ ID NO: 30776 - DNA, 18 bp, Artificial Sequence
  Synthetic
cctggaggcgttctggtt

SEQ ID NO: 30777 - DNA, 19 bp, Artificial Sequence
  Synthetic
gtgggctagtgtagttggc

SEQ ID NO: 30778 - DNA, 19 bp, Artificial Sequence
  Synthetic
gtagttgcaggtccgcatg

SEQ ID NO: 30779 - DNA, 18 bp, Artificial Sequence
  Synthetic
gttctgtgacagggcctg

SEQ ID NO: 30780 - DNA, 20 bp, Artificial Sequence
  Synthetic
gaaggtttgggtggagatgt

SEQ ID NO: 30781 - DNA, 18 bp, Artificial Sequence
  Synthetic
aggtctgcaggagagagc

SEQ ID NO: 30782 - DNA, 20 bp, Artificial Sequence
  Synthetic
ataggtaggtcgggtttgtc

SEQ ID NO: 30783 - DNA, 17 bp, Artificial Sequence
  Synthetic
tctttgggatcggcggg

SEQ ID NO: 30784 - DNA, 19 bp, Artificial Sequence
  Synthetic
tggcatggtagctggagta

SEQ ID NO: 30785 - DNA, 20 bp, Artificial Sequence
  Synthetic
gagaaggaaaaaccgcattt

SEQ ID NO: 30786 - DNA, 18 bp, Artificial Sequence
  Synthetic
gggacatggagccggtaa

SEQ ID NO: 30787 - DNA, 20 bp, Artificial Sequence
  Synthetic
agttgggggttgatggctat

SEQ ID NO: 30788 - DNA, 16 bp, Artificial Sequence
  Synthetic
agaggaaagccgcggc

SEQ ID NO: 30789 - DNA, 20 bp, Artificial Sequence
  Synthetic
cagtcgccttgtacacagtc

SEQ ID NO: 30790 - DNA, 19 bp, Artificial Sequence
  Synthetic
agtatttgcgcatggcctg

SEQ ID NO: 30791 - DNA, 24 bp, Artificial Sequence
  Synthetic
ttaaaaagtagagaaatggggatg

SEQ ID NO: 30792 - DNA, 18 bp, Artificial Sequence
  Synthetic
ttgtcgtcaacgcctgag

SEQ ID NO: 30793 - DNA, 19 bp, Artificial Sequence
  Synthetic
ggtctcgacctgagctcta

SEQ ID NO: 30794 - DNA, 21 bp, Artificial Sequence
  Synthetic
tcttgtcagctgtaattggat

SEQ ID NO: 30795 - DNA, 21 bp, Artificial Sequence
  Synthetic
cagggtttatgtcaactcttc

SEQ ID NO: 30796 - DNA, 20 bp, Artificial Sequence
  Synthetic
cacttcaatgtacacactgc

SEQ ID NO: 30797 - DNA, 23 bp, Artificial Sequence
  Synthetic
atatatccacagcttgttcttcc

SEQ ID NO: 30798 - DNA, 20 bp, Artificial Sequence
  Synthetic
ttcttgtgaaaacaccatgg

SEQ ID NO: 30799 - DNA, 20 bp, Artificial Sequence
  Synthetic
cctctcattgacatctctgt

SEQ ID NO: 30800 - DNA, 21 bp, Artificial Sequence
  Synthetic
agtttctgatgatccactgat

SEQ ID NO: 30801 - DNA, 21 bp, Artificial Sequence
  Synthetic
agtcaatgaagagaactgcat

SEQ ID NO: 30802 - DNA, 25 bp, Artificial Sequence
  Synthetic
ttagtacattagccttttctccttt

SEQ ID NO: 30803 - DNA, 20 bp, Artificial Sequence
  Synthetic
aatattagagtctccagccg

SEQ ID NO: 30804 - DNA, 18 bp, Artificial Sequence
  Synthetic
tttggagtgagtggaggt

SEQ ID NO: 30805 - DNA, 19 bp, Artificial Sequence
  Synthetic
cagtctctgtgtttgtcgt

SEQ ID NO: 30806 - DNA, 21 bp, Artificial Sequence
  Synthetic
gccattcgatctaaagacttc

SEQ ID NO: 30807 - DNA, 19 bp, Artificial Sequence
  Synthetic
ctaatctgcatcccaggtg

SEQ ID NO: 30808 - DNA, 23 bp, Artificial Sequence
  Synthetic
ggttgatttctggtgatatatgt

SEQ ID NO: 30809 - DNA, 18 bp, Artificial Sequence
  Synthetic
gactcagtgatgctgtgc

SEQ ID NO: 30810 - DNA, 20 bp, Artificial Sequence
  Synthetic
gttgattcccactaacttgc

SEQ ID NO: 30811 - DNA, 20 bp, Artificial Sequence
  Synthetic
tctcgtctgaatttgtgtgt

SEQ ID NO: 30812 - DNA, 16 bp, Artificial Sequence
  Synthetic
agagacgccgtcctcg

SEQ ID NO: 30813 - DNA, 17 bp, Artificial Sequence
  Synthetic
cgatgcggtggatgtgg

SEQ ID NO: 30814 - DNA, 16 bp, Artificial Sequence
  Synthetic
tgtctcggccggcatc

SEQ ID NO: 30815 - DNA, 16 bp, Artificial Sequence
  Synthetic
cgggatgggtggacgt

SEQ ID NO: 30816 - DNA, 17 bp, Artificial Sequence
  Synthetic
tctcttccgcgtctccc

SEQ ID NO: 30817 - DNA, 23 bp, Artificial Sequence
  Synthetic
tgtacgtagtgttatgaatggtt

SEQ ID NO: 30818 - DNA, 18 bp, Artificial Sequence
  Synthetic
caatgtccaagccgtggg

SEQ ID NO: 30819 - DNA, 18 bp, Artificial Sequence
  Synthetic
gatccagaccaaagcggc

SEQ ID NO: 30820 - DNA, 16 bp, Artificial Sequence
  Synthetic
gctgcggaccgtcaga

SEQ ID NO: 30821 - DNA, 16 bp, Artificial Sequence
  Synthetic
accagcgccgtggtct

SEQ ID NO: 30822 - DNA, 18 bp, Artificial Sequence
  Synthetic
gccggggatgtagtggac

SEQ ID NO: 30823 - DNA, 16 bp, Artificial Sequence
  Synthetic
gccagcagcccgatct

SEQ ID NO: 30824 - DNA, 18 bp, Artificial Sequence
  Synthetic
gtttactcccgctgctgc

SEQ ID NO: 30825 - DNA, 16 bp, Artificial Sequence
  Synthetic
cggtttacgcctcgcc

SEQ ID NO: 30826 - DNA, 15 bp, Artificial Sequence
  Synthetic
ttcgcccgctgttgc

SEQ ID NO: 30827 - DNA, 16 bp, Artificial Sequence
  Synthetic
accgctgtgtgcctca

SEQ ID NO: 30828 - DNA, 18 bp, Artificial Sequence
  Synthetic
cgtatgttgagcggggac

SEQ ID NO: 30829 - DNA, 16 bp, Artificial Sequence
  Synthetic
atcgctctggccgtgg

SEQ ID NO: 30830 - DNA, 16 bp, Artificial Sequence
  Synthetic
acgctgcgtcggtttc

SEQ ID NO: 30831 - DNA, 17 bp, Artificial Sequence
  Synthetic
ggccctgcgttcaagac

SEQ ID NO: 30832 - DNA, 18 bp, Artificial Sequence
  Synthetic
ctgctcggtgatggacac

SEQ ID NO: 30833 - DNA, 16 bp, Artificial Sequence
  Synthetic
gtgaaaggcacggcgt

SEQ ID NO: 30834 - DNA, 17 bp, Artificial Sequence
  Synthetic
gggctcgttgagaagcg

SEQ ID NO: 30835 - DNA, 16 bp, Artificial Sequence
  Synthetic
aagggcgccgctagtg

SEQ ID NO: 30836 - DNA, 16 bp, Artificial Sequence
  Synthetic
aaggcgcgtgaccacc

SEQ ID NO: 30837 - DNA, 17 bp, Artificial Sequence
  Synthetic
tgcacctctacgcccag

SEQ ID NO: 30838 - DNA, 20 bp, Artificial Sequence
  Synthetic
gtggttagcgagaatgcaga

SEQ ID NO: 30839 - DNA, 16 bp, Artificial Sequence
  Synthetic
tacatcgtcggcgccc

SEQ ID NO: 30840 - DNA, 17 bp, Artificial Sequence
  Synthetic
gccgagagtcgcctgta

SEQ ID NO: 30841 - DNA, 20 bp, Artificial Sequence
  Synthetic
gcgactgcatctacgagctg

SEQ ID NO: 30842 - DNA, 19 bp, Artificial Sequence
  Synthetic
gacgacctggtgatggtct

SEQ ID NO: 30843 - DNA, 17 bp, Artificial Sequence
  Synthetic
cgcgtcagctggtgttg

SEQ ID NO: 30844 - DNA, 18 bp, Artificial Sequence
  Synthetic
attcccgtcagccgtcag

SEQ ID NO: 30845 - DNA, 18 bp, Artificial Sequence
  Synthetic
gtccgctcgtgttccagg

SEQ ID NO: 30846 - DNA, 16 bp, Artificial Sequence
  Synthetic
tggagcccacgccgat

SEQ ID NO: 30847 - DNA, 18 bp, Artificial Sequence
  Synthetic
gcctgtggtggaatcgct

SEQ ID NO: 30848 - DNA, 16 bp, Artificial Sequence
  Synthetic
cattgtgcccgcccaa

SEQ ID NO: 30849 - DNA, 16 bp, Artificial Sequence
  Synthetic
gtatcggttgccgcgg

SEQ ID NO: 30850 - DNA, 16 bp, Artificial Sequence
  Synthetic
ggggaacacgcgacgt

SEQ ID NO: 30851 - DNA, 19 bp, Artificial Sequence
  Synthetic
ctgcgtcacatggaggatc

SEQ ID NO: 30852 - DNA, 18 bp, Artificial Sequence
  Synthetic
tgctcacctccagcatcg

SEQ ID NO: 30853 - DNA, 16 bp, Artificial Sequence
  Synthetic
tgccgccgctctgttc

SEQ ID NO: 30854 - DNA, 20 bp, Artificial Sequence
  Synthetic
gtgtcggcttacttcctctg

SEQ ID NO: 30855 - DNA, 20 bp, Artificial Sequence
  Synthetic
aagacaagatgtcctgctgc

SEQ ID NO: 30856 - DNA, 17 bp, Artificial Sequence
  Synthetic
tcggtgaagaccacggc

SEQ ID NO: 30857 - DNA, 18 bp, Artificial Sequence
  Synthetic
ggcgatctcagcctctgg

SEQ ID NO: 30858 - DNA, 18 bp, Artificial Sequence
  Synthetic
gacggtccaggtccatct

SEQ ID NO: 30859 - DNA, 18 bp, Artificial Sequence
  Synthetic
acgagagtccgtcgagga

SEQ ID NO: 30860 - DNA, 17 bp, Artificial Sequence
  Synthetic
cacgccgtgcagacact

SEQ ID NO: 30861 - DNA, 18 bp, Artificial Sequence
  Synthetic
gttgttgcgtggctttgc

SEQ ID NO: 30862 - DNA, 20 bp, Artificial Sequence
  Synthetic
ggctgcgttttgttcgattt

SEQ ID NO: 30863 - DNA, 16 bp, Artificial Sequence
  Synthetic
cgcgtctcctgcgtct

SEQ ID NO: 30864 - DNA, 16 bp, Artificial Sequence
  Synthetic
agtctgggccgtggct

SEQ ID NO: 30865 - DNA, 19 bp, Artificial Sequence
  Synthetic
cgaggagatcaagccctcg

SEQ ID NO: 30866 - DNA, 19 bp, Artificial Sequence
  Synthetic
ctgattgaggacgcggaaa

SEQ ID NO: 30867 - DNA, 17 bp, Artificial Sequence
  Synthetic
tcaaggcgcacgaatgc

SEQ ID NO: 30868 - DNA, 17 bp, Artificial Sequence
  Synthetic
ctgtaaccaccggcgtg

SEQ ID NO: 30869 - DNA, 16 bp, Artificial Sequence
  Synthetic
gacggcgtttcacccg

SEQ ID NO: 30870 - DNA, 20 bp, Artificial Sequence
  Synthetic
gcgattttatcctgcccaac

SEQ ID NO: 30871 - DNA, 20 bp, Artificial Sequence
  Synthetic
ggaggaggcaagaaagctgt

SEQ ID NO: 30872 - DNA, 18 bp, Artificial Sequence
  Synthetic
cacgagcatcgcaacaac

SEQ ID NO: 30873 - DNA, 18 bp, Artificial Sequence
  Synthetic
gctggacgccgagaactt

SEQ ID NO: 30874 - DNA, 20 bp, Artificial Sequence
  Synthetic
ggattactgccgcaagatgc

SEQ ID NO: 30875 - DNA, 20 bp, Artificial Sequence
  Synthetic
ctgtccttttgcgctctact

SEQ ID NO: 30876 - DNA, 18 bp, Artificial Sequence
  Synthetic
cagcaggttgaacgcaga

SEQ ID NO: 30877 - DNA, 18 bp, Artificial Sequence
  Synthetic
acgttagttggcggtgac

SEQ ID NO: 30878 - DNA, 18 bp, Artificial Sequence
  Synthetic
ccacggcaaaatcggaga

SEQ ID NO: 30879 - DNA, 15 bp, Artificial Sequence
  Synthetic
atgacgccgtcgcct

SEQ ID NO: 30880 - DNA, 18 bp, Artificial Sequence
  Synthetic
ctacacggccgagagtct

SEQ ID NO: 30881 - DNA, 16 bp, Artificial Sequence
  Synthetic
tcgcggactacgacgc

SEQ ID NO: 30882 - DNA, 16 bp, Artificial Sequence
  Synthetic
tggcaccgctgctgga

SEQ ID NO: 30883 - DNA, 16 bp, Artificial Sequence
  Synthetic
acggtctgcgtgcact

SEQ ID NO: 30884 - DNA, 16 bp, Artificial Sequence
  Synthetic
tgctgttgcacgggct

SEQ ID NO: 30885 - DNA, 18 bp, Artificial Sequence
  Synthetic
gggtgggaaaaggcctcc

SEQ ID NO: 30886 - DNA, 16 bp, Artificial Sequence
  Synthetic
tgttacccgcggcgac

SEQ ID NO: 30887 - DNA, 17 bp, Artificial Sequence
  Synthetic
gcaccagctcctccgtt

SEQ ID NO: 30888 - DNA, 16 bp, Artificial Sequence
  Synthetic
acgtagaccggcgcca

SEQ ID NO: 30889 - DNA, 17 bp, Artificial Sequence
  Synthetic
tgtcctacaacggccgt

SEQ ID NO: 30890 - DNA, 17 bp, Artificial Sequence
  Synthetic
agagacgacacagccgg

SEQ ID NO: 30891 - DNA, 18 bp, Artificial Sequence
  Synthetic
ccggacggtggttcatcc

SEQ ID NO: 30892 - DNA, 16 bp, Artificial Sequence
  Synthetic
acgctttcgtgcccgg

SEQ ID NO: 30893 - DNA, 16 bp, Artificial Sequence
  Synthetic
tccacaccgacgccga

SEQ ID NO: 30894 - DNA, 20 bp, Artificial Sequence
  Synthetic
gacaccatctttttcccgga

SEQ ID NO: 30895 - DNA, 18 bp, Artificial Sequence
  Synthetic
ccgtagacctgaccgact

SEQ ID NO: 30896 - DNA, 18 bp, Artificial Sequence
  Synthetic
gaagctttggtcgcctgc

SEQ ID NO: 30897 - DNA, 16 bp, Artificial Sequence
  Synthetic
accactacccgtcggc

SEQ ID NO: 30898 - DNA, 16 bp, Artificial Sequence
  Synthetic
tcgacgccatgccacc

SEQ ID NO: 30899 - DNA, 16 bp, Artificial Sequence
  Synthetic
gcggttgcctgtcagc

SEQ ID NO: 30900 - DNA, 16 bp, Artificial Sequence
  Synthetic
ggctgcgacgcgaaac

SEQ ID NO: 30901 - DNA, 17 bp, Artificial Sequence
  Synthetic
agaacgcggcttccgtc

SEQ ID NO: 30902 - DNA, 18 bp, Artificial Sequence
  Synthetic
ccgatccggtcatcgacc

SEQ ID NO: 30903 - DNA, 16 bp, Artificial Sequence
  Synthetic
tgggccagtgggagct

SEQ ID NO: 30904 - DNA, 16 bp, Artificial Sequence
  Synthetic
tgcggcctgggactca

SEQ ID NO: 30905 - DNA, 16 bp, Artificial Sequence
  Synthetic
tctggtcgccgtgctg

SEQ ID NO: 30906 - DNA, 16 bp, Artificial Sequence
  Synthetic
gacgcgctcaagacgc

SEQ ID NO: 30907 - DNA, 16 bp, Artificial Sequence
  Synthetic
attctccgggtcgcgc

SEQ ID NO: 30908 - DNA, 17 bp, Artificial Sequence
  Synthetic
cccgcgacaaaactgcg

SEQ ID NO: 30909 - DNA, 18 bp, Artificial Sequence
  Synthetic
cgccaggacagtcgcaaa

SEQ ID NO: 30910 - DNA, 19 bp, Artificial Sequence
  Synthetic
gcgagatgatgcacacgta

SEQ ID NO: 30911 - DNA, 20 bp, Artificial Sequence
  Synthetic
cggctagatgtttacgacgt

SEQ ID NO: 30912 - DNA, 19 bp, Artificial Sequence
  Synthetic
cttacctggacgaactgcg

SEQ ID NO: 30913 - DNA, 17 bp, Artificial Sequence
  Synthetic
cgcgcctcaacaatgcg

SEQ ID NO: 30914 - DNA, 17 bp, Artificial Sequence
  Synthetic
gtctgagcgtcgctgac

SEQ ID NO: 30915 - DNA, 16 bp, Artificial Sequence
  Synthetic
tcgcgctcgaccacct

SEQ ID NO: 30916 - DNA, 17 bp, Artificial Sequence
  Synthetic
gaagcgcaagagccacc

SEQ ID NO: 30917 - DNA, 16 bp, Artificial Sequence
  Synthetic
cgtccgcgacaacgtg

SEQ ID NO: 30918 - DNA, 16 bp, Artificial Sequence
  Synthetic
tccaccgagcacaggg

SEQ ID NO: 30919 - DNA, 16 bp, Artificial Sequence
  Synthetic
gaggtttcgcggcagc

SEQ ID NO: 30920 - DNA, 17 bp, Artificial Sequence
  Synthetic
agcccagcacgttaccc

SEQ ID NO: 30921 - DNA, 18 bp, Artificial Sequence
  Synthetic
tgctcgcccaggagacag

SEQ ID NO: 30922 - DNA, 18 bp, Artificial Sequence
  Synthetic
ccacatgatgatggcggc

SEQ ID NO: 30923 - DNA, 17 bp, Artificial Sequence
  Synthetic
actgtcgtttcccccgc

SEQ ID NO: 30924 - DNA, 16 bp, Artificial Sequence
  Synthetic
cgcgtgggtgccatac

SEQ ID NO: 30925 - DNA, 18 bp, Artificial Sequence
  Synthetic
ccacgaaaccgacaggcg

SEQ ID NO: 30926 - DNA, 17 bp, Artificial Sequence
  Synthetic
tggagcggactaccacc

SEQ ID NO: 30927 - DNA, 16 bp, Artificial Sequence
  Synthetic
tgctgtgcacctcggc

SEQ ID NO: 30928 - DNA, 17 bp, Artificial Sequence
  Synthetic
aggccctgatgatccgc

SEQ ID NO: 30929 - DNA, 17 bp, Artificial Sequence
  Synthetic
gccgaaccgctggctta

SEQ ID NO: 30930 - DNA, 19 bp, Artificial Sequence
  Synthetic
gctctacggagtgtgcaag

SEQ ID NO: 30931 - DNA, 17 bp, Artificial Sequence
  Synthetic
tgctctcgcacagctcc

SEQ ID NO: 30932 - DNA, 16 bp, Artificial Sequence
  Synthetic
tagcggctctccagcg

SEQ ID NO: 30933 - DNA, 19 bp, Artificial Sequence
  Synthetic
gggatccgcgtacagactg

SEQ ID NO: 30934 - DNA, 20 bp, Artificial Sequence
  Synthetic
ggccttgaacaccacgttac

SEQ ID NO: 30935 - DNA, 16 bp, Artificial Sequence
  Synthetic
caccagccgcgaaagg

SEQ ID NO: 30936 - DNA, 16 bp, Artificial Sequence
  Synthetic
tctcgagcgacaggcc

SEQ ID NO: 30937 - DNA, 16 bp, Artificial Sequence
  Synthetic
ttcagcgtccggcctc

SEQ ID NO: 30938 - DNA, 19 bp, Artificial Sequence
  Synthetic
ctttcctggacactctggc

SEQ ID NO: 30939 - DNA, 18 bp, Artificial Sequence
  Synthetic
tggctccttaccgtcaca

SEQ ID NO: 30940 - DNA, 18 bp, Artificial Sequence
  Synthetic
ttcctggccctgtgcttt

SEQ ID NO: 30941 - DNA, 19 bp, Artificial Sequence
  Synthetic
gctcatcacgcagacgatg

SEQ ID NO: 30942 - DNA, 18 bp, Artificial Sequence
  Synthetic
agctggacgtttaggcgt

SEQ ID NO: 30943 - DNA, 19 bp, Artificial Sequence
  Synthetic
cgctgaccatcaatgccac

SEQ ID NO: 30944 - DNA, 16 bp, Artificial Sequence
  Synthetic
tccagcggctcatggt

SEQ ID NO: 30945 - DNA, 17 bp, Artificial Sequence
  Synthetic
ctcgtactgctggccct

SEQ ID NO: 30946 - DNA, 18 bp, Artificial Sequence
  Synthetic
cgtcatactctagcctgg

SEQ ID NO: 30947 - DNA, 20 bp, Artificial Sequence
  Synthetic
gcactcaatgtaacgtcact

SEQ ID NO: 30948 - DNA, 18 bp, Artificial Sequence
  Synthetic
cacggcctcatcatgcaa

SEQ ID NO: 30949 - DNA, 16 bp, Artificial Sequence
  Synthetic
ccgctgacatcgccga

SEQ ID NO: 30950 - DNA, 17 bp, Artificial Sequence
  Synthetic
cggtacatgtggcggtc

SEQ ID NO: 30951 - DNA, 18 bp, Artificial Sequence
  Synthetic
gcttcgacacggtggaaa

SEQ ID NO: 30952 - DNA, 16 bp, Artificial Sequence
  Synthetic
aaacaccgccgcccac

SEQ ID NO: 30953 - DNA, 16 bp, Artificial Sequence
  Synthetic
cgggagcgaacgggat

SEQ ID NO: 30954 - DNA, 16 bp, Artificial Sequence
  Synthetic
ccggcgttttcgggac

SEQ ID NO: 30955 - DNA, 16 bp, Artificial Sequence
  Synthetic
acacgttgtacgccgc

SEQ ID NO: 30956 - DNA, 16 bp, Artificial Sequence
  Synthetic
agctacgccgcgagtc

SEQ ID NO: 30957 - DNA, 16 bp, Artificial Sequence
  Synthetic
agctggaagccgacgc

SEQ ID NO: 30958 - DNA, 18 bp, Artificial Sequence
  Synthetic
gtcgcctccacgagagaa

SEQ ID NO: 30959 - DNA, 19 bp, Artificial Sequence
  Synthetic
cagcgacatgttgcttcgt

SEQ ID NO: 30960 - DNA, 16 bp, Artificial Sequence
  Synthetic
ggccgtgcagtctgga

SEQ ID NO: 30961 - DNA, 20 bp, Artificial Sequence
  Synthetic
agcgttggtcgtaacattct

SEQ ID NO: 30962 - DNA, 18 bp, Artificial Sequence
  Synthetic
acgtgtggtgtaactgcg

SEQ ID NO: 30963 - DNA, 16 bp, Artificial Sequence
  Synthetic
cggtgttggtgctcgc

SEQ ID NO: 30964 - DNA, 19 bp, Artificial Sequence
  Synthetic
ccgcatgggaaagtacggt

SEQ ID NO: 30965 - DNA, 20 bp, Artificial Sequence
  Synthetic
cgggctgtcacatcaactct

SEQ ID NO: 30966 - DNA, 19 bp, Artificial Sequence
  Synthetic
tgaaaaacacgacgaaagc

SEQ ID NO: 30967 - DNA, 17 bp, Artificial Sequence
  Synthetic
tcgtctgccccagtacc

SEQ ID NO: 30968 - DNA, 16 bp, Artificial Sequence
  Synthetic
ggcagcccatcctcgt

SEQ ID NO: 30969 - DNA, 18 bp, Artificial Sequence
  Synthetic
agctcaccgaccacagac

SEQ ID NO: 30970 - DNA, 20 bp, Artificial Sequence
  Synthetic
cgatcgtcatgcgtgtctac

SEQ ID NO: 30971 - DNA, 18 bp, Artificial Sequence
  Synthetic
ggacagagcagccgtttc

SEQ ID NO: 30972 - DNA, 16 bp, Artificial Sequence
  Synthetic
ttgtctgggcgcccga

SEQ ID NO: 30973 - DNA, 19 bp, Artificial Sequence
  Synthetic
tcaagcctgttagaaccgc

SEQ ID NO: 30974 - DNA, 19 bp, Artificial Sequence
  Synthetic
tgttgcaccggctttatgc

SEQ ID NO: 30975 - DNA, 16 bp, Artificial Sequence
  Synthetic
gcgcgcctttggacaa

SEQ ID NO: 30976 - DNA, 18 bp, Artificial Sequence
  Synthetic
gatgaccctggcgttgtt

SEQ ID NO: 30977 - DNA, 16 bp, Artificial Sequence
  Synthetic
cgagggaacgagcggt

SEQ ID NO: 30978 - DNA, 18 bp, Artificial Sequence
  Synthetic
ggcctctatctgcgccag

SEQ ID NO: 30979 - DNA, 16 bp, Artificial Sequence
  Synthetic
gaacacggtctgcggc

SEQ ID NO: 30980 - DNA, 19 bp, Artificial Sequence
  Synthetic
cgaagccgtataccgtcag

SEQ ID NO: 30981 - DNA, 19 bp, Artificial Sequence
  Synthetic
ggcgactttcagggcatct

SEQ ID NO: 30982 - DNA, 17 bp, Artificial Sequence
  Synthetic
tggctcggcttctgtca

SEQ ID NO: 30983 - DNA, 18 bp, Artificial Sequence
  Synthetic
gccgtgacactttggctc

SEQ ID NO: 30984 - DNA, 18 bp, Artificial Sequence
  Synthetic
actacctggcgcacagtc

SEQ ID NO: 30985 - DNA, 16 bp, Artificial Sequence
  Synthetic
aacaccacgcggtccg

SEQ ID NO: 30986 - DNA, 16 bp, Artificial Sequence
  Synthetic
taccggagcccccaga

SEQ ID NO: 30987 - DNA, 16 bp, Artificial Sequence
  Synthetic
gccctgttgcgcgtgt

SEQ ID NO: 30988 - DNA, 16 bp, Artificial Sequence
  Synthetic
ttcgccgtcgccgtac

SEQ ID NO: 30989 - DNA, 18 bp, Artificial Sequence
  Synthetic
attgattcgcctcgttcg

SEQ ID NO: 30990 - DNA, 23 bp, Artificial Sequence
  Synthetic
tgaaaagatgtggatatgtgttt

SEQ ID NO: 30991 - DNA, 21 bp, Artificial Sequence
  Synthetic
tttgaatccatccacataggc

SEQ ID NO: 30992 - DNA, 18 bp, Artificial Sequence
  Synthetic
ctcactctggatccagct

SEQ ID NO: 30993 - DNA, 23 bp, Artificial Sequence
  Synthetic
ttatcattggaatcagttggaag

SEQ ID NO: 30994 - DNA, 18 bp, Artificial Sequence
  Synthetic
cagtccgcaagagcattt

SEQ ID NO: 30995 - DNA, 22 bp, Artificial Sequence
  Synthetic
tgaatataggctgttgaacaca

SEQ ID NO: 30996 - DNA, 21 bp, Artificial Sequence
  Synthetic
aaatgcagagagtaccattct

SEQ ID NO: 30997 - DNA, 22 bp, Artificial Sequence
  Synthetic
ataggtagcatcattcaggttg

SEQ ID NO: 30998 - DNA, 19 bp, Artificial Sequence
  Synthetic
tgatccatcattgcccttt

SEQ ID NO: 30999 - DNA, 18 bp, Artificial Sequence
  Synthetic
gttggttggtgttccctc

SEQ ID NO: 31000 - DNA, 19 bp, Artificial Sequence
  Synthetic
gtatcgaaacccacacgta

SEQ ID NO: 31001 - DNA, 21 bp, Artificial Sequence
  Synthetic
tccacatcaagatcatacagt

SEQ ID NO: 31002 - DNA, 20 bp, Artificial Sequence
  Synthetic
gggcaactctggatggtcta

SEQ ID NO: 31003 - DNA, 25 bp, Artificial Sequence
  Synthetic
attatacatgactcacaaaaaccac

SEQ ID NO: 31004 - DNA, 24 bp, Artificial Sequence
  Synthetic
tcaaattcctctctatagtcttct

SEQ ID NO: 31005 - DNA, 20 bp, Artificial Sequence
  Synthetic
cttgcacctgttgttccatg

SEQ ID NO: 31006 - DNA, 18 bp, Artificial Sequence
  Synthetic
ttccatccaaacccacca

SEQ ID NO: 31007 - DNA, 19 bp, Artificial Sequence
  Synthetic
tttccatcagcacaggtaa

SEQ ID NO: 31008 - DNA, 19 bp, Artificial Sequence
  Synthetic
acttctcagctcctcagtt

SEQ ID NO: 31009 - DNA, 18 bp, Artificial Sequence
  Synthetic
tcctctcgaactgcggtg

SEQ ID NO: 31010 - DNA, 20 bp, Artificial Sequence
  Synthetic
gttgttgctatgactggatt

SEQ ID NO: 31011 - DNA, 18 bp, Artificial Sequence
  Synthetic
caaaggcgtttccaagtt

SEQ ID NO: 31012 - DNA, 20 bp, Artificial Sequence
  Synthetic
aactggccaagcaaaacatc

SEQ ID NO: 31013 - DNA, 19 bp, Artificial Sequence
  Synthetic
gcacattacgtccctggaa

SEQ ID NO: 31014 - DNA, 21 bp, Artificial Sequence
  Synthetic
gttgaatgtgaaactgtttgt

SEQ ID NO: 31015 - DNA, 23 bp, Artificial Sequence
  Synthetic
caccttagaaagttctaaccctt

SEQ ID NO: 31016 - DNA, 23 bp, Artificial Sequence
  Synthetic
gatcttttgctaccaaactagat

SEQ ID NO: 31017 - DNA, 19 bp, Artificial Sequence
  Synthetic
ggaccaatgaaagcttgcg

SEQ ID NO: 31018 - DNA, 18 bp, Artificial Sequence
  Synthetic
cttgggcccaacatcctg

SEQ ID NO: 31019 - DNA, 22 bp, Artificial Sequence
  Synthetic
ctttgctcttactcatacatct

SEQ ID NO: 31020 - DNA, 19 bp, Artificial Sequence
  Synthetic
gcaattaagggtgagccaa

SEQ ID NO: 31021 - DNA, 18 bp, Artificial Sequence
  Synthetic
actgtctggggatgacaa

SEQ ID NO: 31022 - DNA, 18 bp, Artificial Sequence
  Synthetic
gcagctgccaagtggtat

SEQ ID NO: 31023 - DNA, 18 bp, Artificial Sequence
  Synthetic
aagtcaacttgcgcgctg

SEQ ID NO: 31024 - DNA, 18 bp, Artificial Sequence
  Synthetic
acttcgggctcaacacct

SEQ ID NO: 31025 - DNA, 20 bp, Artificial Sequence
  Synthetic
ggtagtatacagccgagtct

SEQ ID NO: 31026 - DNA, 18 bp, Artificial Sequence
  Synthetic
tccctacctaacgcccct

SEQ ID NO: 31027 - DNA, 19 bp, Artificial Sequence
  Synthetic
ttggacgatgtcaaagtga

SEQ ID NO: 31028 - DNA, 23 bp, Artificial Sequence
  Synthetic
aatgactatgtttttgactctcg

SEQ ID NO: 31029 - DNA, 18 bp, Artificial Sequence
  Synthetic
attcaagactgcgcacgc

SEQ ID NO: 31030 - DNA, 18 bp, Artificial Sequence
  Synthetic
cgcaggacaggatgcatc

SEQ ID NO: 31031 - DNA, 16 bp, Artificial Sequence
  Synthetic
ctcacgcagcagtcgc

SEQ ID NO: 31032 - DNA, 19 bp, Artificial Sequence
  Synthetic
gcattgcatccctaaaagt

SEQ ID NO: 31033 - DNA, 18 bp, Artificial Sequence
  Synthetic
ccgcgggatccaggttag

SEQ ID NO: 31034 - DNA, 20 bp, Artificial Sequence
  Synthetic
taagttagcctgcacattgg

SEQ ID NO: 31035 - DNA, 18 bp, Artificial Sequence
  Synthetic
aacgatcgcctactggag

SEQ ID NO: 31036 - DNA, 21 bp, Artificial Sequence
  Synthetic
ttcctttttaccatggtgtcc

SEQ ID NO: 31037 - DNA, 19 bp, Artificial Sequence
  Synthetic
accctatgcaaccctgtgg

SEQ ID NO: 31038 - DNA, 20 bp, Artificial Sequence
  Synthetic
acaaattctgcccactcata

SEQ ID NO: 31039 - DNA, 25 bp, Artificial Sequence
  Synthetic
ctttcttatacctagtatgttgctt

SEQ ID NO: 31040 - DNA, 22 bp, Artificial Sequence
  Synthetic
tgttacatctggagttgttagt

SEQ ID NO: 31041 - DNA, 18 bp, Artificial Sequence
  Synthetic
gtacttgcgagcatcggc

SEQ ID NO: 31042 - DNA, 16 bp, Artificial Sequence
  Synthetic
gcgtcccggtcactga

SEQ ID NO: 31043 - DNA, 20 bp, Artificial Sequence
  Synthetic
gacgcataatcgttcgctct

SEQ ID NO: 31044 - DNA, 22 bp, Artificial Sequence
  Synthetic
aatttgaatgtccactgtttga

SEQ ID NO: 31045 - DNA, 16 bp, Artificial Sequence
  Synthetic
ttagtgtgcgccccct

SEQ ID NO: 31046 - DNA, 19 bp, Artificial Sequence
  Synthetic
tgcttcctcataggacggc

SEQ ID NO: 31047 - DNA, 18 bp, Artificial Sequence
  Synthetic
aattgcaccagaccggga

SEQ ID NO: 31048 - DNA, 20 bp, Artificial Sequence
  Synthetic
gcgcctgagcaaaggtatta

SEQ ID NO: 31049 - DNA, 21 bp, Artificial Sequence
  Synthetic
agcaattgttccattggtaac

SEQ ID NO: 31050 - DNA, 19 bp, Artificial Sequence
  Synthetic
ccgttatctggcttaatgc

SEQ ID NO: 31051 - DNA, 24 bp, Artificial Sequence
  Synthetic
aaaagggtttacattatccatcac

SEQ ID NO: 31052 - DNA, 22 bp, Artificial Sequence
  Synthetic
gtcatttcttaacatggcttct

SEQ ID NO: 31053 - DNA, 19 bp, Artificial Sequence
  Synthetic
ccatccacagaacgcttta

SEQ ID NO: 31054 - DNA, 21 bp, Artificial Sequence
  Synthetic
taacacgatcgcatagaaact

SEQ ID NO: 31055 - DNA, 18 bp, Artificial Sequence
  Synthetic
ccatccaaaagccagcca

SEQ ID NO: 31056 - DNA, 23 bp, Artificial Sequence
  Synthetic
atacaattcattctgattgcgtt

SEQ ID NO: 31057 - DNA, 20 bp, Artificial Sequence
  Synthetic
gcgcaaatccagtttatcgc

SEQ ID NO: 31058 - DNA, 18 bp, Artificial Sequence
  Synthetic
ttcatgatgttggctgcg

SEQ ID NO: 31059 - DNA, 18 bp, Artificial Sequence
  Synthetic
gcggtttgcagctgactt

SEQ ID NO: 31060 - DNA, 18 bp, Artificial Sequence
  Synthetic
atcatgcagacggttctc

SEQ ID NO: 31061 - DNA, 19 bp, Artificial Sequence
  Synthetic
cagatatggcgtcgcgaac

SEQ ID NO: 31062 - DNA, 21 bp, Artificial Sequence
  Synthetic
attttctttttgcagggcatt

SEQ ID NO: 31063 - DNA, 20 bp, Artificial Sequence
  Synthetic
ggcggccatcatgagtttac

SEQ ID NO: 31064 - DNA, 19 bp, Artificial Sequence
  Synthetic
tatgtcagctagctctgca

SEQ ID NO: 31065 - DNA, 22 bp, Artificial Sequence
  Synthetic
taaaaattgatactgtgggcgt

SEQ ID NO: 31066 - DNA, 18 bp, Artificial Sequence
  Synthetic
agtcctcgacctcgtcct

SEQ ID NO: 31067 - DNA, 20 bp, Artificial Sequence
  Synthetic
gggctgtagagatgacggta

SEQ ID NO: 31068 - DNA, 24 bp, Artificial Sequence
  Synthetic
ctttttttactctttaagcgagag

SEQ ID NO: 31069 - DNA, 18 bp, Artificial Sequence
  Synthetic
tatggacttcggcctggg

SEQ ID NO: 31070 - DNA, 18 bp, Artificial Sequence
  Synthetic
tgcggatgacagttaggt

SEQ ID NO: 31071 - DNA, 23 bp, Artificial Sequence
  Synthetic
aaagtacacaatttcctctgtac

SEQ ID NO: 31072 - DNA, 18 bp, Artificial Sequence
  Synthetic
tggtgtgaaccagaaagg

SEQ ID NO: 31073 - DNA, 25 bp, Artificial Sequence
  Synthetic
ctcattaaaagggtaagtgtgatta

SEQ ID NO: 31074 - DNA, 18 bp, Artificial Sequence
  Synthetic
aaagggggctaaacactc

SEQ ID NO: 31075 - DNA, 21 bp, Artificial Sequence
  Synthetic
accggtgaacttaaaatagct

SEQ ID NO: 31076 - DNA, 18 bp, Artificial Sequence
  Synthetic
tgcttgttgggacacttt

SEQ ID NO: 31077 - DNA, 24 bp, Artificial Sequence
  Synthetic
catcattttcttctgtttcttcag

SEQ ID NO: 31078 - DNA, 22 bp, Artificial Sequence
  Synthetic
ggttattaaggctaagctttca

SEQ ID NO: 31079 - DNA, 19 bp, Artificial Sequence
  Synthetic
tgttgaggggagcagttgt

SEQ ID NO: 31080 - DNA, 22 bp, Artificial Sequence
  Synthetic
acattaaacctttttcggtact

SEQ ID NO: 31081 - DNA, 21 bp, Artificial Sequence
  Synthetic
gcataaaacctagaccattgg

SEQ ID NO: 31082 - DNA, 18 bp, Artificial Sequence
  Synthetic
agtgcagttgttttcagc

SEQ ID NO: 31083 - DNA, 18 bp, Artificial Sequence
  Synthetic
gttatcgtcagcaactgc

SEQ ID NO: 31084 - DNA, 24 bp, Artificial Sequence
  Synthetic
ccactataaatgttgaagttactc

SEQ ID NO: 31085 - DNA, 18 bp, Artificial Sequence
  Synthetic
gttgtttacgatgcagcg

SEQ ID NO: 31086 - DNA, 21 bp, Artificial Sequence
  Synthetic
ttatcgaaatcagagctgtgg

SEQ ID NO: 31087 - DNA, 21 bp, Artificial Sequence
  Synthetic
cgcttactaatatgggtccat

SEQ ID NO: 31088 - DNA, 23 bp, Artificial Sequence
  Synthetic
gttttgttgtttaatcattccga

SEQ ID NO: 31089 - DNA, 19 bp, Artificial Sequence
  Synthetic
gcctggctttgtactgttt

SEQ ID NO: 31090 - DNA, 19 bp, Artificial Sequence
  Synthetic
ggctagatcaccatcgctg

SEQ ID NO: 31091 - DNA, 20 bp, Artificial Sequence
  Synthetic
gccattctccatatgccaca

SEQ ID NO: 31092 - DNA, 19 bp, Artificial Sequence
  Synthetic
cgtgacctttctcacctgg

SEQ ID NO: 31093 - DNA, 24 bp, Artificial Sequence
  Synthetic
atccataattgtcttgatttcacc

SEQ ID NO: 31094 - DNA, 18 bp, Artificial Sequence
  Synthetic
tgtcagaacatgcagagc

SEQ ID NO: 31095 - DNA, 20 bp, Artificial Sequence
  Synthetic
tcacaatggtaatctcgaga

SEQ ID NO: 31096 - DNA, 23 bp, Artificial Sequence
  Synthetic
caggttctttatgtcattcctag

SEQ ID NO: 31097 - DNA, 18 bp, Artificial Sequence
  Synthetic
gccttgatgctcactgag

SEQ ID NO: 31098 - DNA, 20 bp, Artificial Sequence
  Synthetic
ggaatcttcttgcattcctt

SEQ ID NO: 31099 - DNA, 22 bp, Artificial Sequence
  Synthetic
atgacgtaatcactagtgaatg

SEQ ID NO: 31100 - DNA, 23 bp, Artificial Sequence
  Synthetic
cgttctatttttgaatgtttgga

SEQ ID NO: 31101 - DNA, 18 bp, Artificial Sequence
  Synthetic
tacattggtcacaaggcg

SEQ ID NO: 31102 - DNA, 22 bp, Artificial Sequence
  Synthetic
tctcaatttggacatttccttt

SEQ ID NO: 31103 - DNA, 23 bp, Artificial Sequence
  Synthetic
gtttttccattgaagcataaagc

SEQ ID NO: 31104 - DNA, 19 bp, Artificial Sequence
  Synthetic
ccctctcttcaggaacgta

SEQ ID NO: 31105 - DNA, 22 bp, Artificial Sequence
  Synthetic
gatagaataaagcaagatccgc

SEQ ID NO: 31106 - DNA, 18 bp, Artificial Sequence
  Synthetic
ttccaaggtccgtagtcc

SEQ ID NO: 31107 - DNA, 18 bp, Artificial Sequence
  Synthetic
ccctgatcaacgacatcg

SEQ ID NO: 31108 - DNA, 20 bp, Artificial Sequence
  Synthetic
tctcggattctacctgtgta

SEQ ID NO: 31109 - DNA, 20 bp, Artificial Sequence
  Synthetic
actcaaaagtctctgcagta

SEQ ID NO: 31110 - DNA, 21 bp, Artificial Sequence
  Synthetic
ccttgttttcgagcataatgc

SEQ ID NO: 31111 - DNA, 20 bp, Artificial Sequence
  Synthetic
ggtaactgttgttcctcagt

SEQ ID NO: 31112 - DNA, 19 bp, Artificial Sequence
  Synthetic
ggagatggtgcagatccca

SEQ ID NO: 31113 - DNA, 22 bp, Artificial Sequence
  Synthetic
gttttacaaaagcgtctctttg

SEQ ID NO: 31114 - DNA, 19 bp, Artificial Sequence
  Synthetic
gactctacttggagctcca

SEQ ID NO: 31115 - DNA, 20 bp, Artificial Sequence
  Synthetic
tgaagagtagtctcccctat

SEQ ID NO: 31116 - DNA, 22 bp, Artificial Sequence
  Synthetic
ttctgtataaccaatggaatcg

SEQ ID NO: 31117 - DNA, 21 bp, Artificial Sequence
  Synthetic
tcaaatgtttgagtgatgtca

SEQ ID NO: 31118 - DNA, 21 bp, Artificial Sequence
  Synthetic
ttctcctgaatgttgacctaa

SEQ ID NO: 31119 - DNA, 21 bp, Artificial Sequence
  Synthetic
gattttctgtgtctccaaact

SEQ ID NO: 31120 - DNA, 20 bp, Artificial Sequence
  Synthetic
gaggtagcttcaaaaggttc

SEQ ID NO: 31121 - DNA, 23 bp, Artificial Sequence
  Synthetic
cactggaaaatctttcacttaaa

SEQ ID NO: 31122 - DNA, 22 bp, Artificial Sequence
  Synthetic
tcttttgtagcttacagttgtt

SEQ ID NO: 31123 - DNA, 18 bp, Artificial Sequence
  Synthetic
gcgtttggccacaatcga

SEQ ID NO: 31124 - DNA, 18 bp, Artificial Sequence
  Synthetic
ttccctggaattcgcctt

SEQ ID NO: 31125 - DNA, 21 bp, Artificial Sequence
  Synthetic
acgtatgataacagcactaca

SEQ ID NO: 31126 - DNA, 17 bp, Artificial Sequence
  Synthetic
ggattctcgctgcagcc

SEQ ID NO: 31127 - DNA, 23 bp, Artificial Sequence
  Synthetic
ctttcgatgttttttcaactgat

SEQ ID NO: 31128 - DNA, 23 bp, Artificial Sequence
  Synthetic
ctttcagaagtccaatcatatgt

SEQ ID NO: 31129 - DNA, 21 bp, Artificial Sequence
  Synthetic
atgtaagccaaaagtgctaaa

SEQ ID NO: 31130 - DNA, 20 bp, Artificial Sequence
  Synthetic
cctttcactcttgaatccca

SEQ ID NO: 31131 - DNA, 23 bp, Artificial Sequence
  Synthetic
ctcttttcattttagctctctct

SEQ ID NO: 31132 - DNA, 18 bp, Artificial Sequence
  Synthetic
ctgtggtcagtgcattct

SEQ ID NO: 31133 - DNA, 24 bp, Artificial Sequence
  Synthetic
ccttggttagtatatgttttacct

SEQ ID NO: 31134 - DNA, 18 bp, Artificial Sequence
  Synthetic
gtcacatccacagcaaca

SEQ ID NO: 31135 - DNA, 23 bp, Artificial Sequence
  Synthetic
aattgtgtgtaatattgctgtca

SEQ ID NO: 31136 - DNA, 18 bp, Artificial Sequence
  Synthetic
cactgtccgttagttccc

SEQ ID NO: 31137 - DNA, 24 bp, Artificial Sequence
  Synthetic
aaatctataaaagacagcccaaag

SEQ ID NO: 31138 - DNA, 23 bp, Artificial Sequence
  Synthetic
acaatctttcacatattttgcct

SEQ ID NO: 31139 - DNA, 21 bp, Artificial Sequence
  Synthetic
gcaatacatgtttgtgtaggt

SEQ ID NO: 31140 - DNA, 18 bp, Artificial Sequence
  Synthetic
tgtttgcacagccatcaa

SEQ ID NO: 31141 - DNA, 25 bp, Artificial Sequence
  Synthetic
aatcaaataaatgtctgtgtctgtc

SEQ ID NO: 31142 - DNA, 18 bp, Artificial Sequence
  Synthetic
caggcaccacttccatac

SEQ ID NO: 31143 - DNA, 23 bp, Artificial Sequence
  Synthetic
ctccatcattaaattgacatgtt

SEQ ID NO: 31144 - DNA, 25 bp, Artificial Sequence
  Synthetic
gcattgtgtatagaatcatgactaa

SEQ ID NO: 31145 - DNA, 23 bp, Artificial Sequence
  Synthetic
gcaaataaaatccagaacctgta

SEQ ID NO: 31146 - DNA, 18 bp, Artificial Sequence
  Synthetic
tatcctgacacctttggc

SEQ ID NO: 31147 - DNA, 22 bp, Artificial Sequence
  Synthetic
ctgttaaaaaaatgtctggcaa

SEQ ID NO: 31148 - DNA, 20 bp, Artificial Sequence
  Synthetic
ttacggatgcacataatgtc

SEQ ID NO: 31149 - DNA, 21 bp, Artificial Sequence
  Synthetic
gtgtgaccttaggttactcat

SEQ ID NO: 31150 - DNA, 16 bp, Artificial Sequence
  Synthetic
ggggcactcgcaagca

SEQ ID NO: 31151 - DNA, 16 bp, Artificial Sequence
  Synthetic
acgcgccttggggata

SEQ ID NO: 31152 - DNA, 19 bp, Artificial Sequence
  Synthetic
atagttaacggccgaagcg

SEQ ID NO: 31153 - DNA, 16 bp, Artificial Sequence
  Synthetic
agcagacagtggcggc

SEQ ID NO: 31154 - DNA, 18 bp, Artificial Sequence
  Synthetic
acacgtgagtctcggcat

SEQ ID NO: 31155 - DNA, 18 bp, Artificial Sequence
  Synthetic
gggccacacacactggat

SEQ ID NO: 31156 - DNA, 20 bp, Artificial Sequence
  Synthetic
gtaggtagtctccggatgct

SEQ ID NO: 31157 - DNA, 20 bp, Artificial Sequence
  Synthetic
ggtactggacgtccacgata

SEQ ID NO: 31158 - DNA, 20 bp, Artificial Sequence
  Synthetic
gcggagacagtgtcagaatg

SEQ ID NO: 31159 - DNA, 19 bp, Artificial Sequence
  Synthetic
gcctggagtatgtggaggg

SEQ ID NO: 31160 - DNA, 18 bp, Artificial Sequence
  Synthetic
ctgtgatgggggcaagga

SEQ ID NO: 31161 - DNA, 18 bp, Artificial Sequence
  Synthetic
ccaccccaccaagtcttg

SEQ ID NO: 31162 - DNA, 19 bp, Artificial Sequence
  Synthetic
gctcttgccacttcctgtt

SEQ ID NO: 31163 - DNA, 20 bp, Artificial Sequence
  Synthetic
gtggaatagcactcgtcaca

SEQ ID NO: 31164 - DNA, 19 bp, Artificial Sequence
  Synthetic
gggaatcaccgaaacgtct

SEQ ID NO: 31165 - DNA, 18 bp, Artificial Sequence
  Synthetic
ccggcatcgtagcactcg

SEQ ID NO: 31166 - DNA, 19 bp, Artificial Sequence
  Synthetic
cattctgcacagaccccag

SEQ ID NO: 31167 - DNA, 20 bp, Artificial Sequence
  Synthetic
gcttgccagcgaaatttagg

SEQ ID NO: 31168 - DNA, 19 bp, Artificial Sequence
  Synthetic
gggcagaatgtccaccaaa

SEQ ID NO: 31169 - DNA, 19 bp, Artificial Sequence
  Synthetic
gactcagggacgtaatgcg

SEQ ID NO: 31170 - DNA, 19 bp, Artificial Sequence
  Synthetic
tcgagccgttcttgatgtg

SEQ ID NO: 31171 - DNA, 18 bp, Artificial Sequence
  Synthetic
gttagcactgccacgtcc

SEQ ID NO: 31172 - DNA, 18 bp, Artificial Sequence
  Synthetic
ctcaaccctggtagcggt

SEQ ID NO: 31173 - DNA, 17 bp, Artificial Sequence
  Synthetic
tctttgcggccagctct

SEQ ID NO: 31174 - DNA, 20 bp, Artificial Sequence
  Synthetic
tggtcgtggcatacaccata

SEQ ID NO: 31175 - DNA, 20 bp, Artificial Sequence
  Synthetic
gttcacagcgaagacctcat

SEQ ID NO: 31176 - DNA, 19 bp, Artificial Sequence
  Synthetic
tctatctgtgagggcggtg

SEQ ID NO: 31177 - DNA, 18 bp, Artificial Sequence
  Synthetic
gtcatatgctggctgcgg

SEQ ID NO: 31178 - DNA, 20 bp, Artificial Sequence
  Synthetic
ggcacaggagtaaatagcgg

SEQ ID NO: 31179 - DNA, 21 bp, Artificial Sequence
  Synthetic
tgatccattggtcaaaatgtt

SEQ ID NO: 31180 - DNA, 18 bp, Artificial Sequence
  Synthetic
aggtactctggccattca

SEQ ID NO: 31181 - DNA, 18 bp, Artificial Sequence
  Synthetic
tgtggcattgcactgaac

SEQ ID NO: 31182 - DNA, 21 bp, Artificial Sequence
  Synthetic
accagtatacatcgaagagaa

SEQ ID NO: 31183 - DNA, 18 bp, Artificial Sequence
  Synthetic
ataagtagacctggccgg

SEQ ID NO: 31184 - DNA, 20 bp, Artificial Sequence
  Synthetic
ctgtttcgtttgcagttagt

SEQ ID NO: 31185 - DNA, 24 bp, Artificial Sequence
  Synthetic
aacaattatatgctgatgccaatc

SEQ ID NO: 31186 - DNA, 18 bp, Artificial Sequence
  Synthetic
caccgtacctaggtccta

SEQ ID NO: 31187 - DNA, 19 bp, Artificial Sequence
  Synthetic
ttcatcactcctgcttgaa

SEQ ID NO: 31188 - DNA, 23 bp, Artificial Sequence
  Synthetic
acttcttgtagttctgtgacttt

SEQ ID NO: 31189 - DNA, 19 bp, Artificial Sequence
  Synthetic
caatccctttgcagcatta

SEQ ID NO: 31190 - DNA, 21 bp, Artificial Sequence
  Synthetic
ccataatcacaacttcctgtt

SEQ ID NO: 31191 - DNA, 21 bp, Artificial Sequence
  Synthetic
tccattctttgtgtaggtagt

SEQ ID NO: 31192 - DNA, 19 bp, Artificial Sequence
  Synthetic
ccattaccgccaacatgaa

SEQ ID NO: 31193 - DNA, 21 bp, Artificial Sequence
  Synthetic
gtgggttccgtatttacattc

SEQ ID NO: 31194 - DNA, 19 bp, Artificial Sequence
  Synthetic
caagggatgacagaccaaa

SEQ ID NO: 31195 - DNA, 21 bp, Artificial Sequence
  Synthetic
ctttgtccatctgattgactc

SEQ ID NO: 31196 - DNA, 19 bp, Artificial Sequence
  Synthetic
ggtccctgagattgatgcg

SEQ ID NO: 31197 - DNA, 18 bp, Artificial Sequence
  Synthetic
gcacggagagattggtgg

SEQ ID NO: 31198 - DNA, 20 bp, Artificial Sequence
  Synthetic
tgccggaaaaaactggaagt

SEQ ID NO: 31199 - DNA, 19 bp, Artificial Sequence
  Synthetic
ggtgattggggttccgagt

SEQ ID NO: 31200 - DNA, 20 bp, Artificial Sequence
  Synthetic
cgaccttctctgttgggtac

SEQ ID NO: 31201 - DNA, 21 bp, Artificial Sequence
  Synthetic
gcacactgaaagtacttttcc

SEQ ID NO: 31202 - DNA, 19 bp, Artificial Sequence
  Synthetic
gagggcaaacaatcgatag

SEQ ID NO: 31203 - DNA, 18 bp, Artificial Sequence
  Synthetic
tctcttcacaagcagagc

SEQ ID NO: 31204 - DNA, 22 bp, Artificial Sequence
  Synthetic
acatcttctgtagctaacaaag

SEQ ID NO: 31205 - DNA, 20 bp, Artificial Sequence
  Synthetic
gaatccacagacatagggtt

SEQ ID NO: 31206 - DNA, 18 bp, Artificial Sequence
  Synthetic
atgtcctggtggcagagc

SEQ ID NO: 31207 - DNA, 25 bp, Artificial Sequence
  Synthetic
tattttttgtcacatctatacctcc

SEQ ID NO: 31208 - DNA, 18 bp, Artificial Sequence
  Synthetic
tttcacatcggttggaca

SEQ ID NO: 31209 - DNA, 18 bp, Artificial Sequence
  Synthetic
tattgcaggggcgtctgg

SEQ ID NO: 31210 - DNA, 18 bp, Artificial Sequence
  Synthetic
gctggaacctgttgaaca

SEQ ID NO: 31211 - DNA, 18 bp, Artificial Sequence
  Synthetic
tcattccaggacgtcttc

SEQ ID NO: 31212 - DNA, 18 bp, Artificial Sequence
  Synthetic
acaggaaccttgagctgg

SEQ ID NO: 31213 - DNA, 22 bp, Artificial Sequence
  Synthetic
cctgaggaatactatcaccatt

SEQ ID NO: 31214 - DNA, 19 bp, Artificial Sequence
  Synthetic
tgttgtctgcaatggtaac

SEQ ID NO: 31215 - DNA, 18 bp, Artificial Sequence
  Synthetic
acgtttcctgagcgtaga

SEQ ID NO: 31216 - DNA, 18 bp, Artificial Sequence
  Synthetic
accactcccggtacaaag

SEQ ID NO: 31217 - DNA, 19 bp, Artificial Sequence
  Synthetic
gcgacagtaaagctccagc

SEQ ID NO: 31218 - DNA, 18 bp, Artificial Sequence
  Synthetic
gccagaaaacccgtcgaa

SEQ ID NO: 31219 - DNA, 20 bp, Artificial Sequence
  Synthetic
agcactagtgtcaccctcat

SEQ ID NO: 31220 - DNA, 20 bp, Artificial Sequence
  Synthetic
cgacttagtggagcatgagg

SEQ ID NO: 31221 - DNA, 18 bp, Artificial Sequence
  Synthetic
gccaactgtagaggcgtg

SEQ ID NO: 31222 - DNA, 18 bp, Artificial Sequence
  Synthetic
gttgtcatggccctggtc

SEQ ID NO: 31223 - DNA, 16 bp, Artificial Sequence
  Synthetic
atcgatccgcccgtcg

SEQ ID NO: 31224 - DNA, 16 bp, Artificial Sequence
  Synthetic
gaccggggtgaaacgc

SEQ ID NO: 31225 - DNA, 16 bp, Artificial Sequence
  Synthetic
tgacagagcccaccgc

SEQ ID NO: 31226 - DNA, 19 bp, Artificial Sequence
  Synthetic
tcaaaactgggaccgatcg

SEQ ID NO: 31227 - DNA, 16 bp, Artificial Sequence
  Synthetic
gccggatccaggcaca

SEQ ID NO: 31228 - DNA, 20 bp, Artificial Sequence
  Synthetic
ggatctgattcgggtcacca

SEQ ID NO: 31229 - DNA, 16 bp, Artificial Sequence
  Synthetic
gcgccctgtgcctcat

SEQ ID NO: 31230 - DNA, 18 bp, Artificial Sequence
  Synthetic
ggcagccaaggtgtcaac

SEQ ID NO: 31231 - DNA, 20 bp, Artificial Sequence
  Synthetic
ccactttaccatgggcgatg

SEQ ID NO: 31232 - DNA, 19 bp, Artificial Sequence
  Synthetic
gaacgagtccaggggaaac

SEQ ID NO: 31233 - DNA, 16 bp, Artificial Sequence
  Synthetic
tggcggggtgtcatgg

SEQ ID NO: 31234 - DNA, 20 bp, Artificial Sequence
  Synthetic
ttcatgaagcgggtagcagc

SEQ ID NO: 31235 - DNA, 18 bp, Artificial Sequence
  Synthetic
ctgctgggtggtggaaag

SEQ ID NO: 31236 - DNA, 19 bp, Artificial Sequence
  Synthetic
ggcagggtagtccatggta

SEQ ID NO: 31237 - DNA, 18 bp, Artificial Sequence
  Synthetic
atcacagaggcaacactc

SEQ ID NO: 31238 - DNA, 20 bp, Artificial Sequence
  Synthetic
ccagaaagtttcaggtcatc

SEQ ID NO: 31239 - DNA, 18 bp, Artificial Sequence
  Synthetic
tatacgccccgatcttca

SEQ ID NO: 31240 - DNA, 18 bp, Artificial Sequence
  Synthetic
ctttgttgcctgacacac

SEQ ID NO: 31241 - DNA, 18 bp, Artificial Sequence
  Synthetic
tcatggtcactctccgtt

SEQ ID NO: 31242 - DNA, 19 bp, Artificial Sequence
  Synthetic
gaaagagtcctcatcggag

SEQ ID NO: 31243 - DNA, 20 bp, Artificial Sequence
  Synthetic
tcctcttttaagtgcggaaa

SEQ ID NO: 31244 - DNA, 20 bp, Artificial Sequence
  Synthetic
cgcatatcaatgtcgtttga

SEQ ID NO: 31245 - DNA, 21 bp, Artificial Sequence
  Synthetic
ggctttatgtacgtaccaaac

SEQ ID NO: 31246 - DNA, 20 bp, Artificial Sequence
  Synthetic
atatcgaattgagccgagta

SEQ ID NO: 31247 - DNA, 20 bp, Artificial Sequence
  Synthetic
attcggtaaatgcaaacgta

SEQ ID NO: 31248 - DNA, 19 bp, Artificial Sequence
  Synthetic
ggggggataaaaggcatat

SEQ ID NO: 31249 - DNA, 16 bp, Artificial Sequence
  Synthetic
cgtgcttccacccgtg

SEQ ID NO: 31250 - DNA, 17 bp, Artificial Sequence
  Synthetic
cggtgggaacgtcgcat

SEQ ID NO: 31251 - DNA, 16 bp, Artificial Sequence
  Synthetic
gccgcgatccagaacc

SEQ ID NO: 31252 - DNA, 20 bp, Artificial Sequence
  Synthetic
gagcaattgtaccacgtcct

SEQ ID NO: 31253 - DNA, 18 bp, Artificial Sequence
  Synthetic
ggatggttgtagctgtcc

SEQ ID NO: 31254 - DNA, 22 bp, Artificial Sequence
  Synthetic
tgcatttaaagttctaggtgat

SEQ ID NO: 31255 - DNA, 25 bp, Artificial Sequence
  Synthetic
cttttataaatttctcctactggga

SEQ ID NO: 31256 - DNA, 20 bp, Artificial Sequence
  Synthetic
gttacttggctcattgcttc

SEQ ID NO: 31257 - DNA, 23 bp, Artificial Sequence
  Synthetic
agatcctacatacaaatcatcca

SEQ ID NO: 31258 - DNA, 20 bp, Artificial Sequence
  Synthetic
ttagtgctttggttcctcta

SEQ ID NO: 31259 - DNA, 20 bp, Artificial Sequence
  Synthetic
aggggtattaacaaactccc

SEQ ID NO: 31260 - DNA, 19 bp, Artificial Sequence
  Synthetic
tgcatggcttctcctttta

SEQ ID NO: 31261 - DNA, 20 bp, Artificial Sequence
  Synthetic
gggattgtagggaattccaa

SEQ ID NO: 31262 - DNA, 18 bp, Artificial Sequence
  Synthetic
tatggagactccctgacc

SEQ ID NO: 31263 - DNA, 18 bp, Artificial Sequence
  Synthetic
ttcattgtgtggctccct

SEQ ID NO: 31264 - DNA, 18 bp, Artificial Sequence
  Synthetic
ggctccatttcttgctct

SEQ ID NO: 31265 - DNA, 24 bp, Artificial Sequence
  Synthetic
ccacatgttaaaattttctgtcac

SEQ ID NO: 31266 - DNA, 24 bp, Artificial Sequence
  Synthetic
gctgtactattatggttttagcat

SEQ ID NO: 31267 - DNA, 25 bp, Artificial Sequence
  Synthetic
ctactcctaatggttcaatttttac

SEQ ID NO: 31268 - DNA, 19 bp, Artificial Sequence
  Synthetic
atccccaggagctgttgat

SEQ ID NO: 31269 - DNA, 20 bp, Artificial Sequence
  Synthetic
aaggtacctgaggtgtgact

SEQ ID NO: 31270 - DNA, 18 bp, Artificial Sequence
  Synthetic
caggcaaaaagcagctgc

SEQ ID NO: 31271 - DNA, 16 bp, Artificial Sequence
  Synthetic
tggccgcgtccatcag

SEQ ID NO: 31272 - DNA, 17 bp, Artificial Sequence
  Synthetic
tcgactccacggagctg

SEQ ID NO: 31273 - DNA, 19 bp, Artificial Sequence
  Synthetic
ccagtttgggctcctgaag

SEQ ID NO: 31274 - DNA, 17 bp, Artificial Sequence
  Synthetic
gggagcgtgcgttcaat

SEQ ID NO: 31275 - DNA, 19 bp, Artificial Sequence
  Synthetic
cgacatcacgtacgtcctc

SEQ ID NO: 31276 - DNA, 17 bp, Artificial Sequence
  Synthetic
cgctttgtcgtcccgga

SEQ ID NO: 31277 - DNA, 17 bp, Artificial Sequence
  Synthetic
ccgggagtttccgttcg

SEQ ID NO: 31278 - DNA, 17 bp, Artificial Sequence
  Synthetic
acgaaggaggcgatcgc

SEQ ID NO: 31279 - DNA, 16 bp, Artificial Sequence
  Synthetic
agaaggcagcggacgc

SEQ ID NO: 31280 - DNA, 16 bp, Artificial Sequence
  Synthetic
agagctctgcggggtg

SEQ ID NO: 31281 - DNA, 18 bp, Artificial Sequence
  Synthetic
tcggagcttcccaccgag

SEQ ID NO: 31282 - DNA, 16 bp, Artificial Sequence
  Synthetic
tgggactcgatggccg

SEQ ID NO: 31283 - DNA, 19 bp, Artificial Sequence
  Synthetic
catagcagcgccatcttcc

SEQ ID NO: 31284 - DNA, 19 bp, Artificial Sequence
  Synthetic
tgttcgcctacgtgaaacc

SEQ ID NO: 31285 - DNA, 16 bp, Artificial Sequence
  Synthetic
cggtctccttcgcgga

SEQ ID NO: 31286 - DNA, 19 bp, Artificial Sequence
  Synthetic
gggatctaccgggacatcc

SEQ ID NO: 31287 - DNA, 17 bp, Artificial Sequence
  Synthetic
gcacgggtacaaccagc

SEQ ID NO: 31288 - DNA, 18 bp, Artificial Sequence
  Synthetic
cgtgaagaccatccggga

SEQ ID NO: 31289 - DNA, 17 bp, Artificial Sequence
  Synthetic
gccgaggtgtacaggga

SEQ ID NO: 31290 - DNA, 18 bp, Artificial Sequence
  Synthetic
cttggcccgtttcttcgg

SEQ ID NO: 31291 - DNA, 17 bp, Artificial Sequence
  Synthetic
tcggtcgatctcgggga

SEQ ID NO: 31292 - DNA, 16 bp, Artificial Sequence
  Synthetic
aacaccgcggcgtacc

SEQ ID NO: 31293 - DNA, 20 bp, Artificial Sequence
  Synthetic
acgcgagcagagtaaatgtc

SEQ ID NO: 31294 - DNA, 15 bp, Artificial Sequence
  Synthetic
agacaacgcgcgtgc

SEQ ID NO: 31295 - DNA, 16 bp, Artificial Sequence
  Synthetic
cctcccctcgcctgtt

SEQ ID NO: 31296 - DNA, 16 bp, Artificial Sequence
  Synthetic
agtgtagcggcccgtc

SEQ ID NO: 31297 - DNA, 16 bp, Artificial Sequence
  Synthetic
gcgcttcgatctcgcc

SEQ ID NO: 31298 - DNA, 18 bp, Artificial Sequence
  Synthetic
actcgggggtgatgaagc

SEQ ID NO: 31299 - DNA, 16 bp, Artificial Sequence
  Synthetic
cgaacgcaacgggagc

SEQ ID NO: 31300 - DNA, 19 bp, Artificial Sequence
  Synthetic
gctttttatggcgcccgag

SEQ ID NO: 31301 - DNA, 19 bp, Artificial Sequence
  Synthetic
gcgctacttcatcttcggc

SEQ ID NO: 31302 - DNA, 18 bp, Artificial Sequence
  Synthetic
tgttcgaccactccaccc

SEQ ID NO: 31303 - DNA, 16 bp, Artificial Sequence
  Synthetic
gcagttccacgcggtc

SEQ ID NO: 31304 - DNA, 17 bp, Artificial Sequence
  Synthetic
tcgtcgcactcgctgta

SEQ ID NO: 31305 - DNA, 19 bp, Artificial Sequence
  Synthetic
gcacatgagcttgtaggcc

SEQ ID NO: 31306 - DNA, 16 bp, Artificial Sequence
  Synthetic
cgcccctgtctggtct

SEQ ID NO: 31307 - DNA, 20 bp, Artificial Sequence
  Synthetic
agtgcagaatcacgttggtc

SEQ ID NO: 31308 - DNA, 16 bp, Artificial Sequence
  Synthetic
acacaggatccgccgc

SEQ ID NO: 31309 - DNA, 16 bp, Artificial Sequence
  Synthetic
atcacccgggcagtcg

SEQ ID NO: 31310 - DNA, 17 bp, Artificial Sequence
  Synthetic
agaacccccaggatgcg

SEQ ID NO: 31311 - DNA, 16 bp, Artificial Sequence
  Synthetic
acgtcgctgtgccagg

SEQ ID NO: 31312 - DNA, 17 bp, Artificial Sequence
  Synthetic
acctcggcgatgtgtgt

SEQ ID NO: 31313 - DNA, 19 bp, Artificial Sequence
  Synthetic
tgtagaagtaccgctcggg

SEQ ID NO: 31314 - DNA, 16 bp, Artificial Sequence
  Synthetic
tcaccaggtcgtccgc

SEQ ID NO: 31315 - DNA, 16 bp, Artificial Sequence
  Synthetic
tactcaccccgcccga

SEQ ID NO: 31316 - DNA, 16 bp, Artificial Sequence
  Synthetic
tggtgggtacggggga

SEQ ID NO: 31317 - DNA, 19 bp, Artificial Sequence
  Synthetic
ccaaaggtgtttttccgcc

SEQ ID NO: 31318 - DNA, 17 bp, Artificial Sequence
  Synthetic
acggcccattcggagtc

SEQ ID NO: 31319 - DNA, 19 bp, Artificial Sequence
  Synthetic
gtacgcgtcgtagctgaat

SEQ ID NO: 31320 - DNA, 17 bp, Artificial Sequence
  Synthetic
acggcctccacgaagtc

SEQ ID NO: 31321 - DNA, 17 bp, Artificial Sequence
  Synthetic
tcgtagcggcccagaac

SEQ ID NO: 31322 - DNA, 18 bp, Artificial Sequence
  Synthetic
cgacggtaaacagcgtgt

SEQ ID NO: 31323 - DNA, 16 bp, Artificial Sequence
  Synthetic
tatgcggccggcgtag

SEQ ID NO: 31324 - DNA, 16 bp, Artificial Sequence
  Synthetic
agggccacgaagcgga

SEQ ID NO: 31325 - DNA, 17 bp, Artificial Sequence
  Synthetic
caggaggcgcggactaa

SEQ ID NO: 31326 - DNA, 16 bp, Artificial Sequence
  Synthetic
ttgggcgacgtctgcg

SEQ ID NO: 31327 - DNA, 17 bp, Artificial Sequence
  Synthetic
cacaccacaccacacgg

SEQ ID NO: 31328 - DNA, 15 bp, Artificial Sequence
  Synthetic
acgtgtgcgccgtgt

SEQ ID NO: 31329 - DNA, 16 bp, Artificial Sequence
  Synthetic
tacggcgtggtggtgc

SEQ ID NO: 31330 - DNA, 16 bp, Artificial Sequence
  Synthetic
accccgacgtcttccg

SEQ ID NO: 31331 - DNA, 19 bp, Artificial Sequence
  Synthetic
ggctcggctgaatgtggta

SEQ ID NO: 31332 - DNA, 17 bp, Artificial Sequence
  Synthetic
ccaggcgatggtcaggt

SEQ ID NO: 31333 - DNA, 16 bp, Artificial Sequence
  Synthetic
aagggaagctgcgccg

SEQ ID NO: 31334 - DNA, 17 bp, Artificial Sequence
  Synthetic
acgtgcgatcggatccc

SEQ ID NO: 31335 - DNA, 19 bp, Artificial Sequence
  Synthetic
acctcacacacctcacctc

SEQ ID NO: 31336 - DNA, 18 bp, Artificial Sequence
  Synthetic
gcattctcaggtacctcc

SEQ ID NO: 31337 - DNA, 19 bp, Artificial Sequence
  Synthetic
ggtgtctgagaccctggac

SEQ ID NO: 31338 - DNA, 19 bp, Artificial Sequence
  Synthetic
gcacgttgtattccaggaa

SEQ ID NO: 31339 - DNA, 25 bp, Artificial Sequence
  Synthetic
ctaaagctaacatatgttcatcttg

SEQ ID NO: 31340 - DNA, 18 bp, Artificial Sequence
  Synthetic
tacacatgaagggcagga

SEQ ID NO: 31341 - DNA, 24 bp, Artificial Sequence
  Synthetic
tcaatggaaatctcatatccatct

SEQ ID NO: 31342 - DNA, 23 bp, Artificial Sequence
  Synthetic
catgtcaaatctcacatagtaca

SEQ ID NO: 31343 - DNA, 19 bp, Artificial Sequence
  Synthetic
gtaagctcctcgtcttcgc

SEQ ID NO: 31344 - DNA, 20 bp, Artificial Sequence
  Synthetic
aggtgtagtttgctcatagc

SEQ ID NO: 31345 - DNA, 17 bp, Artificial Sequence
  Synthetic
gcactgacggccgaaag

SEQ ID NO: 31346 - DNA, 20 bp, Artificial Sequence
  Synthetic
cttgctgatactgtctgcca

SEQ ID NO: 31347 - DNA, 20 bp, Artificial Sequence
  Synthetic
ctggaaaaaatgagcagcgg

SEQ ID NO: 31348 - DNA, 19 bp, Artificial Sequence
  Synthetic
ctggtcttcttcaccatcc

SEQ ID NO: 31349 - DNA, 24 bp, Artificial Sequence
  Synthetic
gaactgattagaggaaactttagg

SEQ ID NO: 31350 - DNA, 18 bp, Artificial Sequence
  Synthetic
cctttgcaggtttagcac

SEQ ID NO: 31351 - DNA, 22 bp, Artificial Sequence
  Synthetic
ggtagtcaggatatttgcagat

SEQ ID NO: 31352 - DNA, 20 bp, Artificial Sequence
  Synthetic
ccattgtgtgtatgtaagcc

SEQ ID NO: 31353 - DNA, 20 bp, Artificial Sequence
  Synthetic
tgactgagtgataccagttt

SEQ ID NO: 31354 - DNA, 20 bp, Artificial Sequence
  Synthetic
tggcagcaaccaaaaggttt

SEQ ID NO: 31355 - DNA, 23 bp, Artificial Sequence
  Synthetic
atttcttcagttaaaagttgctc

SEQ ID NO: 31356 - DNA, 18 bp, Artificial Sequence
  Synthetic
gcgctacctgttcagaaa

(The sequence listing continues in the following parts.)

What is claimed is:

1. A method of using a sequencing cell, the method comprising:
    applying a voltage across the sequencing cell, the sequencing cell including a nucleic acid, wherein the applied voltage includes an alternating signal having a first portion and a second portion relative to a reference voltage;
    acquiring, during the first portion of the alternating signal, a plurality of signal values from the sequencing cell, wherein during the first portion of the alternating signal a tag molecule is threaded in a nanopore of the sequencing cell, the tag molecule corresponding to a particular nucleotide, wherein the signal value varies over time;
    acquiring a plurality of correlated signal values that are correlated with respective values of the plurality of acquired signal values thereby forming a plurality of two-dimensional data points, wherein the plurality of two-dimensional data points comprise values in a first dimension that equal the plurality of acquired signal value and values in a second dimension that equal the plurality of correlated signal values, wherein the plurality of correlated signal values are a plurality of acquired signal values that are acquired during the second portion of the alternating signal, wherein during the second portion of the alternating signal, no tag molecule is threaded in the nanopore of the sequencing cell; and
    computing a plurality of transformed signal values by applying a two-dimensional transformation to the plurality of two-dimensional data points, wherein the two-dimensional transformation compensates for a variation of the acquired signal value.

2. The method of claim 1, wherein the plurality of correlated signal values are determined by computing a plurality of integrated histories of a plurality of acquired voltages.

3. The method of claim 1, wherein the two-dimensional transformation is a matrix multiplication.

4. A method of using a sequencing cell, the method comprising:
    applying a voltage across the sequencing cell, the sequencing cell including a nucleic acid, wherein the applied voltage includes an alternating signal having a first portion and a second portion relative to a reference voltage;
    acquiring, during the first portion of the alternating signal, a plurality of signal values from the sequencing cell, wherein during the first portion of the alternating signal a tag molecule is threaded in a nanopore of the sequencing cell, the tag molecule corresponding to a particular nucleotide, wherein the signal value varies over time;
    acquiring a plurality of correlated signal values that are correlated with respective values of the plurality of acquired signal values thereby forming a plurality of two-dimensional data points, wherein the plurality of two-dimensional data points comprise values in a first dimension that equal the plurality of acquired signal value and values in a second dimension that equal the plurality of correlated signal values;
    computing a plurality of transformed signal values by applying a two-dimensional transformation to the plurality of two-dimensional data points, wherein the two-dimensional transformation compensates for a variation of the acquired signal value;
    computing a normalization factor based on a histogram of the plurality of transformed signal values;
    normalizing the plurality of transformed signal values using the normalization factor to obtain a plurality of normalized signal values; and
    identifying one or more states of the nanopore based on the plurality of normalized signal values.

5. The method of claim 4, wherein the normalization factor is determined to be an acquired signal value having a largest amplitude peak in the histogram of the plurality of transformed signal values.

6. The method of claim 5, further comprising, normalizing at least one transformed signal value of the plurality of transformed signal values by dividing the at least one transformed signal value by the normalization factor.

7. A method of using a sequencing cell, the method comprising:
applying a voltage across the sequencing cell, the sequencing cell including a nucleic acid, wherein the applied voltage includes an alternating signal having a first portion and a second portion relative to a reference voltage;
acquiring, during the first portion of the alternating signal, a plurality of signal values from the sequencing cell, wherein during the first portion of the alternating signal a tag molecule is threaded in a nanopore of the sequencing cell, the tag molecule corresponding to a particular nucleotide, wherein the signal value varies over time;
acquiring a plurality of correlated signal values that are correlated with respective values of the plurality of acquired signal values thereby forming a plurality of two-dimensional data points, wherein the plurality of two-dimensional data points comprise values in a first dimension that equal the plurality of acquired signal value and values in a second dimension that equal the plurality of correlated signal values;
computing a plurality of transformed signal values by applying a two-dimensional transformation to the plurality of two-dimensional data points, wherein the two-dimensional transformation compensates for a variation of the acquired signal value; and
determining the two-dimensional transformation to be the transformation that reduces the variation of the plurality of signal values, wherein the two-dimensional transformation is applied to the plurality of two-dimensional data points and wherein the two-dimensional transformation compensates for the voltage offset shift of the cell.

8. A method of using a sequencing cell, the method comprising:
obtaining a plurality of measured signal values for a sequencing cell having a voltage applied across the sequencing cell, the cell including a nucleic acid, wherein the applied voltage includes an alternating signal having a first portion and a second portion relative to a reference voltage;
determining a first set of signal values measured during the first portion of the alternating signal;
creating a histogram from the first set of signal values;
determining a normalization factor by identifying a peak in the histogram, wherein the peak corresponds to an open channel signal value of the sequencing cell;
determining a second set of signal values measured during the first portion of the alternating signal; and
normalizing at least one value in the second set of signal values using the normalization factor to obtain at least one normalized signal value;
wherein identifying the peak in the histogram comprises choosing a second largest amplitude peak to be the peak that corresponds to the open channel signal value of the sequencing cell when a signal value of the second largest amplitude peak is within a range of signal values that define an open channel range and a signal value of the largest amplitude peak is outside the range of signal values.

9. The method of claim 8, wherein identifying the peak in the histogram comprises choosing a largest amplitude peak to be the peak that corresponds to the open channel signal value of the sequencing cell.

10. A method of using a sequencing cell, the method comprising:
obtaining a plurality of measured signal values for a sequencing cell having a voltage applied across the sequencing cell, the cell including a nucleic acid, wherein the applied voltage includes an alternating signal having a first portion and a second portion relative to a reference voltage;
determining a first set of signal values measured during the first portion of the alternating signal;
creating a histogram from the first set of signal values;
determining a normalization factor by identifying a peak in the histogram, wherein the peak corresponds to an open channel signal value of the sequencing cell;
determining a second set of signal values measured during the first portion of the alternating signal; and
normalizing at least one value in the second set of signal values using the normalization factor to obtain at least one normalized signal value;
wherein creating a histogram from the first set of signal values comprises, for each point of the first set of signal values, discounting a contribution of each point to the histogram based on an age of each point.

11. A method of using a sequencing cell, the method comprising:
obtaining a plurality of measured signal values for a sequencing cell having a voltage applied across the sequencing cell, the cell including a nucleic acid, wherein the applied voltage includes an alternating signal having a first portion and a second portion relative to a reference voltage;
determining a first set of signal values measured during the first portion of the alternating signal;
creating a histogram from the first set of signal values;
determining a normalization factor by identifying a peak in the histogram, wherein the peak corresponds to an open channel signal value of the sequencing cell;
determining a second set of signal values measured during the first portion of the alternating signal; and
normalizing at least one value in the second set of signal values using the normalization factor to obtain at least one normalized signal value;
before creating the histogram, obtaining a first set of correlated signal values that are correlated with the first set of signal values measured during the first portion of the alternating signal thereby forming a set of two-dimensional data points;
determining a set of transformed signal values based on the set of two-dimensional data points, wherein the transformed signal value is computed by applying a two-dimensional transformation to the set of two-dimensional data points; and
using the a set of transformed signal values to create the histogram.

12. A method of using a sequencing cell, the method comprising:
obtaining a plurality of measured signal values for a sequencing cell having a voltage applied across the sequencing cell, the cell including a nucleic acid, wherein the applied voltage includes an alternating signal having a first portion and a second portion relative to a reference voltage;
determining a first set of one or more signal values measured during the first portion of the alternating signal, when a tag molecule is threaded in a nanopore of the sequencing cell, the tag molecule corresponding to a particular nucleotide;

determining a second set of one or more signal values measured during the first portion of the alternating signal, when the tag molecule is not threaded in the nanopore of the sequencing cell;

determining a third set of one or more signal values measured during the second portion of the alternating signal when the tag molecule is not threaded in the nanopore of the sequencing cell;

subtracting, from the first set of one or more signal values, corresponding values of the third set of one or more signal values thereby generating a first set of one or more zero point compensated signal values; and subtracting, from the second set of one or more signal values, corresponding values of the third set of one or more signal values to generate a second set of one or more zero point compensated signal values.

13. The method of claim 12, further comprising:

determining corresponding correlated signal values that correspond to the first and second sets of one or more zero point compensated signal values, thereby forming a plurality of two-dimensional data points; and applying a two-dimensional transformation to reduce a variation of the first set of one or more zero point compensated signal values.

14. The method of claim 12, further comprising:

creating a histogram from the first and second sets of one or more zero point compensated signal values;

determining a normalization factor by identifying a peak in the histogram, wherein the peak corresponds to an open channel signal value of the sequencing cell; and normalizing the first set of one or more zero point compensated signal values by dividing by the normalization factor.

15. The method of claim 12, wherein at least one signal value of the second set of one or more zero point compensated signal values is determined to be a normalization factor for normalizing at least one signal value of the first set of one or more zero point compensated signal values.

* * * * *